(12) United States Patent
Apuya et al.

(10) Patent No.: US 8,088,975 B2
(45) Date of Patent: Jan. 3, 2012

(54) PHENYLPROPANOID RELATED REGULATORY PROTEIN-REGULATORY REGION ASSOCIATIONS

(75) Inventors: Nestor Apuya, Culver City, CA (US); Steven Craig Bobzin, Malibu, CA (US); Joon-Hyun Park, Oak Park, CA (US); Elena Doukhanina, Newbury Park, CA (US)

(73) Assignee: Ceres, Inc., Thousand Oaks, CA (US)

( * ) Notice: Subject to any disclaimer, the term of this patent is extended or adjusted under 35 U.S.C. 154(b) by 887 days.

(21) Appl. No.: 11/980,276

(22) Filed: Oct. 29, 2007

(65) Prior Publication Data

US 2009/0070899 A1 Mar. 12, 2009

Related U.S. Application Data

(60) Provisional application No. 60/854,825, filed on Oct. 27, 2006.

(51) Int. Cl.
*C12N 15/82* (2006.01)
*C12N 15/09* (2006.01)
*C12N 15/11* (2006.01)
*C12N 15/29* (2006.01)
*C12N 15/63* (2006.01)
*A01H 5/00* (2006.01)

(52) U.S. Cl. ........ 800/284; 800/278; 800/285; 800/287; 435/320.1; 435/468; 536/23.1; 536/23.2; 536/23.6; 536/24.5

(58) Field of Classification Search .................. None
See application file for complete search history.

(56) References Cited

U.S. PATENT DOCUMENTS

| | | | |
|---|---|---|---|
| 5,728,570 | A | 3/1998 | Matern et al. |
| 6,114,609 | A | 9/2000 | Beck et al. |
| 6,441,272 | B1 | 8/2002 | Ye |
| 6,610,908 | B1 | 8/2003 | Chapple |
| 6,831,208 | B1 | 12/2004 | Chiang et al. |
| 2006/0010516 | A1 | 1/2006 | Forster |

OTHER PUBLICATIONS

GenBank Accession No. AJ010324, dated Jan. 7, 2000.
GenBank Accession No. CAB65335, dated Jan. 7, 2000.
Anterola et al., "Trends in lignin modification: a comprehensive analysis of the effects of genetic manipulations/mutations on lignification and vascular integrity," *Phytochem.*, 2002, 61(3): 221-94.
Amthor, "Efficiency of lignin biosynthesis: a-quantitative analysis," *Annuals of Botany*, 2003, vol. 91, pp. 673-695.
Baucher et al., "Lignin: Genetic engineering and impact on pulping," *Critical Reviews in Biochemistry and Molecular Biology*, 2003, vol. 38, pp. 305-350.
Chinnusamy et al., "Screening for gene regulation mutants by bioluminescence imaging," *Sci STKE*, 2002, 2002(140): 1-10.
Demura et al, "Visualization by comprehensive microarray analysis of gene expression programs during transdifferentiation of mesophyll cells into xylem cells," *Proc Natl Acad Sci USA*, 2002, 99(24): 15794-15799.
Franke et al., "Changes in secondary metabolism and deposition of an unusual lignin in the ref8 mutant of *Arabidopsis*," *The Plant Journal*, 2002, 30(1): 47-59.
Franke et al., "Modified lignin in tobacco and poplar plants overexpressing the *Arabidopsis* gene encoding ferulate 5-hydroxylase," *The Plant Journal*, 2000, 200(3): 223-234.
Franke et al., "The *Arabidopsis REF8* gene encodes the 3-hydroxylase of phenylpropanoid metabolism," *The Plant Journal*, 2002, 30(1): 33-45.
Goicoechea et al., "EgMYB2, a new transcriptional activator from *Eucalyptus* xylem, regulates secondary cell wall formation and lignin biosynthesis," *The Plant Journal*, 2005, 43: 553-567.
Hasegawa et al, "A flexible representation of omic knowledge for thorough analysis of microarray data," *Plant Methods*, 2006, 2(5): 1-18.
Hatfield and Fukushima., "Can lignin be accurately measured?" *Crop Sci*, 2005, vol. 45:832-839.
Hellens et al., "Transient expression vectors for functional genomics, quantification of promoter activity and RNA silencing in plants," *Plant Methods*, 2005, 1(13): 1-14.
Hibino et al., "Increase of cinnamaldehyde groups in lignin of transgenic tobacco plants carrying an antisense gene for cinnamyl alcohol dehydrogenase," *Biosci. Biotech. Biochem.*, 1995, 59(5): 929-931.
Hu et al., "Repression of lignin biosynthesis promotes cellulose accumulation and growth in transgenic trees," *Nature Biotechnology*, 1999, vol. 17, pp. 808-812.
Humphreys and Chapple, "Rewriting the lignin roadmap," *Current Opinion in Plant Biology*, 2002, vol. 5, pp. 224-229.
Joh et al., "High-level transient expression of recombinant protein in lettuce," *Biotechnology and Bioengineering*, 2005, 91(7): 861-871.
Kubo et al., "Transcription switches for protoxylem and metaxylem vessel formation," *Genes & Dev.*, 2005, vol. 19, pp. 1855-1860.
Lapierre et al, "Structural alterations of lignins in transgenic poplars with depressed cinnamyl alcohol dehydrogenase or caffeic acid O-methyltransferase activity have an opposite impact on the efficiency of industrial kraft pulping," *Plant Physiology*, 1999, vol. 19, pp. 153-163.
Lee et al., "Antisense suppression of 4-coumarate:coenzyme a ligase activity in *Arabidopsis* leads to altered lignin subunit composition," *The Plant Cell*, 1997, vol. 9, pp. 1985-1998.
Li et al., "Combinatorial modification of multiple lignin traits in trees through multigene cotransformation," *Proc. Natl. Acad. Sci. USA*, 2003, 100(8): 4939-4944.
'Lignin structure: recent developments' [online]. Ralph, 1999, [retrieved on Mar. 23, 2009]. Retrieved from the Internet:<URL: http://www.dfrc.wisc.edu/DFRCWebPDFs/JR_Brazil99_Paper. pdf>, 16 pgs.

(Continued)

Primary Examiner — Brent T Page
(74) Attorney, Agent, or Firm — Fish & Richardson P.C.

(57) ABSTRACT

Materials and methods for identifying lignin regulatory region-regulatory protein associations are disclosed. Materials and methods for modulating lignin accumulation are also disclosed.

26 Claims, 267 Drawing Sheets

OTHER PUBLICATIONS

'The nature of lignin' [online]. McCrady, 1991, [retrieved on Mar. 23, 2009]. Retrieved on the Internet: <URL: http://palimpsest.stanford.edu/byorg/abbey/ap/ap04/ap04-4/ap04-402.html>, 3 pgs.

Moreel et al., "Phenolic Profiling of Caffeic Acid O-Methyltransferase-Deficient Poplar Reveals Novel Benzodiozane Oligolignols," *Plant Physiology*, Dec. 2004, vol. 136, pp. 4023-4036.

Oh et al., "Transcriptional regulation of secondary growth in *Arabidopsis thaliana*," *Journal of Experimental Botany*, 2003, 54(393): 2709-2722.

Ohashi-Ito et al., "Class III homeodomain leucine-zipper proteins regulate xylem cell differentiation," *Plant Cell Physiol.*, 2005, 46(10): 1646-1656.

Patzlaff et al., "Characterisation of a pine MYB that regulates lignification," *The Plant Journal*, 2003, vol. 36, pp. 743-754.

Reddy et al., "Targeted down-regulation of cytochrome P450 enzymes for forage quality improvement in alfalfa (*Medicago sativa* L.)," *Proc. Natl. Acad. Sci.*, USA, 2005, 102(46): 16573-16578.

Reinhart et al., "MicroRNAs in plants," *Genes & Development*, 2002, vol. 16, pp. 1616-1626.

Sato et al., "Isolation and characterization of a novel peroxidase gene ZPO-C whose expression and function are closely associated with lignification during tracheary element differentiation," *Plant Cell Physiol.*, 2006, 47(4): 493-503.

Sawa et al., "DRP1A is responsible for vascular continuity synergistically working with VAN3 in *Arabidopsis*," *Plant Physiol.*, 2005, 138(2): 819-826.

Sawa et al., "The ATE genes are responsible for repression of transdifferentiation into xylem cells in *Arabidopsis*," *Plant Physiol*, 2005, 137(1): 141-148.

Sewalt et al., Reduced Lignin Content and Altered Lignin Composition in Transgenic Tobacco Down-Regulated in Expression of $_L$-phenylalanine Ammonia-Lyase or Cinnamate 4-Hydroxylase[1] *Plant Physiol.*, 1997, 115: 41-50.

Somleva et al., "*Agrobacterium*-mediated genetic transformation of swtichgrass," *Crop.Sci*, 2002, vol. 42, pp. 2080-2087.

Tuskan et al, "The Genome of Black Cottonwood, *Populus trichocarpa* (Torr. & Gray)," *Science*, Sep. 2006, vol. 313, pp. 1596-1604.

Wroblewski et al., "Optimization of *Agrobacterium*-mediated transient assays of gene expression in lettuce, tomato and *Arabidopsis*," *Plant Biotechnology Journal*, 2005, vol. 3, pp. 259-273.

Yan et al., "New construct approaches for efficient gene silencing in plants," *Plant Physiology*, 2006, vol. 144, pp. 1508-1518.

Ye et al., "Caffeoyl coenzyme A O-methyltransferase and lignin biosynthesis," *Phytochemistry*, 2001, 57(7): 1177-1185.

Ye et al., "Important new players in secondary wall synthesis," *Trends Plant Sci.*, 2006, 11(4): 162-164.

Ye and Varner, "Differential expression of two O-methyltransferases in lignin biosynthesis in *Zinnia elegans*," *Plant Physiol.*, 1995, 108(2): 459-467.

Zhong et al., "Dual methylation pathways in lignin biosynthesis," *The Plant Cell*, vol. 10, pp. 2033-2045.

Zhong et al., "Mutation of SAC1, an *Arabidopsis* SAC Domain Phosphoninositide Phosphatase, Causes alterations in cell morphogenesis, cell wall synthesis, and actin organization," *The Plant Cell*, 2005, 17: 1449-1466.

Zhong et al., "Fragile Fiber3, and *Arabidopsis* gene encoding a type II inositol polyphosphate 5-phosphatase, Is required for secondary wall synthesis, and actin organization in fiber cells," *The Plant Cell*, 2004, 16: 3242-3259.

Zhong et al., "Essential role of caffeoyl coenzyme A O-methyltransferase in lignin biosynthesis in woody poplar plants," *Plant Physiol.*, 2002, 124(2): 563-578.

Zhong et al., "Ectopic deposition of lignin in the pith of stems of two *Arabidopsis* mutants," *Plant Physiol*. 2000, 123(1):59-70.

Zhong and Ye, "Molecular and biochemical characterization of three WD-repeat-domain-containing inositol polyphosphate 5-phosphatase in *Arabidopsis thaliana*," *Plant Cell Physiol*, 2004, 45(11):1720-1728.

Burk et al., "A katanin-like protein regulates normal cell wall biosynthesis and cell elongation," *The Plant Cell*, 2001, 13: 807-827.

Ye and Varner, "Tissue-specific expression of cell wall proteins in developing soybean tissues," *The Plant Cell*, 1991, 3: 23-37.

Zhong et al., "Mutation of a chitinase-like gene causes ectopic deposition of lignin, aberrant cell shapes, and overproduction of ethylene," *The Plant Cell*, 2002, 14: 165-179.

Zhong and Ye, "*IFL1*, a gene regulating interfascicular fiber differentiation in *Arabidopsis*, encodes a homeodomain-leucine zipper protein," *The Plant Cell*, 1999, 11: 2139-2152.

Figure 1

```
                                                                              50
Lead-Annot-ID-541887   MV MRK L QL PL  SQT QKV RF E R  AT E R L QSLS S  SA N S D ASV L V  T D SI PVNHDD
CeresAnnot:1448288     -- MRG L EI SL   NQT QKI RLQR   ALK Q LESL I Y L  RA N F NASVTV     ADTI PVSNED   48
CeresClone:644583      -- MRDL H L PL   NQT QRV RLEA   ALHELQTLAP        AAA S AAVTV       AD N PVNHED   48
gi|50926522            -- MRDL QL SL    NQT QRV RLEA   ALHELQTVAP        A - - A AVTV      ADTI PVND E D  44
CeresClone:1791381     -- MRDL A L SL   NQT QRV RLEA   A F HELQSLAP      AAA S AAVTV       ADTI PVNQ E D  48

100
Lead-Annot-ID-541887   AF L KGHGT SE    V D GELLATVC   GVVERVDKLV        YVRTLRARYK        PEVGDI VVGR
CeresAnnot:1448288     T L LKGHGT SE    RDGEVVATLC    GVVERVNKLV        YVRTLRARYK        PEI GDI I VGR  98
CeresClone:644583      NI LKGHGT I TD   QDGEVVATLC    GVVERVNKLV        YVRTLRARYK        PEVGDI I VGR   98
gi|50926522            NI LKGHGT SD     QDGEVVATLC    GVVERVNKLV        YVRTLRARYK        PEVGDI I VGR   94
CeresClone:1791381     NI LKGHGT SD     QDGEVVATLC    GVVERVNKLV        YVRTLRARYK        PEVGDI I VGR   98

150
Lead-Annot-ID-541887   VI EVAQ K RWR    V ELNFNQDG V   L ML SSMNMPD      GI QRRRT SVD      ELNMRNI F V E
CeresAnnot:1448288     VVEVAQ K RWK     LEI NFSQDAV   L ML SSMNL PD     GL QRRRT ALD      ELNMRSI FEE    148
CeresClone:644583      VI EI APKRWR     LEI NFSQDAV   L ML SSMNL PD     GI QRRRT AVD      ELNMRSI FEE    148
gi|50926522            VI EI APKRWR     LEI NFSQDAV   L ML SSMNL PD     GI QRRRT AVD      ELNMRTI FEE    144
CeresClone:1791381     I EI APKRWR      LEI NFSQDAV   L ML SSMNL PD     GI QRRRT AVD      ELNMRSI FEE    148

200
Lead-Annot-ID-541887   HDVVCAEVRN      F QHDGSL Q L Q  ARSQKYGKLE       KGQLLK V D PY      LVKR S K HFH
CeresAnnot:1448288     NDVVC C EVRN    F QNDG G Q L Q  ARSQKYGKLE       KGQLLTI PPY       LVKRQK HFH     198
CeresClone:644583      NDVVCAEVRG      F QHDGSLHLQ    ARSQKYGKLQ       RGQLLTVPA Y        LVKRKLHFH     198
gi|50926522            NDVI CAEVRG     F QHDGSLHLQ    ARSQKYGKLE       RGQLL T V PA Y     LVKRRKQHFH    194
CeresClone:1791381     NDVI CAEVRG     F QHDGSLHLQ    ARSEKYGKLE       RGQLLTVPPY        LVKRRQHFH      198
```

Figure 1 (continued)

| | | | | | |
|---|---|---|---|---|---|
| Lead-Annot-ID-541887 | YVESLGIDLI | GCNGFIWVG | EHVEVRDPMA | IDDQKDEEMI | SSSSTGKEQS | 250 |
| CeresAnnot:1448288 | HLEQYGVDLI | LGCNGFIWVG | EHVEARDCIV | EDQLNNTEQQ | FTKS---NTTK | 246 |
| CeresClone:644583 | HLEQYDVDLI | LGCNGFIWVG | EHVVVRE--- | IADLKEDEQK | LSAE---AET | 242 |
| gi|50926522 | HLEQYDVDLI | LGCNGFIWVG | EHVVVGE--- | NANMMENKLN | LSAE---VEN | 238 |
| CeresClone:1791381 | HLAQYDVDLI | LGCNGFIWVG | QHVVVGE--- | KTKTTEDQQK | SSAD---AEN | 242 |

| | | | | | |
|---|---|---|---|---|---|
| Lead-Annot-ID-541887 | HIPLETRQTI | CRIGNAIRVL | SNLGFTVTLE | VIMETVNLSN | SKNIDIHDML | 300 |
| CeresAnnot:1448288 | EMPLETRRSI | CQIANAIRVL | SLLGFNVTLE | VILETLDLSS | TLNLGDEML | 296 |
| CeresClone:644583 | FTPIETRRHI | CRLANAARLL | SALGFTLTVE | LIQTAEASV | SSNVEINDML | 292 |
| gi|50926522 | FTPLETRKHI | CRLANAVRVL | SALGFTLTVE | LIETAEASV | SSNIEINNML | 288 |
| CeresClone:1791381 | FTPLETRKHI | CQLANAVRVL | SALGFTLTVE | LIETAEASV | TSNVEVNNML | 292 |

| | | | |
|---|---|---|---|
| Lead-Annot-ID-541887 | GSEFHVVAE | NEAERRR--T | KRKK--- | 322 |
| CeresAnnot:1448288 | GPEFHVLVAE | REAERRTSMT | KRKG--- | 320 |
| CeresClone:644583 | GAEFYVQTAE | GEAKRRGDLL | GKKR--- | 316 |
| gi|50926522 | GAEFYVQTAE | REVKRRADLL | RKKSGAR | 315 |
| CeresClone:1791381 | GAEFYVQTAE | REAKRRADLL | RKKNGGR | 319 |

Figure 2

| | | | | | | |
|---|---|---|---|---|---|---|
| CeresClone:1540519 | MRKPTR | RRGT | SAKGSSGGGI | SKAATLPA--- | ------ | ---LS- | 34 |
| CeresClone:1051305 | ------ | MRTRRGA | CYSGVV | SRMC | SDARV | SKK--- | ---LH | MHMHMHMH | 39 |
| Lead-Annot-ID-548715 | -ML | PSRK | TKR | VFS | ---- | CDFTPGRK- | ---VV- | ------ | 26 |
| CeresAnnot:1447956 | ------ | MRTRRGL | SY | PRGA | AVNA | CDTAAGKR | TTSYKRER | PD-FA- | 39 |
| CeresClone:1923054 | ------ | MRTRRGL | CYPR | ----- | ADVCV | DKL | VV----- | ---FA- | 27 |
| CeresClone:1746793 | ------ | MRTRSGS | LYS | ----- | NNG | GEAAVGQK- | ---KRR | T-AS- | 27 |
| gi|50923813 | ------ | MRTRRGA | CYSP | ----- | ---- | ASCQDGR | R---RKR | T-A- | 25 |
| CeresClone:843382 | ------ | MKTRRGA | CYSCHE | SAAA | EAPEM | HRR---- | ---KRRR | -TA- | 31 |

| | | | | | | |
|---|---|---|---|---|---|---|
| CeresClone:1540519 | ---GY- | ---RG | TV---- | ----D | AFDC | LPDDLV | LAVLAG | AAR | 61 |
| CeresClone:1051305 | VPA | GD | ---SI | YSRKRQKKT | PEKTAGA | DYE | FFESLPDDLV | SI | FCKLSST | 86 |
| Lead-Annot-ID-548715 | ---- | ---- | ---VPSSVSPV | PENTTGAD- | LDSIPDDLV | SI | LCKLGST | 62 |
| CeresAnnot:1447956 | ---A | GD | ---YL | VCRKKNRL | IS | TQKTGETD- | LFDSIPDDLV | SILSKLSSS | 82 |
| CeresClone:1923054 | ---GY | ---NM | AC-RKRQRF | S | PVIAGNSD- | LFDALPDDLV | SILSKLSSS | 68 |
| CeresClone:1746793 | PMGQSAVAG | ECAGGGR | RKR | LARCP | ---D | YLDVLPDDLV | LSILADVAAS | 72 |
| gi|50923813 | ---GGG | ----EG | SAAAAAVAG | GAEGPAND- | MFEELPDDLV | VSILADVAAS | 69 |
| CeresClone:843382 | ------ | ---- | ----MEA | AGCAAVGD- | MFEDLPDDLL | VSILADVAAS | 62 |

| | | | | | | |
|---|---|---|---|---|---|---|
| CeresClone:1540519 | ARCPADL | AAA | AL | PCRRF | RDL | AAHPA | VLSRA | SAAA | AVAV | PAG | RWSDAAHRFL | 111 |
| CeresClone:1051305 | ATKPSDF | VNI | LI | TCKRL | NRL | ALHS | LVLSKA | SPKT | ET | KAR | DWCDSAHKFL | 136 |
| Lead-Annot-ID-548715 | SRCPADF | INV | LL | TCKRL | KGL | AMNPI | VLSRL | SPKAI | AVKAH | NWSE | YSHRFL | 112 |
| CeresAnnot:1447956 | ASCPSDF | INV | LL | TCKRL | NGL | GLHSL | VLSKA | SPKT | FAVKAK | NWSDSAHRFL | 132 |
| CeresClone:1923054 | ASCPSDF | INV | LI | TCKRL | NSF | ALQPL | VLSKA | SSKL | FAI | KAE | NWSESAHRFL | 118 |
| CeresClone:1746793 | ASAPSDL | VSV | HL | TCKKL | NEL | GGHDMV | FAKA | SPAS | LAVKAA | AWSEPAQRFL | 122 |
| gi|50923813 | ARSPGDL | AGA | ML | TCKRF | REL | GQSKV | VLARA | SPRC | LAVRAK | AWSDAAHRFL | 119 |
| CeresClone:843382 | ARSPADL | AGA | MT | CKRF | REL | GQSKV | VLAKV | SPRC | LAVRAK | SWSDSAHRFL | 112 |

Figure 2 (continued)

| | | | | | | |
|---|---|---|---|---|---|---|
| CeresClone:1540519 | RRCAASGNLH | ACYLLGMVLF | YCIGGRATCA | ALLARSAALGG | HAAALYALAV | 161 |
| CeresClone:1051305 | KHCADAGNVE | ACYTLGMIRF | YCLQNRGSGA | SFMAKAAINS | HARALYALAV | 186 |
| Lead-Annot:ID-548715 | KRCVDAGSLE | ACYTLGMIRF | YCLQNRGNGA | SLMAKAAISS | HAPALYSLAV | 162 |
| CeresAnnot:1447956 | KLFADAGNVE | ACYTLGMIRF | YCLQNRGSGA | SLMAKAAISS | YAPALYSLAV | 182 |
| CeresClone:1923054 | KCCADAGNVE | ACYTLGMIRF | YCLQNRGSGA | SLMAKAAISS | HAPALYSLAV | 168 |
| CeresClone:1746793 | KRCADAGNLE | ACYLLGMIRF | YCLGSRSSGA | ALLARAAVGA | HAAALYSLAV | 172 |
| gi|50923813 | QRCADAGNLE | ACYLLGMIRF | YCLGSRCSGA | ALMAAAAVGG | HREALYSLAV | 169 |
| CeresClone:843382 | QGCADAGNLD | ACYLLGMIRF | YCLGSRGSGA | ALMAAAAVGG | HREALYSLAV | 162 |

| | | | | | | |
|---|---|---|---|---|---|---|
| CeresClone:1540519 | VQFNGSGGDK | ADKDPRAGVA | LCARAAWLGH | VPALRELGHC | LQDGYGARRA | 211 |
| CeresClone:1051305 | QFNGSGGTK | SDKDLRAGVA | LCARAAFLGH | VDAMRELGHC | LQDGYGVRQN | 236 |
| Lead-Annot:ID-548715 | QFNGSGGSK | NDKDLRAGVA | LCARAAFLGH | VDALRELGHC | LQDGYGVRQN | 212 |
| CeresAnnot:1447956 | QFNGSGGSK | SDKDLRAGVA | LCARAAFLGH | DALRELGHC | LQDGYGVRQN | 232 |
| CeresClone:1923054 | QFNGSGGAK | NDKDLRAGVA | LCARAAALGH | DALRELGHC | LQDGYGVRQN | 218 |
| CeresClone:1746793 | QFNGSGGSK | SDRDLRAGAA | LCARAASLGH | VDALRELGHC | LQDGYGVRRD | 222 |
| gi|50923813 | QFNGSGGSK | DDRDLRAGAA | LCARAASLGH | VDALRELGHC | LQDGYGVRRS | 219 |
| CeresClone:843382 | QFNGSGGSK | DDRDLRAGAA | LCARAASLGH | VDALRELGHC | LQDGYGVRRS | 212 |

| | | | | | | |
|---|---|---|---|---|---|---|
| CeresClone:1540519 | AATGRYFLLH | AAARELVSSH | C--------- | R-------- | ---LQPQQLR | 232 |
| CeresClone:1051305 | AEGRRFLVQ | ANARELAAVL | S--------- | R-TWLSWN- | PPPVVPNHGQ | 276 |
| Lead-Annot:ID-548715 | VSEGRRFLVQ | ANARELAAVL | S-------TGAAA | RSTWLSLSQP | -PHAHPNHRH | 258 |
| CeresAnnot:1447956 | VTEGRRFLVQ | ANARELAAVL | S-KHNSGFPT | R-TWFSWN- | HPIPHPTNRH | 277 |
| CeresClone:1923054 | LTEGRRFLVQ | ANARELAAGL | SSASVSNLAT | C-SWLTWS-P | HPFAAALPLG | 266 |
| CeresClone:1746793 | PAEGRRLLVA | ANARELTLAL | A----AAAS | R-------- | ---RAATGKPA | 259 |
| gi|50923813 | VLDGRRLLIQ | ANARELAAAV | A----ASASL | L-------- | ---RAAAGSGK | 254 |
| CeresClone:843382 | LLDGRRLLIQ | ANARELAAAV | T----TSASL | L-------- | ---RAAAGSGK | 247 |

Figure 2 (continued)

| | | | | | | |
|---|---|---|---|---|---|---|
| CeresClone:1540519 | ----- | ----- | ----- | ----- | LP-- | 251 |
| CeresClone:1051305 | QG---- | -SGCP- | LLSDFGCNVP | AP---- | EDDA ASRFMAEWWA | 310 |
| Lead-Annot-ID:548715 | QT---- | --CP-- | LLSDFGCNVP | AP---- | EVHP ASLFMAEWFA | 290 |
| CeresAnnot:1447956 | PT GNGPSGCP | LLSDFGCNVP | AP---- | ETHP ANRFLADWFA | AR-- | 315 |
| CeresClone:1923054 | PN---VPGCP | LLSDFGCNVP | AP---- | ESHP ASRFMTEWFA | VR-- | 301 |
| CeresClone:1746793 | AAVEGSGCP | LLSDFGCNVP | AP---- | EAHP ANKFLTDWFG | IR-- | 300 |
| gi|50923813 | AA ASRRHSC--- | LLSDFGWSLP | EA---- | -DPHA ANQFMVDWWA | SR-- | 303 |
| CeresClone:843382 | AS--RRHSC--- | LLSDFGCHAA | APKAGGEAHA | ANRFLVDWFA | SRGA-----Q | 288 |
| | | LLSDFGCRAA | AA-AAGEAHA | ANRFLVEWFA | SRPLAGSTAA | |
| | | | | | LRPL----G | |

| | | | | | | |
|---|---|---|---|---|---|---|
| CeresClone:1540519 | ---SKTGAQGD | GNDADADARL | CSHPRCGRRE | TRRHEFRQCS | ACGSALYCSR | 299 |
| CeresClone:1051305 | ----------G | G-SPGPGLRL | CSHAGCCRPE | TRKHEFRRCS | VCGVVNYCSR | 350 |
| Lead-Annot-ID:548715 | ----------G | GDCPGDGLRL | CSHAGCCRPE | TRKHEFRRCS | VCGVVNYCSR | 331 |
| CeresAnnot:1447956 | ----------G | GF-SSGSGLRL | CSHTGCCGRRE | TRRHEFRRCS | VCGAVNYCSR | 355 |
| CeresClone:1923054 | ----------D | G-IPGPGLRL | CSHVRCGRRE | TRRHEFRRCS | VCGAVNYCSR | 341 |
| CeresClone:1746793 | AAAAKKPATG | GDGDGAELRL | CSHALCGRPE | TRRHEFRRCS | VCGAANYCSR | 350 |
| gi|50923813 | AAAAPTPGSA | AEDEAAGLRL | CSHALCGRPE | TRRHEFRRCS | VCGVVNYCSR | 353 |
| CeresClone:843382 | AESSPAPAPA | PAEEGGGLRL | CSHALCGRPE | TRRHEFRRCS | VCGVVNYCSR | 338 |

| | | | | | | |
|---|---|---|---|---|---|---|
| CeresClone:1540519 | ACQALHWKRA | HRSQCAAAAS | RWL-AAGNAQ | -------- | --EVEVMVDS- | 328 |
| CeresClone:1051305 | ACQALDWKFR | HKAECSPVQ- | RWLEEDGEDV | -GNDDGDG-- | -GNDDVLLPMS | 394 |
| Lead-Annot-ID:548715 | ACQALDWKLR | HKMDCAPVQ- | RWLEEGDGG | EGNVQIDGNG | NGDNVLLPMS | 379 |
| CeresAnnot:1447956 | ACQALDWKLR | HKEGCAPVE- | RWVDEDGEGG | ADGDDGGVDG | DDDDVMES-- | 403 |
| CeresClone:1923054 | ACQALDWKLR | HKAECAPVE- | RWLDEEGVGG | -DG------ | -MDEVIAES- | 380 |
| CeresClone:1746793 | ACQALDWKFRA | HRAQCVPMD- | RWL-AANAGE | -AAPQ----- | --------- | 382 |
| gi|50923813 | ACQALHWKTA | HKAECTPMD- | RWLDNAAAGA | -ANPNA---- | -AAMAAPAP | 395 |
| CeresClone:843382 | ACQALHWKMA | HKAECTPMD- | RWL--DGANA | NPNPNAVAGA | GDAAVAAPAL | 385 |

Figure 3

| | | | | | |
|---|---|---|---|---|---|
| gi\|5678521 6 | | | | A E E A K N L E T A | R A D R S V W L M K | C P T V V S R A W Q | E A A T A A A S S S | 41 |
| CeresClone:704938 | | | | G D E A K Y L E T A | R A D R S V W L M K | C P P V V S Q A W Q | G A S S S S I — — — | 37 |
| CeresClone:281395 | | | | A E E A K Y L E T A | R A D R S V W L M K | C P P V V S R A W Q | A A S A S A S S — — | 40 |
| CeresClone:1784166 | M | | | G E E A K Y L E T A | R A D R S V W L M K | C P P V V S R A W Q | A A S A S A S S S — | 39 |
| Lead-Annot:ID:549656 | M | | | M E D I H N L D L E | K S D R S I W L M K | C P V V V D K A W H | K I A A S S S S S F | 40 |
| CeresClone:463643 | M | | — — M D E E N G Y S | G S I S S N L E T T | K A E R S V W L M K | C P L V V A K S W Q | — — — — — — — — | 38 |
| CeresAnnot:1442640 | M | | M E E D H S N G G N | S S S S G N L E T S | K A D K A V W L M K | C P V V V A K S W K | S H H T — — — — — | 44 |

| | | | | | |
|---|---|---|---|---|---|
| gi\|5678521 6 | | | S N S N A N P N P V | V A K V I V S L D P | L R S — — — — — — | — E D Q Q L Q F K M | 83 |
| CeresClone:704938 | | | — — G D A N P N P V | V A K V V L S L D P | L S S — — — — — — | — A E P S L Q F K M | 67 |
| CeresClone:281395 | | | — D A A N A N P N V | V A K V V L S L D L | L R P E E R P E E R | P E E P T L Q F K M | 78 |
| CeresClone:1784166 | | | — D A A N P N P V | V A K V V L S L D L | P S G E E — — — — | Q Q E P S L Q F K M | 72 |
| Lead-Annot:ID:549656 | | | — A S S D S P P D | M A K I V R E V D P | L R — — — — — — — | — D D S P P E F K M | 69 |
| CeresClone:463643 | SSSDAAAGAN | | — T H P P S Q P I — | L A K V V L S L D P | L H P E E — — — — | — D D P S A V Q F T M | 70 |
| CeresAnnot:1442640 | | | — — S S S D S A P I — | L A K V V L S L D P | L Q S — — — — — — | — D D P S A I Q F T M | 74 |

| | | | | | |
|---|---|---|---|---|---|
| gi\|5678521 6 | E M A Q T — — — G N | G N T P K S Y S L N | M F K D F V P M C V | F S E S N Q — G K L | S C E G K V G H K F | 129 |
| CeresClone:704938 | E M S Q T S V A S T | C N L P K S Y S L N | M F K D F V P M C V | F S E T N Q — G K L | S C E G K V E H K F | 116 |
| CeresClone:281395 | E L A Q T — — — N T | G N T P K S Y S L N | M F K D F V P M C V | F S E S N Q — G K L | S C E G K V E H K F | 124 |
| CeresClone:1784166 | E L A Q T — — — N T | G N T P K S Y S L N | M F Q D F V P M C V | F S E S N Q — G K L | A C E G K V E H K F | 118 |
| Lead-Annot:ID:549656 | Y M V G A — — — — | G N M P K C Y A L N | M F T D F V P M G G | F S D V N Q — G C A | A A E G K V D H K F | 115 |
| CeresClone:463643 | E M A G T — — — — | V N M S K T Y S L N | M F K D F V P M C V | F S E T S Q G G K V | A M E G K V E H K F | 117 |
| CeresAnnot:1442640 | E M A R T — — — E T | G N V P K S Y S L N | M F K D F V P M G M | F S E T P Q — G R V | S M E G K V E H K F | 120 |

| | | | | | |
|---|---|---|---|---|---|
| gi\|5678521 6 | D M E P H S D N L V | N Y G K L C R E R T | Q K S M I K N R K L | M V L A N D N G M S | M R P L P G L V G L | 179 |
| CeresClone:704938 | D M E P H K D N L L | N Y A K L C R E R T | Q K S M V K T R K V | Q V L D N D H G M S | M R P M P G M V G L | 166 |
| CeresClone:281395 | D M E P H S D N L A | N Y G K L C R E R T | Q K Y M V K S R Q V | Q V L D N D H G M S | M R P M P G L V G L | 174 |
| CeresClone:1784166 | D M E P H S D N L V | N Y G K L C R E R T | Q K M M V K S R Q V | Q V L D N D H G M S | M R P M P G M V G L | 168 |
| Lead-Annot:ID:549656 | D M K P Y G E D L E | E Y A R L C R E R T | S K A M V K N R Q I | Q V I D N D R G V H | M R P M P G M L G L | 165 |
| CeresClone:463643 | D M K P H G E N I E | E Y G K L C R E R T | N K S M I K N R Q I | Q V I D N D R G V L | M R P M P G M I G L | 167 |
| CeresAnnot:1442640 | D M K P H E E N I E | E Y S K L C R D R T | K K S M I K N R Q I | R V I D N D R G V H | M R P M P G M V G L | 170 |

Figure 3 (continued)

| | | | | | | | |
|---|---|---|---|---|---|---|---|
| gi\|56785216 | MSSCPKQKEK-K | KPLPVKPSDM | KRTRRDRREL | ENILFKLFER | QPNWSLKNLM | 229 |
| CeresClone:704938 | SSSSKEK-R | KPTPTKPSDV | KRTRRDRREL | ENIIFKLFEK | QPNWALKALV | 215 |
| CeresClone:281395 | PSGSKEK-K | KQAPAKPSDV | KRTRRDRDTEM | ENIIFKLFER | QPNWALKALV | 223 |
| CeresClone:1784166 | PSGSKEK-K | KQTPAKPSDV | KRTRRDRTEM | ENIIFKLFER | QPNWALKALV | 217 |
| Lead-Annot-ID:549656 | VSSNSKEK-R | KPPPVKQTEV | KRTRRDRGEL | EDIAMFKLFEG | QPNWTLKQLV | 214 |
| CeresClone:463643 | VSSNSKDK-K | KTQPVKQSDT | KRTRRDRGEL | EDIMFKLFER | QPNWALKQLV | 216 |
| CeresAnnot:1442640 | SSTSKDK-K | KTQPVKQSDV | KRTRRDRGEL | EDIMFKLFER | QPNWALKQLV | 219 |

| | | | | | | | |
|---|---|---|---|---|---|---|---|
| gi\|56785216 | QETDQPEQFL | KEILNDLCEY | NKRGPNQGTH | ELKPEYKKST | E--DADATAT | 277 |
| CeresClone:704938 | QETDQPEQFL | KEILNDLCMY | NKRGPNQGTH | ELKPEYKKSS | E--DAAGAAP | 263 |
| CeresClone:281395 | QETDQPEQFL | KEILNDLCVY | NKRGPNQGTH | ELKPEYKKST | G--DTDAA-- | 269 |
| CeresClone:1784166 | QETDQPEQFL | KEILNDLCVY | NKRGPNQGTH | ELKPEYKKST | G--DTDAA-- | 263 |
| Lead-Annot-ID:549656 | QETDQPAQFL | KEILNELCVY | NKRGSNQGTY | ELKPEYKKSA | EDDTGGQ--- | 261 |
| CeresClone:463643 | QETDQPAQFL | KEILNELCVY | NKRGANQGTY | ELKPEYKKSV | E--DTSAE-- | 262 |
| CeresAnnot:1442640 | QETDQPAQFL | KEILNELCVY | NKRGTNQGTY | ELKPEYKKTA | E--DTGAD-- | 265 |

Figure 4

```
gi|76446335        MGLASMPSAS EGMLCLILMN TAMPSIVKG  ERSILKVVG  FQLAESSTP   50
gi|37901055        MCLSNLPASS EGVICVVVMN TALSISIVKG VRSVLHIVD  NRLAPFSSSS  50
Lead-Annot-ID:550729  MGLSSLPGPS EGMLCVILVN TALSISIVKG VRSFIGVG   SLSPSSSSP  50
gi|20340241        MGLSSLPGPS EGVLCVILVN TALSISIVKG VRSVLHVLG  RLSQSSSSP   50
CeresClone:473509  MGLSSLPAPS EGVLCILLVN TVLSISIVKG VRTILHIVG  HLSSSSSTS   50
CeresClone:1922929 MGLSSLPAPS EGVLCLLVN  TALSISIVKG IRSILHVVG  HLPP        46
CeresAnnot:1525600 MGLSSLPAPS EGVLCVLLVN TALSISIVKG VRSILHIVG  RLSPSASLP   50 gi|76446335        YSYFASPQ-V VSAEPYDVNL SPPLSYVEEF RNQNPALKYE T--LHC-EDA  97
gi|37901055        SSILFPDY--  SDTESFEFPL HSSDDCVREL RSRRPAKRFD A-VSSC-KQP  96
Lead-Annot-ID:550729 SSVTVSSENS STSESFDFRV CQPESYLEEF RNRTPTLRFE SI-LCRCKQA  99
gi|20340241        SSVTASSE-I PASEPFDFRV SHPESFLEEF RSNKTPTLRYE SI-LCRCKKH  98
CeresClone:473509  PSSPDPSL-- TAPESFEFHL SPSESYIEEF RSRTPTLRFD SI-VCCC-KQP  96
CeresClone:1922929 SSDYTENL--  -SESFDFHL  NTPESYIEEF RSRTPTI-HFG AVVCSC-KRP  91
CeresAnnot:1525600 SSDNAEDT--  -RESLEFRL  SPPENYIEEF RSRMPSIRFN T-VCSC-EQP  94 gi|76446335        EHDCSVCLTE FEPQSDINNL SCGHLFHKVC LEKWLDYLNV TCPLCRTPLI 147
gi|37901055        QHDCPVCLDQ FKPDSEINCL SCGHVFHKAC LEKWLDYRKV TCPLCKSPVM 146
Lead-Annot-ID:550729 DNECSVCLSK FQGDSEINKL KCGHLFHKTC LEKWIDYWNI TCPLCRTPLV 149
gi|20340241        DNECSVCLSK FEEDSEINKL KCGHLFHKTC LEKWIDYWNI TCPLCRTPLV 148
CeresClone:473509  EHDCSVCLTQ FEPESEINRL SCGHLFHKVC LEKWLDYWNI TCPLCRTPLM 146
CeresClone:1922929 QHDCQVCLTQ FEPKSEINHL SCGHLFHKVC LEKWLDYWNI TCPLCRTPLL 141
CeresAnnot:1525600 EHDCSVCLTQ FEPESEINSL SCGHIFHKMC LEKWLDYWNI TCPLCRTPLL 144 gi|76446335        ----PEFED  DPSCFW 158
gi|37901055        ----PEEED  -TSSSW 156
Lead-Annot-ID:550729 VV--PEDHQ  LSSNVW 162
gi|20340241        VVAAEDQKQ  LSSNVW 164
CeresClone:473509  ----PEDD-  -TPCFQ 155
CeresClone:1922929 ----PEEE-  -ASCFL 150
CeresAnnot:1525600 ----PEED-  -ASCFW 153
```

Figure 5

```
                                                                                    37
                              ----MPLLLR  GGSL------  ------FRLY GCG  CGLPSANFSP  SKLAI IRLSL   37
gi|34908948                   ----MPLLLR  GASL------  ------LRLC QCT  SGLSSVKFSS  RVTVLVNLNA    37
CeresClone:1158508            MNNVLQFGLQ  SSAIYVAKFL  VVPLRSLRVG      SFVGVGVGT   RSFNK-RLMS    49
Lead-Annot-ID:554970          ----------  SRSLKIGQLG  SLRLRVMSSK      RGVSSSTKSA  AASIV----     38
CeresAnnot:1528227

72
                              MMAETRATYS  RRAASK----  ----NTDIKKD     DEHVL-----  -K----QLRND   79
gi|34908948                   MRDGMRATYS  RRAEVKKDEQ  PLTEKEDAAE      SDLEM-----  -R----GRSSS   93
CeresClone:1158508            NATAFSINNS  KRKELK----  ---IPGAADQ      NCHQMGSDTD  RDEMGTLQDD    77
Lead-Annot-ID:554970          -------DDK  KDSKLKGMSG  DCSEKVLIEE      SCWKV-----  -Q--SVEFQSIKDD
CeresAnnot:1528227

122
                              PDRLQSMTVK  ELREITRMMG  IPVGNKKDL       VSALMDSLGK  ERNGKVGTSS    129
gi|34908948                   PSQLQSMTVK  ELRELTRRRG  ISVKGTIKKDL     VSALMNSMAV  EANGEGKSS     143
CeresClone:1158508            RKEIEAMTVQ  ELRSTLRKLG  VPVKGRKQEL      STIRLHMDS   NLPDQKETSS    127
Lead-Annot-ID:554970          PGKIEAMTVQ  ELRATLRKFG  VPAKGRKGDL      VFALKHFMGE  SSQELEERVS
CeresAnnot:1528227

163
                              VEKIGVSEVP  SKRK-GASVV  VEQN------      -DSSEVISE   TPSLKRSRAK    172
gi|34908948                   VELVSPLEVP  LKRKGGASVV  VEQK------      LESSEIISE   TPNKKRSRTK    193
CeresClone:1158508            STRSDSVTLK  RKISNREEPT  EDECTNSEAY      DEHGEKRVK   QSTEKNLKAK    167
Lead-Annot-ID:554970          FNSRENISLQ  KNTK------  ---RTS          -VVSINTVSE  VSGFKQSKRR
CeresAnnot:1528227

198
                              NKGTAEES--  --SGANVRQS  KTSVQKKKLV      V---------  -QGASVDHE     209
gi|34908948                   QKSSKNTTCQ  EISVTNVKLS  KTVVQ-KET       V---------  -DGLSPDDD     240
CeresClone:1158508            VSAKATAK--  -EQKSIMRTG  KQQQSKEET       SSTISSELK   TEE[SSPSQ     204
Lead-Annot-ID:554970          MKQSPVED--  ----EIVKVG  TELVTKRKL       S---------  TDDLVTLPQA
CeresAnnot:1528227
```

Figure 5 (continued)

| | | | | | |
|---|---|---|---|---|---|
| gi\|34908948 | EPWTVLVHK | KPQPAWIPYN | PKVMRSPSLS | KDTKALKILS | WNVNGLKALL | 247 |
| CeresClone:1158508 | SEPWTILVHK | KPEASWIPYN | PRTMRPPPLS | KDTRALKIMS | WNVNGLKALL | 259 |
| Lead-Annot-ID-554970 | SEPWTVLAHK | KPQKDMKAYN | PKTMRPPPLP | EGTKCVKVMT | WNVNGLRGLL | 290 |
| CeresAnnot:1528227 | EPWTVLSHK | KPQKGWIPYN | PRTMRPAPLT | DGN-SVKLMS | WNVNGLRALL | 252 |

| | | | | | |
|---|---|---|---|---|---|
| gi\|34908948 | KSRGFSIHQL | AQREDFDILC | LQETKMQ---A | KDVEVIKEGL | LEGYTHSFWT | 295 |
| CeresClone:1158508 | KSRGFSVQQL | AQREDFDVLC | LQETKMQ---E | KDIEVIKDTL | LDGYTNSFWT | 307 |
| Lead-Annot-ID-554970 | KFESFSALQL | AQRENFDILC | LQETKLQ---V | KDVEEIKKTL | IDGYDHSFWS | 338 |
| CeresAnnot:1528227 | KFEGFSALEL | AQRENFDVLC | LQETKLQASE | KDVDSIKQCL | DGYENSFWT | 302 |

| | | | | | |
|---|---|---|---|---|---|
| gi\|34908948 | CSVSKLGYSG | TAIISRVKPL | SIKYGLGVPD | HDTEGRVVTV | EFNDFYLLTA | 345 |
| CeresClone:1158508 | CSVSKLGYSG | TAIISRIKPL | SIKYGLGIPD | HDTEGRVVTV | EFDDFYLLTA | 357 |
| Lead-Annot-ID-554970 | CSVSKLGYSG | TAIVSRIKPL | SVRYGTGLSG | HDTEGRIVTA | EFDSFYLINT | 388 |
| CeresAnnot:1528227 | CSNAKLGYSG | TAIVSRIKPL | SVCYGLGIPD | HDSEGRVVTA | EFDSFYLVNT | 352 |

| | | | | | |
|---|---|---|---|---|---|
| gi\|34908948 | YVPNSGDGLK | RLTYRVTEWD | PSLGNYMKDL | EKSKPVILTG | DLNCAHQEID | 395 |
| CeresClone:1158508 | YVPNSGDGLK | RLTYRVTEWD | PSLGNYMKEL | EKSKPVILTG | DLNCAHQEID | 407 |
| Lead-Annot-ID-554970 | YVPNSGDGLK | RLSYRIEEWD | RTLSNHIKEL | EKSKPVVLTG | DLNCAHEEID | 438 |
| CeresAnnot:1528227 | YVPNSGDGLK | RL-------- | ------EL | EKSKPVILTG | DLNCAHQEID | 386 |

| | | | | | |
|---|---|---|---|---|---|
| gi\|34908948 | HDPAGNRRS | AGFTIEERES | FETNFLSKGF | VDTFRKQHPN | VVGYSYWGYR | 445 |
| CeresClone:1158508 | HDPAGNRRS | AGFTINEERES | FGTNFLSKGF | VDTFRKQHPN | VVAYSYWGYR | 457 |
| Lead-Annot-ID-554970 | FNPAGNKRS | AGFTIEERQS | FGANLDKGF | VDTFRKQHPG | VVGYTYWGYR | 488 |
| CeresAnnot:1528227 | FNPAGNKRS | AGFTIEERQS | FGSNFLSKGL | VDTFRKQHPN | VVGYTYWGYR | 436 |

Figure 5 (continued)

|  | | | | | 493 |
|---|---|---|---|---|---|
| HNARKTNKGW | RLDYFLVSES | AERVHDSYI | PDISASDHS | PLGLVLKL | |
| HNARKTNKGW | RLDYFLVSES | AEKVHDSYI | LPDISASDHS | PLGLVLKL | 505 |
| HGGRKTNKGW | RLDYFLVSQS | AANVHDSYI | LPDINGSDHC | PIGLILKL | 536 |
| HGGRKTNKGW | RLDYFLVSES | ADKVHDSYI | VPDVNGSDHC | PIGLVLKV | 484 | gi|34908948
CeresClone:1158508
Lead-Annot-ID:554970
CeresAnnot:1528227

Figure 6

| | | | | | | | |
|---|---|---|---|---|---|---|---|
| Lead-Annot-ID-840236 | MGRESVAVVT | APPS—ATAPG | TASVA————— | ——TSLAPGFR | FHPTDEELVS | | 42 |
| gi\|21105736 | MEQEGAALVI | APPSTAVSTP | VATVAKRGVT | PPTSLAPGFR | FHPTDEELVR | | 50 |
| | | | | | | | |
| Lead-Annot-ID-840236 | YYLKRKVLGQ | PVRFDAIGEV | DIYKHEPWDL | AVFSRLKTRD | QEWYFYSALD | | 92 |
| gi\|21105736 | YYLRRKACAK | PFRFQAVSEI | DVYKSEPWEL | AEFASLKTRD | LEWYFFSPVD | | 100 |
| | | | | | | | |
| Lead-Annot-ID-840236 | KKYGNGARMN | RATNRGYWKA | TGKDREIRRD | LLLGMKKTL | VFHSGRAPDG | | 142 |
| gi\|21105736 | RKYGNGSRLN | RATGKGYWKA | TGKDRPVRHK | SQTIGMKKTL | VFHSGRAPDG | | 150 |
| | | | | | | | |
| Lead-Annot-ID-840236 | LRTNWVMHEY | RLVEYETEKN | GNLVQDAYVL | CRVFHKNNIG | PPSGNRYAPF | | 192 |
| gi\|21105736 | KRTNWVMHEY | RLADEELERA | G—VVQIAFVL | CRIFQKSGLG | PPNGDRYAPF | | 199 |
| | | | | | | | |
| Lead-Annot-ID-840236 | MEEEWADDEG | ALIPGIDVKL | RLEPPPVANG | NDQMDQEIQS | ASKSLINI NE | | 242 |
| gi\|21105736 | IEEEWDDDTP | LLIPGGEAE— | ——DDVANG | —————————— | —————————— | | 224 |
| | | | | | | | |
| Lead-Annot-ID-840236 | PPRETAPLDI | ESDQQNHHEN | DLKPEEHNNN | NNYDENEETL | KREQMEEEER | | 292 |
| gi\|21105736 | —————————— | ——DEARVDGN | DLDQDALQKA | KAPCQSENLL | EPRTI————— | | 257 |
| | | | | | | | |
| Lead-Annot-ID-840236 | PPRPVCVLNK | EAPLLLQYK | RRRQSESNNN | SSRNTQDHCS | STTTVDNTT | | 342 |
| gi\|21105736 | ————PFVCKRE | RSEDPELSLA | QSKRSKHDDP | SSSHANDSKD | STTSQQDPPT | | 304 |

Figure 6 (continued)

| | | | | | | |
|---|---|---|---|---|---|---|
| Lead-Annot-ID:840236 | TLISSSAAAT | NTAISALLEF | SLMG-SDKK | EKPQQPLRPH | KEPLPPQTPL | 391 |
| gi\|21105736 | TMMTTNYSPT | ----LLAF | PLLEPIEPKE | NQPSNALTFD | SSNLEKSVPP | 348 |

| | | | | | | |
|---|---|---|---|---|---|---|
| Lead-Annot-ID:840236 | ASPEEKVNDL | QKEIHQMSVE | RETFKLEMMS | AEAMISILQS | RIDALRQENE | 441 |
| gi\|21105736 | GYL-KFISNL | ENEILNVSME | RETLKIEVMR | AQAMINILQS | RVDLLNKENE | 397 |

| | | |
|---|---|---|
| Lead-Annot-ID:840236 | ELKKNNANGQ- | 451 |
| gi\|21105736 | DLRRLVRGG- | 406 |

Figure 7

```
                                                                           48
CeresClone:1620054      MSGKAKRRDD  DI-GASDADSE  GHAPPKKSLK  K-DSDDDPDS  TVCEI SKNR   50
Lead-CeresClone:1001761 MSSRGKRKDE  DVRASDDESE   THAPAKKVAK  PADSDQSDD   VVCNI SKNR   50
CeresClone:955105       MSWRGKRKDE  DVRASDDDSE   THAPAKKVAK  PAESSEESDD  VVCNI SKNR 98
CeresClone:1620054      RVAVRNWKGS  MVDI REFYV  KDGKQLPGRK  GI SLTMDQWN  VLRNHVEEID  100
Lead-CeresClone:1001761 RVSVRNWNGK  I DI REFYV  KDGKTLPGKK  GI SL SVDQWN TXRNHAEDI E  100
CeresClone:955105       RVSVRNWNGK  WI DI REFYV KDGKTLPGKK  GI SL SVDQWN TLRNHADGD 98
CeresClone:1620054       ----------  107
Lead-CeresClone:1001761  KALSDLS    107
CeresClone:955105        KALADLS
```

Figure 8 (continued)

| | | | | | | | |
|---|---|---|---|---|---|---|---|
| CeresClone:1898837 | GGNGGYSRG- | ---------- | ----GG | GGGY | -------- | ---- | -GGR--QGGY | GG-------- | 121 |
| CeresAnnot:1450324 | GGGGGYGGRR | EGGGGGYSRG | -GG | GGGYG | -------- | -GGG | ----GGY | GG-------GGGGYG | 138 |
| gi|469070 | GSGGGYGGGG | RREGGY---- | -GG | GGGYG | -------- | -GGG | -GGRREGGY | GG-------GGGGYG | 138 |
| gi|18347 | GGGGGYGGGG | GYGGRREGGG | -GG | GGGYG | GGRRE--- | -GGG | ----GGY | GG-------GGGGYG | 138 |
| gi|2624326 | GGGGGYGGGG | GYGG------ | -GG | GGGYG | GGYASREGG | YGGG | ----GGY | GG-------GGGGYG | 139 |
| CeresClone:815584 | GGGGGYG--- | ---------- | ---- | GGGY | ASREGG--- | -GGG | ----GGY | -------- | 115 |
| CeresClone:1012773 | GGGGGYRS-- | ---------- | ---- | GGGYS | -------- | -GGG | ----GGY | GG--------GRGG- | 118 |
| gi|1346180 | GGGGGYRS-- | ---------- | ---- | GGGY | -------- | -GGG | ----GCW | GG--------QRG- | 134 |
| Lead-CeresClone-1003205 | GSGGGYG--- | ---------- | -RG | GGGYG | GGGG---- | YGGG | GREGGY | SG-------GGGGYS | 125 |
| CeresClone:1465358 | RGGGGGYGG- | ---------- | -GG | GGGYG | GGYSG---- | -GGG | ----GGY | SG-------GGGGGY | 124 |
| CeresClone:1120014 | GGGGGYRG-- | ---------- | -GG | GGGY | -------- | -GGG | ----GGY | GDRRGGGGGGY | 122 |
| CeresClone:1066826 | GGGGGYRG-- | ---------- | -GG | GGGY | -------- | -GGG | ----GGY | GG-------GGGGY | 122 |

| | | | | | | |
|---|---|---|---|---|---|---|---|
| CeresClone:1898837 | GRRDGGSRYS | RG------- | G------- | ---ASEG | NWRS- | 143 |
| CeresAnnot:1450324 | GGRDRG---YG | DGGSRYSSRG | G------- | ---SDGG | SMRD- | 165 |
| gi|469070 | GGRREG---GY | GG------- | G------- | ---GSEG | NWRS- | 156 |
| gi|18347 | GRREGGDGGY | GG------- | G------- | ---GGGS | RW--- | 157 |
| gi|2624326 | GGYGGYGCR | GG------- | G------- | ---NSDG | NWRN- | 160 |
| CeresClone:815584 | ---------- | ---------- | -------- | -------- | ----- | 115 |
| CeresClone:1012773 | -------- | SRGGGGGYG | GGRRDGGEG | G------- | ----- | 118 |
| gi|1346180 | ERR------- | ---------- | -------- | GYGGSGGGG | GW--- | 166 |
| Lead-CeresClone-1003205 | SGGGRGGGE | XG------- | G------- | ---GGGD | VKEWV | 128 |
| CeresClone:1465358 | CRRDGGG-- | GG------- | -------- | -------- | ----- | 146 |
| CeresClone:1120014 | GRRDGGGYGS | GG------- | G------- | ---GGYG | GRRD- | 129 |
| CeresClone:1066826 | | | | | | 143 |

| | | | | | | | |
|---|---|---|---|---|---|---|---|
| gi\|90704785 | FGFVTF MDEQ | SMRDAI EGMN | GRDL DGRNI T | VNR AQARG | --- | GG | 93 |
| gi\|21388658 | FGFVTF ADEN | SMNAI KEMN | GQEL DGRNI T | VNQAQSRG | --- | GG | 92 |
| gi\|4704605 | FGFVTF NDEQ | SMRDAI DAMN | GKM DGRNI T | VNPAQSRG | N GG | GG | 93 |
| gi\|1229138 | FGFVTF ASDE | AMRQAI EAMN | GKDL DGRNI T | VNR AQSRG | S DG | GG | 91 |
| CeresClone:1773631 | FGFVTF SSEQ | SML DAI EAMN | GKDL DGRNI T | VNQAQSRG | --- GG | GG | 92 |
| gi\|107799202 | FGFVTF SSEQ | SML DAI ENMN | GKEL DGRNI T | VNQAQSRG | --- GG | GG | 93 |
| gi\|21625 | FGFVTF SSEQ | SML DAI ENMN | GKEL DGRNI T | VNQAQSRG | --- GG | GG | 93 |
| gi\|7024451 | FGFVTF RDEK | SMRDAI EGMN | GQDL DGRNI T | VNEAQSRG | --- GG | GG | 95 |
| gi\|20152613 | FGFVTF SSEQ | SML DAI DGMN | GQDL DGRNI T | VNEAQSRG | --- GGG | GG | 92 |
| CeresAnnot:1450324 | FGFVTF NNEK | SMRDAI QGMN | GQNL DGRNI T | VNEAQSRG | --- SGGG | GG | 94 |
| gi\|2674201 | FGFVTF RDEK | AMRDAI EGMN | GKEL DGRNI T | VNEAQSRG | --- SGG | GG | 95 |
| CeresClone:1834392 | FGFVTF SSEQ | SMKEAI SGMN | SQEL DGRNI T | VNEAQSR R | --- GGG | GG | 93 |
| gi\|1088863012 | FGFVTF KDEK | SMRDAI EGMN | GSEL DGRNI T | VNEAQSR R | --- SGG | GG | 93 |
| gi\|1934994 | FGFVTF KDEQ | AMRDAI EGMN | GQT DGRNI T | VNEAQARG | --- SGGG | GG | 92 |
| gi\|6911144 | FGFVTF KDEK | SMKEA I EGMN | RQDL DGRNI T | VNEAQSRGGV | --- SGGNG | GG | 96 |
| gi\|799015 | FGFVTF KDEQ | AMRDAI EGMN | GQDL DGRNI T | VNEAQSRG | EAG CGG | GG | 98 |
| gi\|469070 | FGFVTF KDEK | SMRDAI EGMN | GQDI DGRNI T | VNQAQSRG | --- SGG | GG | 91 |
| gi\|22226370 | FGFVTF SNEK | SMNDAI EAMN | GQEL DGRNI T | VNEAQSRG | --- CGGC | GG N | 91 |
| gi\|34851124 | FGFVTF ANEK | SMND V EAMN | GQDI DGRNI T | VNEAQSRG | --- CGGC | GG | 98 |
| gi\|2267569 | FGFVTF ANEK | SMRDAI E E MN | GQEL DGRNI T | VNEAQSRG | --- SGG | GG | 93 |
| gi\|92874469 | FGFVTF AEEK | SMRDAI EGMN | GQDL DGRNI T | VNQAQSRG | --- CGGR | GG | 91 |
| gi\|18347 | FGFVTF KDEK | SMKNAI EGMN | GQEL DGRNI T | VNEAQSRG | --- SGGR | GG | 96 |
| gi\|90265701 | FGFVTF SSSE | SMKDAI EGMN | GQDL DGRSI T | VNEAQSR R | --- GG A --- | GG | 91 |
| CeresClone:1444599 | FGFVTF KDEK | SMKDAI EGMN | GQDL DGRNI T | VNEAQSRG | --- SGA | GG | 89 |
| gi\|13461B1 | FGFVTF KDEK | SMKDAI EGMN | GQDL DGRNI T | VNEAQSRG | --- SGG | GG | 93 |
| CeresClone:1053672 | FGFVTF KDEQ | AMKDAI EGMN | GQDL DGRSI T | VNEAQSRG | --- GG | GG | 93 |
| Lead-CeresClone:1011900 | FGFVTF KDEK | AMKDAI EGMN | GQDL DGRSI T | VNEAQSRG | --- SGG | GG | 93 |
| CeresClone:1075035 | FGFVTF KDEK | SMKDAI EGMN | GQDL DGRNI T | VNEAQSRG | --- SGG | GG | 93 |
| CeresClone:1083222 | FGFVTF KDEK | AMKDAI EGMN | GQDL DGRSI T | VNEAQSRG | --- SGG | GG | 93 |

| ID | Seq1 | Seq2 | Seq3 | Seq4 | Seq5 | Num |
|---|---|---|---|---|---|---|
| gi\|90704785 | GGGSR---- | -------- | -------- | -------YGGGG | VSDDGGWRS- | 181 |
| gi\|21388658 | GGGGY---- | -------- | -------- | -------GGRG | GPSSGNWRND | 162 |
| gi\|4704605 | GL------- | -------- | -------- | -------- | -SEGGSWRR | 155 |
| gi\|1229138 | GYGGS---- | -------- | -------- | -------RG | CSGGGNWRE- | 161 |
| CeresClone:1773631 | GGGGY---- | -------- | -------- | -------GSR | GDSGGNWRN- | 154 |
| gi\|10799202 | YGGNR---- | -------- | -------- | -------- | CDSGGNWRN- | 170 |
| gi\|21625 | GGYGG---- | -------- | -------- | -------NR | GDSGGNWRN- | 168 |
| gi\|7024451 | GGSRY---- | -------- | -------- | -------SRSG | ASDGGSWRN- | 167 |
| gi\|20152613 | GGDRY---- | -------- | -------- | -------AR | GNSDSDWRN- | 168 |
| CeresAnnot:1450324 | GGSRY---- | -------- | -------- | -------SSRG | GSDGGSWRD- | 165 |
| gi\|2674201 | GGSRY---- | -------- | -------- | -------SRGG | GESDGNWKN- | 164 |
| CeresClone:1834392 | GGRREGGYG | DGGSRYSRGG | -------- | -------- | GASEGNWRS- | 168 |
| gi\|108863012 | --------- | -------- | -------- | -------- | ---------- | 117 |
| gi\|1934994 | GGGGY---- | -------- | -------- | -------- | --GGDRY--- | 162 |
| gi\|6911144 | GGSRY---- | -------- | -------- | -------SRGG | GASDGNWRN- | 164 |
| gi\|799015 | GGGGS---- | -------- | -------- | -------- | --SDGNWRN- | 175 |
| gi\|469070 | REGGY---- | -------- | -------- | -------G | CGSEGNWRS- | 156 |
| gi\|2226370 | REGGY---- | -------- | -------- | -------G | GGSEGNWRN- | 156 |
| gi\|34851124 | GGARY---- | -------- | -------- | -------SRGSG | GSEGGSWRS- | 178 |
| gi\|22267569 | GGSRY---- | -------- | -------- | -------SR | DSDGGNWRS- | 166 |
| gi\|6273331 | --------- | -------- | -------- | -------- | ---------- | 105 |
| gi\|92874469 | GGDRGYGGGG | GGDRYSRGGC | -------- | -------- | ADSGGNWRD- | 190 |
| gi\|18347 | GGSRW---- | -------- | -------- | -------- | --WRN---- | 157 |
| gi\|90265701 | --------- | -------- | -------- | -------- | ---------- | 107 |
| CeresClone:1444599 | EEVVAVEATV | AGVMVVKVEV | -------- | -------- | TEERWWWLV- | 168 |
| gi\|1346181 | GGGW----- | -------- | -------- | -------- | ---------- | 169 |
| CeresClone:1053672 | --------- | -------- | -------- | -------- | ---------- | 116 |
| Lead-CeresClone:1011900 | --------- | -------- | -------- | -------- | ---------- | 130 |
| CeresClone:1075035 | --------- | -------- | -------- | -------- | ---------- | 135 |
| CeresClone:1083222 | --------- | -------- | -------- | -------- | ---------- | 138 |

Figure 10

| | | | | | |
|---|---|---|---|---|---|
| gi\|31872116 | MAGGRGARAS | LHLHLAWLCA | FA-T-TAWAH | GG-GGGGDS | DADADGGGEG | 47 |
| CeresClone:984060 | --MARATNAH | HHRLRLLLCL | SL-AAAAWAH | GG-GGD-SDA | DADADGGAAA | 45 |
| CeresClone:1816624 | ----MARATT | ARHLLLLLCL | SLGAATARAH | GG-GGD---A | DADAGGGSPA | 42 |
| gi\|38036140 | ---MSFSLRTF | FF-LSLLLLL | FF-S-SVSSH | GG-HDDDADI | DADSDSEAP- | 43 |
| CeresClone:1649800 | MSPSFCTSLF | LFTLSLLFFL | FF-SL-SVSAH | SG-HDDGGDA | DSDAT---- | 43 |
| Lead-CeresClone:105162 | ----MSRSLV | FFFFLYLVLV | ----PCLSH | GT-GGDHDDD | EAPHVKS--- | 37 |
| CeresClone:1853694 | ---MKLSRDF | FFFLYLSLFI | ----SVTCH | GGSHADGDDD | DDDKAGERNE | 43 |
| CeresAnnot:1494468 | ---MSRSLL | FLSLFLSLLL | ----LTAGH | SG-HNDDDEA | DADADGDTTK | 40 |

| | | | | | |
|---|---|---|---|---|---|
| gi\|31872116 | KPDLRARGLV | AAKLWCLAVV | FAGTLAGGVS | PYFMRWNDAF | LALGTQFAGG | 97 |
| CeresClone:984060 | RPDLRARSLV | EAKLWCLAVV | FVGTLLGGVS | PYFMRWNEAF | LALGTQFAGG | 95 |
| CeresClone:1816624 | -PDLRARGLV | AAKLWCLAVV | FAGTLLGGVS | PYFLRWNEAF | LALGTQFAGG | 91 |
| gi\|38036140 | -HNLRSKSLI | LTKVYCLIVI | FFATFIAGVS | PYVLRWNEGF | LILGTQFAGG | 92 |
| CeresClone:1649800 | -PDLRARPLI | LAKVWCLIVI | FIATFVSGVS | PYLLKWNEGF | LVLGTQFAGG | 92 |
| Lead-CeresClone:105162 | -SDLKSKSLI | SVKIACLVII | FVLTFISGVS | PYFLKWSQGF | LVLGTQFAGG | 86 |
| CeresClone:1853694 | PHDLRSKSLI | LMKVWCLILV | FVGTFVGGVS | PYFLKWNQGF | LVLGTQFAGG | 93 |
| CeresAnnot:1494468 | -INLRSKSLI | LMKIWCLILI | FIGTFIGGVS | PYFLKWNEGF | LVLGTQFASG | 89 |

| | | | | | |
|---|---|---|---|---|---|
| gi\|31872116 | VFLGTAMMHF | LADANETFAD | LLPGTA---- | ---YPFAFML | ACAGYVLTML | 140 |
| CeresClone:984060 | VFLGTALMHF | LSDANETFGD | LLPDSG---- | ---YPWAFML | ACAGYVVTML | 138 |
| CeresClone:1816624 | VFLGTALMHF | LSDADETFGD | LLPDSG---- | ---YPWAFML | ACAGYVVTTI | 134 |
| gi\|38036140 | VFLGTAMMHF | LSDANETFGD | LTDKE----- | ---YPFAFML | ACAGYLITML | 134 |
| CeresClone:1649800 | VFLGTAMMHF | LSDANETFGD | LTQKE----- | ---PFAYML | ACAGYLMTLL | 134 |
| Lead-CeresClone:105162 | VFLGTALMHF | LSDADETFRD | LTAEGESEP | SPAYPFAYML | ACAGFMLTML | 136 |
| CeresClone:1853694 | VFLATALMHF | LSDANETFGD | LTTKE----- | ---YPLAFML | ACAGLLLTML | 135 |
| CeresAnnot:1494468 | VFLGTALMHF | LSDANETFED | LTKKE----- | ---YPFAFML | ACAGYLLLTML | 131 |

Figure 10 (continued)

```
gi|31872116              ADCA SFVMA  RG-GGRTEPA  AAAG----AGL  EEGKLSST NG  NASDPPAADA      186
CeresClone:984060        ADVA SYVVS  RS-QGRST GT  AAT GGSDAGL  EEGKMRTTNG  TRSEPTPADA      187
CeresClone:1816624       ADVI SHVVS  RGRA ACSGA   ----EGL      EEGKVSTT NG  TSSEPHPADA     181
gi|38036140              ADCVI SSLLE KP--NHGAGA   GGDG----QGV  DKGR---S-NG  VNSQSQYQSS     176
CeresClone:1649800       ADAVI SSL FN NM---GRHAQ  DVEG----QGA  DV NKLSS-NG  VTSQSQHRSH     177
Lead-CeresClone-105162   ADSVI AHI YS KT-----QN    DVQG----QGE  DKSN-------  ---------       161
CeresClone:1853694       ADCI SYVYG  KG-KNSCNNG  DLEL----QGA  ERSKT NP-HG  QGDPP VGNGT    180
CeresAnnot:1494468       ADSLI SHVYS KDVV SQANGG DVEL----QDA  ASAK-------  ---------       162 gi|31872116              AAQ DHSVASM  LRNASTLGDS  VLL-------A  ALCFHSVFEG  AI GVAETKA      231
CeresClone:984060        HGS DHSAASI  LRNASTLGDS  VLL-------V  ALCFHSVFEG  AI GI AETKA     232
CeresClone:1816624       HGS DHSVASM  LRNASTLGDS  VLL-------A  ALCFHSVFEG  AI GVAETKA      226
gi|38036140              AGT N---DAD APSSSI GDT  VY FI YYY I--V  AL CAHSVFEG  AI GVSVTKA      223
CeresClone:1649800       DAN HHLASPA  LGYVHSVGDT  VLL-------V  AL CAHSVFEG  AI GVAETKA      222
Lead-CeresClone-105162   ---QRS----  ATTETSI GDS ---------V  ALCFHSVFEG  AI GI SETKS      199
CeresClone:1853694       DT TC--AQSS LTSASSFGDS  VLL-------V  ALCFHSVFEG  AI GVAETEA      224
CeresAnnot:1494468       ----ST----  LSTASSFGDS  LLL-------F  ALCFHSVFEG  AI GVAKT NA      199 gi|31872116              DAWKALWTI S LHKI FAAI AM  GI ALLRMLPD  RPFL SCF GYA  FAFAVSSPVG    281
CeresClone:984060        DAWKALWTI S LHKI FAAI AM  GI ALLRMLPN  RPLL SCFAYA  FAFAI SSPVG   282
CeresClone:1816624       DAWKALWTI S LHKI FAAI AM  GI ALLRMLPN  RPLL SCFAYA  FAFAI SSPI G  276
gi|38036140              DAWKALWTI C LHKI FAAI AM  GI ALLRMVPN  RPLL SCAAYA  FAFAI SSPI G  273
CeresClone:1649800       DAWKALWTI C LHKI FAAI AM  GI ALLRMI PD  RPLVSCAVYA  FAFAI SSPI G   272
Lead-CeresClone-105162   DAWRALWTI T LHKI FAAI AM  GI ALLRMI PD  RPLF SSI TYS  FAFAI SSPI G   249
CeresClone:1853694       DAWKALWTI S LHKI FAAI AM  GI ALLRMI PD  RPLL SCI AYA  FAFAI SSPVG   274
CeresAnnot:1494468       DAWKALWTI T LHKI FAAI AM  GI ALLRMI PD  RPCVSCVAYA  FAFAI SSPVG   249
```

Figure 10 (continued)

| | | | | | | | |
|---|---|---|---|---|---|---|---|
| gi\|31872116 | VG GI VI DAT | TQGRVADWI F | AVSMGLAT GI | FI YVSI NHL L | SKGYT PLRPV | 331 |
| CeresClone:984060 | VG GI I I DAT | TQGRVADWI F | AVSMGLAT GI | FVYVSI NHL L | SKGYR PQRPV | 332 |
| CeresClone:1816624 | VG VGI VI DAT | TQGRVADWI F | AVSMGLAT GI | FVYVSI NHL L | SKGYK PQRPV | 326 |
| gi\|38036140 | VAI GI VLDST | TQGHVADWI F | AI SMGLACGV | FI YVSI NHLF | AKGYV PHKHS | 323 |
| CeresClone:1649800 | VAI GI I LDAT | TQGHVADWI F | AI SMGLACGV | FVYVSVNHL L | AKGYM PHRPT | 322 |
| Lead-CeresClone:105162 | VAI GI VI DAT | TQGSI ADWI F | AL SMS ACGV | FVYVSVNHL L | AKGYR PNKKV | 299 |
| CeresClone:1853694 | VAI GI VI DAT | TQGAVADWI F | AI SMGLACGV | FI YVSI NHL L | AKGYA PQKTV | 324 |
| CeresAnnot:1494468 | VAI GI I I DAT | TQGPVADWI F | AI SMGLACGV | FI YVSI NHLS | TKGYL PQRSV | 299 |

| | | | | |
|---|---|---|---|---|
| gi\|31872116 | AADT PA GRLL | AVVLGVAVI A | VVMI WDT | 358 |
| CeresClone:984060 | AVDT PV GRWL | AVVFGVAVI A | VVMI WDT | 359 |
| CeresClone:1816624 | AVDT PVSRWL | AVVLGVAVI A | VVMI WDT | 353 |
| gi\|38036140 | KADSAYMKFL | AVSL GI GVGVA | VVMI WDT | 350 |
| CeresClone:1649800 | KVDSAYF KFL | AVFL GVGVI A | VVMI WDT | 349 |
| Lead-CeresClone:105162 | HVDE PRYKFL | AVLF GV VI A | VVMI WDT | 326 |
| CeresClone:1853694 | SVNR PHHKFL | SVLL GVGVI A | VVMI WDT | 351 |
| CeresAnnot:1494468 | L VDT PL YKFL | AVSL GI GVI A | VVMI WD- | 325 |

Figure 11

| | | | | | |
|---|---|---|---|---|---|
| Lead-CeresClone-110428 | MGDTAEDQDD | RAMMEAEGVT | SFSELLMFSD | GVLSSSSDHQ | PEGNVGDGGE | 50 |
| CeresClone:1444428    | MGDTA----DD | QAMVEAPGVP | SFSELLMLSD | GFLSSSEDHR | REINGGDGGE | 47 |

| | | | | | |
|---|---|---|---|---|---|
| Lead-CeresClone-110428 | DSLGFVFSGK | TGSRMLCFSG | GYQNDDESLF | LEPSVPTSGV | SDLDPSCIKI | 100 |
| CeresClone:1444428    | DSFGFVFSGT | SGSKMLCFSG | DCQNGDESLF | QEPSFPF-SGV | SVSDPSSCTI | 96 |

| | | | | | |
|---|---|---|---|---|---|
| Lead-CeresClone-110428 | DL-CRNSNDAC | TVDKSTKSST | KKRTGTGNGQ | ESDQNRKPGK | KGKRNQDKSS | 149 |
| CeresClone:1444428    | NTCKNSNDTC | TDERSIKSSN | KKRTGSGNGQ | NMDHNQKPSK | KCKKNQDKST | 146 |

| | | | | | |
|---|---|---|---|---|---|
| Lead-CeresClone-110428 | VGIAKVRKER | LGERIAALQQ | LVSPYGKTDA | ASVLHEAMGY | KFLQDQIQV | 199 |
| CeresClone:1444428    | VGIAKVRKER | LGERIAALQQ | LVSPYGKTDA | ASVLHEAMGY | KFLQDQIQV | 196 |

| | | | | | |
|---|---|---|---|---|---|
| Lead-CeresClone-110428 | LCSPYLINHS | LDGGVVTGDV | MAAMKAKDLR | SRGLCLVPVS | STVHVENSNG | 249 |
| CeresClone:1444428    | LCSPYLINYS | LDGGAVTGDV | TPGKKVRDLR | SRGLCLAPVS | STVHVENSNG | 246 |

| | | |
|---|---|---|
| Lead-CeresClone-110428 | ADFWSPAT- | MGHTTSPSLP | QGF | 270 |
| CeresClone:1444428    | ADLWSPATAS | MGHTMSPSQ- | --- | 265 |

Figure 12

```
CeresClone:463184       ---MSAMVEH TDQRAEA PQ SLAAPNWTIH VSDIKTVKVS NISLVLFKKD    47
Lead-CeresClone:112098  MSVTAAFLDS DQTQHNILMD SQST------ VSGVKTVKIS NVSLIVSKKD    44
CeresClone:1376604      ---------- -------MD SQPTL----- TSPVKTVKIS NVSLNVSKKD    26

CeresClone:463184       IEEFFSFSGD RYIEMQRES GHTQVAYVTF KDTQGADTAV LLTGSKIGDL    97
Lead-CeresClone:112098  VKEFFSFSGD QYVEMRSET QESQVAYVTF KDSQGAETAM LLTGAVIADL    94
CeresClone:1376604      LNEFFSFSGD HYIEMRSET QETQLAYVTF KDPQGAETAM LLTGAVIADH    76

CeresClone:463184       YVTITPNEKY QLPPEALPSS PTNQSPD--A VKKAEDVMST MLAKGFLLGK   145
Lead-CeresClone:112098  RVSITPAVNY QLPPEALALD S-EHSFNGFS VKKAEDVVNI MVGRGYALGK   143
CeresClone:1376604      RVSITPAVNY DLPPEALALD SQEYSFNGFT VKKAEHVVST MMERGYAVGK   126

CeresClone:463184       DAINKAKAFD EHHQLTSNAS STVASIDRKI GLSDKLSFGT AVENGKVREM   195
Lead-CeresClone:112098  DAMEKAKAFD DRHNLISNAS ATIASLDDKM GLSEKLSIGT TVVNEKLRDI   193
CeresClone:1376604      DAMEKAKAFD DRHNLVSNAS ATIASLDNKM GLSEKLSIGT TVVNEKLREV   176

CeresClone:463184       DERYQLSEMT KSAMAAAEQK ASSAGSAIMS NPYVKSGASW FSSAFTAIAK   245
Lead-CeresClone:112098  DERYQVREIT KSALAAAEET AXSARTALMA NPYVSSGASW FSNAFGAVTK   243
CeresClone:1376604      DERYQVREIT KSALAAAEER AISAGTALMA NPYVSSGASW LSNAFGAVTK   226

CeresClone:463184       AAEDVSTMIK EKVEQAVVER NEITYGERKG TVDEFAKTHL EEASDIGPAV   295
Lead-CeresClone:112098  AV------K- EKVENGGEGR KEII------ --------TL DPSSPKVPAV   272
CeresClone:1376604      AV-------- RAEDGGEGR- KEIV------ --------QL DDTSPKAPAV   253
```

Figure 12 (continued)

```
CeresClone:463184      VPVNSDDDRK LATIL        310
Lead-CeresClone-112098 VPVKLG----- -----       278
CeresClone:1376604     VPVNSVDTDF TKPSF        268
```

Figure 13

```
                                                                                       50
                                                                                       26
                                                                                       33
Lead-CeresClone-113639   MMMETRDPAI KLFGMK PFP SVFESAVTME DDEEDWSGG DDKSPEKVTP
CeresClone:562894        -MEEHEDEGD -KL----- --- DTRVENVTKE ELEAD----- ---------P
CeresAnnot:1503065       -MLEPKDPAI KLFGKT ---Q DSVEKSLTEK QEDGV----- ---------S 100
                                                                                        75
                                                                                        82
Lead-CeresClone-113639   ELSDKNNNNC NXNSFNNSKP ETLDKEEATS TDQIESSETP EDNQQITPDG
CeresClone:562894        PLDAEETKIS GTSPEAIVNP KTPSIEEETA KSKGGKSEKE QGDAANSQE-
CeresAnnot:1503065       PVATEEPSNP DATSGTSENP KTPSIEKESF GLQTSRTEEE DSDTSNSPE- 150
                                                                                       125
                                                                                       132
Lead-CeresClone-113639   KTLKKPLKIL PCPRCKSMET KFCYYNYNI NQPRHFCKAC QRYWTAGGTM
CeresClone:562894        KTLKKPDKVL PCPRCKSMDT KFCYYNNYNV NQPRYFCKAC QRYWTAGGTM
CeresAnnot:1503065       KTLKKPDKIL PCPRCNSMDT KFCYYNNYNV NQPRHFCKNC QRYWTAGGTM 193
                                                                                       175
                                                                                       182
Lead-CeresClone-113639   RNVPVGAGRR KNKSSSSHYR HITISEALEA ARLD------ -PGLQANTRV
CeresClone:562894        RNVPVGAGRR KNKNSTSHYR HITISEALQA ARIDAQNGTH LPTLKCNGRV
CeresAnnot:1503065       RNVPVGAGRR KNKNSASHYR HITIPEALQN VRADVPNGVM HPSMKTNGTV 240
                                                                                       224
                                                                                       228
Lead-CeresClone-113639   LSFGLEAHQQ HVAPMAPVMK LQGDQKVSNG ARNGFH-GLA DQRLVARV--
CeresClone:562894        SFGLDAHAP ICDSMASLMN L-GEKKALNG TRNGFHHGFE DQRLPQNHGF
CeresAnnot:1503065       LTFGSDT--P LHESMASVLN -ADKTTRNC TRNGSH-KPD AVRIPVSYGS 289
                                                                                       271
                                                                                       275
Lead-CeresClone-113639   ENGDDCSSG SSVTSNHS IVEPQMNNN NMNGYACIPG
CeresClone:562894        GENGDDSSIT SSIITISS--P KGENNKSTFQ QQPLPQNHG FLPQVPCIPG
CeresAnnot:1503065       GENGDDHSNG SSVTVSN--S IDEAGKSMSK ESAMQNCQG FPPEIPCFPG
```

Figure 13 (continued)

```
                                                              323
Lead-CeresClone-113639   VPWPYTWN- ---PA MPPPG FY PPGYPMP FYP----- -YM T PM    314
CeresClone:562894        VPWPYTWN- ---SP VPPPA LF -PS GFPLP FYPA-TFWNC GMPGNWNVPW 324
CeresAnnot:1503065       VPWPYPWNSA QWSSPLPPPA FC -PPGFPMP FYPAAAYWGC TVPGAWNIPW 370
Lead-CeresClone-113639   LSPSPHQSSS P SQKDSNT N SPTLGKRSRD EESSKRDS--- -E TERKQRL G   362
CeresClone:562894        FSSSS--PAS NLKSPSSSPN SPTLGKHSRD SDMIKQDSLH KEEASTPRNG 371
CeresAnnot:1503065       L -PQP---SSP KQTSSSGPN SPTLGKHSRD ENMLKSSNSE EGESAKENNT 416
Lead-CeresClone-113639   --CILVPKTL RIDDPNEAAK SSIWTTLGIK NEA---MCKAG GMFKGFDHKT   407
CeresClone:562894        --SVLVPKTL RIDDPSEAAK SSIWATLGIK NES---VSGG AMFKAFQSKK   421
CeresAnnot:1503065       ERCLWPKTL RIVDPGEAAK SSIWTTLGIK NDKPDLIGGR GLFKAFDSKV 447
Lead-CeresClone-113639   KMYNNDKAEN SPVLSANPAA LSRSHNFHEQ ----                       436
CeresClone:562894        G---EKNHVEA SPMLMANPAA LSRSLNFHEN SI---                     453
CeresAnnot:1503065       E---KNHEAET SPVLQANPAA LSRSLRFQES SYFG
```

Figure 14 (continued)

| | | | | | | | | |
|---|---|---|---|---|---|---|---|---|
| CeresClone:1790416 | LHEVFQSIGP | VEGCKLIRKE | KSSFGFIDYY | DRRSAALAIL | SLNGKPLYGQ | 120 |
| gi\|77551976 | LHEVFQSIGP | VEGCKLIRKE | KSSFGFVDYY | DRRSAAIAIV | SLNGRQLFGQ | 144 |
| CeresClone:703017 | LHEVFQSIGP | VEGCKLIRKE | KSSFGFVDYY | DRRYAALAIV | SLNGRQLFGQ | 141 |
| gi\|92891800 | LQELFSSAGA | LEGCKLIRKD | KSSYGFVDYF | DRSSAALAIV | TLNGRNIFGQ | 111 |
| gi\|6996560 | QEVFASTGP | LEGCKLIRKD | KSSYGFVHYF | DRRSAALAIV | TLNGRHLFGQ | 114 |
| CeresClone:1376400 | QEIFASTGP | VESCKLIRKE | KSSYGFVHYF | DRRSAGLAIM | SLNGRHLFGQ | 130 |
| Lead-CeresClone-115366 | QEIFTSTGP | VESSKLIRKE | KSSYGFIHYY | DRRSAALAIL | SLNGRHLFGQ | 124 |
| gi\|82400162 | QEVFSSTGL | VEGCKLIRKE | KSSFGFIHYF | DRRSAALAIL | SLNGRHLFGQ | 119 |
| CeresAnnot:1446310 | QEVFASTGP | VEGCKLIRKE | KSSYGFVHYF | DRRAAALAIL | SLNGRHLFGQ | 118 |
| CeresClone:1834350 | QEVFASTGP | VEGCKLIRKE | KSSYGFVHYF | DRRSAALAIL | SLNGRHLFGQ | 118 |
| CeresClone:518274 | QEVFSCIGP | VEGCKLIRKD | KSSYGFIHYF | DRRSAALAIL | SLNGRHLFGQ | 122 |

| | | | | | | | | |
|---|---|---|---|---|---|---|---|---|
| CeresClone:1790416 | PIKVNWAYLS | TQREDTSGHF | NIFVGDLCPE | ITDAALFAFF | SGYSTCSDAR | 170 |
| gi\|77551976 | PIKVNWAYAS | TQREDTSGHF | NIFVGDLCPE | VTDAALFAFF | AGFTSCSDAR | 194 |
| CeresClone:703017 | PIKVNWAYAS | TQREDTSGHF | NIFVGDLSPE | VTDAALFAFF | SAYSTCSDAR | 191 |
| gi\|92891800 | SLKVNWAYTR | GQREDTSGHF | HIFVGDLSPE | VTDATLYACF | SAYSSCSDAR | 161 |
| gi\|6996560 | PIKVNWAYAS | AQREDTSNHY | NIFVGDLSPD | VTDATFACF | SVYTSCSDAR | 164 |
| CeresClone:1376400 | PIKVNWAYAT | GQREDTSSHF | NIFVGDLSPE | VTDAALFESF | SAFNTCSDAR | 180 |
| Lead-CeresClone-115366 | PIKVNWAYAS | GQREDTSSHF | NIFVGDLSPE | VTDATLYQSF | SVFSSCSDAR | 174 |
| gi\|82400162 | PIKVNWAFAS | GQREDTSSHF | NIFVGDLSPE | VTDAMLFACF | SVYPGCSDAR | 169 |
| CeresAnnot:1446310 | PIKVNWAYAS | GQREDTSGHF | NIFVGDLSPE | VTDATLYACF | SVYPSCSDAR | 168 |
| CeresClone:1834350 | PVKVNWAYAS | GQREDTSGHF | NIFVGDLSPE | VTDAMLYACF | SVYHSCSDAR | 168 |
| CeresClone:518274 | PIKVNWAYAS | GQREDTSGHY | NIFVGDLSPE | VTDATLFACF | SVYPSCSDAR | 172 |

| | | | | | | |
|---|---|---|---|---|---|---|
| CeresClone:1790416 | PHE--- | ------- | ------- | FFHSLGAGS | EEVRVTRDKG | FGSVRYSTHE | 307 |
| gi|77551976 | PHD--- | ------- | VNSNDVHR | FFHSLGAGS | EEVRVTRDKG | FGFVRYSTHE | 333 |
| CeresClone:703017 | PHD--- | ------- | INSNDVHR | FFHLGAGS | EEVRVTRDKG | FGFVRYSTHE | 330 |
| gi|92891800 | APEARIHT | ------- | VTSVDLHR | HFHALGAGVI | EDVRVRQRDKG | FGFVRYSTHG | 298 |
| gi|6996560 | APE--- | ------- | VTSVDLHR | HFHALGAGVI | EDVRIQRDKG | FGFVRYSSHA | 303 |
| CeresClone:1376400 | APE--- | ------- | VTQLDLHR | LFHDLGAGVI | EEVRVQRDKG | FGFVRYNTHD | 320 |
| Lead-CeresClone:115366 | APE--- | ------- | VTQLDLHR | YFHALGAGVI | EEVRVQRDKG | FGFVRYNTHP | 313 |
| gi|82400162 | APE--- | ------- | VTQLDLHR | YFHALGAGVI | EEIRIQRDKG | FGFVRYNTHA | 308 |
| CeresAnnot:1446310 | SPEARNFSSY | LHVTQPVLHR | HFHVLGAGVI | EEVRVQRDKG | FGFVRFSTHA | 316 |
| CeresClone:1834350 | APE--- | ------- | VTQLELHC | HFHALGAGVI | EEVRVQRDKS | FGFVRYSTHT | 307 |
| CeresClone:518274 | APE--- | ------- | VTQLDLHR | HFHALGAGVM | EEVRVQRDKG | FGFVRYSTHA | 311 |

| | | | | | | |
|---|---|---|---|---|---|---|
| CeresClone:1790416 | EAALAIQMGN | GQ--LIGGRP | RCSWGNKPTP | PGTASSPLPP | PAPS--PFPT | 354 |
| gi|77551976 | EAALAIQTGN | GQ--LIGGRQI | KCSWGSKPTP | PGTASAPLPP | PAPA--PFNP | 380 |
| CeresClone:703017 | EAARAIQTGN | GQ--LIGGRQI | KCSWGSKPTP | PGTASAPLPP | PALA--PYTP | 377 |
| gi|92891800 | EAALAIQMGN | TR--FLFGKP | KCSWGSKPTP | PGTASITPLPP | PASTHVPV--P | 346 |
| gi|6996560 | EAALAIQLGN | AR--LLFGKPV | KCSWGSKPTP | PGSSSNPLPP | PAIG---Q--P | 349 |
| CeresClone:1376400 | EAALAIQMGN | SQPFLFNRQI | KCSWGNKPTP | ICTASNPLPP | PAPV--AV--P | 367 |
| Lead-CeresClone:115366 | EAALAIQMGN | TQPYLFNRQI | KCSWGNKPTP | PGITSNPLPP | PAPV--PV--P | 360 |
| gi|82400162 | EAALAIQMGN | THSVLGGRQI | KCSWGNKPTP | PGTSNPLPP | PAPT--PL--P | 354 |
| CeresAnnot:1446310 | EAAVAIQMGN | AQSLLCGKQI | KCSWGSKPTP | PGTSSNPLPP | PAAA--PL--P | 363 |
| CeresClone:1834350 | GAALAIQMGN | TQSFLCGKQI | KCSWGSKPTP | PGTSSNPLPP | PAAA--PL--P | 354 |
| CeresClone:518274 | EAALAIQMGN | AQSLLCGKPI | KCSWGSKPTP | PGTASNPLPP | PAAA--SL--P | 358 |

Figure 15

| | | | | | |
|---|---|---|---|---|---|
| CeresClone:305612 | MSTMKFCREC | NNILYPKEDR | EQKVLLLYACR | NCDHQEVADN | NCVYRNVVHH |
| gi|77556133 | MSTMKFCREC | NNILYPKEDR | DQKILLLYACR | NCDHQEVADN | NCVYRNVVHH |
| CeresClone:686862 | MSAMKFCREC | NNILYPKEDR | DQKVLLFACR | NCDHQEVADN | NCVYRNVVHH |
| CeresClone:1113246 | MSAMKFCREC | NNILYPKEDR | DQKVLLLYACR | NCDHQEVADN | NCVYRNVVHH |
| gi|87240462 | MSTMKFCREC | NNILYPKEDR | EQKILLLYACR | NCDHQEAADN | FCVYRNEHH |
| Lead-CeresClone-12256 | MSTMKFCREC | NNILYPKEDK | EQSLLLYACR | NCDHQEAADN | NCVYRNEVHH |
| CeresClone:976830 | MSTMKFCREC | NNILYPKEDK | EQSILLYACR | NCDHQEAADN | NCVYRNEVHH |

| | | | | | |
|---|---|---|---|---|---|
| CeresClone:305612 | SAGEFTQVLQ | DVAGDPTLPR | TKSVRCSSCG | HGEAVFFQAT | ARGEEGMTLF |
| gi|77556133 | SAGEFTQVLQ | DVAGDPTLPR | TKAVRCAVCG | HGEAVFFQAT | ARGEEGMTLF |
| CeresClone:686862 | SAGEFTQVLQ | DVAGDPTLPR | TKEVRCAVCG | HGEAVFFQAT | ARGEEGMTLF |
| CeresClone:1113246 | SAGEFTQVLQ | DVAGDPTLPR | TKEVRCAVCG | HGEAVFFQAT | ARGEEGMTLF |
| gi|87240462 | SVAERTQVLQ | DVADPTLPR | TKAVRCVQCN | HGEAVFFQAT | ARGEEGMTLF |
| Lead-CeresClone-12256 | SVSEQTQILS | DVASDPTLPR | TKAVRCAKCQ | HGEAVFFQAT | ARGEEGMTLF |
| CeresClone:976830 | SVXEQTQILS | DVASDPTLPR | TKAVRCAKCQ | HGEAVFFQAT | ARGEEGMTLF |

| | | |
|---|---|---|
| CeresClone:305612 | FVCCNPSCGN | RWRE | 114 |
| gi|77556133 | FVCCNPSCGH | RWRE | 114 |
| CeresClone:686862 | FVCCNPSCGH | RWRE | 114 |
| CeresClone:1113246 | FVCCNPSCGH | ---- | 110 |
| gi|87240462 | FVCCNPNCGH | RWRD | 114 |
| Lead-CeresClone-12256 | FVCCNPNCSH | RWRE | 114 |
| CeresClone:976830 | FVCCNPNCGH | RWRE | 114 |

Figure 16

```
                                                                                           37    87    137   187   237   270
                                                                                           50    100   150   199   249   299
Lead-CeresClone:123804  MALLRLPGIS ----QILGH  KSNQ------ --KNPNPN-V AFTNHSLSLS
CeresClone:670908       MALLRLVCLP STNQLSTQPH SHSQSTSFSF LRKTPHSQPI NFSLSSFHFP Lead-CeresClone:123804  TPSLCRLHRH ATFPDSIPAK SRNLTSYFST TTQEISKTRL AQNVPWTST
CeresClone:670908       RLSLITTKQT LNLTPTHSSI SEQQTEEPLV SEEEFSRTRL LAQNVPWTST Lead-CeresClone:123804  PEDIRSLFEK YG

Figure 17

```
                       ---------- ---------- -MGSNFGG ---------- ---------PT S     23
Lead-CeresClone-125917 MASTATTTLF ISSEFKPNLP NSLLPRIRI ESPDLSLPDS PSKFRATHLS        50
gi|92873189            ---------- ---------- ---------- CNKPLSISLQ HK------LHI S    15
CeresAnnot:1456569     ---------- ---------- ---------- -MNPLNIHSR ----------        0
CeresAnnot:1450998

L---RRSLS  YALRRLFFLP RISFRCW-RE KAALLVGSF  VFLGFC--SS       66
Lead-CeresClone-125917 LCNCSRTPLT ---PSTIFSP QTTLTNFISQ KISFFLIGSF FVACFL--SR       95
gi|92873189            SNICSKSPFP QIPTSSISKK NNNFTSFLSE KVLVSLVGAF FIGSFGLNT        65
CeresAnnot:1456569     ------MSPFP QILTSSLSKT NYKFTNFLSE KVLVSLVGAF FIGSFGLNT        45
CeresAnnot:1450998

KPALALPTAX VVSQAEL--- ---------ED EKMFEKLLEN EPENMEAMKA    105
Lead-CeresClone-125917 KPAFAVSVPS VDSAL----- ---------- EDLEKKILEK DSRNVEALKV    129
gi|92873189            RQSLALPAQT SGGSVNLEGK RDAQMEKSED EEMYEKVLEK EPRNVEALKV    115
CeresAnnot:1456569     RQSLALPAQT TGPSVNLEEK RDAHMEKSED EEMFEKVLEM EPRNVEALKV     95
CeresAnnot:1450998

VVYKKMRRGE NEDAVKYVEK LMKLEPHEVE WKLLEALCYE TMGELSKAKR    155
Lead-CeresClone-125917 VYGKIRRGK  CKEAEKFVKR LIDEEPNEVE WRLLLALCYE TMGYLSKAKG    179
gi|92873189            VLHGKMRRGQ TKEAVKYVGR LIEIEPEEVE WRLLEALCYE MMGQLNKAKR    165
CeresAnnot:1456569     VVHGKMRRGQ TKEAVKYVER LIDIEPEQVE WRLLEALCYE MMGQLSKAKT    145
CeresAnnot:1450998

LYKDILKEQP LLIRALHGLA MVMHKTHD-T SVFDMLEAM  EVARQGNRVT    204
Lead-CeresClone-125917 LYLEILENWP LFVRALHGLA MVMHKNKEGP AVFEMLNKAV ELAFNENKVT    229
gi|92873189            LFNEILEERP LLLRALHGLA LVMHKNLEGP AVFEMLNKAL EVAHREKRVT    215
CeresAnnot:1456569     LFKEILERP  LLLRALHGLA LVMHKSLEGP AVFEMLNKAL EVARREKRVT    195
CeresAnnot:1450998
```

Figure 17 (continued)

Lead-CeresClone-125917    EERNI QVLI G QMHI VEGQFE EGLKI FQQMV NDNPRDFRPY LCQGI VYSLM   254
gi|92873189               EERNI KI LTA QMRVVQGDLE EGLKKRCQDLI DQNPRDFRPY LCQGI I YSLL   279
CeresAnnot:1456569        EERNI RI LI A QMHVVKGDFE EALKKFQGLV SDNPRDFRPY LCQGI I YSLL   265
CeresAnnot:1450998        EERNI RI LI A QMLVVKGELE EALKKFQGLV SDNPRDFRPY LCQGI I YSLL   245

Lead-CeresClone-125917    DKXEEAAQQF ELYMSLVPGE FPQKGFLDDV ALAAQAKSRE RLQNTFKAKF   304
gi|92873189               DKKEEAAKQF ETYQALVPEE FPQRGFLDDI TLAAKGTSPV QFQKEFRNQF   329
CeresAnnot:1456569        DRKEEAAEQF ETYRSLVPEE FPQRIFLDDV VLEAKTKSRE RFQKEFQAEF   315
CeresAnnot:1450998        GRKEAAAEHF ETYQSLVPDE FPQRMFLDDV VLEAKTKSRE WFQEECQAES   295

Lead-CeresClone-125917    TQGR   308
gi|92873189               SDQK   333
CeresAnnot:1456569        SYRK   319
CeresAnnot:1450998        SYKK   299

Figure 18

| | | | | | | |
|---|---|---|---|---|---|---|
| Lead-CeresClone:14203 | MAEE--HRLQ-- | -EPRLCANNC | GFFGSTATQN | LCSKCFRDLQ | HQEQNSSTAK | 47 |
| CeresClone:1021029 | MSEE--HRLQ-- | -EPRLCANDC | GFFGNTATQN | LCSKCFRDLK | HEQENSSTAK | 47 |
| CeresClone:974951 | MSEE--HRLQ-- | -EPRLCANDC | GFFGNTATQN | LCSKCFRDLK | HEQENSSTAK | 47 |
| gi|92896423 | MAEE--HRCQ-- | AAQRLCANNC | GFFGSPAMQD | LCSKCYRDLQ | MKEQRSSSAK | 48 |
| gi|66271037 | MAEE--HRCQ-- | -APQLCANNC | GFFGSPTTQN | LCSECYRGLQ | LKEQQSSSAK | 47 |
| CeresClone:1853189 | MAEE--HRCQ-- | -APQLCANNC | GFFGSPTTQN | LCSKCYRDLQ | LKEQQSSSAK | 47 |
| CeresClone:1853430 | MAEEQHRCQ-- | -EPRLCANNC | GFFGSPATQN | LCSKCYRDLQ | LKEQQSSSAK | 47 |
| 1460527 | MAEEQHRCQ-- | -EQRLCVNNC | GFFGSPATQN | LCSKCYRDLR | QSQ------ | 41 |
| 1450673 | MAEE--QRCQ-- | -EGHRLCANNC | GFYGSQATEN | LCSKCYRDLH | -------QS | 40 |
| CeresClone:1734621 | MAEE--QRCQ-- | EGHRLCANNC | GFLGSPATLN | LCPKCYRDHR | LKEEQ---- | 43 |
| gi|50909195 | MAEE--QRWQE | GCHRLCANNC | GFFGSPATLD | LCSKCYRDRQ | GRE---STAP | 46 |

| | | | | | | |
|---|---|---|---|---|---|---|
| Lead-CeresClone:14203 | HALTQSLAAV | GAAASSVSP | PPPPP------ | ----ADS | KEIVEAKSEK | 85 |
| CeresClone:1021029 | NALKQTLAAC | VASSSVSSPP | PPPPPAD--- | -LTSDL | KEVNTENPGK | 89 |
| CeresClone:974951 | NALKQTLAAC | VASSXVSSPP | PPPPPAD--- | -LTSDL | KEVNTENPGK | 89 |
| gi|92896423 | LVLNQTLPQ | QSNSSSLDTG | IIHPSS----- | -TSPSV | MIVSSSTPTV | 89 |
| gi|66271037 | QAFNHTLVPS | SSSLPSSSSA | RSS------- | FSASL | PAKEEPSAGT | 85 |
| CeresClone:1853189 | QAFNHTLVPS | SSSLPSSSSA | RSS------- | FSASL | PAKEEPSAGT | 85 |
| CeresClone:1853430 | QAFNHTFVPS | SSSLPSSSSA | RSS------- | FSASL | PVEDEPSAGT | 85 |
| 1460527 | -PLNQLLAPS | SSASVSSFSS | PTVDVIKNQ- | -APVL | VVEGDEKGEF | 84 |
| 1450673 | QPLNHQLLNP | SSSSAASVSS | FLASPAVDVLK | VNTNQKAPVV | VVGDDKKDEV | 90 |
| CeresClone:1734621 | -QRQDAS | HAANVAAAEK | PPH------- | -ASSSA | SVVASPAGNA | 77 |
| gi|50909195 | VVVAAAASAC | PATHPSSPSS | SSCPAF----- | -------L | PSSTAAEAGV | 83 |

Figure 18 (continued)

```
Lead-CeresClone-14203  R----AAAEPE EA ADG---PPQD PKRCLTCRRR VGITGFRCRC GFVFCGTHRY 130
CeresClone:1021029     R----AASEPE EEEEQKPPQD PKRCLTCRRR VGITGFRCRC GFVFCGTHRY 136
CeresClone:974951      R----AASEPE EEEEQKPPQD PKRCLTCRRR VGITGFRCRC GFVFCGTHRY 136
gi|92896423            ELVAAAAGPS EAAEP---PKVQ PNRCGTCRRR VGLTGFKCRC GLTLCGTHRY 137
gi|66271037            K------ETKVV EEEE----VQVT PNRCLSCKKR VGLTGFKCRC GMVFCGIHRY 129
CeresClone:1853189     K------ETKVV EEEE----VQVT PNRCLSCKKR VGLTGFKCRC GMVFCGIHRY 129
CeresClone:1853430     K------ETKVV EGEE----VQVT PNRCLSCKKR VGLTGFKCRC GMVFCGIHRY 129
1460527                K------AEPI VVV-----PQQK PNRCLTCRRR VGLTGFKCRC GMVFCGTHRY 126
1450673                K------AGEPA AGKQ---QQHK PSRCAMCRKR VGLTGFKCRC GMVFCGTHRY 134
CeresClone:1734621     RGPPALASPA VAA----AAAG ASRCASCRKR VGLTGFKCRC GATHCGAHRH 124
gi|50909195            V------VA--- ----AVAK ACRC VGLTGFACRC GGTFCGAHRY 120

Lead-CeresClone-14203  AEQHECSFDF KRMGKDKIAK ANPIVKADKL -EKI 163
CeresClone:1021029     AEQHECTFDF KRVGKEKIAK ANPIVKAEKL -EKI 169
CeresClone:974951      AEQHECTFDF KRVGKEKIRK ANPIVKAEKL -EKX 169
gi|92896423            PEQHGCGFDF KGMGREEI-- ANPVVKGEKL -NKI 170
gi|66271037            PGTTCLCF--- --- --- --- 137
CeresClone:1853189     PEQHACAFDF KGMGKQQIAK ANPLVKGEKL -QKI 162
CeresClone:1853430     PEQHACTFDF KGMGKQQIAK ANPLVKGEKL -QKI 162
1460527                PEQHDCEFDF KSLGKEQIAK ANPVVKGEKL -QRI 159
1450673                PEQHDCEFDF KSLGKQQIAK ANPVVKGEKL -QKI 167
CeresClone:1734621     AEQHSCTFDF KAAGREAITR ANPVVKADKL -NRI 157
gi|50909195            PERHACGFDF KAAGRDALAR ANPLIKGDKL KDKI 154
```

Figure 19

```
Lead-CeresClone:1480    MGRGKIEIKR  ENANNRVVT  FSKRRNGLVK  KAKEITVLCD  AKVALIIFAS   50
CeresClone:1067639      MGRGKIEIKR  ENANNRVVT  FSKRRNGLVK  KAKEITVLCD  AKVALIVFAS   50
CeresClone:1068473      MGRGKIEIKR  ENVNNRVLT  FSKRRNGLVK  KAKEITVLCD  AKVALIVFAS   50

Lead-CeresClone:1480    NGKMLDYCCP  SMDLGAMLDQ  YQKLSGTNYG  MLSMRTLAMR  LGSRKR---    97
CeresClone:1067639      NGKMTDYCCP  SMDLGAMLDQ  YQKLSGKKLW  DAKHENLSNE  IDRIKKENDN  100
CeresClone:1068473      NGKMTDYCCP  SMDLGAMLDQ  YQKLSGNKLW  DAKHENLSNE  IDKIKKENDS  100

Lead-CeresClone:1480    -MAYNWSSG   I---------  ----------  ----------  -           107
CeresClone:1067639      LQLELRHLKG  XD--------  ----------  ----------  -           112
CeresClone:1068473      LQLELRHLKG  EDQSLNLKN   LMAVEHAVEH  GLDKVRDHQM  E           141
```

Figure 20

| | | | | | | |
|---|---|---|---|---|---|---|
| gi\|2500073 | | | | | | 0 |
| gi\|401686 | | | | | | 0 |
| gi\|311907 | | | | | | 0 |
| gi\|5902803 | MNFNLLHYWA | FAHIIQGPN | TESPPLVNRE | RKSEKRERDL | WLCIARCSSS | 50 |
| CeresClone:1834939 | | | | | | 0 |
| CeresClone:1840642 | | | | | | 0 |
| gi\|1053067 | | | | | | 0 |
| 1538756 | | | | | | 0 |
| gi\|50911379 | | | | | | 0 |
| CeresClone:727613 | | | | | | 0 |
| CeresClone:1785552 | | | | | | 0 |
| gi\|34914060 | | | | | | 0 |
| gi\|4586580 | | | | | | 0 |
| CeresClone:1932400 | | | | | | 0 |
| CeresClone:1835140 | | | | | | 0 |
| CeresClone:1128644 | | | | | | 0 |
| Lead-CeresClone-1492 | | | | | | 0 |
| gi\|89257443 | | | | | | 0 |

| | | | | | | |
|---|---|---|---|---|---|---|
| gi\|2500073 | ---- | MNPE | ---- | YDYLFKLLL | GDSGVGKSC | LLLRFADDTY | 33 |
| gi\|401686 | ---- | MNPE | ---- | YDYLFKLLL | GDSGVGKSC | LLLRFADDTY | 33 |
| gi\|311907 | ---- | MNPE | ---- | YDYLFKLLL | GDSGVGKSC | LLLRFSDDSY | 33 |
| gi\|5902803 | HRSKT | MNPE | ---- | YDYLFKLLL | GDSGVGKSC | LLLRFADDSY | 88 |
| CeresClone:1834939 | ---- | MERKK | KKLCDFDLFF | YDYLFKLLL | GDSGVGKSC | LLLRFADDSY | 33 |
| CeresClone:1840642 | ---- | MNPE | ---- | YDYLFKLLL | GDSGVGKSC | LLLRFADDSY | 33 |
| gi\|1053067 | ---- | MNPE | ---- | YDYLFKLLL | GDSGVGKSC | LLLRFADDSY | 33 |
| 1538756 | ---- | MNPE | ---- | CSDYLFKLLL | GDSGVGKSC | LLLRFADDSY | 38 |
| gi\|50911379 | ---- | MNPE | ---- | YDYLFKLLL | GDSGVGKSC | LLLRFADDSY | 33 |
| CeresClone:727613 | ---- | MNPE | ---- | YDYLFKLLL | GDSGVGKSC | LLLRFADDSY | 33 |
| CeresClone:1785552 | ---- | MNPE | ---- | YDYLFKLLL | GDSGVGKSC | LLLRFADDSY | 33 |
| gi\|34914060 | ---- | MNPE | ---- | YDYLFKLLL | GDSGVGKSC | LLLRFADDSY | 33 |
| gi\|4586580 | ---- | MNPE | ---- | YDYLFKLLL | GDSGVGKSC | LLLRFADDSY | 33 |
| CeresClone:1932400 | ---- | MNPE | ---- | YDYLFKLLL | GDSGVGKSC | LLLRFADDSY | 33 |
| CeresClone:1835140 | ---- | MNPE | ---- | YDYLFKLLL | GDSGVGKSC | LLLRFADDSY | 33 |
| CeresClone:1128644 | ---- | MT-- | ---- | -IXFLFKLLL | GDSGVGKSC | LLLRFADDSY | 29 |
| Lead-CeresClone-1492 | ---- | MNPE | ---- | YDYLFKLLL | GDSGVGKSC | LLLRFADDSY | 33 |
| gi\|89257443 | ---- | MNPE | ---- | YDYLFKLLL | GDSGVGKSC | LLLRFADDSY | 33 |

Figure 20 (continued)

| | | | | | | |
|---|---|---|---|---|---|---|
| gi\|2500073 | TESYI STI GV | DFKI RTVELD | GKV KLQI WD | TAGQERFRTI | TSSYYRGAHG | 83 |
| gi\|401686 | TESYI STI GV | DFKI RTVELD | GKV KLQI WD | TAGQERFRTI | TSSYYRGAHG | 83 |
| gi\|311907 | LESYI STI GV | DFKI RTVEQD | GKTI KLQI WD | TAGQERFRTI | TSSYYRGAHG | 83 |
| gi\|5902803 | VESYI STI GV | DFKI RTVEQD | GKTI KLQI WD | TAGQERFRTI | TSSYYRGAHG | 138 |
| CeresClone:1834939 | VESYI STI GV | DFKI RTVEQD | GKTI KLQI WD | TAGQERFRTI | TSSYYRGAHG | 83 |
| CeresClone:1840642 | LDSYI STI GV | DFKI RTVEQD | GKTI KLQI WD | TAGQERFRTI | TSSYYRGAHG | 83 |
| gi\|1053067 | -SYI STI GV | DFKI RTVEQD | GKTI KLQI WD | TAGQERFRTI | TSSYYRGAHG | 83 |
| 1538756 | LDSYI STI GV | DFKI RTVEQD | GKTI KLQI WD | TAGQERFRTI | TSSYYRGAHG | 86 |
| gi\|50911379 | LDSYI STI GV | DFKI RTVEQD | GKTMKLQI WD | TAGQERFRTI | TSSYYRGAHG | 83 |
| CeresClone:727613 | LESYI STI GV | DFKI RTVEQD | GKTI KLQI WD | TAGQERFRTI | TSSYYRGAHG | 83 |
| CeresClone:1785552 | LDSYI STI GV | DFKI RTVEQD | GKTI KLQI WD | TAGRERFRTI | TSSYYRGAHG | 83 |
| gi\|34914060 | LDSYI STI GV | DFKI RTVEQD | GKTI KLQI WD | TAGQERFRTT | TSSYYRGAHG | 83 |
| gi\|4586580 | LDSYI STI GV | DFKI RTVEQD | GKTI KLQI WD | TAGQERFRTI | TSSYYRGAHG | 83 |
| CeresClone:1932400 | LDSYI STI GV | DFKI RTVEQD | GKTI KLQI WD | TAGQERFRTI | TSSYYRGAHG | 83 |
| CeresClone:1835140 | LDSYI STI GV | DFKI RTVEQD | GKTI KLQI WD | TAGQERFRTI | TSSYYRGAHG | 83 |
| CeresClone:1128644 | LDSYI STI GV | DFKI RTVEQD | GKTI KLQI WD | TAGQERFRTI | TSSYYRGAHG | 83 |
| Lead-CeresClone-1492 | LDSYI STI GV | DFKI RTVEQD | GKTI KLQI WD | TAGQERFRTI | TSSYYRGAHG | 79 |
| gi\|89257443 | LDSYI STI GV | DFKI RTVEQD | GKTI KLQI WD | TAGQERFRTI | TSSYYRGAHG | 83 |

| | | | | | | |
|---|---|---|---|---|---|---|
| gi\|2500073 | I VVYDVT DQ | ESFNNVKQWL | NEI DRYASEN | VNKLLVGNKS | DLTSKKVVEY | 133 |
| gi\|401686 | I VVYDVT DQ | ESFNNVKQWL | AEI DRYASEN | VNKLLVGNKS | DLTGKKVVDY | 133 |
| gi\|311907 | I VVYDVT DQ | ESFNNVKQWL | SEI DRYASEN | VNKI LVGNKS | DLTANRVVSY | 133 |
| gi\|5902803 | I VYDVT DE | ESFNNVRQWL | SEI DRYASDG | VNKI LVGNKS | DLTENRAPY | 188 |
| CeresClone:1834939 | I VYDVT DQ | DSFNNVKQWL | ENFNNVKQWL | VNKLLVGNKS | DLTANKVVSY | 133 |
| CeresClone:1840642 | I VYDVT DQ | ESFNNVKQWL | SEI DRYASDN | VNKLLVGNKC | DLNDNRAVSY | 136 |
| gi\|1053067 | I VYDVT DQ | ESFNNVKQWL | NEI DRYASEN | VNKLLVGNKS | DLTANKVVSY | 133 |
| 1538756 | I VYDVT DQ | ESFNNVKQWL | NEI DRYASEN | VNKLLVGNKS | DLADKRAVSY | 133 |
| gi\|50911379 | I VYDI T DQ | ESFNNVKQWL | NEI DRYASEN | VNKLLVGNKC | DLAESRVVSY | 133 |
| CeresClone:727613 | I VYDVT DQ | ESFNNVKQWL | NEI DRYASEN | VNKLLVGNKS | DLAENRVVSY | 133 |
| CeresClone:1785552 | I VYDVT DQ | ESFNNVKQWL | NEI DRYASEN | VNKLLVGNKS | DLAANKVVSY | 133 |
| gi\|34914060 | I VYDVT DQ | ESFNNVKQWL | NEI DRYASEN | VNKLLVGNKC | DLTENKVVSY | 133 |
| gi\|4586580 | I VYDVT DQ | ESFNNVKQWL | NEI DRYASEN | VNKLLVGNKS | DLTANKVVSY | 133 |
| CeresClone:1932400 | I VYDVT DQ | ESFNNVKQWL | NEI DRYASEN | VNKLLVGNKS | DLTANKVVSY | 133 |
| CeresClone:1835140 | I VYDVT DQ | ESFNNVKQWL | NEI DRYASEN | VNKLLVGNKS | DLTS---- | 123 |
| CeresClone:1128644 | I VT YDVT DQ | ESFNNVKQWL | NEI DRYASEN | VNKLLVGNKS | DLTSQKVVST | 133 |
| Lead-CeresClone-1492 | I VT YDVT DQL | ESFNNVKQWL | NEI DRYASEN | VNKLLVGNKN | DLTSQKVVST | 133 |
| gi\|89257443 | | | | | | |

Figure 20 (continued)

| | | | | | | |
|---|---|---|---|---|---|---|
| gi\|2500073 | SV AKAFADEI | GI PFLETSAK | NATNVEQAFM | TMAAEI KN-R | MASQPI PTKA | 182 |
| gi\|401686 | QA AKAFADEI | GI PFLETSAK | NATNVEQAFM | TMAAEI KN-R | MASQPVPPKP | 182 |
| gi\|311907 | ET AKAFADEI | GI PFLETSAK | DATNVEQAFM | AMTSAI KN-R | MASQPA NSA | 182 |
| gi\|5902803 | ET GKA ADEV | GI PFMETSAK | DSTNVEQAFM | AMSASI KE-R | MASQPAGNNA | 237 |
| CeresClone:1834939 | ET AKAFADEI | GI PFMETSAK | DATNVEQAFM | AMAASI KD-R | MASQPAMNNA | 182 |
| CeresClone:1840642 | DT AKAFADEI | GI PFME ASAK | SATNVEQAFM | AMAASVKD-R | MATQPA NNA | 182 |
| gi\|1053067 | ET AKAFADEI | GI PFMETSAK | NSTNVEQAFM | AMAAEI KN-R | MASQPASNNA | 185 |
| 1538756 | ET AKAFADEI | GI PFMETSAK | NAL NVEQAFM | AMAASI KD-R | MASQPAA NA | 182 |
| gi\|50911379 | KA GKAL ADEI | GI PFMETSAK | DATNVEKAFM | AMAASI KD-R | MASQPAASGA | 182 |
| CeresClone:727613 | EA GKAL ADEI | GI PFMETSAK | NATNVEQAFM | TMAGE KN-R | MASQPAIT NAS | 183 |
| CeresClone:1785552 | ET AKAFADEI | GI PFMETSAK | DATNVEQAFM | TMAGE KNRR | MASQPA - NNA | 181 |
| gi\|349914060 | ET AKAFADEI | GI PFMETSAK | NATNVEQAFM | AMAAEI KN-R | MASQPAMNNA | 182 |
| gi\|4586580 | ET AKAFADEV | GI PFLETSAK | DSMNVEQAFM | AMAASI KN-R | MASQPG MNNA | 182 |
| CeresClone:1932400 | - - - - - - - - - | - - - - - - - - - | - - - - - - - - - | - - - - - - - - - | - - - - - - - - - | 123 |
| CeresClone:1835140 | ET AKAFADEL | GI PFLETSAK | NATNVEEAFM | AMT AAI KT-R | MASQPA - GGA | 181 |
| CeresClone:1128644 | ET AQAFADEL | GI PFLETSAK | NATNVEEAFM | AMT AAI KT-R | MASQPS - GGA | 181 |
| Lead-CeresClone:1492 | | | | | | |
| gi\|89257443 | | | | | | |

| | | | | |
|---|---|---|---|---|
| gi\|2500073 | GG PVVRPQEG | KPI NS KSSSC | C - - | 203 |
| gi\|401686 | GG PVVRPTEG | KPI NN KSSSC | C - - | 203 |
| gi\|311907 | - KPPTVN RG | QPVT - QSGGC | CSS | 203 |
| gi\|5902803 | - RPPTVQI RG | QPVA - QKNGC | CST | 258 |
| CeresClone:1834939 | - KPPTVQI RG | QPVA - QK GGC | CSS | 203 |
| CeresClone:1840642 | - KPPTVQI RG | QPVN - QQSGC | CSS | 203 |
| gi\|1053067 | - RPPTVQI RG | QPVN - QKNGC | CSS | 206 |
| 1538756 | - RPPTVQI RG | QPVN - QKTSC | CSS | 203 |
| gi\|50911379 | - RPATVQI RG | QPVE - QKASC | CSS | 203 |
| CeresClone:727613 | - SRPATVQMRG | QPVA - Q - - | - - | 197 |
| CeresClone:1785552 | - KPATVQMRG | QPVA - QQSSC | CS - | 203 |
| gi\|349914060 | - RPPTVQI RG | QPMN - QKSGC | CST | 202 |
| gi\|4586580 | - RPPTVQI QG | QAVA - QKSGC | CSS | 203 |
| CeresClone:1932400 | - RPPTVN KG | QPVN - QNSGC | CSS | 123 |
| CeresClone:1835140 | - - - - - - - - - | - - - - - - - - - | - - - | 202 |
| CeresClone:1128644 | - KPPTVQI RG | QPVN - QQSGC | CSS | 203 |
| Lead-CeresClone:1492 | - KPPTVQI RG | QPVNQQSSGC | CSS | 203 |
| gi\|89257443 | | | | |

| | | | | | |
|---|---|---|---|---|---|
| CRGSLKRIRS | RDLWVLTNYN | DVIDPANLER | ENVRQFYSYI | DSLPLILPDN | 244 |
| CRGSLKRIRS | TDLWVLTNSN | DVIDPAHLEK | ENVRHFYSYI | DSLPLILPDS | 243 |
| CRGSIKRVNS | EDLWVLTCDE | DVVDPETVTK | EDLRFYLHI  | NSLPKDYPEA | 241 |
| CRGSLKRVNS | EDLWVLTCNN | EVVDTKAVSK | EDLSRFYLYV | NSLPKDYHDS | 236 |
| CRGSLRRVNS | EDLWVLTCNE | DVVDAETVSK | EDLRFYLYI  | NSLPKDHPDA | 246 |
| CRGSLRRVNS | EDLWVLTCDE | DVVDAETVSK | EDLRFYLYI  | NKLPKDNPDA | 249 |

| | |
|---|---|
| IFFFYDYLI  | 254 |
| IFFFYEYLL  | 253 |
| AFLVYNEYLI | 251 |
| LFLMYYEYLI | 246 |
| LFLMYYEYLI | 256 |
| LFLMYYEYLI | 259 |

CeresClone:1831324
CeresClone:398632
Lead-CeresClone-156298
CeresAnnot:1512948
CeresClone:659211
gi|92877546

CeresClone:1831324
CeresClone:398632
Lead-CeresClone-156298
CeresAnnot:1512948
CeresClone:659211
gi|92877546

Figure 22

| | | | | | |
|---|---|---|---|---|---|
| gi\|45387429 | -MATNSSHS | PRTVEEIFKD | FSARHAAVLR | ALTT DVEDFY | SQCDPERDNL | 49 |
| CeresClone:477995 | ----MEMAST | PRTVEEIFKD | YTARRTAIVR | ALSQDVDEFY | GLCDPDKENL | 46 |
| CeresAnnot:1518013 | -------MAS | PRTVEEIFKD | YNARRSALVR | ALTI EADEMY | LQCDPEKENL | 43 |
| Lead-CeresClone-156373 | ----MAAAVSSN | PRTVEEIFKD | YSARRAALLR | ALTKDVDDFY | SQCDPEKENL | 49 |
| CeresClone:1393778 | -----MAAVSSN | PRTVEEIFKD | YTARRSALLR | ALTVDVDEFY | SQCDPEKENL | 47 |
| gi\|34900462 | MEMAAPVSPA | PRTVEDIFKD | FSGRRAGLVR | ALTVDVDEFY | GFCDPEKENL | 50 |
| CeresClone:1826835 | -MTPASVSSN | PRSVEEIYKD | FSGRRAGLVR | ALTSDVDDFY | SSCDPDKENL | 49 |
| Consensus | -----A-VSS- | PRTVEEIFKD | YSARRAALVR | ALT-DVDDFY | SQCDPEKENL | 50 |

| | | | | | |
|---|---|---|---|---|---|
| gi\|45387429 | CLYGHPNESW | EVAPAEEVP | PELPEPVLGI | NFARDGME RR | DWLSLVAMHT | 99 |
| CeresClone:477995 | CLYGHPNETW | EVTL PAEEVP | PELPEPALGI | NFARDGMNRR | DWLSLVAVHS | 96 |
| CeresAnnot:1518013 | CLYGHPNESW | EVTL PAEEVP | PELPEPALGI | NFARDGMT RK | DWLSLVAVHS | 93 |
| Lead-CeresClone-156373 | CLYGHPNESW | EVNPAEEVP | PELPEPALGI | NFARDGMQRK | DWLSLVAVHS | 99 |
| CeresClone:1393778 | CLYGHPNESW | EVAPAEEVP | PELPEPALGI | NFARDGMQRK | DWLSLVAVHS | 97 |
| gi\|34900462 | CLYGHPNGRM | EVAPAEEVP | PEMPEPALGI | NFARDGMHRR | DWLSLVAVHS | 100 |
| CeresClone:1826835 | CLYGLPSGTW | AVAPAEEVP | PELPEPALGI | NFARDGMQRR | DWLSLVAVHS | 99 |
| Consensus | CLYGHPNESW | EV-LPAEEVP | PELPEPALGI | NFARDGMQRR | DWLSLVAVHS | 100 |

| | | | | | |
|---|---|---|---|---|---|
| gi\|45387429 | DSWLLSVAFY | FGARLNRNER | SRVFTLINDL | PTVFEAVTGR | KPLKD-KPSV | 148 |
| CeresClone:477995 | DSWLLSVAFY | LGARLNRNER | KRLFSLINDL | PTVFEVVTER | KPVKD-KPTA | 145 |
| CeresAnnot:1518013 | DSWLLSVGFY | FGARLNRNER | KRLFSMVNDL | PTLFEIVTGR | KPVED-KPSA | 142 |
| Lead-CeresClone-156373 | DCWLSVSFY | FGARLNRNER | KRLFSLINDL | PTLFDVVTGR | KAMKDNKPSS | 149 |
| CeresClone:1393778 | DCWLLSVAFF | FGARLNGNER | KRLFSLINDH | PTLFDVVTGR | KPIKDNKPSS | 147 |
| gi\|34900462 | DSWLISVAFF | FGARLNANDR | KRLFSMVSDL | PTVLEALSDR | KHGRDNKSGA | 150 |
| CeresClone:1826835 | | | | PSVFEAFSDR | KHGRD-RSGV | 148 |
| Consensus | DSWLLSVAFY | FGARLNRNER | KRLFSLINDL | PTVFEVVTGR | KPVKD-KPSA | 150 |

| | | | | | |
|---|---|---|---|---|---|
| gi\|45387429 | DSGKKSKNNA | KREKQMKANQ | RL------QEE | SDDEDE---G | NEDEHEETLC | 190 |
| CeresClone:477995 | DSGSKSRGST | KRSSDGQVKS | N-------PKF | ADDGYE--D | EDDEHSETLC | 186 |
| CeresAnnot:1518013 | DQGSKSRNNT | KRSTDGQARS | NS------PKL | -KLSYV--E | DEDEHGDTLC | 180 |
| Lead-CeresClone-156373 | DGSKSRNGT | KRSIDGQTKS | ST------PKL | MEESYE-EEE | EEDEHGDTLC | 193 |
| CeresClone:1393778 | DSGSKSRNGT | KRSIEGQTKS | PT------PRP | MEESYE-DEEE | EEEHSETLC | 192 |
| gi\|34900462 | DNGSKSRHSG | KRANDVQTKT | SR-----PAV | VDDGYD----**|** | JEEEHTETTFC | 190 |
| CeresClone:1826835 | DSGKSKSRHSS | KRGSDGHVKN | SRAAPAAKQ | YDDDDD----[| | DDEEHTETFC | 195 |
| Consensus | DSGSKSRNNT | KRSSDGQ-KS | N-------PK- | -DD-YE----E | -EDEH-ETLC | 200 |

Figure 22 (continued)

|  | | | | | | |
|---|---|---|---|---|---|---|
| gi\|45387429 | GSCGT NGNED | EFWI GCDMCE | KWY HGKCVKI | TPAKAQSI KE | YRCPSC–SNK | 239 |
| CeresClone:477995 | GSCGGNY NAD | EFWI GCDI CE | RWF HGKCVKI | TPAKAESI KQ | YKCPSC–SLR | 235 |
| CeresAnnot:1518013 | GSCGGNY NAD | EFWI GCDI CE | RWY HGKCVKI | TPAKAESI KQ | YKCPSC–STK | 229 |
| Lead-CeresClone:156373 | GSCCGHY TNE | EFWI CCDVCE | RWY HGKCVKI | TPAKADSI KQ | YKCPPC–CAK | 242 |
| CeresClone:1393778 | GI CGGNY TQD | EFWI CCDI CE | RWF HGKCVKI | TPAKAEH LKH | YKCPPPC–CAK | 241 |
| gi\|34900462 | GT CGGRY NAN | EFWI GCDI CE | RWY HGKCVRI | TPAKAEH LKH | YKCPDC SSK | 240 |
| CeresClone:1826835 | GT CGGL YNSN | EFWI GCDI CE | RWF HGKCVRI | TPARADH LKH | YKCPDC SSK | 244 |

Consensus  GSCGGNYN-D  EFWI GCDI CE  RWY HGKCVKI  TPAKAESI KQ  YKCP-C-S-K  250

| | |
|---|---|
| gi\|45387429 | RAK HMA | 245 |
| CeresClone:477995 | RGRP --- | 239 |
| CeresAnnot:1518013 | KSRH --- | 233 |
| Lead-CeresClone:156373 | KGRQ --- | 246 |
| CeresClone:1393778 | KGRQ --- | 245 |
| gi\|34900462 | KSRQ --- | 244 |
| CeresClone:1826835 | KMRQ --- | 248 |

Consensus  K-RQ---  256

Figure 23

```
Lead-CeresClone-158240  MCGGAIISDF         PPPR----S  LRVTNEFIWP  DL---KNKVK  ASKKRSNKRS   43
gi|37538128             MCGGGSIISDY        DPSRT---S  RRLTAEFLWG  RFDLGKKQKN  PNNYHSKAKH   47
gi|84453218             MCGGAIISDF         PAAAVGGS   RRVTADILWP  NL--------  ---RKTGSKK   39

Lead-CeresClone-158240  DFFDLDDDFE         ADFQGFKDDS  AFDCE-----  D--DDDVFVNVKP  FVFTATTKPV   89
gi|37538128             LRSEVDDFE          ADFQDFKELS  D-------   DEDVQVDVKP  FAFSASKHST   88
gi|84453218             SSFLLDDDFE         AGFRQFKDDS  DEDEDEDD    DEGLLVGVKG  FTFAASNNKS   89

Lead-CeresClone-158240  ASAFVSTGIY         LVGSAYAKKT  V-ESAEQAEK  SSKRKRKNQY  RGI RQRPWGK   138
gi|37538128             ---------          -GSKSLKTV   DSDKDAAADK  SSKRKRKNQY  RGI RQRPWGK   126
gi|84453218             SRNFSR-----        GSAGAKSV   ASKSNEQAEK  ESKRKRKNQY  RGI RQRPWGK   133

Lead-CeresClone-158240  WAAEIRDPRK         GSREWLGTFD  TAEEAARAYD  AAARRIRGTK  AKVNFPEEKN    188
gi|37538128             WAAEIRDPRK         GVRVWLGTFN  TAEEAAKAYD  IEARRIRGKK  AKVNFPDE-A    175
gi|84453218             WAAEIRDPRK         GVRVWLGTFN  TAEEAARAYD  AEARRIRGKK  AKVNFPDE-A    182

Lead-CeresClone-158240  PSVVSQKRPS         AKTNNLQKSV  AKPNKSVTLV  QQPTHLSQQY  CNNSFDNSFG    238
gi|37538128             PAPASRHTVK         VNPQKVL--   --PEESLYSL  QSDSAI----  MNSVEDDHYD    216
gi|84453218             PN-ASSKRLK         TNPDNQL     --LNKNLNSF  KPNGNNKMFN  FSENMENFYS    226

Lead-CeresClone-158240  DMSFMEEKPQ         MYNNQFGLTN  SFDAGGNNGY  --------    QYFSSDQGSN    278
gi|37538128             SFGFFEEKP-         -MTKQYGYEN  GSSASADTGF  GSFVPSAGGD  IYFNSDVGSN    264
gi|84453218             PMDQVEQKP-         LVNNQYG---  AADIGAFTGN  GVHLAPADVN  AYFSSEHSSN    272
```

Figure 23 (continued)

```
Lead-CeresClone-158240  SFDCSEFGWS DHGPKTPEIS SML---VNNN EASFVEET NA AKKL----- 319
gi|37538128             SFECSDFGWG EPCSRTPEIS SVLSAAI ECN EAQFVEDANS QKKL----- 308
gi|84453218             SFDYSDLCWG EQGPKTPEIS SVFSAPLEAE PQMNMQSNNS QDMLPMQAES 322

Lead-CeresClone-158240  ------KPNSDE SDDLMAYLDN ALWD--TPLE VKAMLGADAG AVTQEENPV  363
gi|37538128             -KSCTNNPVA  DDGNPRYYGT ---------- -ASLLGAD-- ---------  327
gi|84453218             AKTLSEELAD  IESQLKFFEN SFDDNWSDAS LKAMLGADAG VTQDAGNM   369

Lead-CeresClone-158240  ELWSLDEINF MLEGDF                                          379
gi|37538128             ---WSFDDLPS DAGGVE                                          327
gi|84453218             NLWSFDDLPS  DAGGVE                                          385
```

Figure 24

| | | | | | |
|---|---|---|---|---|---|
| Lead-CeresClone:16284 | MVSPENTNWL | SDYPL LI EGA | FSDQNPTFPW | QI DGSA TVS | VL EVDGFLCD | 47 |
| CeresClone:976709 | MVFPENTNWL | SDYPLLI DGV | FSHHSPTFPW | QI DGSATTVS | VE EVDGFLCD | 50 |

| | | | | | |
|---|---|---|---|---|---|
| Lead-CeresClone:16284 | ADVI KEPSSR | KRI KTESCTG | SNSKACREKQ | RRDRLNDKFT | ELSSVLEPGR | 97 |
| CeresClone:976709 | SDVI KEPGSK | KRVKSESNAG | PSSKACREKQ | RRDKLNDKFT | ELSSI LEPGR | 100 |

| | | | | | |
|---|---|---|---|---|---|
| Lead-CeresClone:16284 | TPKTDKVAI I | NDAI RMVNQA | RDEAQKLKDL | NSSLQEKI KE | LKDEKNELRD | 147 |
| CeresClone:976709 | APKTDKVAI I | NDAI RMVNQA | RDEAQRLKDL | NSNLQEKI KE | LKDEKNELRD | 150 |

| | | | | | |
|---|---|---|---|---|---|
| Lead-CeresClone:16284 | EKQKLKVEKE | RI DQQLKAI K | TQPQPQPCFL | PNPQTLSQAQ | APGSKLVPFT | 197 |
| CeresClone:976709 | EKQKLKTEKD | RI EQQLKAI N | T-----QPCXL | PNPPTLXQAQ | AXGXKLVPFT | 196 |

| | | |
|---|---|---|
| Lead-CeresClone:16284 | TYPGFAMWQF | MPPAAVDTSQ | DHVLRPPVA | 226 |
| CeresClone:976709 | TYPGFAMWQF | MPPAAVDTSQ | DHVLXPPVA | 225 |

```
Lead-CeresClone-1845    MKI IVSI LVL  ASLLLL SSSL  ASATI SDA FG   SGAVA PA PQS  KDGPALE KWC   50
CeresAnnot:1483577      MKLSFAA LLL   LSVVLL SSFL  RFTM --- AVP   NHVAS PPPPS   ---PAI PSFC   44
CeresClone:890211       MKLVFGT LLL   CSLLLSF SFL  EPVI --- AYE   D--- -        ------ SSYC   32
CeresClone:556120       MKLVFAT LLL   CSLLLSS SFL  EPVI --- AYE   D--- -        ------ SSYC   32

Lead-CeresClone-1845    GQKCEG RCKE   AGMKDRCL KY   CGI  CCKDCQC  VPSGTYGNKH    ECA CYRDKLS   100
CeresAnnot:1483577      DPKCCKA RCAK  AGKYQRCY DY   CG□  CCKDCKC  VPSGTYGNKS    ECP CYRDKLN    94
CeresClone:890211       SNKCAD RCSS   AGVKDRCVKY   CGI  CCVE CKC  VPSGTYGNKH    ECP CYRDKLN    82
CeresClone:556120       SNKCSD RCSS   AGVKDRCLRY   CGI  CCAE CKC  VPSGTYGNKH    QCP CYRDKLN    82

Lead-CeresClone-1845    SKGTPKCP      108
CeresAnnot:1483577      SKGTSKCP      102
CeresClone:890211       KKGKPKCP       90
CeresClone:556120       KKGKPKCP       90
```

Figure 27

| Sequence | Alignment Block 1 | | | Pos |
|---|---|---|---|---|
| CeresClone:1674566 | ------MSS | SI SMMEARMP | PGFRFHPRDD ELVMDYLLQK LSGHGH---- | 39 |
| Lead-CeresClone-205648 | METEEEMKES | SI SMVEAKLP | PGFRFHPKDD ELVCDYLMRR SLHNNH---- | 46 |
| gi|34558777 | ------MSSNS | SLSVVESKLP | PGFRFHPRDE ELI CDYLMKK LDQSPD---- | 41 |
| CeresAnnot:1456842 | -------MS | NI SFVEAKLP | PGFRFHPRDE ELVCDYLMKK ASHCDS---- | 38 |
| gi|151148912 | -------MS | NI SMVEAKLP | PGFRFHPRDE ELVCDYLMKK LTHNDS---- | 38 |
| CeresClone:577178 | -------MS | NI SMVEARLP | PGFRFHPRDE ELVCDYLERK VQHNDS---- | 38 |
| gi|1021139801 | ------MAMS | HLSMVEARLP | PGFRFHPRDD ELVLDYLSRK VSGENGNG-- | 42 |
| CeresClone:644344 | ------MS | SLSMVEARLP | PGFRFHPRDD ELVLDYLERK LGGGAGGAA | 42 |
| gi|52076897 | ------MSGMN | SLSMVEARLP | PGFRFHPRDD ELVLDYLERK LLDGGVGGAA | 45 |

| Sequence | Alignment Block 2 | | | Pos |
|---|---|---|---|---|
| CeresClone:1674566 | -------HAG | AAI VVDVDLN | KCEPWDLPDS ACVGGKEWYF FSLRDRKYAT | 82 |
| Lead-CeresClone-205648 | -------RP | PLVLI QVDLN | KCEPWDI PKM ACVGGKDWYF YSQRDRKYAT | 88 |
| gi|34558777 | -------QQQQ | YPFLI EVDLN | KSEPWEI PEV ACVGGKEWYF YSQRDRKYAT | 85 |
| CeresAnnot:1456842 | -------- | -LLMI EVDLN | KCEPWDI PET ACVGGKDWYF YSQRDRKYAT | 77 |
| gi|151148912 | -------- | -LLMI DVDLN | KCEPWDI PET ACVGGKEWYF YTQRDRKYAT | 77 |
| CeresClone:577178 | -------- | -LLLI DVDLN | KCEPWELPEM ACVGGKEWYF FNLRDRKYAT | 77 |
| gi|1021139801 | ------GMHG | WPVI VDVDLN | KCEPWELPEM ACVGGKDKEWYF YSLRDKKYAT | 86 |
| CeresClone:644344 | AAVA--SI YG | CPAMVDVDLN | KIEPWDLPEI ACI GGKEWYF YSLRDKKYAT | 90 |
| gi|52076897 | AAAAAVTI YG | CPVMVDVDLN | KCEPWDLPEI ACVGGKEWYF YSLRDRKYAT | 95 |

| Sequence | Alignment Block 3 | | | Pos |
|---|---|---|---|---|
| CeresClone:1674566 | GQRTNRATHS | GYWKATGKDR | AVVAGGEDAV AVGMRKTLVF YRGRAPRGRK | 132 |
| Lead-CeresClone-205648 | GLRTNRATAT | GYWKATGKDR | TI LRKG----K LVGMRKTLVF YQGRAPRGRK | 135 |
| gi|34558777 | GLRTNRATVS | GYWKATGKDR | AVVRKG----S VGMRKTLVF YQGRAPKGRK | 132 |
| CeresAnnot:1456842 | GLRTNRATAS | GYWKATGKDR | HI LRKG----T LVGMRKTLVF YQGRAPKGKK | 124 |
| gi|151148912 | GLRTNRATAS | GYWKATGKDR | PI LRKG----T VGMRKTLVF YQGRAPKGRK | 124 |
| CeresClone:577178 | GLRTNRATAS | GYWKATGKDR | RVARRG----M VGMRKTLVF YGRAPKGRK | 124 |
| gi|1021139801 | GLRTNRATRS | GYWKATGKDR | RVARRG----M VGMRKTLVF HVGMRKTLVF YRGRAPKGRK | 133 |
| CeresClone:644344 | GQRTNRATES | GYWKATGKDR | AI SRKG----L LVGMRKTLVF YEGRAPKGKK | 137 |
| gi|52076897 | GQRTNRATES | GYWKATGKDR | PI SRKG----L LVGMRKTLVF YKGRAPKGKK | 142 |

Figure 27 (continued)

```
                                                                              178
CeresClone:1674566      TEWVMHEFRL  HPHAAPCLLP  A--AANKED  WVLCRVFYKS  -RTTTPR-PE   178
Lead-CeresClone-205648  TDWVMHEFRL  QGSH------PP  NHSLSSPKED  WVLCRVFHKN  TEGVI-CR-DN  181
gi|34558777             SDWVMHEFRL  EGPLNNIRP   Q--ISSPRED  WVLCRVFHKN  KELLAAKQG    179
CeresAnnot:1456842      TDWVMHEFRI  EGPLG----QP K--TSSEKED  WVLCRVFYKN  TREVVAK-PS   168
gi|15148912             TEWVMHEFRI  EGPHG----PP K--VSSSKED  WVLCRVFYKS  -REVSAK-PS   167
CeresClone:577178       TDWVMHEFRI  EGPHG----PP N--ISSSKED  WVLCRVFYKN  -SEVLAK-PS   167
gi|102139801            TDWVMHEFRI  EPSSN----PP N-----FSFEED  WVLCRVSSKT  -RGVITK-PD   175
CeresClone:644344       TEWVMHEFRK  EGQGDL MKLP  L-----KED   WVLCRVFYKT  -RTTTAK-PS   179
gi|52076897             TEWVMHEFRK  EGQGDPMKLP  L-----KED   WVLCRVFYKS  -RTTLAK-PT   185

211
CeresClone:1674566      SED---ARDG  TPSAESQLPA  ALPLAPLADT                    AAPTV        211
Lead-CeresClone-205648  MGS----CF   DETASASLPP  ----MDP---  YL----         EPSSYLSDDH   216
gi|34558777             TSSNNI YYDD GTI GSSSLPP  ----MENP--  YINFDQ         TQPNNNI NM   220
CeresAnnot:1456842      IRS----CY   DDTGSSSLPA  L---MDS---  YITFDQ         TQPNLDE---   200
gi|15148912             MGS----CY   EDTGSSSLPA  L---MDS---  YISFDQ         TQAHADE---   199
CeresClone:577178       MGS----CY   EDTGSSTLPA  L---MDS---  YISFDQ         TQTHADE---   199
gi|102139801            VKN----YD   DDTISSSLPP  L---RNT---  YITFDQ         APRSLEG---   207
CeresClone:644344       TGS----NYNI DSAAATSLPP  L---DN----  YIAFDHPGMS     TVQNLEG---   217
gi|52076897             EGS----YNNI DSVATTSLPP  L---TDN---  YIAFDQPG--     SMQNLEG---   221

239
CeresClone:1674566      ---AEKVMC   LSGL-PEL    LNSNLTNSVS  PFRRPVSLGD   LLAFE-----GGSA  239
Lead-CeresClone-205648  HYIINEHVPC  FSNL-SQNQT  FTSHSHHHH   ELKIPCKNPN   PLFT--GGSA GGFP 263
gi|34558777             NELYEQVPC   FSIFTPNQTT  -TNQNFPYIT  PATSTTTGAT   PLTAYGGPFGQVP    270
CeresAnnot:1456842      ---HEQVPC   FSIF-SQIQ-  -ANPIFNHMT  QMEVPNLP-T   KGTGPFGQVP       242
gi|15148912             ---FEQVPC   FSIF-SQNQ-  -ANPIFNHMT  TME-PKLP--   --ATTYGGAP       237
CeresClone:577178       ---FEQVPC   FSIF-SQNQ-  -TNPIFNHMT  TME-PKFPLN   HATTTYGGAP       241
gi|102139801            ---FEQVPC   FSNF-TAQL-  ----        AAAAPPVGSP   DLSY-----        235
CeresClone:644344       ---YEQVPC   FSNG-PSSH-  ----PSSA    SMNIPVMAMA   PMAADQEQ---      254
gi|52076897             ---YEQVPC   FSNN-PSQQ-  ----        PSSSMNVPLT   SAMVDQEQ---      253
```

Figure 27 (continued)

```
CeresClone:1674566       ------------ASEKES VLTVMTS------------------VSNNTS-   258
Lead-CeresClone-205648   SATLTGLDSF C----SSDQMV RALLSQ------------------LTKIDG-   293
gi|34558777              ADIGNYLNAT ATSSTCDNKV KAVLSHLST KNIIMEGNNN NSNFNNSSAQ   320
CeresAnnot:1456842       MNITTHSDAF ----SCDTKV KAVLNH-----------------FNMMES-   271
gi|15148912              -NLGYCLDPL ----SCDRKV KAVLSQ------------------TKMER-   265
CeresClone:577178        -NLGYCLDPL ----SCDRKM KAVLNQ------------------TKMER-   269
gi|102139801             ---------- YDNKFS TRPAFDH------------------FPKLNPP   255
CeresClone:644344        ---------- QHMGKA KDALSQ------------------LTRFEQG-   274
gi|52076897              ---------- NNMGRA KDVLSQ------------------FTKFEG-   272

CeresClone:1674566       SVLELTPNC- --------- NWNQENGM-S RMWSPLGI---   284
Lead-CeresClone-205648   SLGPKESQS- -YGEGSSE- SLTDIGIPS TVWNC------   324
gi|34558777              NIMNIKGGNS PSFGEVSSET SFLSEVAYHP TMWNNY-----   356
CeresAnnot:1456842       --NANIKCS PSLGEGSSE- SYLSDVGM-P NLWNHY-----   302
gi|15148912              NPLNQSLKGS TSFGEGSSE- SYLSEVGM-P HMWNNY-----   299
CeresClone:577178        NPLNQSLKGS PSLGEGSSE- SYLSEVGM-P HVWNY------   302
gi|102139801             NIIQENLE-- --------- SYFGENAV-S HMRNPF-----   278
CeresClone:644344        NVKREAPAQG GVFAQDGF-- EYLAESGF-S QMWNSLS----   308
gi|52076897              NVKREALQS- -NFSQDGF-- DYLAESGF-T QMWNSLS----   304
```

FIGURE 28

| | | | | | |
|---|---|---|---|---|---|
| SEQ-ID-NO-568-GI:6850309 | MYQSSSSTSS | SSQRSSLPGG | GGLIRYGSAP | GSFLNSVVDE | VIGGGSSNAR | 50 |
| SEQ-ID-NO-566-CLONE:21406 | MYQSSSSTSS | SSQRSSLPGG | GGLIRYGSAP | GSFLNSVVDE | VIGGGSSNAR | 50 |
| SEQ-ID-NO-567-GI:24030386 | MYQSSSSTSS | SSQRSSLPGG | GGLIRYGSAP | GSFLNSVVDE | VIGGGSSNAR | 50 |
| SEQ-ID-NO-572-ANNOT:1498288 | MYQQPSSSSS | SPQKPTVP-- | ---------- | SGFLTRAVDS | VIGVD----R | 44 |
| SEQ-ID-NO-574-ANNOT:1471938 | MYQQPSSSSS | SPQKSNLP-- | ---------- | SGFLTRAVDS | VIGAD----R | 44 |

| SEQ-ID-NO-568-GI:6850309 | DFTGYQPSSD | NFIGN---- | FFT | GAADSSSLRS | DSTTCGVNNS | SDGQKQLGNN | 98 |
| SEQ-ID-NO-566-CLONE:21406 | DFTGYQPSSD | NFIGN---- | FFT | GAADSSSLRS | DSTTCGVNNS | SDGHKQLGNN | 98 |
| SEQ-ID-NO-567-GI:24030386 | DFTGYQPSSD | NFIGN---- | FFT | GAADSSSLRS | DSTTCGVNNS | SDGQKQLGNN | 98 |
| SEQ-ID-NO-572-ANNOT:1498288 | ELSGL---GST | SLVGSRQYFS | G----DSPSVTS | EST-CKVNPS | SCDPKAPKSG | 89 |
| SEQ-ID-NO-574-ANNOT:1471938 | ELSGL---GST | PLVGRQQHFS | G----DSPSITS | EST-CKVNSS | SCDRKAPKSG | 89 |

| SEQ-ID-NO-568-GI:6850309 | NNNNSNKDIF | LDRSYGGFNE | SQQHKSNDI | LARQRSSPAD | 148 |
| SEQ-ID-NO-566-CLONE:21406 | NNNNSNKDIF | LDRSYGGFNE | SQQHKSNDI | LARQRSSPAD | 148 |
| SEQ-ID-NO-567-GI:24030386 | NNNNSNKDIF | LDRSYGGFNE | SQQHKSNDI | LARQRSSPAD | 148 |
| SEQ-ID-NO-572-ANNOT:1498288 | GSSGS----- | LQRSY-CFNE | VAH------- | LVRQRSSPAG | 120 |
| SEQ-ID-NO-574-ANNOT:1471938 | GGGG------ | LQRSY-GLNE | AH-------- | LVRQRSSPAG | 119 |

| SEQ-ID-NO-568-GI:6850309 | FFTYLASDKN | NFSLNQPTSD | YSPQGGSNGG | RGHSRLKSQL | SFTNHDSLAR | 198 |
| SEQ-ID-NO-566-CLONE:21406 | FFTYLASDKN | NFSLNQPTSD | YSPQGGSNGG | RGHSRLKSQL | SFTNHDSLAR | 198 |
| SEQ-ID-NO-567-GI:24030386 | FFTYLASDKN | NFSLNQPTSD | YSPQGGSNGG | RGHSRLKSQL | SFTNHDSLAR | 198 |
| SEQ-ID-NO-572-ANNOT:1498288 | FLSHLATENG | GFSI-TRESGG | YNAHSGPGGG | HSVSRLKPQL | SFTRQESLSQ | 170 |
| SEQ-ID-NO-574-ANNOT:1471938 | FLSHLATENG | GFSI-TRGTGG | YNSRNGSGGG | P--SRLKSQL | SFTRQDSLSQ | 167 |

| SEQ-ID-NO-568-GI:6850309 | NEVNETPV-- | -----HDG | SGHSFSAASF | GAATTDSWDD | GSGSIGFTVT | 240 |
| SEQ-ID-NO-566-CLONE:21406 | NEVNETPV-- | -----HDG | SGHSFSAASF | GAATTDSWDD | GSGSIGFTVT | 240 |
| SEQ-ID-NO-567-GI:24030386 | NEVNETPV-- | -----HDG | SGHSFSAASF | GAATTDSWDD | GSGSIGFTVT | 240 |
| SEQ-ID-NO-572-ANNOT:1498288 | SEVSENVME | GIGSDNNHQN | CTHSYSAAGF | G--MESWDN | -PNSIVFS-G | 215 |
| SEQ-ID-NO-574-ANNOT:1471938 | SEVSENVME | GIGSDNGSQN | STHSYSAASF | G--MESWDT | -PNSIVFS-G | 212 |

| SEQ-ID-NO-568-GI:6850309 | RPSKRSKDMD | SGLFS----- | --QYSLPSDT | -SMNYMDNFM | QLPEDSVPCK | 282 |
| SEQ-ID-NO-566-CLONE:21406 | RPSKRSKDMD | SGLFS----- | --QYSLPSDT | -SMNYMDNFM | QLPEDSVPCK | 282 |
| SEQ-ID-NO-567-GI:24030386 | RPSKRSKDMD | SGLFS----- | --QYSLPSDT | -SMNYMDNFM | QLPEDSVPCK | 282 |
| SEQ-ID-NO-572-ANNOT:1498288 | PPSK------ | ---------- | --QFSLPQTS | LELETVEKLL | HVPEDSVPCK | 247 |
| SEQ-ID-NO-574-ANNOT:1471938 | HPSKQARTGD | YSCFNAL | ETQFSLPQTS | LEMATVEKLL | QIPEDSVPCK | 262 |

FIGURE 28 (Continued)

```
                       PRSIAERERR  TRISGKLKKL  QDLVPNMDKV  SL              323
                       PRSIAERERR  TRISGKLKKL  QDLVPNMDKQ  TSYSDMLDLA      332
SEQ-ID-NO-568-GI-6850309       RAKRGCATH
SEQ-ID-NO-566-CLONE-21406      RAKRGCATH
SEQ-ID-NO-567-GI-24030386      RAKRGCATH      PRSIAERERR  TRISGKLKKL  QDLVPNMDKQ  TSYSDMLDLA      332
SEQ-ID-NO-572-ANNOT-1498288    RAKRGFATH      PRSIAERERR  TRISGKLKKL  QDLVPNMDKQ  TSYADMLDFA      297
SEQ-ID-NO-574-ANNOT-1471938    RAKRGCATH      PRSIAERERR  TRISGKLKTL  QDLVPNMDKQ  TSYADMLELA      312

SEQ-ID-NO-568-GI-6850309       VQHIKGLQHQ     LQNLKKDQEN  CTCGCSEKPS  ----------  ----------      323
SEQ-ID-NO-566-CLONE-21406      VQHIKGLQHQ     LQNLKKDQEN  CTCGCSEKPS  ----------  ----------      362
SEQ-ID-NO-567-GI-24030386      VQHIKGLQNE     VEKLHKEMEN  CTCGCEKSTP  ----------  ----------      362
SEQ-ID-NO-572-ANNOT-1498288    VKHIKGLQNE     VEML------C CTYCWSFPN   LHLIFVCPSL  TETPQRIGRL      327
SEQ-ID-NO-574-ANNOT-1471938                                                                       357

SEQ-ID-NO-568-GI-6850309       ----------     ----------  323
SEQ-ID-NO-566-CLONE-21406      ----------     ----------  362
SEQ-ID-NO-567-GI-24030386      ----------     ----------  362
SEQ-ID-NO-572-ANNOT-1498288    YLWMQTINPM     ILPTKEI     327
SEQ-ID-NO-574-ANNOT-1471938                                374
```

Figure 29

```
                              50
CeresClone:1556085    MGGRVDHEYS YLFKMVLIGD SGVGKSNILS RFTRNHFSLD SKSTIGVEFA   50
Lead-CeresClone-224919 MGGRVDHEYS YLFKMVLIGD SGVGKSNILS RFTRNHFSLD SKSTIGVEFA  50
gi|50933495           MGGRVDHEYS YLFKMVLIGD SGVGKSNILS RFTRNHFSLD SKSTIGVEFA   50

100
CeresClone:1556085    TKSLQIDGKT IKAQIWDTAG QERYRAITSA YYRGAVAALL VYDITKRQSF  100
Lead-CeresClone-224919 TKSLQMDGKT KAQIWDTAG QERYRAITSA YYRGAVGALL VYDITKRQSF   100
gi|50933495           TKSLQMEGKT KAQIWDTAG QERYRAITSA YYRGAVGALL VYDITKRQSF    100

150
CeresClone:1556085    DNVHRWLREL RDHADSSIVI MMVGNKSDLI HLRAISEDEG KALAEKEGLF  150
Lead-CeresClone-224919 DNVHRWLREL RDHADSSIVI MMVGNKSDLI HLRAISEDEG KALAEKEGLF 150
gi|50933495           DNVHRWLREL RDHADSSIVI MMVGNKSDLI HLRAVSEDEG KALAEKEGLF  150

200
CeresClone:1556085    FLETSAMEAI NVEEAFQTII TEVYGIVNRK ALAAKEAAAT AAPLPSQGKT  200
Lead-CeresClone-224919 FLETSAMEAI NVEQAFQTIM TEVYGIVNRK ALAAKEAAAA TASLPSQGKK 200
gi|50933495           FLETSAMEAV NVEEAFQTII TEVYGIVNRK ALAAKEAAAA SAPLPSQGKT  200

CeresClone:1556085    SIDSNAGNT KKACCST   217
Lead-CeresClone-224919 SIDSTAGNT KRACCST   217
gi|50933495           SIDSAAGNT KRACCSA   217
```

FIGURE 30

| SEQ ID | Sequence | Pos |
|---|---|---|
| SEQ-ID-NO-597-GI-150042132 | MGRRACCAKE GVKEGAWTSK EDDALAAYVK AHGEGKWREV FGKAGLRRCG | 50 |
| SEQ-ID-NO-594-CLONE-590625 | MS--I--TA- -------- ISLEVSSN-- --LWKVI --- | 20 |
| SEQ-ID-NO-593-ANNOT-1483277 | MESMNRRRRR KQPKN---SS ESEEVSSI-- --EWEFI --- | 31 |
| SEQ-ID-NO-596-ANNOT-1467420 | MDRRRRRRRK QAKIN---NG ESEEVSSI-- --EWEFI --- | 30 |
| SEQ-ID-NO-590-CLONE-226/1 | MDNTNRLRRL HCHKQPKIH- SSQEVSSM-- --KWIHI --- | 33 |
| SEQ-ID-NO-591-CLONE-1079601 | MDNTNRRRRS KQHKYT--LE DSEEVSSI-- --EWKFI --- | 31 |

| SEQ ID | Sequence | Pos |
|---|---|---|
| SEQ-ID-NO-597-GI-150042132 | KSCRLRWLNY LRPNIRRGNI SYDEECLIIR LHRLLGNRWS LIAGRLPGRT | 100 |
| SEQ-ID-NO-594-CLONE-590625 | ---------- -------IIM SCQEECLIRR MYKLVGDKWN LIAGRIPGRK | 52 |
| SEQ-ID-NO-593-ANNOT-1483277 | ---------- -------NM SEQEECLIYR MHRLVGERWD LIAGRIPGRK | 63 |
| SEQ-ID-NO-596-ANNOT-1467420 | ---------- -------DM SEQEECLIYR MYRLVGERWD LIAGRIPGRK | 62 |
| SEQ-ID-NO-590-CLONE-226/1 | ---------- -------NM TEQEECLIFR MYRLVGDRWD LIARRYVGRE | 65 |
| SEQ-ID-NO-591-CLONE-1079601 | ---------- -------NM TEQEECLILR MYRLVGDRWD LIAGRVPGRQ | 63 |

| SEQ ID | Sequence | Pos |
|---|---|---|
| SEQ-ID-NO-597-GI-150042132 | DNEI KNFW- ---------- ---------- -NS TLV | 113 |
| SEQ-ID-NO-594-CLONE-590625 | AEEI ERFWIM RHGDAFSVKR ----AGSKT QDS | 80 |
| SEQ-ID-NO-593-ANNOT-1483277 | AEEI ERFWIM KHREGFAENG KLYNEVKSR TSS | 95 |
| SEQ-ID-NO-596-ANNOT-1467420 | AKFI ERFWIM KHREGFAEKR RLHSKAKSK TTR | 94 |
| SEQ-ID-NO-590-CLONE-226/1 | AKFI FRYWIM RNCDYFSHK- ---------- --- | 84 |
| SEQ-ID-NO-591-CLONE-1079601 | PEEI ERFWIM RNSDSFAEKR LQLHHESSHK NNK | 96 |

Figure 31

```
                                                                                      49
gi|50918981         MGLDVGEI GM  GLDLSLDLKM  FAARSAVRMA  AAAKEA-TG  VEACIRSLEE   49
Lead-CeresClone-240112  MGLDVGEI GM  GLDLGLDLGL  FAARSAGGMA  AAA-KGAPAE  IESCIRSLEE   49
CeresClone:1791988  MGLDVAEI GM  GLDLGLDLRL  FAARSAVGMA  AAAAKGAPAG  LEACIRSLEE   50 gi|50918981         ERRKIEMFRR  ELPLCARLLA  DVIELMKEEA  GKRRKDGDDA  EAKAEDGDKT   99
Lead-CeresClone-240112  ERRKIEVFRR  ELPLCVRLLA  DVIDELKDEA  AKR---GGDA  EAKADDGDKR   96
CeresClone:1791988  ERRKIEVFRR  ELPLCVRLLA  DVIEELKEEA  ARK---GGDL  E-RPDDGDKR   97 gi|50918981         KWMSTAQLWV  DSRGSDADSE  NDRRSGSTSP  ASRLLGGAEE  SSSRAVA---   146
Lead-CeresClone-240112  KWMSTAQLWL  DSDAKSDESD  KEQLSEITSP  EPKLLGGA-P  MPIRAVAAVP   145
CeresClone:1791988  KWMSTAQLWV  DSDATS-KSE  KEQPSEMTSP  EPKLLGG--P  MPIRAVPVVP   144 gi|50918981         --PPPYFRRE  ERVVLR----P  AMPLLPPASH  RSPPPAAAA   ATAAGDDHRH   191
Lead-CeresClone-240112  PLPPPFFRRE  DSSAGS----  GLSLVPPAAK  PPIPPMSAS-  -D-----    181
CeresClone:1791988  PPPPPGFRRD  DNAAGTARLP  GLSLLPPAAK  TSVSPVPAV-  ----DEHRQ   188 gi|50918981         VVASSFATAV  PSPVPAALSL  QAQAQQQQQQ  ARKSRRCWSP  ELHRQFVAAL   241
Lead-CeresClone-240112  NASGRFCATM  PI-PSGSGANL  HSQAQQQ---  ARKARRCWSP  ELHRLFVAAL   227
CeresClone:1791988  NAAARLSATM  S-PSGSGLNL  HTQTQQQQQL  ARKTRRCWSP  ELHRQFVAAL   237 gi|50918981         QQLGGPQVAT  PKQIREVMKV  DGLTNDEVKS  HLQKYRLHNR  KSPG-TASAS   290
Lead-CeresClone-240112  HQLGGPQVAT  PKQIREVMKV  DGLTNDEVKS  HLQKYRLHNR  RSPGVAPVS   277
CeresClone:1791988  HQLGGPQVAT  PKQIREVMQV  DGLTNDEVKS  HLQKYRLHNR  RSPG-MAPVS   286
```

Figure 31 (continued)

| | | | | | | | |
|---|---|---|---|---|---|---|---|
| gi\|50918981 | HSIVLVGD | LW | AS--QEVSCS | QSGSPQGPLQ | LSGSGVAVSA | ATAG--DSCC | 336 |
| Lead-CeresClone-240112 | QSVMLAGGLW | | APPHQEQSSS | QSGSPQGPLQ | FSGSGV--A | ATVGGDSSSS | 324 |
| CeresClone:1791988 | QSIVLVGGLW | | SSQEQSSSQS | QSGSPQGPLQ | FSGSGMAVSA | ATVGGDSSSS | 336 |

| | | |
|---|---|---|
| gi\|50918981 | EDDDKS-EGY | VRK-- | 348 |
| Lead-CeresClone-240112 | DEDDKS-EGY | SRKYV | 338 |
| CeresClone:1791988 | DEDDKSDEGY | SRK-- | 349 |

Figure 32

```
                                                                                          45
gi|77556137        MSSSSLSPAG ---------- ----AGVVAA -DH SSDGDS RREKRRLSNR ESARRSRLRK       49
gi|40019253        MSSSSLSPGG GRLSGGDGDS GATEVAG-DN RREKRRLSNR ESARRSRLRK                  47
gi|62898531        MSSPSRRSSS ---PESNIDG GSGSGSAGDE RKRKRMLSNR ESARRSRMRK                  48
CeresClone:676378  MASPIQQQR STTTSSGSEG GDPH I----- RQRKRMLSNR ESARRSRMRK                  37
gi|72398495        MATNPRSTSP ---LSDIDG -NI------- RKRKRKLSNR ESARRSRMRK                   38
gi|2244744         MAP------ -EQQSP--- ---------- NI------- RKRKRKQSNR ESARRSRMRK          45
gi|9650826         MASVQNQNQV ---NSGGNSI DLRYATF    KKRKRKRMISNR ESARRSRMKK                43
gi|3986151         MAS I---T QQAV------ DQQYAKF   RKRKRMESNR ECARRSRMRK                   42
gi|77999786        MAS I---T QQPA------ Q-RYANY   RKRKRMESNR ESARRSRMRK                   42
gi|16580132        MAL----T QQPA------ Q-RYATN   RKRKRMESNR ESARRSRMRK                    42
gi|5901747         MAS I---T QQPA------ Q-RYATN   RKRKRMLSNR ESARRSRMRK                    42
CeresClone:1728175 MSSI PVRRAS ---SSEGDS QPTS----- RKRKRMI SNR ESARRSRMRK                  39
CeresAnnot:1497776 ---MSARQAA SPESDN DPRYANV-DE RKRKRMI SNR ESARRSRMRK                      40
Lead-CeresClone:2831 ---MQT SPESDN DPRYATVTDE RKRKRMI SNR ESARRSRMRK
CeresClone:1385680 ---MGSK SPDSDN DPRYASVTDE RKRKRMI SNR ESARRSRMRK gi|77556137        QQHLDELVQE VARLQADNAR VLARASEI AG QTARVEQENT VLRARAAELG     95
gi|40019253        QQHLDELVQE VARLKAENAR VLARANDITS QFVRVDQENT VLRARAAELG     99
gi|62898531        QQRMEELI AE ASRLQAENKR VEAQI GAYTT ELTKVDGENA VLRARHGELA     97
CeresClone:676378  QKQLEDLTDE VSRLQSANKK LAENI EAKEE ACVETEAANS ILRAQTMELA     98
gi|72398495        QQRLDELTAQ ATQLKEENKK LREM DGSNQ LYLNFASENN VLRAQAAELA     87
gi|2244744         QQRLDELMAQ ESQI QEENKV LQKI DDSKQ MFFGVVSENN ILRAQLGELT     88
gi|9650826         QQHVDKLI AE MSQLQSQNKV VTQKI NEATQ NYRAMDAENN VLRAQLSELT     95
gi|3986151         QQRLGELMGE TT QLHKQNSI CRERI DSVER NYHTVEAENN VLRAQIAELT     93
gi|77999786        QQHLEELMSE LT QLQNQNTI WSKRI DAVGK NYLIT DAENN VLRAQMAELT     92
gi|16580132        QQHLEELMSQ MT QLQNQNVL WREKI DAVGR NFHTLDAENN VLRAQMAELT     92
gi|5901747         QQHLEELMSQ LT QLQNQSTI WREKI ESVGR QYVKVESENA VLRAQLSELT     92
CeresClone:1728175 QQHLDDLI NQ AEQLKNQNSQ DVQI NLATQ RRMAMESANN ILRAQSELT     92
CeresAnnot:1497776 QKQMGDLVNE VSKLQNENNQ LMQGI NVGQQ KYI EMESKNN VLRAQAVELT     92
Lead-CeresClone:2831 QKQLGDLI NE VTLLKNDNAK TEQVDEASK KYI EMESKNN VLRAQASELT    89
CeresClone:1385680 QKQLGDLI NE VTVLKNDNAK TEQVDAATR RYVEMESKND VLRAQEVELK    90
```

Figure 33

```
CeresClone:1315656    MAFFSHHHLQ QPHPAAPPPQ ---------- ---------- --QQQQPAP LSFRNALPVP VDGQI PAPLA  48
gi|34902144           MAFFSHHHLQ QPHPQAPPPP PPQQQQQPVP ---------- PQQQQQPVP PSFRNALPVP VDGQI PAPLP  50
Lead-CeresClone-285598 MAFFSHHHLQ QPHPQAPPQQAPPP ---------- ---NQQQPVL ---------- PSFRNALPVP VDGQI PAPLT  47
CeresClone:236111     MALHPHL--- ---------- ---------- ---PVL ---QDS PSFRNAL-FCG VDGQI PAPLT  39
gi|62320820           ----GTSHLQ LHIQQQ----- ---------- ---------- ---QDS KNFRD--FCG IDGQI SPELG  28
gi|45602841           -MGALPHHHLQ LHIQQQQP-- ---------- ---------- -QQQQQS KSYRD--LYNN MDGQI STPVA  36
gi|40807658           -MALPHHHLQ LHIQQQ----- ---------- ---------- -QQQQQS KSYRD--LYNN MDGQI TTPVV  46
gi|45544873           -MALPHHHLQ LHIQQQP---- ---------- ---------- -HQQQQS KSYRD--LYNN MDGQI TNPVV  42
gi|45758663           -MAFLQDQFQ RHYQQQ----- ---------- ---------- -QPHQQQT KSFRN--LQT- MDGQI TTPVV  41
gi|92888885           -MAHPQHQFQ QHYQPQ----- ---------- ---------- -QQQQPQT KN-RN--YA- IEGQMSQQMA SPAVA  40
CeresAnnot:1486505                                                                        DSQI SPAVA  39

CeresClone:1315656    FFNAPPAFPD QAGQPQIV--- ---------- -DAAGLTAAA ---------- ---------- MGW---  79
gi|34902144           FFNPPPAFQD QPAQPPLV--- ---------- -DAMGLTAAA ---------- ---------- -LGW--  81
Lead-CeresClone-285598 FFNPPPAFPE QPAQTTLV--- ---------- -DAVGLTAAA ---------- ---------- -LGW--  78
CeresClone:236111     FFNPPPAFPE QPAQAPLV--- ---------- -DAVGLTAAA ---------- ---------- -LGW--  70
gi|62320820           FNR-SENLHD QSQHPPYI PP FHVAGFAPGP ---------- ---------- NGADFE WNYG  77
gi|45602841           YFN--CSNLPE QSQHPPYI PP FQVVGLAPGL VVQIDGSDGG GLDLQWNY--  77
gi|40807658           YFN--GSNLPE QSQHPPYI PP FQVVGLAPGT --VDDG GLDLQWNY--  87
gi|45544873           YFN--GSNLPE QSQHPPYI PP FQVVGLAPGT --ADDG GLDLQWNY--  83
gi|45758663           YFN--GSNLPE QSQHPPYI PP F-----GFAPGT --ADDG GLDLQWNY--  82
gi|92888885           YFN--PTDLQD QSQHPPYI PP FHVVGFAPGP VIPADGSDG GVDLHWNF--  83
CeresAnnot:1486505    YFN--PSNLQD QSQHPPYVPP FHVVGFAPGP --GNDGSDG GLELQWNY--  83
```

Figure 33 (continued)

| | | | | | | | |
|---|---|---|---|---|---|---|---|
| CeresClone:1315656 | ------- | ------- | RQP | REQEL-LG--EN | SQMSSIDFLQ | TGSAVSTGLA | LSLEDRRHGG | 121 |
| gi\|34902144 | ------- | ------- | RQP | REQEL-LG--EN | SQMSSIDFLQ | TGSAVSTGLA | LSLEDRRHGG | 123 |
| Lead-CeresClone-285598 | ------- | ------- | RQP | REQEL-LG--EN | SQMSSIDFLQ | TGSAVSTGLA | LSLEDRRHGG | 120 |
| CeresClone:236111 | ------- | ------- | ROP | REQEL-LG--EN | SQMSSIDFLQ | TGSAVSTGLA | LSLEDRRHGG | 112 |
| gi\|62320820 | LGLEPRRERL | ------- | ------- | KEQDFLE--NN | SQISSIDFLQ | ARS--VSTGLG | LSLDNARVA- | 124 |
| gi\|45602841 | GLEPKRKRP | ------- | ------- | KEQDFLE--NN | SQISSVDFLQ | PRS--VSTGLG | LSLDNGRLA- | 124 |
| gi\|40807658 | GLEPKKKRP | ------- | ------- | KEQDFMENNN | SQISSVDFLQ | RRS--VSTGLG | LSLDNGRLA- | 134 |
| gi\|45544873 | GLEPKKKRP | ------- | ------- | KEQDFMENNN | SQISSVDFLQ | RRS--VSTGLG | LSLDNGRLA- | 130 |
| gi\|45758663 | GLEPERKRP | ------- | ------- | KEQDFLE--NN | SQISSVDFLQ | PRS--VSTGLG | LSLDNTRLA- | 129 |
| gi\|92888885 | GLEPKRKRL | ------- | ------- | KEQDFLE--NN | SQISSVDFLQ | ARS--VSTGLG | LSLDNTRVS- | 129 |
| CeresAnnot:1486505 | | | | | | | | 129 |

| | | | | | | | |
|---|---|---|---|---|---|---|---|
| CeresClone:1315656 | G-GAGAGNSS | GDSPLLLLPM | LDDDISREVQ | RLDADMDRFI | RAQSERMRQS | 170 |
| gi\|34902144 | GSGAGAGNSS | GDSPLLLLPM | LDDDISREVQ | RLDADMDRFI | KAQSERLRQS | 173 |
| Lead-CeresClone-285598 | G---GAGNSS | GDSPLLLLPM | LDDDISREVQ | RLDADMDRFI | KAQSERLRQS | 167 |
| CeresClone:236111 | G---GAGNSS | GDSPLLLLPM | LDDDISREVQ | RLDADMDRFI | KAQSERLRQS | 159 |
| gi\|62320820 | ----SSS | DGSA----LSL | VGDDIDRELQ | RQDADIDRFI | KIQGDQLRHA | 164 |
| gi\|45602841 | ----SSS | CDSA---FLGL | VGDDIERELQ | RQDAEIDRYI | KVQGDRLRQA | 164 |
| gi\|40807658 | ----SSS | CDSA---FLGL | VGDDIERELQ | RQDAEIDRYI | KVQGDRLRQA | 174 |
| gi\|45544873 | ----SSS | CDSA---FLGL | VGDDIERELQ | RQDAEIDRYI | KVQGDRLRQA | 170 |
| gi\|45758663 | ----SSS | GDSA---LLSL | -GDDIDRELQ | RQDDLEMDRFL | KLQGEQLRQT | 169 |
| gi\|92888885 | ----SSS | GDSA----LLSL | GDDIDSELQ | RQDVEVDKFL | KIQGDRLRQT | 169 |
| CeresAnnot:1486505 | | | | | | 169 |

Figure 33 (continued)

| | | | | | | |
|---|---|---|---|---|---|---|
| CeresClone:1315656 | LEKVQAKQF | EALASVEDKI | LRKIRDKESE | VQNINKRNLE | LEDQIKQMAG | 220 |
| gi\|34902144 | LEKVQAKQF | EALASVEDKI | LRKIRDKEAE | VENINKRNSE | LEDQIKQLAV | 223 |
| Lead-CeresClone-285598 | LEKVQAKQF | EALASVEDKI | FRKIRDKEAE | VETINKRNSE | LEDQIKHLGV | 217 |
| CeresClone:236111 | LDKIKRGQQ | KTVSLMEEKV | VQKLREKDEE | VETINKRNSE | LEDQIKHLGV | 209 |
| gi\|62320820 | LEKVQANQL | QTVTYVEEKV | IQKLREKETE | LERINRKNKE | LEVRMEQLTM | 214 |
| gi\|45602841 | VLEKVQANQI | QAITYVEEKV | LQKLRERDTE | VEDINKKNME | LELRMEQLDL | 214 |
| gi\|40807658 | VLEKVQANQI | QAITYVEEKV | LQKLRERDTE | VDDINKKNME | LELRMEQLAL | 224 |
| gi\|45544873 | VLEKVQANQI | QAITYVEEKV | LQKLRERDTE | VDDINKKNME | LELRMEQLDL | 220 |
| gi\|45758663 | ILEKVQATQL | QSVSIIEDKV | LQKLREKETE | VENINKRNME | LEDQMEQLSV | 219 |
| gi\|92888885 | LEKVQADQL | QTLSLVEEKV | LQKLRQKEAE | VESINKKNME | LEEKMEQLSM | 219 |
| CeresAnnot:1486505 | | | | | | 219 |

| | | | | | | |
|---|---|---|---|---|---|---|
| CeresClone:1315656 | EVGAWQQRAK | YNESMISALK | YNLEQVCAHQ | SKDFKEGCCD | SEVDDTASCC | 270 |
| gi\|34902144 | EVGAWQQRAK | YNESMINALK | YNLEQVCAHQ | SKDFKEGCCD | SEVDDTASCC | 273 |
| Lead-CeresClone-285598 | EVGAWQHRAK | YNESLINALK | YNLEQVCAHQ | SKDFKEGCCD | SEVDDTASCP | 267 |
| CeresClone:236111 | EVGAWQRAK | YNENMINALK | YNLEQVCAHQ | SKDFKEGCCD | SEVDDTASCR | 259 |
| gi\|62320820 | EAEAWQQRAK | YNENLIAALN | YNLDRAQG-R | PRDSLEGCCD | SEVDDTASCF | 263 |
| gi\|45602841 | EANAWQQRAK | YNENLINTLK | VNLEHVYA-Q | SRDSKEGCCD | SEVDDTASCC | 263 |
| gi\|40807658 | EANAWQQRAK | YNENLINTLK | VNLQHVYA-Q | SRDSKEGCCD | SEVDDTASCC | 273 |
| gi\|45544873 | EANAWQQRAK | YNENLINTLK | VNLQHVYA-Q | SRDSKEGCCD | SEVDDTASCC | 269 |
| gi\|45758663 | EAGAWQQRAR | YNENMIAALK | FNLQQAYL-Q | GRDSKEGCCD | SEVDDTASCC | 268 |
| gi\|92888885 | EAGAWQERAR | YNENMINAIK | FNIQQVYA-Q | SRDSKEGCCD | SEVDDTASCC | 268 |
| CeresAnnot:1486505 | | | | | | 268 |

Figure 33 (continued)

| | | | | | | | |
|---|---|---|---|---|---|---|---|
| CeresClone:1315656 | NGGAVNLQLM | PKENNHPKDL | TACRVCKSSE | ACMLLLPCRH | LCLCKECESK | 320 |
| gi\|34902144 | NGGAANLQLM | PKENRHSKDL | TACRVCKSSE | ACMLLLPCRH | LCLCKECESK | 323 |
| Lead-CeresClone:285598 | YGGAVNLQLM | PKENRQPKNL | TACRVCKSSE | ACMLLLPCRH | LCLCKECESK | 317 |
| CeresClone:236111 | DGGANFQLT | PKENRQPKDL | TACRVCKSSE | ASMLLLPCRH | LCLCKECESK | 309 |
| gi\|62320820 | NGRD | -NSNNNTKTM | MMCRFCGVRE | MCMLLLPCNH | MCLCKECERK | 306 |
| gi\|45602841 | NGRATDLHLL | CRDSNEMKEL | MTCKVCRVNE | VSMLLLPCKH | LCLCKECESK | 313 |
| gi\|40807658 | NGRATDLHLL | CRDSKEMKEL | MTCRVCRTNE | VGMLMLPCKH | LCLCKECESK | 323 |
| gi\|45544873 | NGRATDLHLL | CRDSKEMKEL | MTCRVCRTNE | VCMLLLPCKH | LCLCKECESK | 319 |
| gi\|45758663 | NGRATDLHLL | CRDSKEMKEL | MTCRVCRTNE | VCMLLLPCKH | LCLCKECESK | 318 |
| gi\|92888885 | NGRSLDFHLL | SNENSNMKDL | MKCKACRVNE | VTMVLLPCKH | LCLCKECESK | 318 |
| CeresAnnot:1486505 | NGRADFHLL | SNDNDMKEL | MTCKACRVNE | VCMLLLPCKH | LCLCKDCESK | 318 |

| | | | |
|---|---|---|---|
| CeresClone:1315656 | LSFCPLCQSS | KLGMEIYM- | 339 |
| gi\|34902144 | LSFCPLCQSS | KLGMEIYM- | 342 |
| Lead-CeresClone:285598 | LSICPLCQSS | KLGMEIYYA | 337 |
| CeresClone:236111 | LSFCPLCQSS | KLGMEIYYA | 329 |
| gi\|62320820 | SSCPLCQSS | KFLGMEVYM- | 325 |
| gi\|45602841 | LSLCPLCQST | KYIGMEIYM- | 332 |
| gi\|40807658 | LSLCPLCQST | KYIGMEVYM- | 342 |
| gi\|45544873 | LSLCPLCQST | KYIGMEVYM- | 338 |
| gi\|45758663 | LSLCPLCQST | KYIGMEVYM- | 337 |
| gi\|92888885 | LSFCPLCQSS | KFIGMEVYM- | 337 |
| CeresAnnot:1486505 | LSFCPLCHSS | KFIGMEVYM- | 337 |

Figure 34

```
1443201              ----------  ----------  ----------  ----------  ----------  ----------    0
CeresClone:749118    ----------  ----------  ----------  ----------  ----------  ----------    0
CeresClone:1421639   ----------  ----------  MGS-PSGQPE  FDYLFKVLLI  GDSGVGKSSL  LLSFTSNTFD  DLSPTIGVDF   49
CeresClone:1716210   ----------  ----------  ----------  ----------  ----------  ----------    0
1450718              ----------  ----------  MDSASSGQPE  FDYLFKLLLI  GDSGVGKSSL  LLRFTSDSFE  DLSPTIGVDF   50
Lead-CeresClone-2898 ----------  ----------  ----------  ----------  ----------  ----------    0

1443201              ---MVVL SLL  L NAV VF-  ----------  ----------  ---- T-VYDVTRRE   27
CeresClone:749118    ---MVN AGK  KLKLAVWDTA  ----------  ----------  ---GIS MGMYDVTRRE   47
CeresClone:1421639   KVKYL T GEK  KLKLAIWDTA  CQERFRTLTS  SYYRGAQGII  ---- M--VYDVTRRE   98
CeresClone:1716210   ----------  ----------  ----------  ----------  ----------  ----M----     9
1450718              KVK VN GGK  R LKLAIWDTA  CQERFRTLTS  SYYRGAQGVI  ---- M--VYDVTRRD   99
Lead-CeresClone-2898 ----------  ----------  ----------  ----------  ----------  ----M-VYDVTRRD    9

1443201              TFTNLSEI WA  KEIDLYSTNQ  DCIKMLVGNK  VDKESERVT   KKEGIDFARE   77
CeresClone:749118    TFTNLSDI WA  KEIDLYSTNQ  DCIKMLVGNK  VDKESERAVT  KKEGIDFARE   97
CeresClone:1421639   TFTNLSEI WA  KEIDLYSTNQ  DCIKMLVGNK  VDKESERAVS  KKEGIDFARV  148
CeresClone:1716210   TFTNLSDI WA  KEIELYSTNQ  DCIKMLVGNK  VDKESDRAVT  KKEGINFARE   59
1450718              TFTNLSEI WA  KEIDLYSTNQ  DCIKMLVGNK  VD-------   KKEGIDFARE  131
Lead-CeresClone-2898 TFTNLSDI WA  KEIDLYSTNQ  DCIKMLVGNK  VDKESERAVS  KKEGIDFARE   59

1443201              YGCLFLECSA  KTRVNVEQCF  PSLLAEGSSG  VKKNVFKQK P  127
CeresClone:749118    YGCLFLECSA  KTKVNVEQCF  PSLLADA SSG  AKKNIFKQK A  147
CeresClone:1421639   YGCLFLECS K  QT----       PSLLAEGS KG  VKKNIF SEK R  160
CeresClone:1716210   YGCLFLECSA  KTRVNVQQCF  ----------  ----------  109
1450718              ----------  ----------  PSL T AEGSSG  GKKNIFKQ NP  131
Lead-CeresClone-2898 YGCLFLECSA  KTRVNVEQCF  ----------  ----------  109
```

Figure 35

```
                                                                                              48
CeresClone:677386      MASNG    MAS SPSAFFPPNF  LLHMQQAPPQ  HDPQEHHQQH  HHHHHEHLP            27
Lead-CeresClone-2913   MSCNN-GM ---SFFPSNF      MI QTS----  ----------  -YEDDHPHQ            24
CeresClone:1384592     MSCNN-GM ---SFFPSNF      MI QTS----  ----------  -YED----LP           24
CeresClone:1121989     MSCNN-GM ---SFFPSNF      MI QTS----  ----------  -YED----LP           26
gi|349379              MI CTG-M ---AFFSSNF      MLQSS-----  ----------  -QEDDHHAP            26
1463575                MI CNG-M ---AFFPTNF      MLQLS-----  ----------  -HDQDDHQP            21
gi|48209882            -------- ---AFFPTNF      MLQTP-----  ----------  -HHEDEHQP            28
gi|48209945            MI CTNYEM ---AFFPTNF     MLQTP-----  ----------  -HHEDEHQP 93
CeresClone:677386      PPHPQHNPFL  PSPQCPS-LQ  DFRGGLSPML  GKRPAMYGGG  GCG-------             64
Lead-CeresClone-2913   S---PSLAPLL ---PS---CSL DLH-GFASFL  GKRSPMEGCC  -DLE------             57
CeresClone:1384592     P---SLSPLL  ---PSI--PQ  DLH-GFASFL  GKRSPVE---  ----------             57
CeresClone:1121989     P---SLSPLL  ---PSI--PQ  DLH-GFASFL  GKRSPVE---  -GLE------             69
gi|349379              T---SLSPIL  PP--CSTT-PQ DFS-GLAAFL  GKRSMSSYSG  -GLE------             62
1463575                P---SLNPIL  ---PSI--PQ  DFH-GVASFL  GKRSMSMSFSG LNNNMDGCD              61
gi|48209882            S---TSLNPIL ---CSI--PQ  DFH-GI ASFL GKRS--MSFSG -D------ACH            68
gi|48209945            S---TSLNPIL ---PSI--PQ  DFH-GI ASFL GKRS--MSFSG MDGNN---ACE 142
CeresClone:677386      GDEVTGGGAN  EEETSDDGSQ  L--GEKKRRL  NVEQVRTLEK  NFEVANKLEP             109
Lead-CeresClone-2913   TGNNMNG---  EEDYSDDGSQ  ---MGEKKRRL NMEQVKTLEK  NFELGNKLEP             102
CeresClone:1384592     AGNI MNG--- EEDYSDDGSQ  ---MGEKKRRL NMEQVKTLEK  NFELGNKLDP             102
CeresClone:1121989     AGNI MNG--- EDELSDDGSQ  ---MGEKKRRL NMEQVKTLEK  NFELGNKLDP             116
gi|349379              QEGNMNG---  EDELSDDGSQ  LLAGEKKRRL  NMEQVKTLQR  NFELGNKLEP             105
1463575                EEG-NG----  EDDLSDDGSQ  ---AGEKKRRL NMEQVKTLEK  NFELGNKLEP             103
gi|48209882            EN---HG---  EDDLSDDGSQ  ---AGEKKRRL NMEQVKTLEK  NFELGNKLEP             110
gi|48209945            EN---HG---  EDDLSDDGSQ  ---AGEKKRRL NMEQVKTLEK  NFELGNKLEP
```

Figure 35 (continued)

| | | | | | | |
|---|---|---|---|---|---|---|
| CeresClone:677386 | ERKMQLARAL | GLQPRQVAIW | FQNRRARWKT | KQLEKDYDVL | KRQFDAVKAE | 192 |
| Lead-CeresClone-2913 | ERKMQLARAL | GLQPRQIAIW | FQNRRARWKT | KQLEKDYDTL | KRQFHTLKAE | 159 |
| CeresClone:1384592 | ERKMQLARAL | GLQPRQIAIW | FQNRRARWKT | KQLEKDYDTL | KRQFDSLKAE | 152 |
| CeresClone:1121989 | ERKMQLARAL | GLQPRQIAIW | FQNRRARWKT | KQLEKDYDTL | KRQFDSLKAE | 152 |
| gi|349379 | ERKMQLARAL | GLQPRQIAIW | FQNRRARWKT | KQLEKDYDAL | KRQFEAVKAE | 166 |
| 1463575 | ERKMQLARAL | GLQPRQIAIW | FQNRRARWKT | KQLEKDYDLL | KRQFDAIKAE | 155 |
| gi|48209882 | ERKMQLARAL | GLQPRQIAIW | FQNRRARWKT | KQLEKDYEVL | KRQFDAIKAE | 153 |
| gi|48209945 | ERKMQLARAL | GLQPRQIAIW | FQNRRARWKT | KQLEKDYEVL | KRQFDAIKAE | 160 |

| | | | | | | |
|---|---|---|---|---|---|---|
| CeresClone:677386 | NDALSHNKK | LQSEILGLKG | CREAASELN | –KETEASC | SNRSENSSE– | 240 |
| Lead-CeresClone-2913 | NDLQTHNQK | LQAEIMGLKN | –RE–QTESIN | –KETEGSC | SNRSDNSSDN | 206 |
| CeresClone:1384592 | NDHLQTHNQK | LQAEIMSSRN | –RE–QTESIN | –KETEGSC | SNRSDNSSDN | 199 |
| CeresClone:1121989 | NDHLQTHNQK | LQAEIMSSRN | –RE–QTESIN | –KETEGSC | SNRSDNSSDN | 199 |
| gi|349379 | NDSLQSQNHK | LHAEIMALKN | –RE–PAELN | –KETEGSC | SNRSENSSC | 213 |
| 1463575 | NDALQAQNQK | LHAEILTLKS | –RE–PTEPN | –KETEGSC | SNRSENSSD– | 201 |
| gi|48209882 | NDALQTQNQK | LHAEIMSLKN | –REQPTESIN | –KETEGSC | SNRSENSSE– | 200 |
| gi|48209945 | NDALQTQNQK | LHAEQ––––– | –––PTESIN | –KETEGSC | SNRSENSSE– | 199 |

| | | | | | | |
|---|---|---|---|---|---|---|
| CeresClone:677386 | NLDISRT–P | PSDGPMDAP– | –––PSHQQGG | GGGGMIPFYP | SVARPAGVDI | 285 |
| Lead-CeresClone-2913 | RLDISTAPP | SNDSTLTGGH | PP–PPQTV–– | –GRHFFPPSP | ATATTTTTM– | 252 |
| CeresClone:1384592 | FRLDISTAVP | SVDSTTGGH | PP–APQTV–– | –GRHFFPPAT | ATTTTTTM– | 243 |
| CeresClone:1121989 | FRLDISTAVP | SVDSTTGGH | PP–APQTV–– | –GRHFFPPAT | ATTTTTTM– | 243 |
| gi|349379 | ILDISRT–P | ATDSPLSSHH | QH–QHQP– | –PNLFPSSN | IDRPNSNNIV | 257 |
| 1463575 | KLDISRT–P | AIDSPLSNHH | P–TSRSFFP | SSSSSIRPAG | VAIRPTGVA– | 247 |
| gi|48209882 | KLDISRT–P | AIDSPLSNHH | PNISSRPFFP | ––PSMIRSNN | N–––NNGVV– | 244 |
| gi|48209945 | KLDISRT–P | AIDSPLSNHH | PNISSRPFFP | ––PSMIRSNN | NNNSNNGVV | 246 |

CeresClone:677386
Lead-CeresClone-2913
CeresClone:1384592
CeresClone:1121989
gi|349379
1463575
gi|48209882
gi|48209945

Figure 35 (continued)

```
CeresClone:677386      DHLLHASVPK  ME--------  ----------  HHGGPDTPSF  GNLLCGVDEP  318
Lead-CeresClone:2913   --QFFQNSSS  GQ--------  ----------  -SMVKEENSI  SNMFCAMDDH  281
CeresClone:1384592     --QFFQNSSS  GQ--------  ----------  -SMVKEENSI  SNMFCAMDDH  272
CeresClone:1121989     --QFFQNSSS  GQ--------  ----------  -SMVKEENSI  SNMFCAMDDH  272
gi|349379              AHQLFHNSSS  RPADHQLHCH  --------H-  -SNAIKEECF  STMFVGMDDH  300
1463575                --QLFQTNPS  RP----DIQCQ  ----------  --LVKEENL   GNMFCSIEDQ  283
gi|48209882            SHQLFHINSS  SS----RQDLK  KIDQ------  NNSSVKEESL  SNMFCGIDDQ  291
gi|48209945            PHQLFHINSS  SP----RQDLK  LMDQNTTTTN  NNSSVKEESL  SNMFCGIDDQ  293

CeresClone:677386      PPFWPWADHQ  QFN         331
Lead-CeresClone:2913   SGFWPWLDQQ  QYN         294
CeresClone:1384592     SGFWPWLDQQ  QYN         285
CeresClone:1121989     SGFWPWLDQQ  QYN         285
gi|349379              SGFWPWLEQP  QFN         313
1463575                SGFWPWLEQQ  HFN         296
gi|48209882            TSFWPWLEQQ  HFN         304
gi|48209945            TSFWPWLEQQ  HFN         306
```

Figure 36

```
gi|50925955         MGANGHPPPA SAAAQNGS-- ---------- ---------- --HSSGGGG- ---------G DGGGGANPS  37
CeresClone:337432   MGANGH-PPA STVAQNGS-- ---------- ---------- --HSGGGG-- ---------- -GGGGVNPS  32
Lead-CeresClone-2942 MAASAN---PS GNNQEGSSAT QKVSSSSAAA ANGAAVNSVD NGGNTGAAAD                    48
1455934             -MAN----PS GTNNQDGN-- ---------- ---QAPSSFNG ---------- ---------N NPSNGNSDPS  32
CeresClone:1619846  MMAN----PS GNHQEHTH-- ---------- ---VVSSSA- ---------- ---------- --------PE  22 gi|50925955         PGGTVAALRH DPGLAREWSP EEQSTLDELL ---------- ---------- ---------- ---------  70
CeresClone:337432   NGGTGAALRH DPGLAREWST EEQTILDELL ---------- ---------- ---------- ---------  65
Lead-CeresClone-2942 NSQTGALRH  NPGISTDWTL EEQSLLEDLL VKY------- ---------- ---------- ---------  81
1455934             SGSS---LKH NPGISTDWTF EEQTILEEGL VKY------- ---------- ---------- ---------  79
CeresClone:1619846  TSGAALAMKH NPGISLDWTA EEQALLEDGL SKY------- ---------- ---------- ---------  55 gi|50925955         ---------- ASDAPVIRYA KIAMKLPDKT VRDVALRCRW MNKKESGKRK                        110
CeresClone:337432   ---------- ASDLPVVRYA KVAMKLPEKT VRDVALRCRW MNKKESAKRK                        105
Lead-CeresClone-2942 ---------- ATEPSVFRYA KIAMKMKDKT VRDVALRCRW MTKKENGKRR                        121
1455934             KLIFLMSHSF AEETNVVRYA KIAINLPNKT VRDVALRCRW MNKKEQSKRR                        129
CeresClone:1619846  ---------- ASESNIVRYA KIALQLQQKT VRDVALRVRW MNKKENSKRR                         95 gi|50925955         KEDHSSSKKS KDKKEKVSDS SLKPPVHIAC RPNVPPYPLP ALPIDDDE-- ---------- ---------- 159
CeresClone:337432   KEDHNSSKKS KDKKEKVSDS SSKPPVHMVG RPNVPPYPLP VLPMDDDE-- ---------- ---------- 154
Lead-CeresClone-2942 KEDHSI-SRKS KDKKEKATDS SAKSSSHLNV HPNGPSYAPP MMPIDTDDGI                       170
1455934             KEDENLARRS RDKKERHGDP SAKTSNFMAA RPSVSPFATP MLPLESEEGI                       178
CeresClone:1619846  KDDHNLTRKS KDKKERVSDP AVKSSNFVA- RSNVSPYAPP MIAMDNDDGI                       144
```

Figure 36 (continued)

|  | | | | | |
|---|---|---|---|---|---|
| gi\|50925955 | SSKAI GGPTG | EI LET NAQVL | SQI STNLSTM | QI------ | -QDNI SLLCQ | 200 |
| CeresClone:337432 | SSKAI GGPTG | EI LET NAHVL | GQI SSNLSNM | QI------ | -QDNI SLLCQ | 195 |
| Lead-CeresClone-2942 | SYKAI GGVSG | DLLEQNAQMF | NQLSTNFSAF | QVNSTSTFHL | HENVNI LCK | 220 |
| 1455934 | SYDAI GGVTG | DLLKQNAQI L | NQI SANLASF | QI------ | -QENLNLLRR | 219 |
| CeresClone:1619846 | SYTAI GGPTG | DLLEQNAQAL | NQI STNLSAF | QV------ | -QENI NLFCQ | 185 |

|  | | | | | |
|---|---|---|---|---|---|
| gi\|50925955 | TRDNI LRVLK | EI NDAPDI MK | QMPPL PVKI N | EELVNSML PR | PTVPMQ- | 246 |
| CeresClone:337432 | TRDNI LRVLK | EI NDAPDI MK | QMPPL PVKI N | EELVNSLL PR | PTVPMQ- | 241 |
| Lead-CeresClone-2942 | ARDNI LALN | DLNDMPEVMK | QMPPL PVKLN | EELANSI LPR | PSHQRKS | 267 |
| 1455934 | TRDNI RKI MN | QMNDVPELMK | QMPPL PVKLN | DDLADTI LLP | PNLPRP- | 265 |
| CeresClone:1619846 | TRDNI LKI MN | ELNDSPEVMK | QMPPL PVKVN | EELANSI LPR | TNLPPQS | 232 |

Figure 37

```
Lead-CeresClone-31044  M----------  ----------  ----------  -AIKGLTAYLN   21
1496976                M----------  ----------  ----------  AIKGGSAYLN    21
1444027                MRSWGKWVSE   IREPRKKSRI  WLGTYPTAEM  AIKGGSAYLN    50

Lead-CeresClone-31044  FPKLAGELPR   PVTNSPKDIQ  AAASLAAVNW  EVAEIVEAEP    71
1496976                FPEFAHELPP   PLSKSPKDIQ  AAAKAAAA--  EGEGGGEAEL    68
1444027                FPEFAHELPP   PLSKSPKDIQ  AAAKAAAA--  EGEGGGEAEL    97

Lead-CeresClone-31044  SRTVAQLFS    SDTSLTTTQ   SQEYSEASCA  STSACDKDS---  121
1496976                NVSNLSDSLA   MDNTQES---  ----------  SSSPSTDSD---  102
1444027                NVSNLSDSLA   MDNTQES---  ----------  SSSPSTDSD---  131

Lead-CeresClone-31044  LFTDENEMM    RNDAFCYYSS  TWQLCGADAG  FRLEEPFFIS    E    162
1496976                LFIDG---VH   HSDGFCYYSS  SWQLCAADTG  FRLGEPFLLE    Y    140
1444027                LFIDG---VH   HSDGFCYYSS  SWQLCAADTG  FRLGEPFLLE    Y    169
```

Figure 38

```
                                                                                          50
Lead-CeresClone-312833  MARRPASWEQ  GGDEYDYLFK  VVLIGDSGVG  KSNLLSRFTK  NTFALDSKST
gi|50920025             MARRPAPWEQ  GGDEYDYLFK  IVLIGDSGVG  KSNLLSRFTR  NSFSLDSKST  50

100
Lead-CeresClone-312833  GVEFATRTL   QVENKIKAQ   WDTAGQERY   RAITSAYYRG  AVGALLVYDV
gi|50920025             GVEFATRTI   QVEGKIVKAQ  WDTAGQERY   RAITSAYYRG  AVGALLVYDV  100

150
Lead-CeresClone-312833  TKVMTFENVK  RWLKELRDHA  DSNIVVMLIG  NKTDLRHLRS  VAVEDAASFA
gi|50920025             TKATTFENVK  RWLKELRDHA  DSNIVVMLIG  NKIDLKHLRS  VSLEDATSFA  150

200
Lead-CeresClone-312833  ESEGLFFIET  SALDATNVEK  AFHTVLAEIY  RIISKKPLSS  EESGLGSGNL
gi|50920025             EREGLSFVET  SALDATNVDK  AFQTVLTEIY  RIISKKALAA  DEAGAGAGAV  200

Lead-CeresClone-312833  REGQSIQVSA  TNSGALTSRC  CSS  223
gi|50920025             REGQSIQVSA  TDSSSFTSRC  CSF  223
```

Figure 39

```
                                                                              50
CeresClone:1620744      MKGAKGKGTV KDKKEVLKPV DDKRVGKRKA ATKTESSSKK QTKKGKLASK
Lead-CeresClone-31322   MKDNQTEVES RSTDDRLK-- ---------- ---------- GNKVGKK-TK    29
CeresClone:980901       MKGGETKAQS KSTDERLK-- ---------- -------TR  GKKAGKKAAK   30
CeresClone:1030653      MKGGESKAQA KSTDERLK-- ---------- -------TR  GKKAGKK-VK    29
CeresClone:956177       MKGGESKAQA KSTDERLK-- ---------- -------TR  GKKAGKK-VK    29

100
CeresClone:1620744      DPNKPKKPAS AFFVFMEEFR KIYKLENPDN KGVAAVGEAG GEKWKSLFYA
Lead-CeresClone-31322   DPNRPKKPPS PFFVFLDDFR KEFNLANPDN KSVGNVGRAA GKKWKTMTEE    79
CeresClone:980901       DPNKPKRPPS AFFVFLEGFR KEFNLANPDN KSVGAVGKAA GAKWKSMTDE    80
CeresClone:1030653      DPNKPKRPPS AFFVFLEGFR KEFNLANPDN KSVGAVGKAA GAKWKSMTAE    79
CeresClone:956177       DPNKPKRPPS AFFVFLEGFR KEFNLANPDN KSVGAVGKAA GAKWKSMTAE    79

121
CeresClone:1620744      EKAPYEAKAA KRNXKYERSW L--------- ---------- ----------
Lead-CeresClone-31322   ERAPFVAKSQ SKKTEYAVTM QQYNMELANG NKTTLGDDE- ---------    117
CeresClone:980901       DKAPYVAKAE SKKTEYTKTM QKYNMKLANG TSTAGDDDSD KSKSEVNDEA   130
CeresClone:1030653      DKAPYVAKAE TKKTEYAKTM QKYNMKLANG TSTAGDDDSD KSKSEVNDEE   129
CeresClone:956177       DKAPYVAKAE TKKTEYAKTM QKYNMKLANG TSTAGDDDSD KSKSEVNDEE   129

CeresClone:1620744      ---------- -          121
Lead-CeresClone-31322   ---KQEKAAD D          125
CeresClone:980901       EGGSEEEEDD D          141
CeresClone:1030653      DAASDEEEDD D          140
CeresClone:956177       DAASDEEEDD D          140
```

Figure 40

Sequence alignment (positions 1–271):

Positions 1–50
```
Lead-CeresClone-325679  MDHEEIKDIV  RKFPAFAYYS  VDRKIKPLVE  LLLELGVKNS  SIPGIIKKRP
gi|50910213             MDHEEIKNVV  RKFPAFAYYN  VDRKIKPLVA  LLLELGVPRS  NIPGIIKKRP
```

Positions 51–100
```
Lead-CeresClone-325679  QLCGISMSDN  LKPMMAYLES  GVDKAQWSK   VITRFPALLT  YSRNKVQTTV
gi|50910213             QLCGISLSDN  LKPMMTYLEN  VGINKDKWSK  VLSRFPALLT  YSRQKVETTV
```

Positions 101–150
```
Lead-CeresClone-325679  SFLAELGVSE  KSIGKILTRC  PHIMSYSVDD  NLRPTAAYFR  SIGADAASLI
gi|50910213             SFLTELGVPK  ENIGKILTRC  PHIMSYSVND  NLRPTAEYFQ  SIGADAASLI
```

Positions 151–200
```
Lead-CeresClone-325679  QKSPQAFGLN  VEAKLRPTTE  FFLARGFSVE  EVGVMANRFG  VHTLSLEEN
gi|50910213             QKSPQAFGLN  IEAKLKPITE  FFLERDFTME  EIGTMANRFG  IHTLSMEDN
```

Positions 201–250
```
Lead-CeresClone-325679  LLPKYEFFLA  MEYPRCELVK  FPQYFGYSLD  RRIKPRYARM  TGCGVRLILN
gi|50910213             LLPKYEYFLT  MGYPRNELVK  FPQYFGYSLE  QRIKPRYARM  DCGVRLILN
```

Positions 251–271
```
Lead-CeresClone-325679  QMLSVSDARF  EKILEKKTAR  L    271
gi|50910213             QLLSVSDSRF  EDILRKRMDG       271
```

Figure 41

| | | | | | |
|---|---|---|---|---|---|
| Lead-CeresClone:32754 | MADSPQRRRD | SRSPSPRKER | ARSRSRSRSR | SRSRPRLRSR | SRSLPRPMSP | 50 |
| CeresClone:1855403 | MADSP-RKRN | SQSPSPWREQ | SRSRSRSRPR | SRSRSRSRSW | SR--PRHRSR | 47 |
| CeresClone:572426 | MADSP-PRRN | SRSPSPWRAE | SRSRSRSRSR | PRSRSRSRSF | EK--QRPRSR | 47 |

| | | | | | |
|---|---|---|---|---|---|
| Lead-CeresClone:32754 | SRSRGRSRSR | SRGRSEVENP | GTTLYVTGLS | TRVTDKDLEA | HFAKEGKVAS | 100 |
| CeresClone:1855403 | SHSRGRSRSR | SRGRVDAGNP | GNTLYVTGLS | QRVTERDLEE | HFSKEGKVAS | 97 |
| CeresClone:572426 | SRSRGRSRSR | SNERSEAKNA | GTTLYVTGLS | SRVTERDLEE | HFSKEGKVAS | 97 |

| | | | | | |
|---|---|---|---|---|---|
| Lead-CeresClone:32754 | CFLVMEPRTR | VSRGFAFVTM | SSLKDAERCI | KYLNQSVLEG | RYITVERSRR | 150 |
| CeresClone:1855403 | CFLVVEPRTR | ISRGFAFVTM | DSVEDASRCI | KYLNQSILEG | RFITVERSRR | 147 |
| CeresClone:572426 | CFLVVEPRTR | SRGFAFITM | DTVEDANRCI | KYLNQSVLEG | RYITVERSRR | 147 |

| | | | | | |
|---|---|---|---|---|---|
| Lead-CeresClone:32754 | KRPRTPTPGH | YLGLKSSRDS | DREGRSSRGR | HY---DRDDYR | DR----RSPR | 194 |
| CeresClone:1855403 | KRPRTPTPGH | YLGLKNTRDY | G-RGERGRYR | GG--GRDDYG | YR----RSPR | 190 |
| CeresClone:572426 | KRPRTPTPGH | YLGLKSTRDY | GHRGDHGRYR | GGSGHDDYG | YRGDRGRSPR | 197 |

| | | | | | |
|---|---|---|---|---|---|
| Lead-CeresClone:32754 | ------RD | YSPRDE---- | -RSRRDRSY | SPHGRSPERR | SERRSERSER | 231 |
| CeresClone:1855403 | RS--PYRG-RD | YSPRYS-PH | GGRSRRERSY | SPP-YS--- | ----RSPR | 221 |
| CeresClone:572426 | HS-PPYRGGRD | YSPRHSPPY | GGRSRRDRSR | SLP-YSPYGS | PDRRY----- | 241 |

| | |
|---|---|
| Lead-CeresClone:32754 | RYEPRGSR | 239 |
| CeresClone:1855403 | ---RGSR | 225 |
| CeresClone:572426 | ---ARGSR | 246 |

Figure 42

|  |  |  |  |  |  |  |
|---|---|---|---|---|---|---|
| 1503188 | M--------- | ---------- | ---------- | ---------- | ---------- | 1 |
| Lead-CeresClone-33139 | M--------- | ---------- | ---------- | ---------- | ---------- | 1 |
| gi\|21386951 | MVRPPCCDKG | GVKKGPWTPE | EDILVTYIQ | EHGPGNWRAV | PTNTGLLRCS | 50 |

|  |  |  |  |  |  |  |
|---|---|---|---|---|---|---|
| 1503188 | ---------- | ---------- | ---------- | ---IH | LQALLGNRWA | AIASYLPQRT | 24 |
| Lead-CeresClone-33139 | ---------- | ---------- | ---------- | ---VH | LQALLGNRWA | AIASYLPQRT | 24 |
| gi\|21386951 | KSCRLRWTNY | LRPGIKRGNF | TEHEEKM | VH | LQALLGNRWA | AIASYLPQRT | 100 |

|  |  |  |  |  |  |  |
|---|---|---|---|---|---|---|
| 1503188 | DNDIKNYWNT | HL | KKLKKLQ | QDSHQELDRS | ------AGQ | EGQSRQ SRG | 56 |
| Lead-CeresClone-33139 | DNDIKNYWNT | HLKKKLNKVN | QDSHQELDRS | SLSSSPSSSS | ANSNSNI SRG | 74 |
| gi\|21386951 | DNDIKNYWNT | HLKKKLNKVN | QDSHQELDRS | SLSSSPSSSS | ANSNSNI SRG | 150 |

|  |  |  |  |  |  |  |
|---|---|---|---|---|---|---|
| 1503188 | QWERRLQTDI | HMARQALSEA | LSPEKPNSL | TELKPS----- | ------C | 93 |
| Lead-CeresClone-33139 | QWERRLQTDI | HLAKKALSEA | LSPAVAPIIT | STVTTSSSA | ESRRSTASAS | 124 |
| gi\|21386951 | QWERRLQTDI | HLAKKALSEA | LSPAVAPIIT | STVTTSSSA | ESRRSTSSSA | 200 |

|  |  |  |  |  |  |  |
|---|---|---|---|---|---|---|
| 1503188 | GYEKPAPAS- | LYASSTENIA | KLLKGWMRSG | PNQSLTNSTT | TQNSFNMAV | 142 |
| Lead-CeresClone-33139 | GFLRTQETST | TYASSTENIA | KLLKGWVKNS | PK-------- | TQNSADQIAS | 166 |
| gi\|21386951 | GFLRTQETST | TYASSTENIA | KLLKGWVKNS | PK-------- | TQNSADQIAS | 242 |

|  |  |  |  |  |  |  |
|---|---|---|---|---|---|---|
| 1503188 | ADSFSSEEL | NRADENDTEL | SEAFESLFGF | DSSNIDFSQS | TSPDTGLLQD | 192 |
| Lead-CeresClone-33139 | TE---VKEVI | K--SDDGKEC | AGAFQSFSEF | DHSYQQ--AG | VSPD-----H | 204 |
| gi\|21386951 | TE---VKEVI | K--SDDGKEC | AGAFQSFSEF | DHSYQQ--AG | VSPD-----H | 280 |

Figure 42 (continued)

```
1503188              ESKPN----S  SAQVPLSVLE  RWLFDEGAMQ  GKEYL SEVTP  DEN-NLF      234
Lead-CeresClone-33139 ETKPDITGCC  SNQSQWSLFE  KWLFEDSGGQ  ---- GDI LL  DENTNFF      247
gi|21386951          ETKPDITGCC  SNQSQWSLFE  KWLFEDSGGQ  ---- GDI LL  DENTNFF      323
```

Figure 43

| | | | | | |
|---|---|---|---|---|---|
| gi\|92894385 | -MDDI KGLC | G----WSMKE | NKLFE LALAL | VDESH PERWE | MVAAM VGGE K | 45 |
| gi\|34913016 | MASMSVSSSR | A---PQWTARQ | NEQFERALAV | YDRDTPERWH | NI ARAVA G-K | 47 |
| Lead-CeresClone:331755 | MASMSLSSSR | A---QWTAKQ | NKLFEQALAV | YDRDTPDRWH | NI ARAVGG--K | 46 |
| CeresClone:331755 | MASMSLSSSR | A---QWTAKQ | NKLFEQALAV | YDRDTPDRWH | NI ARAVGG--K | 46 |
| CeresClone:1775942 | MASMSMRSSR | A---QWTAKQ | DKLFEQALAV | YDKDTPDRWH | NI ARAVGG--K | 46 |
| gi\|61652985 | ----MASTR | GSGRPWSAKE | NKAFEKALAV | YDRDTPDRWA | NVARAVE G-R | 44 |
| CeresClone:1723374 | MASGSMSSS|- | ---WTAKE | NKMFEKALAV | YDKETRDRWS | KI ARAI GG--K | 43 |
| gi\|7981380 | ---MSSMSSQH | GSSGSWTAKQ | NKAFEKALAK | YDKDTPDRWQ | NVAKAVGG--K | 47 |
| CeresClone:638126 | MASSSLSIKQK | ASDSSWTPKQ | NKAFEKALAV | YDKDTPDRWH | NVAKAVGG--K | 49 |
| CeresAnnot:1514100 | MASSNSMSSRG | S|--GSWTVQQ | NKLFEKALAV | YDRDTPDRWY | NVARAVGG--K | 47 |
| CeresClone:1847251 | MASNSLTSSR | TSGSSWTAKQ | NKLFEKALAK | YDKDTPDRWH | NI AKAVGG--K | 49 |
| gi\|38566494 | MASNSMSSSA | S|----WTRKE | NKLFERALAT | YDQDTPDRWH | NVARAVGG--K | 45 |

| | | | | | |
|---|---|---|---|---|---|
| gi\|92894385 | SAGEVQKHYV | LLEDLELE | SGKF---DHK | LGEDN TCVIV | D|TESLCLSD | 92 |
| gi\|34913016 | SADEVKLYYD | LVEDVKR E | TGKVPF PAYR | CPQPAI AENS | GI W------- | 90 |
| Lead-CeresClone:331755 | SADEVRRYYE | LLVKDLEHI E | AGKVPF PAYR | CPGGYDDADS | DRLKHLT---- | 93 |
| CeresClone:331755 | SADEVRRYYE | LLVKDLEHI E | AGKVPF PAYR | CPGGYDDADS | DRLKHLT---- | 93 |
| CeresClone:1775942 | SAEEVRRYYE | LLEE DVKR E | AGKVPF PVYR | CPPAPPPI TS | ------- | 86 |
| gi\|61652985 | TPEEVKKHYE | LVEDI KYI E | SGKVPF PNYR | TTGG NMKTDE | KRFRNLKI R-- | 93 |
| CeresClone:1723374 | TADEVKRYYD | LVEDVRR E | AGQMPYANYR | SSNGRG----- | ---------- | 79 |
| gi\|7981380 | SADEVKRHYE | LLRDVFFID | NGMVPF PKYK | TTGGSHNSTS | D|--------- | 88 |
| CeresClone:638126 | TAEEVKRHYE | LLEDLRHI E | SGHVPF PNYR | STGSSTNVEE | EERLLKYLKL | 99 |
| CeresAnnot:1514100 | SADEVKRHYE | LVEDVKHI E | SGHVPF PNYR | TTGANGHARD | GI V------- | 90 |
| CeresClone:1847251 | SVEEVKLHYE | LVRDLKD|E | SGRY PYP-YP | TN|-------- | ---------- | 80 |
| gi\|38566494 | SAEEVRRHYE | LLI RDVNDI E | SGRYPHPNYR | SNG NH----- | ---------- | 81 |

Figure 43 (continued)

| | | |
|---|---|---|
| gi\|92894385 | K | 93 |
| gi\|34913016 | - | 90 |
| Lead-CeresClone:331755 | - | 93 |
| CeresClone:331755 | - | 93 |
| CeresClone:17775942 | - | 86 |
| gi\|16652985 | - | 93 |
| CeresClone:17723374 | - | 79 |
| gi\|7981380 | N | 88 |
| CeresClone:638126 | - | 100 |
| CeresAnnot:1514100 | - | 90 |
| CeresClone:1847251 | - | 80 |
| gi\|38566494 | - | 81 |

Figure 45

```
Lead-CeresClone-337432    MGANGHP-PA STVAQNGSHS ---------- ---------- GGGGGGGVNP   31
gi|50925955               MGANGHPPPA SAAAQNGSHS ---------- -----SGGGG GDGGGGGANP   36
CeresAnnot:1509127        -MAN---IPS GTNNQDGNQA ---------- ---PSSFNG NNPSNGNSDP   31
gi|27754217               MAASAN--PS G-NNQEGSSA TQKVSSSSAA AANGAAVNSV DNGGNTGAAA   47
CeresClone:1619846        MMAN----PS G-NHQEHLHV ---------- -----VSSSAP           21

Lead-CeresClone-337432    SNGGTGAALR HDPGLAREWS TEEQTILDEL LVKYASDLPV VRYAKVAMKL   81
gi|50925955               SPGGTVAALR HDPGLAREWS PEEQSTLDEL LVKYASDAPV LRYAKIAMKL   86
CeresAnnot:1509127        SSGSS---LK HNPGISTDWT FEEQTILEEG LVDFAEFTNV VRYAKIAINL   78
gi|27754217               DNSQIIGALR HNPGISTDWT LEEQSLLEDL LVKYATEPSV FRYAKIAMKM   97
CeresClone:1619846        ETSGAALAMK HNPGISLDWT AEEQALLEDG LSKYASESNI VRYAKIALQL   71

Lead-CeresClone-337432    PEKTVRDVAL RCRWMNKKES AKRKKEDHNS SKKSKDKKEK VSDSSSKPPV  131
gi|50925955               PDKTVRDVAL RCRWMNKKES GKRKKEDHSS SKKSKDKKEK VSDSSLKPPV  136
CeresAnnot:1509127        PNKTVRDVAL RCRWMNKKEQ SKRRKEDCNL ARRSRDKKER HGDPSAKTSN  127
gi|27754217               KDKTVRDVAL RCRWMIKKEN GKRRKEDHS- SRKSKDKKEK AIDSSAKSSS  146
CeresClone:1619846        QQKTVRDVAL RVRWMNKKEN SKRRKDDHNL TRKSKDKKER VSDPAVKSSN  121

Lead-CeresClone-337432    HMVGRPNVPP YPLPVLPMDD DEL-ISSKAIG GPTGEILETN AHVLGQISSN  180
gi|50925955               HIAGRPNVPP YPLPALPIDD DEL-ISSKAIG GPTGEILETN AQVLSQISTN  185
CeresAnnot:1509127        FMAARPSVSP FATPMLPLES EEGISYDAIG GVTGDLLKQN AQILNQISTN  177
gi|27754217               HLNVHPNGPS YAPPMMPIDT DDGISYKAIG GVSGDLLEQN AQMFNQLSTN  196
CeresClone:1619846        FVA-RSNVSP YAPPMIAMDN DDGISYTAIG GPTGDLLEQN AQALNQISTN  170
```

Figure 45 (continued)

| | | | | | |
|---|---|---|---|---|---|
| Lead-CeresClone:337432 | LSNMQIQDNI | SLLCQTRDNI | LRVLKEINDA | PDIMKQMPPL | PVKINEELVN | 230 |
| gi|50925955 | LSTMQIQDNI | SLLCQTRDNI | LRVLKEINDA | PDIMKQMPPL | PVKINEELVN | 235 |
| CeresAnnot:1509127 | LASFQIQENL | NLLRTRDNI | RKIMNQMNDV | PELMKQMPPL | PVKLNDDLAD | 227 |
| gi|27754217 | FSAFQLHENV | NILCKARDNI | LALNDLNDM | PEVMKQMPPL | PVKLNEELAN | 246 |
| CeresClone:1619846 | LSAFQVQENI | NLFCQTRDNI | LKIMNELNDS | PEVMKQMPPL | PVKVNEELAN | 220 |

| | | | |
|---|---|---|---|
| Lead-CeresClone:337432 | SLLPRPTVPM | QI | 241 |
| gi|50925955 | SMLPRPTVPM | QI | 246 |
| CeresAnnot:1509127 | TILPPNLPR | PI | 238 |
| gi|27754217 | SILPRPSHQR | KS | 258 |
| CeresClone:1619846 | SILPRTNLPP | QS | 232 |

Figure 46

| | | | | | | | |
|---|---|---|---|---|---|---|---|
| gi\|21279 | -MAVCTVYT | PTTTHLGSS | ---------- | ------FNQ | NNKQVEFNYK | R SSSNNT LF | 41 |
| CeresAnnot:1500106 | -MAVCTVYTT | Q--SLNSTCSI | STPTKTHL | GF | NQRHVFYST | NKKT---TKRA | 46 |
| gi\|23197622 | -MAVSTIYST | Q--ALNSTHF- | LT------- | SSS | SSKQVFLY-- | RRQPQTNRRF | 40 |
| gi\|100796 | -MAFCSPHST | T--SLRSPCT- | ----PN--- | SGF | RQNQVI FTT | RSSRRSNTRH | 44 |
| Lead-CeresClone-339518 | MMAICSAHTT | T--SLRSPCT- | ----VSNAAGL | --- | VQKQVI FLTS | INRRSGSRRR | 49 |
| gi\|50911777 | -MAISSLHAT | T--SLHSPCT- | ----TN---- | TSF | RQNQVI FFTT | RSNRRGSTRY | 42 |
| CeresClone:243130 | -MAICSAHTT | T--SLRSPCT- | ----TVSN-- | AGL | RQKQVI FVTS | NRRSGGGRRH | 44 |
| CeresClone:1776411 | -MAICSTHTT | T--SLHSPCT- | ----TVSN-- | AGF | RQKQVI FFTS | NRRS---GRRH | 42 |

| | | | | | | | |
|---|---|---|---|---|---|---|---|
| gi\|21279 | TTRPS---YV | ITCSQQ---QT | -VI GLAADSG | CGKSTFMRRL | TSVFGGAAEP | 86 |
| CeresAnnot:1500106 | SS------AV | ITCSAD-T QT | -VI GLAADSG | CGKSTFMRRL | TSVFGGAAEP | 89 |
| gi\|23197622 | N------TL | ITCAQE--- T | -VI GLAADSG | CGKSTFMRRL | TSVFGGAAKP | 80 |
| gi\|100796 | -GART--FQ | VSCAVE--- QP | -VI GLAADSG | CGKSTFMRRL | TSVFGGAAEP | 88 |
| Lead-CeresClone-339518 | GCGVSRTLLQ | VSCSADGNKP | VVI GLAADSG | CGKSTFMRRL | TSVFGGAAEP | 99 |
| gi\|50911777 | GGART---FQ | VSCSVD---KP | -VI GLAADSG | CGKSTFMRRL | TSVFGGAAEP | 87 |
| CeresClone:243130 | GGARS---FQ | VSCSVD---KP | VVI GLAADSG | CGKSTFMRRL | TSVFGGAAEP | 89 |
| CeresClone:1776411 | GGART---FQ | VSCSVE---KP | VVI GLAADSG | CGKSTFMRRL | TSVFGGAAEP | 87 |

| | | | | | | | |
|---|---|---|---|---|---|---|---|
| gi\|21279 | PKGGNPDSNT | LI SDTTTVI C | LDDFHSLDRN | GRKVEKVTAL | DPKANDFDLM | 136 |
| CeresAnnot:1500106 | PRGGNPDSNT | LI SDTTTVI C | LDDYHSLDRT | GRKEKGVTAL | DPRANNFDLM | 139 |
| gi\|23197622 | PKGGNPDSNT | LI SDTTTVI C | LDDYHSLDRY | GRKEQKVTAL | DPRANDFDLM | 130 |
| gi\|100796 | PKGGNPDSNT | LI SDTTTVI C | LDDYHSLDRT | GRKEKGVTAL | DPKANDFDLM | 138 |
| Lead-CeresClone-339518 | PRGGNPDSNT | LI SDTTTVI C | LDDYHSLDRT | GRKEKGVTAL | DPRANNFDLM | 149 |
| gi\|50911777 | PKGGNPDSNT | LI SDTTTVI C | LDDYHSLDRT | GRKEKGVTAL | DPRANDFDLM | 137 |
| CeresClone:243130 | PKGGNPDSNT | LI SDTTTVI C | LDDYHSLDRN | GRKEKGVTAL | DPRANNFDLM | 139 |
| CeresClone:1776411 | PKGGNPDSNT | LI SDTTTVI C | LDDYHSLDRT | GRKEKGVTAL | DPRANNFDLM | 137 |

Figure 46 (continued)

| | | | | | | | |
|---|---|---|---|---|---|---|---|
| gi|21279 | YEQVKALKEG | KAVDKPIYNH | VSGLLDPPEL | QPPKI LVI E | GLHPMYDARV | | 186 |
| CeresAnnot:1500106 | YEQVKAIKDG | TAVEKPIYNH | VTGLLDPPEL | KPPKI LVI E | GY---YDQRV | | 185 |
| gi|23197622 | YEQVKALKNG | IAVEKPIYNH | VTGLLDPPEL | QPPKI LVI E | GLHPMFDERV | | 180 |
| gi|100796 | YEQVKAIKEG | KAI EKPIYNH | VTGLLDPAEL | QPPKI FVI E | GLHPMYDERV | | 188 |
| Lead-CeresClone-339518 | YEQVKAIKQG | QAVQKPIYNH | VTGLLDPPEL | TPPKI FVI E | GLHPMFDERV | | 199 |
| gi|50911777 | YEQVKAIKEG | KAI EKPIYNH | VTGLLDPPEL | QPPKI FVI E | GLHPMYDERV | | 187 |
| CeresClone:243130 | YEQVKAIKEG | QAVEKPIYNH | VTGLLDPPEL | APPKI FVI E | GLHPMFDERV | | 189 |
| CeresClone:1776411 | YEQVKAIKEG | QT EKPIYNH | VTGLLDPPEV | KPPKI FVI E | GLHPMFDERV | | 187 |

| | | | | | | | |
|---|---|---|---|---|---|---|---|
| gi|21279 | RELLDFSIYL | DI SNEVKFAW | KI QRDMKERG | HSLESI KASI | ESRKPDFDAY | | 236 |
| CeresAnnot:1500106 | RDLLDFSIYL | DI SNEVKFAW | KI QRDMAERG | HSLESI KASI | EARKPDFDAY | | 235 |
| gi|23197622 | RDLLDFSIYL | DI SNEVKFAW | KI QRDMAERG | HSLESI KASI | EARKPDFDAF | | 230 |
| gi|100796 | RELLDFSIYL | DI SNEVKFAW | KI QRDMAERG | HSLESI KASI | EARKPDFDAF | | 238 |
| Lead-CeresClone-339518 | RDLLDFSIYL | DI SDEVKFAW | KI QRDMAERG | HSLESI KASI | EARKPDFDAY | | 249 |
| gi|50911777 | RDLLDFSIYL | DI SDEVKFAW | KI QRDMAERG | HSLESI KASI | EARKPDFDAF | | 237 |
| CeresClone:243130 | RDLLDFSIYL | DI SDEVKFAW | KI QRDMAERG | HSLESI QASI | EARKPDFDAF | | 239 |
| CeresClone:1776411 | RDLLDFSIYL | DI SDEVKFAW | KI QRDMAERG | HSLESI KASI | EARKPDFDAF | | 237 |

| | | | | | | | |
|---|---|---|---|---|---|---|---|
| gi|21279 | DPQKQHADV | VI EVLPTELI | PDDDEGKVLR | VRMI QKEGVK | FFNPVYLFDE | | 286 |
| CeresAnnot:1500106 | DPQKQYADA | VI EVLPTQLI | PDDNEGKVLR | VKLI MKEGVE | FFSPVYLFDE | | 285 |
| gi|23197622 | DPQKQYADA | VI EVLPTQLI | PDDNEGKVLR | VRLI MKEGVK | YFSPVYLFDE | | 280 |
| gi|100796 | DPQKQYADA | VI EVLPTQLI | PDDDEGKVLR | VKLI MKEGVK | FFNPVYLFDE | | 288 |
| Lead-CeresClone-339518 | DPQKQYADA | VI EVLPTQLI | PNDDEGKVLR | VKLI MKEGVK | NFNPVYLFDE | | 299 |
| gi|50911777 | DPQKQYADA | VI EVLPTQLI | PDDNEGKVLR | VKLI MKEGVD | NFNPVYLFDE | | 287 |
| CeresClone:243130 | DPQKQYADA | VI EVLPTQLI | PDDDEGKVLR | VKLI MKEGVK | NFNPVYLFDE | | 289 |
| CeresClone:1776411 | DPQKQYADA | VI EVLPTQLI | PDDNEGKVLR | VKLI MKEGVK | HFNPVYLFDE | | 287 |

Figure 46 (continued)

| | | | | | |
|---|---|---|---|---|---|
| gi\|21279 | GSTISWIPCG | RKLTCSYPGI | KFSYGPDTFY | GNEVTVVEMD | GMFDRLDELI | 336 |
| CeresAnnot:1500106 | GSSISWIPCG | RKLTCSYPGI | KFSYGPDAYY | GHEVSVLEMD | GQFDRLDELI | 335 |
| gi\|23197622 | GSTISWIPCG | RKLTCSYPGI | KFNYEPDSYF | DHEVSVLEMD | GQFDRLDELI | 330 |
| gi\|100796 | GSTINWIPCG | RKLTCSYPGI | KFSYGPDTYF | GQEVSVLEMD | GQFDRLDELI | 338 |
| Lead-CeresClone-339518 | GSTISWVPCG | RKLTCSYPGI | KFAYGPDTYF | GNEVSVLEMD | GQFDRLDELI | 349 |
| gi\|50911777 | GSSITWVPCG | RKLTCSYPGI | KFSYGPDTYF | GHEVSVLEMD | GQFDRLDELI | 337 |
| CeresClone:243130 | GSTISWVPCG | RKLTCSYPGI | KFSYGPDTYF | GNEVSVLEMD | GQFDRLDELI | 339 |
| CeresClone:1776411 | GSSISWVPCG | RKLTCSYPGI | KFAYGPDTYF | GHEVSVLEMD | GQFDRLDELI | 337 |

| | | | | | |
|---|---|---|---|---|---|
| gi\|21279 | YVESHLSNLS | TKFYGEVTQQ | MLKHQNFPGS | NNGTGLFQTI | IGLKIRDLFE | 386 |
| CeresAnnot:1500106 | YVESHLSNIS | TKFYGEVTQQ | MLKHADFPGS | NNGTGLFQTI | VGLKIRDLFE | 385 |
| gi\|23197622 | YVESHLSNLS | TKFYGEVTQQ | MLKHADFPGS | NNGTGLFQTI | VGLKIRDLYE | 380 |
| gi\|100796 | YVESHLSNLS | TKFYGEVTQQ | MLKHADFPGS | NNGTGLFQTI | VGLKIRDLYE | 388 |
| Lead-CeresClone-339518 | YVESHLSNLS | TKFYGEVTQQ | MLKHADFPGS | NNGTGLFQTI | VGLKIRDLYE | 399 |
| gi\|50911777 | YVESHLSNLS | TKFYGEVTQQ | MLKHADFPGS | NNGTGLFQTI | IGLKIRDLYE | 387 |
| CeresClone:243130 | YVESHLSNLS | TKFYGEVTQQ | MLKHADFPGS | NNGTGLFQTI | VGLKIRDLYE | 389 |
| CeresClone:1776411 | YVESHLSNLS | TKFYGEVTQQ | MLKHADFPGS | NNGTDLFQTI | VGLKIRDLYE | 387 |

| | | |
|---|---|---|
| gi\|21279 | QLVASRSIAT | ATAAKA | 402 |
| CeresAnnot:1500106 | QIVASRAKTP | VEATKA | 401 |
| gi\|23197622 | QLIANKATAR | AEKAKA | 395 |
| gi\|100796 | QIAERAGVP | AEAAKV | 404 |
| Lead-CeresClone-339518 | QIVAERAGAP | AEAAKV | 415 |
| gi\|50911777 | QIAERAGAP | TEAAKV | 403 |
| CeresClone:243130 | QIVAERAGVP | AEAAKV | 405 |
| CeresClone:1776411 | QIVAERAGAP | AETAKV | 403 |

Figure 47

| | | | | | | |
|---|---|---|---|---|---|---|
| gi\|16549070 | MGRCKI EI KR | ENSTNRQVT | YSKRRGGIMK | KAKFLTVLCD | AQVSLIMFSS | 50 |
| gi\|48375197 | MARGKI QI KR | ENQTNRQVT | YSKRRNGLFK | KAHELTVLCD | ARVSIIMFSS | 50 |
| gi\|1561782 | MARGKI QI KR | ENQTNRQVT | YSKRRNGLFK | KAHELTVLCD | ARVSIIMFSS | 50 |
| gi\|6707088 | MARGKI QI KR | ENQTNRQVT | YSKRRNGLFK | KAHELTVLCD | ARVSIIMFSS | 50 |
| Lead-CeresClone-34635 | MARGKI QI KK | ENSTNRQVT | YSKRRNGLFK | KAGFLTVLCD | AKVSIIMFSS | 50 |
| gi\|5825623 | MARGKI QI KK | ENQTNRQVT | YSKRRNGLFR | KAHELTVLCD | AKISILMFSS | 50 |
| gi\|99109361 | MARGKI QI KL | ENSTNRQVT | YSKRMRNGLFK | KAHELTVLCD | ARVSIIMFST | 50 |
| CeresClone:1921942 | MARGKI QI KK | ENQTNRQVT | YSKRRNGLFK | KAHELTVLCD | AKVSIVMISS | 50 |
| gi\|42795257 | MARGKI QI KR | ENQTNRQVT | YSKRRNGLFK | KAHELTVLCD | AKVSIIMISS | 50 |
| gi\|83999564 | MARGKI QI KR | ENQTNRQVT | YSKRRNGLFK | KAHELSVLCD | AKVSIVMISS | 50 |
| gi\|1370276 | MARGKI QI KR | ENQTNRQVT | YSKRRNGLFK | KAHELTVLCD | AKVSILMISS | 50 |
| gi\|22665 | MARGKI QI KR | ENTNRQVT | YSKRRNGLFK | KAHELSVLCD | AKVSIVMISS | 50 |
| gi\|82734191 | MARGKI QI KR | ENPTNRQVT | YSKRRNGLFK | KANELTVLCD | AKVSILMFSS | 50 |
| gi\|42795301 | MARGKI QI KR | ENQTNRQVT | YSKRRNGLFK | KANELTVLCD | AKVSIIMFSS | 50 |
| gi\|42795285 | MARGKI QI KR | ENQTNRQVT | YSKRRNGLFK | KANELTVLCD | AKVSIIMFSS | 50 |
| gi\|60100348 | MARGKI QI KR | ENQTNRQVT | YSKRRNGLFK | KANELSVLCD | AKVSIIMFSS | 50 |
| gi\|60858812 | MARGKI QI KK | ENQTNRQVT | YSKRRNGLLK | KANELTVLCD | AKVSIIMFSS | 50 |

| | | | | | | |
|---|---|---|---|---|---|---|
| gi\|16549070 | TGKFSEYCSP | STTTKNIFDR | YQQASGISLW | NSHYERMQSH | LKLKEENN | 100 |
| gi\|48375197 | SNKLHEFISP | NTTTKEIDL | YQTVSDVDVW | SAHYERMQET | KRKLLETNRN | 100 |
| gi\|1561782 | SNKLHEFISP | NTTTKEIDL | YQTVSDVDVW | SAHYERMQET | KRKLLETNRN | 100 |
| gi\|6707088 | SNKLHEFISP | NTTTKEIDL | YQTVSDVDVW | ATQYERMQET | KRKLLETNRK | 100 |
| Lead-CeresClone-34635 | TDKLHEYISP | STTTKQFFDQ | YQKAAGIDLW | ATQYERMQEH | RQLKEVNKN | 100 |
| gi\|5825623 | SKLHEFISP | SDSAKQLFDQ | YQKTVGVDLW | SSQYERMQEH | LKQLKEVNRN | 100 |
| gi\|99109361 | SKLHEFISP | STTTKQVFDQ | YQKTLGIDLW | NTHYEKMQEH | LKKLKEVNRN | 100 |
| CeresClone:1921942 | TGKLHEYISP | STTTKQMFDQ | YQKIAQVDLW | QPHYEKMQEH | LKKLKDVNRN | 100 |
| gi\|42795257 | TQKLHEFISP | SJTTTKQLFDL | YQKTGVDLW | TTHYEKMQEQ | RKLKEVNRN | 100 |
| gi\|83999564 | TQKLHEFISP | STTTKQLFDQ | YQKAVGVDLW | NSHYEKMQEH | RKLKDVNRN | 100 |
| gi\|1370276 | TGKLHEYISP | SVTTKQLFDQ | YQKAVGVDLW | SSHYEKMQEQ | LKKLNEVNRN | 100 |
| gi\|22665 | TQKLHEFISP | SITTKQLFDL | YQKAVGVDLW | SSHYEKMQEH | RKLKDVNRN | 100 |
| gi\|82734191 | TGKLHEYISP | TATKQLFDQ | YQKAQVDVW | NTHYQKMQDH | LKKLKEVNRN | 100 |
| gi\|42795301 | TQKLHEFISP | STTTKQLFDQ | YQKAVGVDVW | NTHYQKMQDH | LQKLKEVNRN | 100 |
| gi\|42795285 | TQKLHEFISP | SLTTKQLFDQ | YQKAVGVDLW | SSHYENMQEN | LKKLKEVNRN | 100 |
| gi\|60100348 | TQKLHEFISP | STSTKQFFDQ | YQMTVGVDLW | SSHYENMQEN | LKKLKEVNRN | 100 |
| gi\|60858812 | TGKLHEYISP | ATSTKELFDQ | YQKTLGVDLW | THYERMQDN | LKKLKDINRN | 100 |

```
CeresClone:704527       MQAAAS----              ----------YR  GAAGHRRAGH  PSRRPPGPSL  LLPVSVAGVG   38
gi|34914598             MELLLRPSPP              PPWAIPRRSS    GERTKPCRSR  SRSRTGTSKQ  TFPVP--LVG   49
CeresClone:1724787      MALPLRPAAP              AP---PPWRCS   ----------  ASLLDTASKQ  AFPVP-LPAD   44
CeresClone:1397168      MALLLRLAAP              SV---PPRRSS   GLRALP---R  VVLPEVVSKQ  SFLR---LPG   43
CeresClone:627169       MVMLIR----              ----------    CFFARP---R  FSQPQFYGNN  TKP----LVD   32
Lead-CeresClone:36370   MAALIR----              ----------    CC--------S GGQPPPRDKS  RAPE----G    31
CeresAnnot:1481678      MAVIIR----              ----------    CS--------  -----PSSDHI ISPKPHLPAG   30

CeresClone:704527       RFSDAAVPLR              V----------GS LPLPRARGGG  DFARLDA---  ----RDG--    71
gi|34914598             KVGRRPFPVQ              ----------    --CSIVRCCL  SSTDAH---   ----STSDD    80
CeresClone:1724787      RVARFSLSAK              ----------    --RSAGRLVQ  SMTDLTG--   ----FRSDGI   75
CeresClone:1397168      STASMPCPIK              ----------    --RSAARCAP  SLTEHND--   ----SRNNGI   74
CeresClone:627169       KLAFLS----              ----------    --LKPDKGVP  HFEDTLD--   ----GSSK     57
Lead-CeresClone:36370   KFATSIGYSV              ----------    --VRKPGDHP  PFSKI-HSSS  QPKERQGK     69
CeresAnnot:1481678      KLASLLFRAR              KFTPSSGDAS    SILSASRHKL  PGSESVH---  RPASEGHLNT   78

CeresClone:704527       -EAWQLTRAL              GLILPGHQKM    VHANLLKTAV  LST-MSMLIM  PLEAS-AETC  118
gi|34914598             HEDNGHGHFL              MKSTSDLQKV    ISSCFGKACL  LSS--VMLVL  PPSCF-AEPC  127
CeresClone:1724787      HAANEHSRDL              MRSTSDLQEV    VLSSFGKACL  FGS-CIIYVL  PPACL-AEPC  123
CeresClone:1397168      HASSVYGHDL              MKSMSDLQEV    VFSSFSKACL  LSS-CIIYGL  PPSCI-AEPC  122
CeresClone:627169       ISCLLHCSKC              KE--------D   LHQREPSLIF  VASNVLMFSM  PNTAL-AETC   99
Lead-CeresClone:36370   LQTPFASVGS              LDKFSAFEGL    GRLKLPVMAV  LTNSLQMAT   PLEALAAEI-C 119
CeresAnnot:1481678      VQVPPVCDKF              LELSAHQGN     MQLRSSAMAF  LVTNALMWIT  PFEAL-AETC  127

CeresClone:704527       QPTSSFANMP              IFAVALIGA     AVGGLLARQR  KDELKRLNNQ  LRQINTALRR  168
gi|34914598             EPEYSLPNMP              LLFAIAMIGA    TVGGLLARQR  RGELKRLNDQ  LRQINAALRR  177
CeresClone:1724787      EQEYSLPNMP              LLFAIAMVGA    TVGGLLARQR  RGELARLNDQ  LRQINAALRR  173
CeresClone:1397168      EQEYFLPNMP              LLFAIAMVGA    TVGGLLARQR  RGELARLNDQ  LRQINAALRR  172
CeresClone:627169       EADNSVFNMP              LLAVALIGA     TVGGLLARQR  RNELQRVNEQ  LQQINAALRK  149
Lead-CeresClone:36370   EPESSMFSMP              LLLVALIGA     TVGGLLARQR  KGELQRLNEQ  LRQINAALRR  169
CeresAnnot:1481678      EADSSIFNMP              LLLFVALVGA    TVGGLLARQR  KGELQRLNEQ  LRQINAALRR  177
```

Figure 48 (continued)

```
CeresClone:704527        QAQIESFAPG LTYAPV--GR AGELEVIVDP RKQQLVVNLK NGKNYMRNQD  216
gi|34914598              QAKIESYAPS LSYAPV-GSK PESEVIVDP  QKDRLISYLR AGKNYLRNQA  226
CeresClone:1724787       QAKIESYAPT LSYAPV-GSK PESEVIVNP  QKERLIAYLR TGKNYLRNQA  222
CeresClone:1397168       QAKIESYAPA LSYAPV-GSK PESEVIVDP  QKQRLIAYLR TGKNYLRNQA  221
CeresClone:627169        QAKIESYAPS LSYAPIGG R  LDNEIIVDP  KKQELISKLK NGKNFLRNQQ  199
Lead-CeresClone:36370    QAKIESYAPS LSYAPV-GAR PDSEIIVEP  KKQELISKLK TGKTFLRNQE  218
CeresAnnot:1481678       QAKIESYAPT LSYAPV-GSR TESEVIVDP  RKEDLISRLK VGKNFLRNQD  226

CeresClone:704527        LDKAVMEFKT ALELAESIGD RFEEKKAARG LGASLQRLGQ YREAMSWYYK  266
gi|34914598              PDKAFPEFKA AFDLAQSLGD HVEEKKAARG LGASLQRQGK YKEAIKYHSM  276
CeresClone:1724787       PDKAFPEFKA ALDLAQALGD HVEEKKAARG LGASFQRQGK YKEAIKYHSM  272
CeresClone:1397168       PDKAFPEFKA ALDLAQARSLGD HVEEKKAARG LGASLQRQGK YKEAINYHSM  271
CeresClone:627169        PDKAFTEFKN ALELAQNLKD PLEEKKAARG LGASLQRQGK YRDAIKYHSM  249
Lead-CeresClone:36370    PEKAYTEFKL ALELAQSLKD PTEEKKAARG LGASLQRQGK YREAIQYHSM  268
CeresAnnot:1481678       PEKAFVEFKS ALELAQNLKD PTEEKKAVRG LGASLQROGK LQEAIKYHSM  276

CeresClone:704527        VLALSKEITGE DSGCTEAYGA ADCCVDLGD  LEGAAKLYDE YISRLQPRD   315
gi|34914598              VLNISKLTGE DAGVTEAYGA ADCYTELGE  LEKAGKFYDK MIARLE--ND  324
CeresClone:1724787       VLNISKMTGE DAGVTEAYGA ADCYTELGE  LEKAGEFYDK MIARLE--SD  320
CeresClone:1397168       VLNISKVTGE DAGVTEAFGA ADCYTELGE  LEKAGKFYDK MIARLE--NE  319
CeresClone:627169        VLGISEREEE DSGSTEAYGA ADCYTELGD  LEKAGQFYDK MIARLE--KD  297
Lead-CeresClone:36370    VLAISKRESE DSGITEAYGA ADCYTELGD  LEKAGKFYDT MIARLE--TD  316
CeresAnnot:1481678       VLAISKREGE ESGNTEAYGA ADCYTELGD  LEQAAKFYDK MIARLE--TD  324
```

CeresClone:704527  
gi|34914598  
CeresClone:1724787  
CeresClone:1397168  
CeresClone:627169  
Lead-CeresClone:36370  
CeresAnnot:1481678

```
CeresClone:1754197      ----------  ----------  RPLSISDLS  PAPMHGSQLR  VAYQGVPGAY  SEAAAKAYP   138
CeresClone:909699       RSLP------  ----------  -APLRIADLS  PAPMHGSELR  VAYQGVPGAY  SEKASAKAYP  134
CeresClone:383227       AITKNLP---  ----------  -QPLRIADLS  PAPMHGSQLR  VAYQGVPGAY  SEKAAGKAYP  137
gi|70664005             GVAKNLP---  ----------  -QPLRISDLS  PAPMHGSQLR  VAYQGVPGAY  SEKAAGKAYP  134
CeresClone:1856164      PPTQ------  ----------  -KPLTITDLS  PAPMHGSQLR  VAYQGVPGAY  SEKAMGKAYP  152
CeresClone:1807870      PPAKQPPQ--  ----------  -KPLTITDLS  PAPKHGSQLR  VAYQGVPGAY  SEAAAGKAYP  158
1488340                 SNSSIKPHQP  QKPLTITDLC  PAPMHGSHLR  VAYQGVPGAY  SEAAAGKAYP              160
gi|45935145             ----------  ----------  -KPLTITDLS  PAPMHGSTLR  VAYQGVPGAY  SEAAAGKAYP  169
Lead-CeresClone-37739   SK--------  ----------  -KPLSISDLS  PAPMHGSNLR  VAYQGVPGAY  SEAAAGKAYP  142
gi|20259555             PLVPQHRHNP  LKPLSMTDLS  PAPMHGSNLR  VAYQGVPGAY  SEAAAGKAYP              137

CeresClone:1754197      GCDAIPCDQF  EVAFQAVELW  IADRAVLPVE  NSLGGSIHRN  YDLLLRHRLH              188
CeresClone:909699       GSDAIPCDQF  EVAFQAVELW  VADRAVLPVE  NSLGGSIHRN  YDLLLRHRLH              184
CeresClone:383227       GCDAIPCDQF  EVAFQAVELW  IADRAVLPVE  NSLGGSIHRN  YDLLLRHRLH              187
gi|70664005             GCDAIPCDQF  EVAFSAVELW  IADRAVLPVE  NSLGGSIHRN  YDLLLRHRLH              184
CeresClone:1856164      NCEAIPCDQF  EVAFQAVELW  IADRAVLPVE  NSLGGSIHRN  YDLLLRHRLH              202
CeresClone:1807870      NCEAIPCDQF  EVAFQAVELW  IADRAVLPVE  NSLGGSIHRN  YDLLLRHRLH              208
1488340                 NCEAIPCDQF  EVAFQAVELW  IADRAVLPVE  NSLGGSIHRN  YDLLLRHRLH              210
gi|45935145             NCEAIPCDQF  EVAFQAVELW  IADRAVLPVE  NSLGGSIHRN  YDLLLRHRLH              219
Lead-CeresClone-37739   NCQAIPCDQF  EVAFQAVELW  IADRAVLPVE  NSLGGSIHRN  YDLLLRHRLH              192
gi|20259555             NCQAIPCDQF  EVAFQAVELW  IADRAVLPVE  NSLGGSIHRN  YDLLLRHRLH              187

CeresClone:1754197      VGEVQLPVH   HCLLALPGVR  RELLTRVISH  PQALAQCELT  LNAM-GLNVA              237
CeresClone:909699       VGEVQLPVH   HCLLALPGVR  REDITRVISH  PQALAQCEHT  LTRMPGLNAA              234
CeresClone:383227       VGEVQLPVH   HCLLALPGVR  KECLTRVISH  PQALAQCEHT  LTAM-GLNVV              236
gi|70664005             VGEVQLPVH   HCLMALPGVR  KECLTRVMSH  PQALAQCEHT  LTAM-GLNVV              233
CeresClone:1856164      VGEVQLPVH   HCLLALPGVR  KEYLARVISH  PQALSQCEHT  LTKL-GLNVT              251
CeresClone:1807870      VGEVQLPVH   HCLLALPGVR  TEYLTRVISH  PQALSQCENT  LTKL-GLNVT              257
1488340                 VGEVQLPVH   HCLLALPGVR  KEYINRVISH  PQALAQCELT  LTKL-GLQAA              259
gi|45935145             VGEVQLPVH   HCLLALPGVR  KEYLTRVISH  PQALAQCELT  LTKL-GLNVA              268
Lead-CeresClone-37739   VGEVQLPVH   HCLMALPGVR  KEFLTRVISH  PQGLAQCELT  LTKL-GLNVA              241
gi|20259555             VGEVQLPVH   HCLLALPGVR  KEFLTRVISH  PQGLAQCEHT  LTKL-GLNVA              236
```

Figure 49 (continued)

| | | | | | | |
|---|---|---|---|---|---|---|
| CeresClone:1754197 | REAF DDT AGA | AEHI AAA GLR | DTAAI ASARA | AELYGLQVLA | DGI QDDAG NV | 287 |
| CeresClone:909699 | REAF DDT AGA | AEYVAAN GLR | DTAAI ASSRA | AELYGMEVLA | DGI QDDSG NV | 284 |
| CeresClone:383227 | REAF DDT AGA | AEYVAAN GLR | DTAAI ASSRA | AELYGMEVLA | DGI QDDSG NV | 286 |
| gi|70664005 | REAV DDT AGA | AEYVAAN CLR | DTAAI ASSRA | AELYGMEVLA | DGI QDDC NV | 283 |
| CeresClone:1856164 | REAV DDT AGA | AEYI AANNLR | DTAAI ASARA | AELYGLQILA | DGI QDDSS NV | 301 |
| CeresClone:1807870 | REAV DDT AGA | AEYI A T NNLR | DTAAI ASARA | AELYGL N VLA | DGI QDDSS NV | 307 |
| 1488340 | REAV DDT AGA | AEYI AANNLR | DTAAI ASARA | AELYGMQVLA | DGI QDDSS NV | 309 |
| gi|45935145 | REAV DDT AGA | AEYI AANNLR | DTAAI ASARA | AELYGL H VL E | EGI QDDSS NV | 318 |
| Lead-CeresClone-37739 | REAV DDT AGA | AEFI AANNI R | DTAAI ASARA | AEI YGLEI L E | DGI QDDAS NV | 291 |
| gi|20259555 | REAV DDT AGA | AEFI ASNNLR | DTAAI ASARA | AEI YGLEI L E | DGI QDD V S NV | 286 |

| | | | | | | |
|---|---|---|---|---|---|---|
| CeresClone:1754197 | TRFVMLAREP | I PRTDRPFK | TSI VF T HDAD | GTSI LFKVLS | AFAFRDI SLT | 337 |
| CeresClone:909699 | TRFVMLAREP | VPR M DRPFK | TSI VFAHDKE | GTSVLFKVLS | AFAFRDI SLT | 334 |
| CeresClone:383227 | TRFVMLAREP | VVPRTDRPFK | TSI VFAHDRE | GTSVLFKVLS | AFAFRDI SLT | 336 |
| gi|70664005 | TRFVMLAREP | I VPRTDRPFK | TSI VFAHDKE | GTSVLFKVLS | AFAFRDI SLT | 333 |
| CeresClone:1856164 | TRFVMLAREP | I I PRTDRPFK | TSI VFAHEE- | GTSVLFKVLS | AFAFRNI SLT | 350 |
| CeresClone:1807870 | TRFVI LARDP | I I PRTDRPFK | TSI VFAHDK- | GTSVLFKVLS | AFAFRNI SLT | 356 |
| 1488340 | TRFVMLAREP | I I PRTDRPFK | TSI VFAHDK- | GTSVLFKVLS | AFAFRNI SLT | 358 |
| gi|45935145 | TRFVMLAREP | I I PRTDRPFK | TSI VFAHEK- | GT C VLFKVLS | AFAFRNI SLT | 367 |
| Lead-CeresClone-37739 | TRFVMLAREP | I I PRTDRPFK | TSI VFAHEK- | GTSVLFKVLS | AFAFRDI SLT | 340 |
| gi|20259555 | TRFVMLAREP | I I PRTDRPFK | TSI VFAHEK- | GTSVLFKVLS | AFAFRDI SLT | 335 |

| | | | | | | |
|---|---|---|---|---|---|---|
| CeresClone:1754197 | KI ESRPHRHR | PI RLVDDANV | GTAKHFEYMF | YI DFQASMAD | VRAQNALAEI | 387 |
| CeresClone:909699 | KI ESRPH--- R | PI RLA D S S T - | --APK Q FEYMF | YVDFQASLAD | PR V QNALAEV | 380 |
| CeresClone:383227 | KI ESRPHRHR | PI R F X VDDANV | GTAKHFEYMF | YVDFQASLAE | PRAQNALAEV | 386 |
| gi|70664005 | KI ESRPHRHR | PI RLVDDANV | GTAKHFEYMF | YVDFQASLAE | PRAQNALAEV | 383 |
| CeresClone:1856164 | KI ESRPHRNR | PI RLVDDANV | GTAKHFEYMF | YVDFEASMAE | VRAQNALAEV | 400 |
| CeresClone:1807870 | KI ESRPHRNR | PI RLVDDANV | GTAKHFEYMF | YVDFEASMAE | VRAQNALAEV | 406 |
| 1488340 | KI ESRPHRNR | PI RLVDD G NV | GTAKHFEYMF | YVDFEASMAD | VRAQNALAEV | 408 |
| gi|45935145 | KI ESRPHRNR | PI RLVDD E NV | GTAKHFEYMF | YVDFEASMAD | VRAQNALAEV | 417 |
| Lead-CeresClone-37739 | KI ESRPN H N V | PI RLVDEANV | GTAKHFEYMF | YI DFEASMAE | SRAQNALSEV | 390 |
| gi|20259555 | KI ESRPN H NR | PI RVVDDANV | GTAKHFEYMF | YVDFEASMAE | A RAQNALAEV | 385 |

Figure 49 (continued)

| | | | | |
|---|---|---|---|---|
| CeresClone:1754197 | QEFTSFLRVL | GSYPMDMTPW | EAAPSSWSSR | VDNSSSQH | 425 |
| CeresClone:909699 | QEFTSFLRVL | GSYPMDMTPM | AAGVASSE-- | SSSAYSSS | 416 |
| CeresClone:383227 | QEYTSFLRVL | GSYPMDMTPM | TAGSSSTVVS | SSDDPSSS | 424 |
| gi|70664005 | QEYTSFLRVL | GSYPMDMTPM | TAGSSSTV-- | TSDDSSST | 419 |
| CeresClone:1856164 | QEFTSFLRVL | GSYPMDMTPW | CPSSGD---- | -------- | 426 |
| CeresClone:1807870 | QEFTSFLRVL | GSYPMDMTPW | CPSSS----- | -------- | 430 |
| 1488340 | QEFTSFLRVL | GSYPMDMTPW | CPSRGEDD-- | DDDEKNPF | 444 |
| gi|45935145 | QEFTSFLRVL | GSYPMDMTPW | SPSRGD---- | -------- | 443 |
| Lead-CeresClone:37739 | QEFTSFLRVL | GSYPMDMTSW | SPSSSS---- | SSSSTFSL | 424 |
| gi|20259555 | QEFTSFLRVL | GSYPMDMTPW | SPTSSTSS-- | -------- | 413 |

Figure 50

```
gi|50919643         MEAV------------RHPSLS RLKPNP------NAQRTPALS -T VPFR----      33
Lead-CeresClone-37980  MQKVFLAMDT CALVHQSLS RIKLSPPKSS SSSSAFSP ESLPI RRIEL      50
CeresClone:630887   MEAIFVTKPA S---HSLLLT KLSPNPKHLF PPHQQSFHN RHKPTR----    43
1460561             MDSLF------ ---VNQALS RLKLSPK-LT IPSYFSYQSP LHLKQNHGRK      40 gi|50919643         -LRL PNRRLT AAVFQDQTN PRNPASKGGD DDEAYGEVDR IVSSRTIKNP      82
Lead-CeresClone-37980  CFR--GA CAA VQRNYEETTS SVEEAEEDDE SSSSYGEVNK IIGSRTAGEG      99
CeresClone:630887   --FR---P VIAVFQNQHQ QDAAAASNHT EDESYGEVKG IIGSRALEAA      86
1460561             PYN---SFTLF AIQDQQETQN PLQETTQNIE DDESYGEVSK IIGSRAVEGG      88 gi|50919643         VFAEDGSATT VTALEYLVEW KDGHEPSWIP AEAIAADVVA EYETPWWTAA      132
Lead-CeresClone-37980  ---------- -AMEYLIEW KDGHSPSWVP SSYIAADVVS EYETPWWTAA      137
CeresClone:630887   ---------- TGMEYLIEW NDGHAPSWVP ADFIAKDVVA EYETPWWTAA      125
1460561             ---------- KGMEYFLEW KDGHTPSWVP SDFIAKDVVA EYETPWWTAA      127 gi|50919643         KKADAE TA LLA-DET LRR DPDAEDAQGR TAMHFAAGLG SEECVRALAE      181
Lead-CeresClone-37980  RKADEQALSQ LL---EDR DVDAVDESGR TALLFVAGLG SDKCVRLLAE      182
CeresClone:630887   KKADESALKN LI--ESDDGR DVDAVDADGR TALLFVAGLG SESCVKLLAE      173
1460561             KKADSSALSQ LSENEDERR DVNAVDSDGR TALLFVSGLG SEPCVKLLAE      177 gi|50919643         AGADVGRPER AGGGLTPLHI AMGYGRPAAV RALLELGAEP EAPDGQGRTP      231
Lead-CeresClone-37980  AGADLDHRDM R--GGLTALHM AAGYVRPEVL EALVELGADL EVEDERGLTA      231
CeresClone:630887   AGANLDHRD S--GGLTALHM AAGYVRPGVA KVLLDLGADP EVADDRGRTA      222
1460561             AGAELDHRDN S--GGLTALHM AAGYVKPGVV KLLVDLGADP EVKDDRGLTP      226
```

Figure 50 (continued)

```
gi|50919643         ELMQDVLAK TPKGNPATFE RRLAEAAAK ELEKAVYEWG EVEKVVDGRG  281
Lead-CeresClone-37980  LELAREILKT TPKGNPMQFG RRIGLEKVIN VLEGQVFEYA EVDEIVEKRG  281
CeresClone:630887   DLAREILKV TPKGNPMQFG RRIGLEGVIR VLEGAVFEYA EVQEILERRG  272
1460561             DLAKEILRV TPKGNPMQFG RRLGLESVIR NLEEGIFEYA EVQEILEKRG  276 gi|50919643         EGKWREYLVE WRDGGDREWV RAAWVAEDLV KDFDAGLEYA VAEAVVNKRE  331
Lead-CeresClone-37980  KGKDVEYLVR MKDGGDCEWV KGVHVAEDVA KDYEDGLEYA VAESVIGKRV  331
CeresClone:630887   KGENLEYLVR MKDGGANEWV KAKFVAEDLV KDYEAGLEYA VAEAVLAKRV  322
1460561             KGKDLEYLVK MKDGSDNEWV KAKFIGEDLV MDFEAGLEYA VAKGVVGKRL  326 gi|50919643         AAEGEGKWEY LVKWDIEEA  TWEPAENVDA ELLQEFEQRQ SGVAAGGDAP  381
Lead-CeresClone-37980  GDDGK--TIEY LVKWTDMSDA TWEPQDNVDS TIVLLYQ--- ---------  367
CeresClone:630887   ADEG---TPEF LVKWADLEEP TWEPEENVDP ELVKAFE--- -------GSNQ  362
1460561             GDDG---KNEY LVKWTDIDEA TWEPEENVDL DLIKEFE--E GQNGVGSVE  372 gi|50919643         PPPPVAG---  ---------- PPPPVAG---  388
Lead-CeresClone-37980  QQQPINE---  ---------- QQQPINE---  374
CeresClone:630887   AQPSSNGPAV VFSNQDSPSL AQPSSNGPAV  382
1460561             AQLTSDG---  ---------L AQLTSDG---  380
```

Figure 51 (continued)

| | | | | | | |
|---|---|---|---|---|---|---|
| gi\|92897066 | QLPAVAVPPPP | SNVEFELEE- | ------AAST T | TPSTGRYCTR | CQNAKPPRCH | 139 |
| Lead-CeresClone-38360 | DLEKSEGNQA | LIGEASV--- | ------GDS | SSHGVRYCRK | CNQYKPPRSH | 112 |
| CeresClone:1850953 | DEEKGDADPL | VGSGYGSAQL | DPKQ-SAMVA | VSQEJRFCHK | CKQFKPPRAH | 139 |
| CeresClone:230342 | DVEMGETAPL | ASSELCSQMN | SQQSVALGNM | TNPRVRYCRK | CNQLKPPRCH | 148 |
| gi\|108711626 | DEERGETAPL | SGLDFNSQVN | SQQSIAHNDT | GHPRARYCRK | CNQMKPPRCH | 148 |
| gi\|50919203 | DEERGETAPL | SGLDFNSQVN | SQQSIAHNDT | GHPRARYCRK | CNQMKPPRCH | 148 |
| CeresClone:1825572 | DEERGETAPL | STTEL----- | ------SDT | GSPRIRYCRK | CNQLKPPRCH | 137 |
| CeresClone:1819666 | DEERGEADPL | STTEL----- | ------NDT | GSSRIRYCRK | CNQLKPPRCH | 130 |
| CeresClone:573293 | DEERGEADPL | VGTEFSN--- | ------LPSD- | PNPRVRYCRK | CNQLKPPRCH | 138 |
| 1524357 | DEERGEADPL | NGSEFSG--- | ------VQSDQ | SNQRIRYCRK | CNQLKPPRCH | 139 |
| 1470949 | DEERGEADPL | NGSEFSG--- | ------VQSDQ | SNQRIRYCRK | CNQLKPPRCH | 114 |

| | | | | | | |
|---|---|---|---|---|---|---|
| gi\|92897066 | HCSICQRCVL | KMDHHCIWVV | NCVGARTYKY | FLLFLYTFL | ETTLVCLALI | 189 |
| Lead-CeresClone-38360 | HCSVCGRCIL | KMDHHCVWVV | NCVGALNYKS | FLLFLFYTFL | ETTVVAVSLL | 162 |
| CeresClone:1850953 | HCSVCGRRCIL | KMDHHCVWVV | NCVGALNYKY | FLLFLFYTFL | ETTLVSLLL | 189 |
| CeresClone:230342 | HCSVCGRCVL | KMDHHCVWVV | NCVGALNYKY | FLLFLFYTFL | ETTLVTLSLL | 198 |
| gi\|108711626 | HCSVCGRCVL | KMDHHCVWVV | NCVGALNYKY | FLLFLFYTFL | ETTLVTLSLL | 198 |
| gi\|50919203 | HCSVCGRCVL | KMDHHCVWVV | NCVGALNYKF | FLLFLFYTFL | ETTLVTLSLL | 198 |
| CeresClone:1825572 | HCSVCGRCVL | KMDHHCVWVV | NCVGALNYKF | FLLFLFYTFL | ETALVTLSLL | 187 |
| CeresClone:1819666 | HCSVCGRCVL | KMDHHCVWVV | NCVGALNYKY | FLLFLFYTFL | ETALVTLSLL | 180 |
| CeresClone:573293 | HCSVCGRCVL | KMDHHCVWVV | NCVGALNYKY | FLLFLYTFL | ETTLVTASLL | 188 |
| 1524357 | HCSVCGRCVL | KMDHHCVWVV | NCVGALNYKY | FLLFLFYTFL | ETSLVTLSLS | 189 |
| 1470949 | HCSVCGRCVL | KMDHHCVWVV | NCVGALNYKY | FLLFLFYTFL | ETSLVTLSLS | 164 |

Figure 51 (continued)

```
gi|92897066          PSFLRFFGVG GAKNHKLSPG GFSAIFLASL LNLAFALSLL CFIVMHLSLL   239
Lead-CeresClone-38360 PJFLVFFSDG DG-DITVSPG SLAASFVAFV LNIAFALSVL GFLIMHITLV   211
CeresClone:1850953   RVFMEFFNEG ------- SLAATFITFV LNIAFITLSIL GFLIMHITLV   236
CeresClone:230342    PHFIAFFSDA ---EIDETPG ALATTFLTFV LNLAFSLSVL GFMIMHISLV   245
gi|108711626         PHFIAFFSDI ---EIPGSPPA ALATTFLTFV LNLAFSLSVL GFMIMHVSLV   245
gi|50919203          PHFIAFFSDI ---DIPGSPPA ALATTFLTFV LNLAFSLSVL GFMIMHVSLV   245
CeresClone:1825572   PHFIAFFSDV ---EIPGTPG ALATTFLTFV LNLAL------ GFMIMHVSLV   219
CeresClone:1819666   PHFIAFFSDV ---EIPGTPG SLATTFLAFV LNLAFTLSVL GFLIMHISLV   227
CeresClone:573293    PHFIAFFSDG ---EIPGTPG SLATTFLAFV LNLAFALSVL GFLIMHISLV   235
1524357              PHFIAFFSDG ---EIPGTPG TLATTFLAFD VNLPCTCS--- GFLIMHISLV   236
1470949              PHFIAFFSDG ---EIPGTPG TLATTFLAFD VNLPCTCS--- CYLLCGCGLR   209 gi|92897066          LSNTTSVE-- ---------- ---------- --VHEKKKGV RWRYDVGRKK   265
Lead-CeresClone-38360 ARNTTIE--- ---------- ---------- -AYEKHTV-- NMPYNVGRKT   236
CeresClone:1850953   GANTSTIEVI IYVSLCCQSN QSRSRFHMFI FQAYEKKTSP KWRYDLGWKK   286
CeresClone:230342    SANTTIE--- ---------- ---------- -AYEKKTTP HMIYDLGRKR   271
gi|108711626         SANTTIE--- ---------- ---------- -A-------- ---------  254
gi|50919203          SANTTIE--- ---------- ---------- -AYEKKTTP  RWMYDIGRKR   271
CeresClone:1825572   SGNTTIE--- ---------- ---------- -AYEKKTTP  FWKYDLGRKR   219
CeresClone:1819666   AANTTIE--- ---------- ---------- -AYEKKTTP  KWRYDLGRRK   253
CeresClone:573293    SANTTIE--- ---------- ---------- -AYEKKTTP  KWRYDLGRKK   261
1524357              NSDDSMQCQC L--------- ---------- -AYEKKTTP  KWRYDLGRKK   262
1470949                                                                      238
```

Figure 51 (continued)

| | | | | | | |
|---|---|---|---|---|---|---|
| gi\|92897066 | NFEQ | ---- | ---- | TKKALMLFP | FSEEDLENP | ALRGIEFPTR | 302 |
| Lead-CeresClone-38360 | NFEQ | ---- | VFG | SDKMYWFVPL | YTEDDKKKLP | ALGGLDFTSR | 273 |
| CeresClone:1850953 | NFEQ | ---- | VFG | LDKKYWFIPA | YSEDDLRRLP | ALHGFEYPTR | 323 |
| CeresClone:230342 | NFAQ | ---- | VFG | NDRKYWFIPA | YSEEDLRRTP | ALQGLDYPVR | 308 |
| gi\|108711626 | ---- | ---- | ---- | ---------- | ---------- | ---------- | 254 |
| gi\|50919203 | NFIQ | ---- | VFG | NDKRYWFIPA | YSEEDLRRMP | VLQGLDYPVR | 308 |
| CeresClone:1825572 | ---- | ---- | ---- | ---------- | ---------- | ---------- | 219 |
| CeresClone:1819666 | NFAQ | ---- | VFG | NNKMYWFIPS | YSDEDIRKMP | ALQGLDYPVR | 290 |
| CeresClone:573293 | NFEQ | ---- | VFG | MDKKYWFIPA | YSDDDLRRMP | ALQGLDYPSK | 298 |
| 1524357 | NFEQ | ---- | ---- | ANKRYWFIPT | YSDDDLRRMP | ALQGLEYPSK | 296 |
| 1470949 | NFEQAILPFE | LLLGILH | VFG | ADKRYWFIPT | YSDDDLRRMP | ALQGLEYPSK | 288 |

| | | | |
|---|---|---|---|
| gi\|92897066 | --SDVDV--- | -L | 307 |
| Lead-CeresClone-38360 | SESETEPLQS | -L | 284 |
| CeresClone:1850953 | ---PDLEPLQQ | -H | 332 |
| CeresClone:230342 | ---PDFDG-QE | -L | 316 |
| gi\|108711626 | ---------S | -L | 256 |
| gi\|50919203 | ---TDLDG-QE | -L | 316 |
| CeresClone:1825572 | ---------- | -L | 220 |
| CeresClone:1819666 | ---SDFDG-QG | -F | 298 |
| CeresClone:573293 | ---PDFDS-QI | -- | 304 |
| 1524357 | ---PDFDS-QE | -F | 304 |
| 1470949 | ---PDFDS-QE | -F | 296 |

FIGURE 53

| SEQ ID NO | Sequence | | | | Pos |
|---|---|---|---|---|---|
| SEQ-ID-NO:850-CLONE:282892 | MMMAEVAANH | SKRSHNDGYF | SAK------- | ----------AAAAAASPEE | LGS------MSMS | 41 |
| SEQ-ID-NO:845-CLONE:1329861 | -MMMTQVANH | SKRNHTDSYF | SGKQQ----- | --QQAGATTTS | GGSEEFAGMG | 46 |
| SEQ-ID-NO:847-CLONE:1322549 | -MMMTQVANH | SKRNHTDSYF | SGK------- | --QQAVATTATS | SGSEEFAGMG | 44 |
| SEQ-ID-NO:844-GI:5669656 | ---------- | ---------- | ---------- | -----MPHKRSP | EHSSSLTSL | 19 |
| SEQ-ID-NO:838-CLONE:3900 | ---------- | ---------- | ---------- | MMENKRNVCS | LGE----SS | 24 |
| SEQ-ID-NO:839-CLONE:158765 | ---------- | ---------- | -MEFSGDAGM | ALSEKASNA | TSL------ | 15 |
| SEQ-ID-NO:849-ANNOT:1533351 | ---------- | ---------- | ------MS | MENKRSPCS | VDH------ | 12 |
| SEQ-ID-NO:843-ANNOT:1480628 | ---------- | ---------- | ---------- | ME------- | ---------- | 2 |
| SEQ-ID-NO:846-CLONE:537752 | ------MIA | SSFCNADSMF | SREEGIDVRK | MMEHKRRPCS | VDQSSYTS A | 43 |
| SEQ-ID-NO:841-CLONE:1839717 | ---------- | ---------- | ---------- | MENKRSPCS | VDHSSFTPL A | 19 |

| SEQ ID NO | | | | | | Pos |
|---|---|---|---|---|---|---|
| SEQ-ID-NO:850-CLONE:282892 | SKKPRNSNSP | R-TAPVSPKE | KKDRIGERVA | ALQQLVSPFG | ---KTDTASV | 87 |
| SEQ-ID-NO:845-CLONE:1329861 | SKKPRNASPR | GSGGPISPKE | KKDKVGERVA | ALQQLVSPFG | ---KTDTASV | 93 |
| SEQ-ID-NO:847-CLONE:1322549 | SKKPRNASPR | G-GGPISPRE | KKDKVGERVA | ALQQLVSPFG | ---KTDTASV | 90 |
| SEQ-ID-NO:844-GI:5669656 | TPKRLKA--- | ---DMLSSKE | KKEKFGERIS | APQQLVSPYG | ---KTDTASV | 61 |
| SEQ-ID-NO:838-CLONE:3900 | -IKRHKS--- | -DLSFNSKE | RKDKVGERIS | ALQQLVSPYG | ---KTDTASV | 65 |
| SEQ-ID-NO:839-CLONE:158765 | ---------- | -ISLFNSKE | RKDKVGERIV | ALQQIVSPYG | ---KTDTASV | 50 |
| SEQ-ID-NO:849-ANNOT:1533351 | ---------- | -GTLTSLAT | KRHK------ | --ADFS | ISTKTDTASV | 38 |
| SEQ-ID-NO:843-ANNOT:1480628 | SKRQKA--- | -GSALGEKE | RKEKLGERI | ALQQLVSPYG | ---KTDTASV | 37 |
| SEQ-ID-NO:846-CLONE:537752 | SKRQKS--- | -DLSISTKE | RKEKIGERIV | ALQQLVSPYG | ---KTDTSSV | 84 |
| SEQ-ID-NO:841-CLONE:1839717 | ---------- | -DLLSTKD | RKDKVGERIV | TLQQLVSPYG | ---KTDTASV | 60 |

| SEQ ID NO | | | | | | Pos |
|---|---|---|---|---|---|---|
| SEQ-ID-NO:850-CLONE:282892 | LQEASGYIRF | LHQQLQVLSS | PYMRAPPAAG | AAPEDTEHYS | LRSRGLCLVP | 137 |
| SEQ-ID-NO:845-CLONE:1329861 | LQEASGYIKF | LHQQLEVLSS | PYMRPPPAPG | AEPEDPDHYS | LRNRGLCLVP | 143 |
| SEQ-ID-NO:847-CLONE:1322549 | LQEASGYIKF | LHQQLEVLSS | PYMRPPPPSPG | AEPEDPDHYS | LRNRGLCLVP | 140 |
| SEQ-ID-NO:844-GI:5669656 | LLEAMGYIEF | LHEQVKVLSA | PYLGTMPM-- | SKTQEELEQYS | LRSQGLCLVP | 109 |
| SEQ-ID-NO:838-CLONE:3900 | LLDAMHYIEF | LHEQVKVLSA | PYLQTIPD-- | ATQEELEQYS | LRNRGLCLVP | 113 |
| SEQ-ID-NO:839-CLONE:158765 | LLDAMHYIRF | LHEQVQVLSA | PYLQTIPD-- | ATQEELEQYS | LRNRGLCLVP | 98 |
| SEQ-ID-NO:849-ANNOT:1533351 | MEAMEYIRF | LHEQVQVLSA | PYLQGTST-- | AQMQGLGQHS | LESKGLCLVP | 86 |
| SEQ-ID-NO:843-ANNOT:1480628 | MEAMEYIRF | LHEQVQVLSA | PYLQGTST-- | AQMQELGQYS | LRNKGLCLVP | 85 |
| SEQ-ID-NO:846-CLONE:537752 | KEAMEYIGF | LHKQVKLLSA | PYLESSPA-- | AKMQVEPCS | LRSRGLCLVP | 132 |
| SEQ-ID-NO:841-CLONE:1839717 | LLQAMEYIQF | LHEQVKVLSA | PYLQTSPT-- | NNMQEQEHYS | LRSQGLCLVP | 108 |

FIGURE 53 (Continued)

| | | | | |
|---|---|---|---|---|
| SEQ ID NO:850 CLONE:282892 | VDQTLQLTQS | NGADLWAPAN | TTRRR------ | ---------- | 162 |
| SEQ ID NO:845 CLONE:1329861 | VEQTLQLTQS | NGADLWAPAN | TTRRT------ | ---------- | 168 |
| SEQ ID NO:847 CLONE:1322549 | VEQTLQLTQS | NGADLWAPAN | TTRRC------ | ---------- | 165 |
| SEQ ID NO:844 GI:5669656 | VSYTVGVATS | NGADIWAPIK | TSQSSSPE-N | DV-------- | 140 |
| SEQ ID NO:838 CLONE:3900 | MENTVGVAQS | NGADIWAPVK | TPLSPAFSVT | SQSPFR | 149 |
| SEQ ID NO:839 CLONE:158765 | MENTVGVAQS | NGADIWAPVK | TPLSPAFSVT | SQSPFR | 134 |
| SEQ ID NO:849 ANNOT:1533351 | LSYTAGIARS | NGADIWAPIK | SP-SPKCN-K | SISQFH | 120 |
| SEQ ID NO:843 ANNOT:1480628 | TSCTAGIARS | NGADIWAPIK | SP-SPKFN-K | DVSPFH | 119 |
| SEQ ID NO:846 CLONE:537752 | VSVTIGVAES | NGADIWAPIK | TTTSPKFE-K | DVSQFH | 167 |
| SEQ ID NO:841 CLONE:1839717 | LSYTMGVVHS | NGADIWAPIK | TA-SPKFD-K | PFTQFN | 142 |

Figure 54

```
CeresClone:1065335        ----------------  ----------  ----------  --MGRCPTRK  XKKRRLSHKT   18
Lead-CeresClone-39855     ----------------  ----------  ----------  --MGRCPTRK  VKKRRLSHKT   18
gi|20259185               ----------------  ----------  ----------  --MGRCPTRK  VKKRRLSHKT   18
gi|50948587               MGLMGFPLLS QDKSGLLLPL  PAAAASASAA  QMGGKCPHRK  VKKRRLSHKT   50
CeresClone:1801885        M---------  ----------  ----------  --GGKCPHRK  VKKRRLSHKT   19
CeresClone:1060804        M---------  ----------  ----------  --GGKCPHRK  VKKRRLSHKT   19
CeresClone:1793747        M---------  ----------  ----------  --GGKCPSRK  VKKRRFSHKT   19
CeresClone:1832492        M---------  ----------  ----------  --GGKCPSRK  VKKRRFSHKT   19
CeresClone:788576         M---------  ----------  ----------  --GGKCPHRN  VKKRRYSHKT   19
CeresClone:465010         M---------  ----------  ----------  --GGKCPHRN  VKKRRYSHKT   19

CeresClone:1065335        ARRDKFEVKG  DDLVYTELRK  ----------  KPLESEDLP   GMGQFYCLHC   63
Lead-CeresClone-39855     ARRDKFEVKG  DDLVYTELRK  ----------  KPLQLDEDLP  GMGQFYCLHC   63
gi|20259185               ARRDKFEVKG  DDLVYTELRK  ----------  KPLQLDEDLP  GMGQFYCLHC   63
gi|50948587               ARRGKFLVKA  DDAVYDELVK  PETETLADAGK DADATQLPVDEDLP  GMGQFYCLHC  100
CeresClone:1801885        ARRGKFLLKA  DDAVYEELVK  PETELADQGK  DAQAKDLPVDEDLP  GMGQFYCLHC   69
CeresClone:1060804        ARRGKFLLKA  DDAVYDELVK  PETELADQGK  DAETKELPVDEDLP  GMGQFYCLHC   69
CeresClone:1793747        ARRDKFLLKG  DDLVYDELQK  ----------  KPLPRDEDLP  GLGQFYCLHC   64
CeresClone:1832492        ARRDKFLLKG  DDLVYDELQK  ----SDTEK   KPLPRDEDLP  GMGQYYCLHC   64
CeresClone:788576         ARRTKFELKG  DDMVYAQLNK  ----PDEER   APLPLDEDLP  EMGQYYCLHC   64
CeresClone:465010         ARRTKFELKG  DDMVYAQLNK  ----PDQER   PPLPVDEDLP  GMGQYYCLHC   64

CeresClone:1065335        DRYFCNVSVR  DDHFKTKKHK  KRVKLMNGPA  PHSQLDADLA  AGMGMPDNGX  113
Lead-CeresClone-39855     DRYFSNASVR  DDHFKTKKHK  KRVNMMMGQA  PHSQLDADLA  GGMGMPDNGP  113
gi|20259185               DRYFSNVSVR  DDHFKTKKHK  KRVNMMMGQA  PHSQLDADLA  GGMGMPDNGP  113
gi|50948587               DRYFASESVR  EEHYRSKRHK  KRIKQMSGPA  PHTQLDAELA  AGMGMPDNGL  150
CeresClone:1801885        DRYFASESVR  DEHYRSKRHK  KRVKVMSGPA  PHTQLDAELA  AGMGMPDNGL  119
CeresClone:1060804        DRYFASESVK  DDHYRSKRHK  KRVKVMSGPA  PHTQLDAELA  AGMGMPDNGL  119
CeresClone:1793747        DRYFANSSVR  DEHFKTKRHK  KRLKQMSGPA  PHTQLDAELA  AGMGMPKPDNGL 114
CeresClone:1832492        DRYFANSTVR  DEHFKTKRHK  KRLKQMSGPA  PHTQLDADVA  AGMGMPDNGP  114
CeresClone:788576         DRYFSNVAVR  DEHFKTKRHK  KRIKQMMGPA  PHTQLDADLA  AGMGMPDNGP  114
CeresClone:465010         DRYFANITVR  DEHFKTKRHK  KRIKQMGPA   PHTQLDADLA  SGMGMPDNGP  114
```

Figure 54 (continued)

```
CeresClone:1065335       KLMAA----- ---------- ---------- HRELLQC--- ----------  118
Lead-CeresClone-39855    KLMSNLVFTE LRKPETEDLP GMGQFNCLLC HRNFSNASVM DYHFKTKKHK  150
gi|20259185              KLMSNLVFTE LRKPETEDLP GMGQFNCLLC ---------- ----------  163
gi|50948587              KLMSM----- ---------- ---------- ---------- ----------  155
CeresClone:1801885       KLMSM----- ---------- ---------- ---------- ----------  124
CeresClone:1060804       KLMSM----- ---------- ---------- ---------- ----------  124
CeresClone:1793747       ALMKM----- ---------- ---------- ---------- ----------  119
CeresClone:1832492       ALMSM----- ---------- ---------- ---------- ----------  119
CeresClone:788576        KLMSM----- ---------- ---------- ---------- ----------  119
CeresClone:465010        KLMSM----- ---------- ---------- ---------- ----------  119

CeresClone:1065335       ---------- ---------- ---------- ---------- -----       118
Lead-CeresClone-39855    ---------- --IS DGLSFQD--- ---------- -----             159
gi|20259185              KRVKKIERPA PHSQLDADLA GGMGMPDNGP KLMSA                  198
gi|50948587              ---------- ---------- ---------- ---------- -----       155
CeresClone:1801885       ---------- ---------- ---------- ---------- -----       124
CeresClone:1060804       ---------- ---------- ---------- ---------- -----       124
CeresClone:1793747       ---------- ---------- ---------- ---------- -----       119
CeresClone:1832492       ---------- ---------- ---------- ---------- -----       119
CeresClone:788576        ---------- ---------- ---------- ---------- -----       119
CeresClone:465010        ---------- ---------- ---------- ---------- -----       119
```

| | | | | | | |
|---|---|---|---|---|---|---|
| Lead-CeresClone-40334 | SLQLELRHLK | GEDI QSLNLK | NL MAVEHAIE | HGLDKVRDHQ | — | 139 |
| gi\|67043456 | NLQLELRHLK | GEDI QSLNLK | NL MAVEHAIE | HGLDKVRDHQ | — | 139 |
| gi\|602902 | NMQIELRHLK | GEDITSLPYP | DLMRLEDALE | NGLVGVREKQ | — | 139 |
| gi\|454265 | SMQVKLRHLK | GEDI NSLNHK | ELMVLEEGLT | NGLSSISAKQ | — | 139 |
| gi\|4218173 | SMQIELRHLK | GEDITSLNYE | ELIAYEDALE | NGLTNIREKK | — | 139 |
| gi\|48727608 | CMQIELRHLK | GEDLNSLNPK | ELIPIEEALQ | NGLVNVRAKQ | — | 139 |
| gi\|53988171 | NMQIELRHLK | GGDLNSLNPK | ELIPLEDVLQ | NGLTSVRDKQ | — | 139 |
| gi\|33309888 | NMQIELRHLK | GGDLNSLSPK | ELIPLEDALQ | NGLTSVRDKQ | — | 139 |
| gi\|33338587 | NMQIELRHLK | GEDI STLNYK | ELMVLEEALE | NGLSVRDKQ | — | 139 |
| gi\|84578879 | SMQIELRHLK | GEDITSLNHR | ELMAIEEALE | NGI STLKAKQ | — | 139 |
| gi\|51832629 | SMQIELRHLK | GEDITSLNYK | ELMSLEDALE | NGLAGLRDKQ | — | 139 |
| gi\|56785938 | GMQIELRHLK | GDDITSLNYK | ELMALEDALE | NGLTGVRDKK | — | 139 |
| CeresClone:1625939 | SMQIELRHLK | GEDITSLNYK | ELMALEDALE | NGLSGVREKK | — | 139 |
| gi\|60100344 | SMQVELRHLK | GEDITSLNHV | ELMALEEALE | NGLEVSVREKQ | — | 139 |
| CeresClone:474230 | SMQIELRHLK | GEDITSSLHHT | ELMAIEEALD | TGLVSVREKQ | — | 139 |
| gi\|12666533 | NMQIELRHLK | GEDITSLNYK | ELMALEEALE | AGLAAVCKKQ | ASTIFYSNKN | 150 |
| 1452158 | NMQIELRHLR | GEDITSLNYK | ELMALEEALE | NGLTGVREKQ | — | 139 |
| gi\|4105097 | | | | | | |

| | | | | | | |
|---|---|---|---|---|---|---|
| Lead-CeresClone-40334 | MELLSKRRN | EKMMAEEQRQ | LTFQLQQQEM | A—IASNARGM | M— | 179 |
| gi\|67043456 | MEYFMTKRRN | EKMLAEENRQ | LSFQLQQQEM | A—IASNARGM | M— | 179 |
| gi\|602902 | MEMYKLHKKN | HKMLEDENNQ | LAYMLHKQEM | D———GNMR-E | MEAGVCSNPS | 185 |
| gi\|454265 | SELRIVRKN | DQILEEEHKQ | LQYALHQKEM | AAMGGNMR-M | EEV—YH-QR | 186 |
| gi\|4218173 | DELPKIMRKH | EQVLEEENKH | LMYLVQQSEM | AAMG——— | —— | 173 |
| gi\|48727608 | MEYLKMLKKN | ERYLEEENKR | LRCILHHQQI | E—LEGNMRME | MENG—YNTQK | 187 |
| gi\|53988171 | MDYLKMLKKN | ERMLEDENKR | LTYLLHQQQM | A—MEGSMR-E | LDIG—YH-HK | 185 |
| gi\|33309888 | MDFLKMLKKN | ERLLEEENKN | LFLLLHHQEL | A—MNGNVR-E | LELG—DPLK | 185 |
| gi\|33338587 | MEFLKKLKKN | EKILEEENKH | LTYLLHQQEL | A—MDANVR-E | LELG—YP-SK | 185 |
| gi\|84578879 | MEFVRMMRKH | NEMIEEENQS | LQFKLRQLHL | DPMDDNVM-E | AQAV—YDHQG | 187 |
| gi\|51832629 | SEHVECMREN | LKELEEETHKH | LNFVMRQREM | A—MENNVR-E | LESG—YHQP | 186 |
| gi\|56785938 | MEVHRMFKRN | EKILEDENKE | LNFLLQQHLA | LEGVGNMH— | —— | 177 |
| CeresClone:1625939 | MEVHRMFKRN | GKILEEENRE | LSFLLQQRMA | VEGIGNMH— | —— | 177 |
| gi\|60100344 | MEVYRVCRRN | DKILEEENRE | LNFILQQRMA | V———EGAR-D | ADNE—FD-QS | 183 |
| CeresClone:474230 | MDVYRMFRRN | DKILEEENKR | LTFLMQQRLA | V———EGAR-X | VDNG—FD-QS | 183 |
| gi\|12666533 | SKFVDMMRDN | GKALEDENKR | LTYELQKQQE | MKIKENVR-N | MENA—YHQRQ | 187 |
| 1452158 | MEYHSMLEQN | EKMLDEEFKR | LQFVLQQQEM | A—MGENAM-E | MENA—YHQQR | 197 |
| gi\|4105097 | SEFMKMMRTN | ERMMEEENKR | LNYELYQKEM | VAMGDSVR-E | MDIG—YN-QR | 186 |

Figure 55 (continued)

| | | | | | |
|---|---|---|---|---|---|
| Lead-CeresClone-40334 | MR------ | DHDG | ------QF | GYR | VQPIQPNLQE | KI MSLVI D | 208 |
| gi\|67043456 | MR------ | DHDG | ------QF | GYR | VQPIQPNLQE | KI MSLVI D | 208 |
| gi\|602902 | DR------ | DYHY | QNPI PPY | GFR | VQPMQPNLQD | RM------- | 213 |
| gi\|454265 | DR------ | DYEY | ------QMPFAL | R | VQPMQPNLHE | RM------- | 212 |
| gi\|4218173 | -------- | DYQA | ------AHEPFSF | R | VQPMQPNLHE | RM------- | 197 |
| gi\|48727608 | GR------ | DYPS | ------QMPFAF | R | AQPMQPNLQE | NK------- | 212 |
| gi\|53988171 | DR------ | EYAA | ------QMPMT | FR | VQPIQPNLQG | NK------- | 210 |
| gi\|33309888 | AR------ | DFAC | ------QIPIAF | R | VQPIQPNLQE | NK------- | 210 |
| gi\|33338587 | DR------ | DFAS | ------HMPLAF | H | VQPIQPNLQE | NN------- | 210 |
| gi\|84578879 | VA------ | DYEA | ------QMPFAF | R | VQPMQPNLQE | RF------- | 212 |
| gi\|51832629 | YQRAAVNHND | | YNPQMPFAF | R | EL-------- | --------- | 208 |
| gi\|56785938 | -------- | ---- | --------- | -- | -------GQ | WI------- | 181 |
| CeresClone:1625939 | -------- | ---- | --------- | -- | EQ------- | WI------- | 181 |
| gi\|60100344 | VR------ | DFNS | ------QMPFAF | R | VQPMQPNLQE | RI------- | 208 |
| CeresClone:474230 | VR------ | DYNS | ------HMPFAF | R | VQPMQPNLQE | RI------- | 208 |
| gi\|12666533 | LG------ | NYNN | NQQQIPFAF | R | VQPIQPNLQE | RI------- | 215 |
| 1452158 | MR------ | DYNF | ------QVPFAF | R | VQPIQPNLQE | RM------- | 222 |
| gi\|41105097 | MR------ | DFNS | ------QMPFAF | R | VQPIQPNLQE | RE------- | 211 |

Figure 56

| | | | | |
|---|---|---|---|---|
| Lead-CeresClone-41634 | MI GLS------ FPEDL DCGNF FDNMDDL MDF PGGDI D------ ------ | 32 |
| CeresClone:1360604 | MF CQS------ FAEDL DCGNF FDNMDDL LDF PGGDI D------ ------V | 32 |
| CeresClone:1844070 | ------ -MSKL VSPPL I PPSTPPL -F PA------ ------F | 21 |
| CeresAnnot:1457905 | MI GQT NTTSN FMDEI DCGSF FEHI DDL LEF PSDVDATLP DCTTTNNHTS | 50 |

| Lead-CeresClone-41634 | GFGI GDSDSF PTI WTT HDT WPAASDPLFS SNTNSDSSPE LYVPFEDI VK | 82 |
| CeresClone:1360604 | GFGI GDSDSF PNI WTT HQDI WPAASDPLFA SNTNSDSSPE YVPFEDI VK | 82 |
| CeresClone:1844070 | GLLTPSHSRV LI QF------ -FS NNSASDLSAE LSVPYEDI VQ | 57 |
| CeresAnnot:1457905 | CF MNN DDNSF PCI WST QSDS LP------ -GSASDLSAE LSVPYEDI VQ | 91 |

| Lead-CeresClone-41634 | VERPPTFVEE TL------ VE KKEDSFSTNT DSSSSH------ SQFRSSSPVS | 122 |
| CeresClone:1360604 | VERPKCFVEE SL------ VE KKEDSFFTNT DSSSSH------ SQFRSSSPVS | 122 |
| CeresClone:1844070 | LEWLSNFVED SNCGASLTI K KQEPN-SNNK DSPSHHDHDH ------ HQFQTSSPVS | 106 |
| CeresAnnot:1457905 | LEWLSNFVED SF SGGSLT MK KEESTI VNNK ESPPHH---Q YQFQTSSPVS | 138 |

| Lead-CeresClone-41634 | VLESSSSSK TTN------ TTSL VLPGKHGRPR TKRPRPP------ ------VQD | 159 |
| CeresClone:1360604 | VLESSSSSH TTN------ TTSL VLPGKHGRPR TKRPRPQ------ ------VQE | 159 |
| CeresClone:1844070 | VLESSSSYSG EKP------ V AAPGKCGRAR SKRPRPATFN PRPAI HLI SP | 150 |
| CeresAnnot:1457905 | VLESSSSCSG EKT APRSPEV GASGKRGRAR SKRPRPATFT PRPAMQLI SP | 188 |

| Lead-CeresClone-41634 | KDRV------ ------ ------K DNVCGGDSRL I RI PKQFLS DHNKMI NKKK | 194 |
| CeresClone:1360604 | KDKV------ ------ ------N DNVFGADSRL I RI PKQFLS DHSKMI TKKK | 194 |
| CeresClone:1844070 | SSSVNDN DVP QSLFVPKVPS DSENHAESRL LI KLPRQVNP EH------ -KK | 194 |
| CeresAnnot:1457905 | TSSI --TEVP QPFVPPKI AL DSENFAESRL VI KI PNHVDP EH------ -KK | 230 |

Lead-CeresClone-41634
CeresClone:1360604
CeresClone:1844070
CeresAnnot:1457905

Figure 56 (continued)

```
Lead-CeresClone-41634   KKKAKI TSSS SSSG DLEVN GN--NVDSYSS EQYPLRKCMH CEVTKTPQWR   243
CeresClone:1360604      KKKAKV SSS SMSE DLE N GNNNVDSC SS EQNPVRKCMH CEVTKTPQWR   244
CeresClone:1844070      KKKI KL T ---- ----- APPPTDNNTT QNPSVRKCMH CEI TKTPQWR   235
CeresAnnot:1457905      KKKI KF T ---- VPL-- GPVEMNQNSS PQQAVRKCMH CEI TKTPQWR   270

Lead-CeresClone-41634   LGPMGPKTLC NACGVRYKSG RLFPEYRPAA SPTFTPALHS NSHKKVAEMR   293
CeresClone:1360604      LGPMGPKTLC NACD VRYKSG RLFPEYRPAA SPTFTPALHS NSHKKVAEMR   294
CeresClone:1844070      AGPMGPKTLC NACGVRYKSG RLFPEYRPAA SPTF PSVHS NSHKKV L EMR   285
CeresAnnot:1457905      AGPMGPKTLC NACGVRYKSG RLFPEYRPAA SPTF V PSLHS NSHKKV V EMR   320

Lead-CeresClone-41634   NKRCSDGSYI TE---- ENDL QGL I PNNAYI GV-------- D---      322
CeresClone:1360604      NKRCSNGSYI NE---- ENDL HDLV L NNAYI GI GVGKSQRV EKF       333
CeresClone:1844070      TK CG ----- TADA PEMI PNKSNP AL-------- DYI       308
CeresAnnot:1457905      AK -SGE KI T V SRPAAMVANP PELI PNKSNP AM-------- DYI       354
```

Figure 57

| | | | | |
|---|---|---|---|---|
| Lead-CeresClone-478453 | MHKLGRGHRD | KLQQFITITG | ASEKLALQAL | KASDWHLEGA | FDFFYS-QPQ | 49 |
| CeresClone:1923578 | MHKLGRGHRD | KVQQFMTITG | ASERLALQAL | KASDWHLEGA | FDFFYS-QPQ | 50 |
| CeresClone:1956222 | MYKLGRGNRD | KVQQFMTITG | ASEKVALQAL | KASDWHLEGA | FDFFYS-QPQ | 49 |
| CeresClone:291139 | MYKLGRGNRD | KVQQFMTITG | ASEKVALQAL | KASDWHLEGA | FDFFYS-QPQ | 49 |
| gi|51535194 | MHKLGRGSRD | KVQQFMTITG | ASEKVALQAL | KASDWHLEGA | FDFFYS-QPQ | 49 |
| CeresClone:569584 | MHKLGRGSRD | KVQQFMATG | ASEKVALQAL | KASDWHLEGS | FDYFYS-QPQ | 49 |

| | | | | |
|---|---|---|---|---|
| Lead-CeresClone-478453 | LKTFTDSRHL | EELYNRYKDA | YVDMILADGI | TLCNDIQVD | PQDIVMLVLS | 99 |
| CeresClone:1923578 | KSYDTTYL | EELYKRYKDP | YTDMILPDGI | TLCNDLQVD | PQDIVMLVVS | 100 |
| CeresClone:1956222 | -SAVNARHL | EEIFNRYKEP | DADMIMVEGV | SQLCNDLQVD | PQDIVMLVIS | 98 |
| CeresClone:291139 | V-SVVNTRHL | EDIFNRYKEP | DADMIMVEGI | SQFCNDLQVD | PQDIVMLVIS | 98 |
| gi|51535194 | -ISLTNSRHL | EDLYNRYKEP | DVDMIMVEGV | SQFCDLQVD | PQDIVMLVIS | 98 |
| CeresClone:569584 | -SVTNSRHL | ---YSRYKER | DADMIMVEGT | SQLCNDLVD | PQDVVMLVIS | 95 |

| | | | | |
|---|---|---|---|---|
| Lead-CeresClone-478453 | WHMKAGTMCE | FSKKEFIEGL | QSLGIDSLEK | FREKIPYMRS | ELKDEQKFRE | 149 |
| CeresClone:1923578 | WHMKASTMCE | YSKEEFTGL | QALGIDSLEK | FRERIPFMRS | ELKDEQKFRE | 150 |
| CeresClone:1956222 | WHMKAATMCE | FTRQEFIGGL | QSIGVDSIEK | FRAKLPSLRA | ELKDDNKFRE | 148 |
| CeresClone:291139 | WHMKAATMCE | FTRQEFIGGL | QSIGVDSIEK | FRGKLPSLRA | ELKDDNKFRD | 148 |
| gi|51535194 | WHMKAATMCE | FTRQEFIGGL | QSIGVDSIEK | LREKLPSLRA | EIKDDHKFRE | 148 |
| CeresClone:569584 | WHMKAATMCE | FTRQEFIDGL | QSIGVDSIEK | LREKLPSLRA | EIKDDNKFRE | 145 |

| | | | | |
|---|---|---|---|---|
| Lead-CeresClone-478453 | YNFAFGWAK | EKGQKSLALD | TAIGMWQLLF | AEKQWPLVDH | WCQFLQARHN | 199 |
| CeresClone:1923578 | YNFAFGWAK | EKGQKSLALD | TAIGMWQLLF | AEKQWPLVDH | WCQFLQARHN | 200 |
| CeresClone:1956222 | YNFAFTWAR | EKGQKSLSLE | TAIGMWQLLF | ADRNWPLLDH | WCQFLQVRHN | 198 |
| CeresClone:291139 | YNFAFTWAR | EKGQKSLSLE | TSIGMWQLLF | AERNWPLLDH | WCQFLQVRHN | 198 |
| gi|51535194 | YNFAFAWAR | EKGQKSLALE | TALGMWQLLF | AERHWPLIDH | WCQFLQVRHN | 198 |
| CeresClone:569584 | YNFAFAWAR | EKGQKSLPLE | TAIGMWRLLF | AERHWPLIDH | WCQFLQVRHN | 195 |

Figure 57 (continued)

| | | | | | | |
|---|---|---|---|---|---|---|
| Lead-CeresClone-478453 | KAI S*DTWSQ | LLEFAKTVGS | N LSDYDAEGA | WPYLIDEFVE | YLNENGI IQN | 249 |
| CeresClone:1923578 | KAI SRDTWSQ | LLEFARTVDP | A LSNYDAEGA | WPYLIDEFVE | YLNENGI IQS | 250 |
| CeresClone:1956222 | KAI SRDTWAQ | LLEFVKSIDP | QLSNYDDEGA | WPYLIDEFVE | YLTENGLVQR | 248 |
| CeresClone:291139 | KAI SRDTWSQ | LLEFVKTI DPP | QLSNYDDEGA | WPYLIDEFVE | YLTENGLVQR | 248 |
| gi|51535194 | KAI SRDTWSQ | LLEFVKTIDP | QLSNYDEEGA | WPYLIDEFVE | YLTENGFVQL | 248 |
| CeresClone:569584 | KAI SRDTWSQ | LLEFVKTIDP | QLSNYDEEGA | WPYLIDEFVE | YLTENGCVQR | 245 |

| | | |
|---|---|---|
| Lead-CeresClone-478453 | DLINDSSLKR | 259 |
| CeresClone:1923578 | GQFK------ | 254 |
| CeresClone:1956222 | KK-------- | 250 |
| CeresClone:291139 | KR-------- | 250 |
| gi|51535194 | RK-------- | 250 |
| CeresClone:569584 | NK-------- | 247 |

Figure 58

```
CeresClone:630211          ME------           ----------  ANGISGCTAE  AAARRPPHVA  MLVTPGMGHL  PLAELAKRL    42
CeresClone:1534695         MEN-----           ----------  ANASSCRNGD  GTQTPPPHVA  MLATPGMGHL  PLAELAKRL    43
gi|77551916                MENGK---           ----------  CNGSSTTKCN  GAAAAAMHVA  MLVTPGMGHL  PLAELAKRL    45
CeresClone:1858581         MENGNGASPC         ----------  CNGNGNGNGA  AAAAPPPHVA  MLVTPGMGHL  PLAELAKRL    50
Lead-CeresClone-479006     -------            ----MEEEAP  PVPPAPPPVA  PMIEFAKRA   MLPSPGMGHL  PMIEFAKRL    36
gi|14532902                -------            ----------  ----------  MEESKTPHVA  MLPSPGMGHL  PLVEFAKRL    30
gi|13508844                -------            ----------  ----------  --MEHTPHIA  MVPTPGMGHL  PLVEFAKRL    28
CeresAnnot:1444387         -------            ---------M  ----------  AQTDAPAHVA  LPSPGMGHL   PLVELAKRL    31
CeresClone:1886347         -------            ----------  ----------  MAKLQTPHIA  LPSPGMGHL   PLVQFARSL    30

CeresClone:630211          AARHGVTATL         --TFAS-TASA  TQRAFLASLP  PG-SSLSLPP  VDLSDLPPDA    91
CeresClone:1534695         AQRHGVTSTL         --TFAS-TASA  TQRAFLASMP  PAVASMALPP  VDMSDLPRDA    92
gi|77551916                AARHGVTSTL         --TFAS-TASA  TQREFLASLP  PAVSVSLPP   VDLSDLPADA    94
CeresClone:1858581         ARRHGATATL         --TFAS-AASA  TQRAFLASLP  PAVTSLAL-P  VDLSDLPRGA    99
Lead-CeresClone-479006     VRYHNLAVTF        VIPTDGPPSK   AQKAVFQALP  DSISHTFL-PP  VNLSDFPPGT    86
gi|14532902                VHLHGLTVTF        VIAGEGPPSK   AQRTVFLDLP  SSISSVFL-PP  VDLTDLSSST    80
gi|13508844                VLRHNFGVTF        I-PTDGPLPK   AQKSFLDALP  AGVNYVLL-PP  VSFDDLPADV    78
CeresAnnot:1444387         VHQHNFSITF        VIPTDGSTSK   AQRSVLGSLP  SAIHSVFLLPQ  VNLSDLPEDV    81
CeresClone:1886347         VHQHNFIVTF        VIPTNDSPSK   AQKSVLDSLP  TSITHLFLHP  ADLSDLPLDS    80

CeresClone:630211          SIEMLMSEEC         VRLVPALTEA  LSRLME----  TTRL-VAYFA  DLFGADSFDA   136
CeresClone:1534695         AIETLMSEEC         VRAVPALTEA  LLSLKQRPTT  TGRL-VAFVT  DLFGADAFDA   141
gi|77551916                AIETLMSEEC         VRLVPALTAI  LSGIRE----  RRRL-VAFVA  DLFGADSFDA   139
CeresClone:1858581         AIETLMSEEC         ARSVPALTD-  LRDLRR----  RTRL-VAFVA  DLFGADSFDA   144
Lead-CeresClone-479006     KIETLISHTV        LLSLPSLRQA   FHSLSS----  TYTL-AAVVV  DLFATDAFDV   131
gi|14532902                RIESRISLTV        TRSNPELRKV   FDSFVE----  GGRLPTALVV  DLFGTDAFDV   126
gi|13508844                RIETRICLTI        ARSLPSLRDV   VKTLLA----  TTKL-AALVV  DLFGTDAFDV   123
CeresAnnot:1444387         KIETTISHTV        ARSLPSLRDV   FRSLVD----G  GARV-VALVV  DLFGTDAFDV   127
CeresClone:1886347         KIETVISLTL        ARSLSFLRDA   FKSMVD----  KTNL-VALVV  DLFGTDAFDV   125
```

| | | | | | |
|---|---|---|---|---|---|
| CeresClone:630211 | EIAAAVREVM | AGPGKGAEVR | AKVATLQKAA | IEGLLEGGAA | MAALDEVASK | 477 |
| CeresClone:1534695 | DIAAVVRELM | TAEGKGAAVR | AKVEELQKAA | AEGLRDGGAT | AALAEVVKE | 482 |
| gi|77551916 | KIAAVVREMM | VGEGRGAAVR | AKVAELQKMA | TDGLRDGGAA | TSALDEVVDK | 484 |
| CeresClone:1858581 | KIAAAVQEVM | EGEGRGAAVR | AKVAELQKAA | AEGLQEGGAA | TAALAEVVEK | 482 |
| Lead-CeresClone-479006 | EIASVVKCLM | EGH-EGKKLR | YRIKDLKEAA | AKALSPNGSS | TDHSNLVLK | 469 |
| gi|14532902 | EVARVVKGLM | EGE-EGKGVR | NKMKELKEAA | CRVLKDDGTS | TKALSLVALK | 466 |
| gi|13508844 | EIANAVKGLM | EGE-EGKKFR | STMKDLKDAA | SRALSDDGSS | KALAELACK | 462 |
| CeresAnnot:1444387 | EIANAVRGLM | EGE-EGKRVR | NRMKDLKEAA | ARVLSEDGS- | -SELAHK | 462 |
| CeresClone:1886347 | EIAKAVKVLM | EGE-EGKGVR | NRMKHLKEAA | SKLLGENGCS | TKALSQVASK | 464 |

| | | |
|---|---|---|
| CeresClone:630211 | WTGAEHA---- | 484 |
| CeresClone:1534695 | WTSADDSVY- | 491 |
| gi|77551916 | WTGGEK---- | 490 |
| CeresClone:1858581 | WTCEEN---- | 488 |
| Lead-CeresClone-479006 | WTNKTISTSG-- | 480 |
| gi|14532902 | WKAHKKELEQNGNH | 480 |
| gi|13508844 | WENKLSST--- | 470 |
| CeresAnnot:1444387 | WKNQKCT--- | 469 |
| CeresClone:1886347 | WRNQTAI--- | 471 |

Figure 59

```
                                                                                                   35
gi|21280839      ----------    NNRGRYPPGI   GAGRG-----A   FNPNPN---YQ   SRSGYQQHPP      35
gi|92877732      -------MNN    NNRGRYPPGI   GL GRGSGGGG  LNSNPNNANA    GFQQRPHYQQ      43
Lead-CeresClone-534281  MNHNNSNNSN  NNRARYPPGM   GLGRG-----G   F---NPN----   -LSQNPNQNQ    39
CeresAnnot:1471100   -------MNN  NNRGRYPPGI   GAGRG-----GG  MSANPN----FQ  SRVPQQQYVQ    38
CeresClone:1795581   -------MH   QPRARYPPGY   GGGGGGVGGG    -GGGNHNYY     GRNPQPQ--PH   40
CeresClone:703763    --------M   DQRARHPPGI   GNGRG------G  ---NPN----YH  GRGPPPTQQH    32
gi|50911116          --------M   DPRARYPPGI   GNGRG------G  ---NPN----YY  NRGPPLQQQH    32
CeresClone:1580901   --------M   DPRARYPSGM   GNGRG------G  ---TPN----YY  GRGPPQQQPH    32 gi|21280839      PQYVQRG---N   YAQNHQQQFQ   QAPSQPHQYQ   QQ--------    -----QQQQWL     73
gi|92877732      QQYVQRHLMQ    NQNQHQQHYQ   HHQQNQQQYV   QQNQ------    -----QQQQWL     85
Lead-CeresClone-534281  NHHAFQARPP  YHQQQQAQYV   QRHLLQ----Q  ----------    -----QQQQWL     73
CeresAnnot:1471100   RHFGQNHHQQ   QYNQHQQNHN   QQQQQQQQQQ   ----------    -QHQQQQQWL      76
CeresClone:1795581   HHQHYQHQQP   PPQQQPQQHA   HRNS------   ----------    -SHQHQQWL       72
CeresClone:703763    HQQPSPPSPQ   QAQGHPQQYM   QRQSQHSQHS   QHHSQ-----    -QLQHQQWL       75
gi|50911116          NHHQQQ----   TSAPHHQQYV   QRQPQQHHHH   NHHQQH----    -QQQQQQWL       73
CeresClone:1580901   QHHQQQQQT    SGAHHHQQYA   QRQQQHRHS    HNHQQQQQQH    QSQQQQQQWL      82 gi|21280839      RRGQIPGGNS    NGDAVVEVEK   TVQ-------SEV  -DPNSEDWKA    RLKLPAPDTR      119
gi|92877732      RRNQLGGGTD    -TNVVEEVEK   TVQ-------SET  NDPSSQDWKE    KLKLPPADTR      130
Lead-CeresClone-534281  RRDA------  NAVDEVEK     TVQ-------SEA  VDSSSQDKKA    RLKIPPADTR      111
CeresAnnot:1471100   RRSQLAAAD-   SSVDEVEK     TVQ-------SEA  VDSSSQDWKA    KLKIPPADTR      119
CeresClone:1795581   RRDQGPASAA   GSGDAAVRT    AAQ-------LDA  ADSSQDWKA     QLNPAPDTR      117
CeresClone:703763    RRNQIAGEAA   SGAARASEHH   APA------ADD   DSSQDWKA      QLKLPPPDTR      122
gi|50911116          RRNQIAREAA   GTDRNSEPK    AVAQSPAVDG    DSSQDWKA      QLKLPPQDTR      122
CeresClone:1580901   RRNQIAREAA   GAAVTSEPK    ALAPSTAADG    VNSSSQDWKT    QLKLPPPDTR      131
```

Figure 59 (continued)

```
                         YRTEDVTATK  GNEFEDYFLK  RELLMGIYEK  GFERPSPIQE  ESIPIALTGR  169
gi|21280839              YRTEDVTATK  GNEFEDYFLK  RELLMGIYEK  GFERPSPIQE  ESIPIALTGS  180
gi|92877732              YKTEDVTATK  GNEFEDYFLK  RELLMGIYEK  GFERPSPIQE  ESIPIALTGS  161
Lead-CeresClone-534281   YQTEDVTATK  GNDFEDYFLK  RELLMGIYEK  GFERPSPIQE  ESIPIALTGS  169
CeresAnnot:1471100       YRTEDVTATK  GNEFEDYFLK  RELLMGIYEK  GFERPSPIQE  ESIPIALTGS  167
CeresClone:1795581       YQTEDVTATK  GNEFEDYFLK  RELLMGIYEK  GFERPSPIQE  ESIPIALTGS  172
CeresClone:703763        YRTEDVTATK  GNEFEDYFLK  RELLMGIYEK  GFERPSPIQE  ESIPIALTGS  172
gi|50911116              YRTEDVTATK  GNEFEDYFLK  RELLMGIYEK  GFERPSPIQE  ESIPIALTGS  181
CeresClone:1580901

DILARAKNGT  GKTAAFCIPV  LEKIDQDNNV  QAVILVPTR   ELALQTSQVC  219
gi|21280839              DILARAKNGT  GKTAAFSIPA  LEKIDQDNNI  QVVILVPTR   ELALQTSQVC  230
gi|92877732              DILARAKNGT  GKTAAFCIPA  LEKIDQDNNV  QVVILVPTR   ELALQTSQVC  211
Lead-CeresClone-534281   DILARAKNGT  GKTAAFCIPA  LEKIDQDNNF  QVVILVPTR   ELALQTSQVC  219
CeresAnnot:1471100       DILARAKNGT  GKTAAFCIPA  LEKIDPEKNA  QVVILVPTR   ELALQTSQVC  217
CeresClone:1795581       DILARAKNGT  GKTAAFCIPA  LEKIDQDKNA  QVVILVPTR   ELALQTSQVC  222
CeresClone:703763        DILARAKNGT  GKTAAFCIPA  LEKIDQEKNA  QVVILVPTR   ELALQTSQVC  222
gi|50911116              DILARAKNGT  GKTAAFCIPA  LEKIDQEKNA  QVVILVPTR   ELALQTSQVC  231
CeresClone:1580901

KELGKHLKIQ  VMVTTGGTSL  KDDIMRLYQP  VHLLVGTPGR  LDLTKKGVC   269
gi|21280839              KELGKHLQIQ  VMVTTGGTSL  KDDIMRLYQP  VHLLVGTPGR  LDLAKKGVC   280
gi|92877732              KELGKHLKIQ  VMVTTGGTSL  KDDILRLYQP  VHLLVGTPGR  LDLTKKGVC   261
Lead-CeresClone-534281   KELGKHLKIQ  VMATTGGTSL  KDDIMRLYQP  VHLLVGTPGR  LDLAKKGVC   269
CeresAnnot:1471100       KELGKYLNQ   VMVSTGGTSL  RDDIMRLYQP  VHLLVGTPGR  LDLTRKGIC   267
CeresClone:1795581       KELGKHLKIQ  VMVTTGGTSL  KDDIVRLYQP  VHLLVGTPGR  LDLTKKGIC   272
CeresClone:703763        KELGKHLKIQ  VMVTTGGTSL  KDDIRLYQP   VHLLVGTPGR  VDLTKKGIC   272
gi|50911116              KELGKHLKIQ  VMVTTGGTSL  KDDIVRLYQP  VHLIVGTPGR  ILDLTKKGVC  281
CeresClone:1580901
```

Figure 59 (continued)

| | | | | | | | |
|---|---|---|---|---|---|---|---|
| gi\|21280839 | VLKDCSVLVM | DEADKLLSQE | FQPSVEH IS | FLPE SRQI LM | FSATFPVTVK | 319 |
| gi\|92877732 | VLKDCSMLVM | DEADKLLSPE | FQPSI EQLI Q | FLPPT RQI LM | FSATFPVTVK | 330 |
| Lead-CeresClone:534281 | LKDCAMLVM | DEADKLLSPE | FQPSI EQLI H | FLPTT RQI LM | FSATFPVTVK | 311 |
| CeresAnnot:1471100 | LKDCSMLVL | DEADKLLSPE | FQPSI EQLI R | FLPSSRQI LM | FSATFPVTVK | 319 |
| CeresClone:1795581 | VLKDCSMLVM | DEADKLLAPE | FQPSVE A I H | FLP D SSRQI LM | FSATFPVTVK | 317 |
| CeresClone:703763 | L N DCSMLI M | DEADKLLSPE | FQPSVEQLI R | YLPSSRQI LM | FSATFPVTVK | 322 |
| gi\|50911116 | LKDCSMLI M | DEADKLLSPE | FQPSI EQLI R | YLPASRQI LM | FSATFPVTVK | 322 |
| CeresClone:1580901 | LKDCSMLI M | DEADKLLSPE | FQPSI EQLI R | YLPASRQI LM | FSATFPVTVK | 331 |

| | | | | | | | |
|---|---|---|---|---|---|---|---|
| gi\|21280839 | DFKDRF LT NP | YVI NLMDELT | LKGI TQFYAF | VEERQKI HCL | NTLFSKLQI N | 369 |
| gi\|92877732 | DFKDRYLRKP | MI I NLMDELT | LKGI TQFYAF | VEERQKVHCL | NTLFSKLQI N | 380 |
| Lead-CeresClone:534281 | DFKDRYLQKP | YVI NLMDELT | LKGI TQFYAF | VEERQKVHCL | NTLFSKLQI N | 361 |
| CeresAnnot:1471100 | DFKDRYLPKP | YVI NLMDELT | LKGI TQFYAF | VEERQKVHCL | NTLFSKLQI N | 369 |
| CeresClone:1795581 | EFKEKYLPKP | YVI NLMDELT | LK E TQYYAF | VEERQKVHCL | NTLFSKLQI N | 367 |
| CeresClone:703763 | A F KDKYLPKP | YVI NLMDELT | LKGI TQFYAF | VEERQKVHCL | NTLFSKLQI N | 372 |
| gi\|50911116 | EFKDKYLPKP | YVI NLMDELT | LKGI TQFYAF | VEERQKVHCL | NTLFSKLQI N | 372 |
| CeresClone:1580901 | EFKDKYLPKP | YVI NLMDELT | LKGI TQFYAF | VEERQKVHCL | NTLFSKLQI N | 381 |

| | | | | | | | |
|---|---|---|---|---|---|---|---|
| gi\|21280839 | QSI I FCNSVN | RVELLAKKI T | ELGYSCFYI H | AKML QDHRNR | VFHDFRNGAC | 419 |
| gi\|92877732 | QSI I FCNSVN | RVELLAKKI T | ELGYSCFYI H | AKML QDHRNR | VFHDFRNGAC | 430 |
| Lead-CeresClone:534281 | QSI I FCNSVN | RVELLAKKI T | ELGYSCFYI H | AKML QDHRNR | VFHDFRNGAC | 411 |
| CeresAnnot:1471100 | QSI I FCNSVN | RVELLAKKI T | ELGYSCFYI H | AKML QDHRNR | VFHDFRNGAC | 419 |
| CeresClone:1795581 | QSI I FCNSVN | RVELLAKKI T | ELGYSCFYI H | AKML QDHRNR | VFHDFRNGAC | 417 |
| CeresClone:703763 | QSI I FCNSVN | RVELLAKKI T | ELGYSCFYI H | AKML QDHRNR | VFHDFRNGAC | 422 |
| gi\|50911116 | QSI I FCNSVN | RVELLAKKI T | ELGYSCFYI H | AKML QDHRNR | VFHDFRNGAC | 422 |
| CeresClone:1580901 | QSI I FCNSVN | RVELLAKKI T | ELGYSCFYI H | AKML QDHRNR | VFHDFRNGAC | 431 |

Figure 59 (continued)

| | | | | | | |
|---|---|---|---|---|---|---|
| gi\|21280839 | RNLVCTDLFT | RGIDIQAVNV | VINFDFPKNA | ETYLHRVGRS | GRFGHLGLAV | 469 |
| gi\|92877732 | RNLVCTDLFT | RGIDIQAVNV | VINFDFPKNS | ETYLHRVGRS | GRFGHLGLAV | 480 |
| Lead-CeresClone:534281 | RNLVCTDLFT | RGIDIQAVNV | VINFDFPKNA | ETYLHRVGRS | GRFGHLGLAV | 461 |
| CeresAnnot:1471100 | RNLVCTDLFT | RGIDIQAVNV | VINFDFPKNS | ETYLHRVGRS | GRFGHLGLAV | 469 |
| CeresClone:1795581 | RNLVCTDLFT | RGIDIQAVNV | VINFDFPKTS | ETYLHRVGRS | GRFGHLGLAV | 467 |
| CeresClone:703763 | RNLVCTDLFT | RGIDIQAVNV | VINFDFPKTA | ETYLHRVGRS | GRYGHLGLAV | 472 |
| gi\|50911116 | RNLVCTDLFT | RGIDIQAVNV | VINFDFPKTA | ETYLHRVGRS | GRFGHLGLAV | 472 |
| CeresClone:1580901 | RNLVCTDLFT | RGIDIQAVNV | VINFDFPKNS | ETYLHRVGRS | GRFGHLGLAV | 481 |

| | | | | | |
|---|---|---|---|---|---|
| gi\|21280839 | NLITYEDRFN | LYRIEQELGT | EIKQIPPHD | QAIYCQ | 505 |
| gi\|92877732 | NLITYEDRFN | LYRIEQELGT | EIKQIPPFD | QAVYCR | 516 |
| Lead-CeresClone:534281 | NLITYEDRFN | LYRIEQELGT | EIKQIPPHD | QAIYCR | 497 |
| CeresAnnot:1471100 | NLITYEDRFN | LYRIEQELGT | EIKQIPPQI D | QAIYCQ | 505 |
| CeresClone:1795581 | NLITYEDRFN | LYMEQELGT | EIKTIPPQI D | LAVYCQ | 503 |
| CeresClone:703763 | NLITYEDRFN | LYRIEQELGT | EIKPIPPQI D | RTYCQ | 508 |
| gi\|50911116 | NLITYEDRFN | LYRIEQELGT | EIKPIPPQI D | QAIYCQ | 508 |
| CeresClone:1580901 | NLITYEDRFN | LYRIEQELGT | EIKQIPPQI D | QAIYCQ | 517 |

Figure 60

```
                                                                                                               50
gi|51090847              ME L MVDR V H  G S L R L F MHRN  A V F L CERLCA  Q F PAE T NVQ L  L A T CY L H NNQ    50
Lead:CeresClone-539801   MEA I LVDC A Q  K S L RHFMH S N  A I F I S QRLCA  Q F PSE T N L Q L  L AGCY LQSNQ    50
CeresAnnot:1531585       MEA I LVDCVN    H S L RHFMHRN    A I FMCERLCA    E F PSE T N L Q L  L AGCY LQNNQ    50
CeresClone:1209672       MEAMLVDCVN      N S L RHF VYKN   A I FMCERLCA    E F PSE V N L Q L  L AT S Y LQNNQ 100
gi|51090847              P Y A AYH I L KG  K K L P E SRYLF  AMSCF RMNLL   R E AE E A L CPV   N E PN I E VPSG  100
Lead:CeresClone-539801   AY C AYH I L KG  T QMAQSRYLF    A I SCF H MDLL   S E AE AA L R P A  D E PGAE VPNG   100
CeresAnnot:1531585       AY S AYH I L KG  T QMAQSRYLF    A I SCF QMDLL    N E AE AA L CPV    N E PGA E VPNG  100
CeresClone:1209672       AY S AYH L L KG  T QMAQSRYLF    A L SCF QMDLL    N E A E SAL CPV    N E PGAE I PNG 150
gi|51090847              A L G HY L LGV I  Y R Y T G R V E AA  A E QF V QAL T L  DPL LWAAY E E   L C I LG V AEDA  150
Lead:CeresClone-539801   AAGHY L LGL I   Y R C T DRRKNA    I QHF KQAL SM   DPL LMWAAY E E   L C I LGAA E E A  150
CeresAnnot:1531585       A P GHY L LGL I  Y R Y T DRRKSA    H HF KQAL S I   DPL L E WAAY E E   L C I LGAAE E A  150
CeresClone:1209672       AAGHY L LGL I   Y K Y T DRRKNA    A QQF KQS L T I  DPL LWAAY E E   L C I LGAAE E A 198
gi|51090847              N E C F S E A T A L  R L QQE L T S - T   S NV E K S NF V N  E NRF L S S NV S  A S F GD - SPKQ  199
Lead:CeresClone-539801   T V F GE AAA F  C L QKQYLN - C   S T S P NSHMSP   E H S N E VAAR P   CM S E E A SPRQ  200
CeresAnnot:1531585       A A V F D E AAA L  C I QKQHMNHA    S A S QNL S I S N   E DRNLVSARN    F GL E DGSPRQ  200
CeresClone:1209672       T A V F G E T AA L  S I QKQYMQQL    S T S L GLN T Y N  E RN S T S T KN   T S S E DYSPRQ 244
gi|51090847              I KQL H AN T T A   E V SGY P H - - -  - V K S T AL H MQ   NGAP SNL S Q F  DT PSP L S T QA  247
Lead:CeresClone-539801   L KQMQS - - K    D I A T YHHGAS   I L GGAAG Q P I   N E S S SNMSYY   N T PSPMV AQL   250
CeresAnnot:1531585       S KH P Q G N NL R   D I P GNYHCA T   T L GGSASQ P S   NGG L P NL S F Y  N T PSPMA T QL  241
CeresClone:1209672       S KH T QSHGL K    D I SGNFH - - -  - - - - - SHG V    NGG V SNMSF Y   N T PSPVAAQL
``` gi|51090847
Lead:CeresClone-539801
CeresAnnot:1531585
CeresClone:1209672

Figure 60 (continued)

| | | | | |
|---|---|---|---|---|
| gi\|51090847 | SGI APPPLFR | NMH----AYQN | TAGGNAPSKP | KVNAPNLTLR | RKYIDEAGLK | 291 |
| Lead-CeresClone-539801 | SSVAPPPLCR | NVLPNGQNLT | TLSTDSSPKS | TVNSPIQAPR | RKFVGEGKLR | 297 |
| CeresAnnot:1531585 | SSVAPPPLCR | NMQPNGSNLS | MPGFDNSARS | TLNSNMQAPR | RKFVDEGKLR | 300 |
| CeresClone:1209672 | SGIAPPPLFR | NFQPAVANPN | SLITDSSPKS | TVNSTLQAPR | RKFVDEGKLR | 291 |

| | | | | |
|---|---|---|---|---|
| gi\|51090847 | KVSGRLFNQS | SDSVPRRSAR | LSRDTTINSN | SNISQFGGNG | TDHSSGKLRV | 341 |
| Lead-CeresClone-539801 | KISGRLF---- | SDSGPRRSSR | LSSDSSVNTN | ANSTVVSGNG | TNNS---YK-- | 340 |
| CeresAnnot:1531585 | KISGRLF---- | SDSGPRRSTR | LAAEAGSNQN | TSSTLVAGNG | TNNSPKYL--- | 345 |
| CeresClone:1209672 | KISGRLF---- | SDSGPRRSSR | LSADSGANIN | SSVATVSGN-- | VNNASKYL--- | 335 |

| | | | | |
|---|---|---|---|---|
| gi\|51090847 | NSSTPSKLCS | TALRSVQVRK | GKPQATENFD | EGNRYHVVDE | MWTDNMTSTS | 391 |
| Lead-CeresClone-539801 | ---GGSKLNH | MAFRTMAIRK | GQSWANENID | EGIRNEAFDD | SSLNRTSINS | 387 |
| CeresAnnot:1531585 | ---GGSKFSS | MAIRSVTVRK | GQSWVNENYD | EGIRNEAFDD | SRANNTSSNC | 392 |
| CeresClone:1209672 | ---GGSKLSS | LALRSVTLRK | GHSWANENMD | EGVRGEPFDD | SRPNTASTTG | 382 |

| | | | | |
|---|---|---|---|---|
| gi\|51090847 | SSTSIVDGRY | PEQEKSE---- | -RVLSQDSKL | ALGIRELMAL | LRTLGEGYRL | 437 |
| Lead-CeresClone-539801 | CSSPVIEAKS | YEQEAATFHI | GGQVTSGSKV | TGTSEILTL | LRVLGEGYRL | 437 |
| CeresAnnot:1531585 | SLSLTGDSRS | LETEVATMPV | GGVIASPSCI | LSGALEILGL | LRTLGEGYRL | 442 |
| CeresClone:1209672 | SMA-------S | NDQEDETMSL | GGIAMSSQT | TIGVSEILNL | LRTLGEGCRL | 426 |

| | | | | |
|---|---|---|---|---|
| gi\|51090847 | SCLFKCQEAL | EVYRKLPEAQ | FNTGWLCQV | GKIYFELVNY | LEADHFFELA | 487 |
| Lead-CeresClone-539801 | ACLYRCQDAL | DTYLKLPQKH | YNTGWLSQV | GKAYFELVDY | LEADCAFSRA | 487 |
| CeresAnnot:1531585 | SCMYRCQDAL | DVYMKLPHKH | YNTGWLCQV | GKAYVELVDY | LEADRAFSLA | 492 |
| CeresClone:1209672 | SYMYRCQEAL | DTYMKLPHKH | YNTGWLSQV | GKAYFELIDY | LEAEKAFRLA | 476 |

Figure 60 (continued)

```
gi|51090847        HRLSPCTLEG  MDIYSTVLYH  NEEMRLSYL   AQDLVSDRL   SPQAWCAVGN    537
Lead-CeresClone-539801  RQLTPYSLEG  MDIHSTVLYH  KEDMKLSYL   AQELISTDRL  APQSWCAMGN    537
CeresAnnot:1531585      RRASPYSLEG  LDVYSTVLYH  KEDMKLSYL   AQELISTDRL  APQSWCAIGN    542
CeresClone:1209672      RQASPYCLEG  MDIYSTVLYH  KEDMKLSYL   AQELISTDRL  APQSWCAMGN    526 gi|51090847        CFALRKDHET  ALKNFQRAVQ  LDSRVAYAHT  LCGHEYSALE  DYENSKLYR     587
Lead-CeresClone-539801  CYSLQKDHET  ALKNFQRAVQ  LNPRFAYAHT  LCGHEYVALE  DFENGIKCYH    587
CeresAnnot:1531585      CYSLQKDHET  ALKNFQRAVQ  LDSRFAYAHT  LCGHEYVALE  DFENGIKSYQ    592
CeresClone:1209672      CYSLQKDNET  ALRNFLRAVQ  LNPRFAYAHT  LCGHEYTTLE  DFENGMKSYQ    576 gi|51090847        SALQVDERHY  NAWYGLGVVY  RQEKFEFAE   HHFRRAFQIN  PCSSVLMCYL    637
Lead-CeresClone-539801  SALRVDSRHY  NAWYGLGMLY  RQEKYEFSE   HHFHMAYQIN  PRSSVILSYL    637
CeresAnnot:1531585      SALRIDARHY  NSWHGLGMVY  RQEKNEFSE   HHFRMAFQIN  PCSSVIMSYL    642
CeresClone:1209672      NALRVDTRHY  NAWYGLGMIY  RQEKLEFSE   HHFRMAFDN   PSSSVIMSYL    626 gi|51090847        GMALHALKRN  EEALEMMENA  FADKKNPLP   KYQKALLLG   LQKYPDALDE    687
Lead-CeresClone-539801  TALHALKRS   GEALAMEKA   LEDKKNPLP   MYQKASILVS  LERDEALDV     687
CeresAnnot:1531585      GTALHALKRS  EEALEMMERA  LADKKNPLP   MYQKANILVS  LESFDEALEV    692
CeresClone:1209672      GTSLHALKRS  EEALEIMEQA  VADRKNPLP   MYQKANILVC  LERDEALEV     676 gi|51090847        LERLKEAPH   ESSMYALMGK  YKQLNLDK    AVFCFGIALD  LKPPAADVAI    737
Lead-CeresClone-539801  LEELKEAQPR  ESSVYALMGN  YRRRHMHER   AMFHYGVALD  LKPSLTDAM     737
CeresAnnot:1531585      LEELKEYAPR  ESSVYALMGK  YKRRNMHEK   AMFHFGLALD  LKPSATDVAT    742
CeresClone:1209672      LEELKEYAPS  ESSVYALMGR  YKRRNMHDK   AMLHFGLALX  M------       717
```

Figure 61

```
                              MGRGKVEI RR  EKSTNRRVT  FMKRRNGLLK  KAMEMGI LCD  AEVGLMI FSS   50
gi|150081463                  MGRGKI VI RR  DNSTSRQVT  FSKRRSGLLK  KAKELSI LCD  AEVGVI I FSS   50
gi|2959320                    MGRGKI VI QR  DNTTSRQVT  FSKRRSGLLK  KAKELSI LCD  AQVGLI I FSS   50
gi|34452085                   MGRGKI VI RR  DNSTSRQVT  FSKRRNGI LK  KAKELAI LCD  AEVGLVI FSS   50
gi|50924820                   MGRGKI VI RR  DNSTSRQVT  FSKRRNGI LK  KAKELAI LCD  AEVGLVI FSS   50
gi|29611976                   MGRGKI VI RR  DNSTSRQVT  FSKRRNGLLK  KAKELSI LCD  AEVGLI VFSS   50
Lead-CeresClone-542773        MGRGKI VI RR  DKSTSRQVT   FSKRRSGLLK  KAKELAI LCD  AEVGVVI FSS   50
gi|1816459                    MGRGKI VI QR  DNSTSRQVT  FSKRRNGLLK  KAKELAI LCD  AEVGVT FSS    50
CeresClone:1845589

TGKLHEFAT-  TSI RSVI ERY  NKT QGDSLQS  PLDPTLELKF  WQLEVALRQ    99
gi|150081463                  TGKLYDYASN  SSMKTI I ERY  NRVKEEQ-HQ  LLNHASEI KF  WQREVASLQQ   99
gi|2959320                    TGKLYEFAS-  NSMRSVI ERY  YKMKEEH-H-  LMSPMSEVKY  WQREVASLRQ   97
gi|34452085                   TGKLYEYAS-  TSMKSVI DRY  GRAKEEQ-QT  VANPNSELKF  WQREAASLRQ   98
gi|50924820                   TGRLYEYSS-  TSMKSVI DRY  GKAKEEQ-QD  VANPNSELKF  WQREAASLRQ   98
gi|29611976                   TGRLYEDYAS-  TSMKSVI ERY  NKVKEDH-QQ  LI NPASEVKE  WQREVASLRQ   98
Lead-CeresClone-542773        TGKLYEFSS-  TSMKSI I ERH  TKTKEDH-HQ  LLNHGSEVKF  WQREAATLRQ   98
gi|1816459                    TGKLYDFAS-  TSMRSI I ERY  NKAKEEH-QQ  LGSPT SEVKF  WQREAALRQ    98
CeresClone:1845589

QLHNMQEDHR  KVMGLEVYGL  SVKDLQNLEN  QLEMSLSGIR  MKKEQI LI EQ  148
gi|150081463                  QLQHLQECHR  KLVGEELSGM  NANDLQNLED  QLVTSLKGVR  LKKDQLMI NE  149
gi|2959320                    QLHYQENHR   QLLGEKLSGL  GI KDLTHLEN  KLEMSI KGVR  KQKEQI LDE   147
gi|34452085                   QLHSLQENHR  QLMGQDLSGL  GVKELQT EN  QLEMSI RCR   TKKDQLMI DE  148
gi|50924820                   QLHNLQENYR  QLT GDDLSGL  NVKELQSLEN  QLET SLRGVR  AKKDHLI DE   148
gi|29611976                   QVQMQECHR   QMMGQELSGL  GI EELGNLEK  RLEMSLKGVR  MKKDQI LI DE  148
Lead-CeresClone-542773        QLQDLQENHR  KLMGEELQGL  NVEDLHRLEN  QLEMSLRGVR  MKKVQMLTDE  148
gi|1816459                    KLQNLQENHR  QMMGEELSGL  GVKELQNLES  QLEMSLRGVR  MKKDQI LMNE  148
CeresClone:1845589
```

Figure 61 (continued)

```
gi|15081463      QELTHKQGS  FVHQENFELF  NKF-------  -------QAYGT  SDPNAVNGDT   186
gi|2959320       REL|-NRKGQ  |IQKENHELQ  NIVDIMRKEN  IKLQKKVHGR  TNVIEGNSSV   198
gi|34452085      KEI|-TRKGN  LIHQENIELY  KKVNLIRQEN  TDLQKKYYEK  GCGSEPNEGV   196
gi|50924820      HEL|-NRKGS  LIHQENMELY  RKVNLIRQEN  AELYKKLYET  GAENEANRDS   197
gi|29611976      HDL|-NRKAS  FHQENTDLY  NKINLIRKEN  DELHKKIYET  EGPSGVNRES   197
Lead-CeresClone-542773  VKEL|-HQKGS  LAHQENVELN  RKINLIRKEN  EELQ-KVIEA  KCRKGVAASN   196
gi|1816459       VHEL|-RRKGH  LIHQENNELY  EKVKLLQQEN  KELCKKAYGT  RDVSAANGTA   197
CeresClone:1845589  QEL|-NRKGN  LIHQENVELY  KKV-------  -------YGT  RDVDGANKDS   183 gi|15081463      ISPYDFTISE  ESQGHIHFQL  ----PQNFSD  LARAIY----  -------LS-  218
gi|2959320       D----PISNGT  TIYAPPQLQL  IQLQPAPRE-  --KSIRLGLQ  LS-         234
gi|34452085      QATFAISNGY  DLHAPIYLQL  RPPQTQKNQT  STSVMQFGLQ  LH-         238
gi|50924820      TTPYNFAVIE  EANTPARLEL  NPPSQQNDAE  QTTPPKLG--  ---         235
gi|29611976      PTPFNEAVVE  TRDVPVQLEL  STLPQQNNIE  PSTAPKLGLQ  LIP         240
Lead-CeresClone-542773  P--PFITNYGC  NMLAPISLQL  SLPEST----  ----------  ---         221
gi|1816459       LVPFGEAIGR  EQFEPIQLH  SQPEPENIET  SRASGSK---  ---         234
CeresClone:1845589  LLTNGLGLGE  DSQVPVCLQL  CQPQQQSMET  PTRATNLGRL  QLQ         226
```

Figure 62

| | | | | | | |
|---|---|---|---|---|---|---|
| gi\|549809 | —MARI PGRP— | —DYDA LIKLL | LVGDSG— | ———— | ———— | LLRFTDDMFT 39 |
| CeresAnnot:1458068 | —ME IIKK— | —NWV DKWF | KVNKKDEFRE | EKVC | VGKSCL | LLRFSDGSFT 43 |
| gi\|1654144 | MAAPPARARAR | ADYDYLIKLL | LIGDSG—— | ———— | VGKSCL | LLRFSDGSFT 41 |
| gi\|974776 | MAAPPARARAR | ADYDYLIKLL | LIGDSG—— | ———— | VGKSCL | LLRFSDGSFT 41 |
| gi\|313029 | MAAPPARARAR | ADYDYLIKLL | LIGDTG—— | ———— | VGKSCL | LLRFSDGSFT 41 |
| CeresClone:1802574 | MAAPPARARAR | ADYDYLIKLL | LIGDSG—— | ———— | VGKSCL | LLRFSDGSFT 41 |
| CeresClone:1725800 | MAAPPVRARAR | ADYDYLIKLL | LIGDSG—— | ———— | VGKSCL | LLRFSDGSFT 41 |
| CeresClone:683923 | MAAPPARARAR | ADYDYLIKLL | LIGDSG—— | ———— | VGKSCL | LLRFSDGSFT 41 |
| gi\|50935375 | MAAPARARAR | ADYDYLIKLL | LIGDSG—— | ———— | VGKSCL | LLRFSDGSFT 41 |
| CeresClone:636809 | MAGAPAARAR | ADYDYLIKLL | LIGDSG—— | ———— | VGKSCL | LLRFSDGSFT 42 |
| gi\|1370190 | MAAPPARPR | ADYDYLIKLL | LIGDSG—— | ———— | VGKSCL | LLRFSDGSFT 41 |
| gi\|2808638 | MAAPPARARAR | ADYDYLIKLL | LIGDSG—— | ———— | VGKSCL | LLRFSDGSFT 41 |
| gi\|5669640 | MAAPPARARAR | ADYDYLIKLL | LIGDSG—— | ———— | VGKSCL | LLRFSDGSLI 41 |
| gi\|871508 | MAAAPARARAR | ADYDYLIKLL | LIGDSG—— | ———— | VGKSCL | LLRFSDGSFT 41 |
| Lead-CeresClone-543118 | MAAPPARARAR | ADYDYLIKLL | LIGDSG—— | ———— | VGKSCL | LLRFSDGSFT 41 |
| gi\|28973447 | MAAPPARTR | ADYDYLIKLL | LIGDSG—— | ———— | VGKSCL | LLRFSDGSFT 41 |
| CeresClone:1390343 | MAAPPARARAR | ADYDYLIKLL | LIGDSG—— | ———— | VGKSCL | LLRFSDGSFT 41 |
| gi\|18447913 | MAAPPARARAR | ADYDYLIKLL | LIGDSG—— | ———— | VGKSCL | LLRFSDGSFT 41 |
| CeresClone:1895506 | MAAPPARARAR | ADYDYLIKLL | LIGDSG—— | ———— | VGKSCL | LLRFSDGSFT 41 |
| gi\|92897911 | MAAPPARARAR | ADYDYLIKLL | LIGDSG—— | ———— | VGKSCL | LLRFSDGSFT 41 |

Figure 62 (continued)

| | | | | | | |
|---|---|---|---|---|---|---|
| gi\|549809 | SSFI TTI GI D | FKI KK VDVDG | KL VKL QI WDT | AGQERF RTI T | SAYYRGA QGI | 89 |
| CeresAnnot:1458068 | TSFI TTI GI D | FKI RTI ELDG | KRI KLQI WDT | AGQERF RTI T | TAYYRGAMGI | 93 |
| gi\|1654144 | TSFI TTI GI D | FKI RTI ELDG | KRI KLQI WDT | AGQERF RTI T | TAYYRGAMGI | 91 |
| gi\|974776 | TSFI TTI GI D | FKI RTI ELDG | KRI KLQI WDT | AGQERF RTI T | TAYYRGAMGI | 91 |
| gi\|313029 | TSFI TTI GI D | FKI RTI ELDG | KRI KLQI WDT | AGQERF RTI T | TAYYRGAMGI | 91 |
| CeresClone:1802574 | TSFI TTI GI D | FKI RTI ELDG | KRI KLQI WDT | AGQERF RTI T | TAYYRGAMGI | 91 |
| CeresClone:1725800 | TSFI TTI GI D | FKI RTI ELDG | KRI KLQI WDT | AGQERF RTI T | TAYYRGAMGI | 91 |
| CeresClone:683923 | TSFI TTI GI D | FKI RTI ELDG | KRI KLQI WDT | AGQERF RTI T | TAYYRGAMGI | 91 |
| gi\|50935375 | TSFI TTI GI D | FKI RTI ELDQ | KRI KLQI WDT | AGQERF RTI T | TAYYRGAMGI | 92 |
| CeresClone:636809 | TSFI TTI GI D | FKI RTI EQDG | KRI KLQI WDT | AGQERF RTI T | TAYYRGAMGI | 91 |
| gi\|1370190 | TSFI TTI GI D | FKI RTI ELDG | KRI KLQI WDT | AGQERF RTI T | TAYYRGAMGI | 91 |
| gi\|2808638 | TSFI TTI GI D | FKI RTI EMDG | KRI KLQI WDT | AGQERF RTI T | TAYYRGAMGI | 91 |
| gi\|5669640 | TSFI TTI GI D | FKI RTI ELDG | KRI KLQI WDT | AGQERF RTI T | TAYYRGAMGI | 91 |
| gi\|871508 | TSFI TTI GI D | FKI RTI ELDS | KRI KLQI WDT | AGQERF RTI T | TAYYRGAMGI | 91 |
| Lead-CeresClone-543118 | TSFI TTI GI D | FKI RTI ELDG | KRI KLQI WDT | AGQERF RTI T | TAYYRGAMGI | 91 |
| gi\|28973447 | TSFI TTI GI D | FKI RTI ELDG | KRI KLQI WDT | AGQERF RTI T | TAYYRGAMGI | 91 |
| CeresClone:1390343 | TSFI TTI GI D | FKI RTI ELDG | KRI KLQI WDT | AGQERF RTI T | TAYYRGAMGI | 91 |
| gi\|18447913 | TSFI TTI GI D | FKI RTI ELDG | KRI KLQI WDT | AGQERF RTI T | TAYYRGAMGI | 91 |
| CeresClone:1895506 | TSFI TTI GI D | FKI RTI ELDG | KRI KLQI WDT | AGQERF RTI T | TAYYRGAMGI | 91 |
| gi\|92897911 | TSFI TTI GI D | FKI RTI ELDG | KRI KLQI WDT | AGQERF RTI T | TAYYRGAMGI | 91 |

| Name | Sequence | Pos |
|---|---|---|
| gi\|549809 | ARGQALADEF GFRFYETSAK DNVHVEEAF AVAKDVLARM EGEHANQQL | 189 |
| CeresAnnot:1458068 | SKGQALADEY GIKFFETSAK TNLNVEEVFF SIARDIKQRI SETDSRAE- | 191 |
| gi\|1654144 | AKGQALADEY GIKFFETSAK TNLNVEEVFF SIGRDIKQRL SDTDSRAE- | 189 |
| gi\|974776 | AKGQALADEY GIKFFETSAK TNLNVEEVFF SIARDIKQRL ADSDTRQE- | 189 |
| gi\|313029 | SKGQALADEY GIKFFETSAK TNLNVEEVFF SIGKDIKQRL SESDSKTE- | 189 |
| CeresClone:1802574 | AKGQALADEY GIKFFETSAK TNLNVEQVFF SIARDIKQRL AETDSKPE- | 189 |
| CeresClone:1725800 | AKGQALADEY GIKFFETSAK TNLNVEQVFF SIARDIKQRL AETDSKPE- | 189 |
| CeresClone:683923 | AKGQALADEY GIKFFETSAK TNLNVEQVFF SIARDIKQRL AETDSKIE- | 189 |
| CeresClone:50935375 | SKGQALADEY GIKFFETSAK TNLNVEEVFF SIARDIKQRL ADTDSRAE- | 189 |
| CeresClone:636809 | SKGQALADEY GIKFFETSAK TNLNVEEVFF SIAKDIKQRL AETDSKIE- | 190 |
| gi\|1370190 | AKGQALADEY GIKFFETSAK TNLNVEEVFF SIARDIKQRL ADTDSKAE- | 189 |
| gi\|2808638 | SKGQALADEY GIKFFEASAK TNMNVEEVFF SIARDIKQRL ADTDSRSE- | 189 |
| gi\|5669640 | SKGQALADEY GIKFFETSAK TNMNVEEVFF SIARDIKQRL ADTDSRAE- | 189 |
| gi\|871508 | AKGQALADEY GIKFFETSAK TNLNVEEVFF SIGRDIKQRL SDTDSKAE- | 189 |
| Lead-CeresClone:543118 | SKGQALADEY GIKFFETSAK TNMNVEEVFF SIARDIKQRL ADTDSRAE- | 189 |
| gi\|28973447 | AKGQALADEY GIKFFETSAK TNLNVEEVFF SIAKDIKQRL SDTDSKAE- | 189 |
| CeresClone:1390343 | SKGQALADEY GIKFFETSAK TNLNVEEVFF SIGRDIKQRL AESDNRAE- | 189 |
| gi\|18447913 | SKGQALADEY GIKFFETSAK TNLNVEEVFF SIARDIKQRL ADTDSKAE- | 189 |
| CeresClone:1895506 | SKGQALADEY GIKFFETSAK TNLNVEEVFF SIARDIKQRL ADTDSKAE- | 189 |
| gi\|92897911 | SKGQALADEY GIKFFETSAK TNLNVEEVFF SIARDIKQRL ADTDSKSE- | 189 |

Figure 62 (continued)

| | | | | | | | | |
|---|---|---|---|---|---|---|---|---|
| gi\|549809 | QQQQ | SAAQP | VRL | TSGSPSP | AQG | ---- | KSC | CR-------- | 217 |
| CeresAnnot:1458068 | PQ-- | NQP | DPSA | SGG--QA | AQNLYHA | AA | AT | CGWLNAEYTG | HTH | 232 |
| gi\|1654144 | PA-- | RI | SQT | DQELD---C | AGH | --- | TEV | CMLWKLKTNY | IN- | 222 |
| gi\|974776 | AQPSI | T | KPA | DQ--SGN-QA | AAK | --- | SAC | CGS-------- | 215 |
| gi\|313029 | PQ-S | RI | NQS | DQAGTAG-QC | AQK | --- | SSC | CGS-------- | 216 |
| CeresClone:1802574 | EK-A | KI | NKP | DQGTEQA--A | AQK | --- | STC | CGS-------- | 215 |
| CeresClone:1725800 | DR-T | KI | NKP | DQAAEG-TA | GQR | --- | SAC | CGS-------- | 216 |
| CeresClone:683923 | DK-T | KI | NKA | EGGDA--PA | APR | --- | SAC | CGS-------- | 214 |
| gi\|50935375 | DR-T | KI | NKP | E-GDAEA-TT | ASG | --- | SAC | CGS-------- | 215 |
| CeresClone:636809 | PA-G | KI | NNQ | LDHATAG-EV | LQK | --- | STC | CG--------- | 215 |
| gi\|1370190 | PQ-T | QI | NQP | DASASGG--QA | AQK | --- | SAC | CGS-------- | 216 |
| gi\|2808638 | PQ-T | KI | NQQ | EQGAGTS--AA | AQK | --- | SAC | CGS-------- | 216 |
| gi\|5669640 | PS-T | LKI | NQP | EAGAGGS--QT | SQK | --- | SAC | CGS-------- | 216 |
| gi\|871508 | PQ-T | KI | NQQ | DPAANGG--QA | ATK | --- | SAC | CGS-------- | 215 |
| Lead-CeresClone-543118 | PQ-LA | KI | NQP | DQATSGG--QP | AQK | --- | SAC | CGS-------- | 216 |
| gi\|28973447 | PA-T | KI | SQT | DQAGAG--QA | TQK | --- | SAC | CGS-------- | 216 |
| gi\|1390343 | PQ-T | KI | NQQ | DQADGAG--QA | TQK | --- | SAC | CGS-------- | 216 |
| gi\|18477913 | PQ-R | RI | NQQ | DQAGGA--QA | AQK | --- | SSC | CGA-------- | 216 |
| CeresClone:1895506 | PQ-A | KI | NQQ | DQAGAA--AA | AQK | --- | SAC | CGA-------- | 216 |
| gi\|92977911 | PQ-T | KI | NQP | DQAGAA--QA | AQK | --- | SAC | CGS-------- | 216 |

Figure 63

| | | | | | | |
|---|---|---|---|---|---|---|
| gi\|21592849 | --MER SSSMK | QWKKGPA RGK | GGPQNALCQY | RGVRQRTWGK | WVAEIREPKK | 48 |
| CeresAnnot:1474923 | MENCRRSPLK | PWKKGPTRGK | GGPQNAMCEY | RGVRQRTWGK | WVAEIREPKK | 50 |
| Lead-CeresClone-557009 | MDI CKKSPLK | PWKKGPTRGK | GGPQNASCEY | RGVRQRTWGK | WVAEIREPKK | 50 |
| gi\|92897616 | MDNSKKSPLK | PWKKGPTRGK | GGPQNASCEY | RGVRQRTWGK | WVAEIREPKK | 50 |

| | | | | | | |
|---|---|---|---|---|---|---|
| gi\|21592849 | RARLWLGSFA | TAEEAAMAYD | EAALKLYGHD | AYLNLPHLQR | NTRPSLSNSQ | 98 |
| CeresAnnot:1474923 | RTRLWLGSFA | TAEEAAMAYD | EAARRLYGPD | AYLNLPHLQS | NFNPLN-KSQ | 99 |
| Lead-CeresClone-557009 | RTRLWLGSFA | TAEEAAMAYD | EAARRLYGPD | AYLNLPHLQP | RSTSTI-TSG | 99 |
| gi\|92897616 | RTRLWLGSFA | TAEEAAMAYD | EAARRLYGPD | AYLNLPHMQT | HSNSTM-KTG | 99 |

| | | | | | | |
|---|---|---|---|---|---|---|
| gi\|21592849 | RFKWVPSRKF | SMFPSCGML | NVNAQPSVHI | QRLEELKK | TGLLSQSYSS | 148 |
| CeresAnnot:1474923 | KKWIPSKNF | KWIPSKNF | NIHAQPSVHV | HQRLEELKN | NRPLHQSSVA | 149 |
| Lead-CeresClone-557009 | KFKWPSKNF | SMFPSCGLL | NVNAQPSVHL | HQRLQELKR | NSVVSQSS-- | 147 |
| gi\|92897616 | KFKWLPSKNF | SMFPSCGLL | NVNAQPSVHL | HQRLQEFKQ | NAVVASQSSF | 149 |

| | | | | | | |
|---|---|---|---|---|---|---|
| gi\|21592849 | SSSSTESKT- | NTSFLDEKTS | KGE------ | ----TDNMF | EGGDQKKPEI | 185 |
| CeresAnnot:1474923 | SSSSSSESRN | EVMIVSD-EN | HVANLAVAEK | DVELSSEKML | LRNHDEKPQI | 198 |
| Lead-CeresClone-557009 | SSSSNDPKA- | EIQNVDS-KN | HGEDENPP-K | DVQTSSEEVL | GDL-QEKPQI | 193 |
| gi\|92897616 | SSSSNDPKAE | EIQKVDSKKS | HTEDPLPKET | IVQTSANKML | GDLQEEKPQI | 199 |

| | | | | | | |
|---|---|---|---|---|---|---|
| gi\|21592849 | DLTEFLQQLG | LKDENEAEP | SEVAECHSPP | PWNEQEELG- | -SPFRTENFS | 233 |
| CeresAnnot:1474923 | DLNEFLQQLG | LKEEKQPDS | NDVEECLTVP | ESSQKYENE- | LAALADKSFN | 247 |
| Lead-CeresClone-557009 | DLHEFLQQMG | LKEERQSER | TDSSGSSTVR | EAVLTDDCDH | LGVFSDKSVN | 243 |
| gi\|92897616 | DLNEFLQQMG | LKEGSHSEQ | TESSGSSIVH | EVLPRDDNDQ | LGIFSDMSVN | 249 |

| | | | | | | |
|---|---|---|---|---|---|---|
| gi\|50911399 | VRQRPWGKFA | AEI RDPAKNG | ARVWL GTFDS | AEEAAVAYDR | AAYRMRGSRA | 201 |
| CeresClone:555364 | VRQRPWGKFA | AEI RDPAKNG | ARVWL GTYDT | AEDAAVAYDR | AAYRMRGSRA | 192 |
| CeresClone:1443683 | VRQRPWGKFA | AEI RDPARNG | ARVWL GTYDT | AEDAALAYHR | AAYRMRGSRA | 187 |
| CeresClone:1809375 | VRQRPWGKFA | AEI RDPAKNG | ARVWL GTYDT | AEDAALAYDR | AAYRMRGSRA | 192 |
| gi\|28274828 | VRQRPWGKFA | AEI RDPAKNG | ARVWL GTYES | AEEAALAYDR | AAFRMRGTKA | 159 |
| gi\|1208498 | VRQRPWGKFA | AEI RDPAKNG | ARVWL GTYET | AEEAALAYGK | AAFRMRGSKA | 151 |
| gi\|8809571 | VRQRPWGKFA | AEI RDPAKNG | ARVWL GTYET | AEEAALAYDK | AAYRMRGSKA | 155 |
| Lead-CeresClone-6042 | VRQRPWGKFA | AEI RDPAKNG | ARVWL GTFET | AEDAALAYDR | AAYRMRGSRA | 200 |
| CeresClone:1926437 | VRQRPWGKFA | AEI RDPAKNG | ARVWL GTFET | AEDAALAYDK | AAFRMRGSKA | 184 |
| 1446840 | VRQRPWGKFA | AEI RDPAKNG | ARVWL GTFET | AEDAALAYDR | AAYRMRGSRA | 203 |
| gi\|32401273 | VRQRPWGKFA | AEI RDPAKNG | ARVWL GTFET | AEDAALAYDR | AAFRMRGSRA | 190 |
| gi\|92878372 | VRRRPWGKFA | AEI RDPAKNG | ARVWL GTFET | AEDAALAYDR | AAYRMRGSRA | 197 |
| CeresClone:582684 | VRQRPWGKFA | AEI RDPAKNG | ARVWL GTFET | AEDAALAYDR | AAYRMRGSRA | 190 |

| | | | | | | |
|---|---|---|---|---|---|---|
| gi\|50911399 | LLNFPLRI GS | EI AAAAAAAA | A--GNKRPYP | DPASGSSP | SSSSSS--SSS | 248 |
| CeresClone:555364 | LLNFPLRI GS | EI AAAHAAAA | AA--GDKRPSP | EPATSDSSS | SS--------- | 233 |
| CeresClone:1443683 | LLNFPLRI GS | ----------- | ---GDKRPSP | AP---- | ----------- | 217 |
| CeresClone:1809375 | LLNFPLRI GS | EI AAATAAAA | AAPGDKRPSP | EPATSSDSSF | STSSSSSCS-- | 241 |
| gi\|28274828 | LLNFPHRI GL | ----------- | ---NE----P | VRVTVKRRLS | ESASSSVSSA | 194 |
| gi\|1208498 | LLNFPHRI GL | ----------- | ---NE----P | VRLTAKRRSP | EPASSSI SSA | 186 |
| gi\|8809571 | LLNFPHRI GL | ----------- | ---NE----P | VRLTVKRRSP | EPASSSN--- | 190 |
| Lead-CeresClone-6042 | LLNFPLRVNS | ----------- | ---GE----P | VRI KSKRSSF | SSSN------ | 229 |
| CeresClone:1926437 | LLNFPLRVNS | ----------- | ---GE----P | VRVTSKRASP | EPSNFS--SSG | 218 |
| 1446840 | LLNFPLRVNS | ----------- | ---GE----P | VRVTSKRSSP | EPSSSV----- | 234 |
| gi\|32401273 | LLNFPLRVNS | ----------- | ---GE----P | VRI TSKRSSP | ERSVSSSS--- | 224 |
| gi\|92878372 | LLNFPLRVNS | ----------- | ---GE----P | VRI ASKRSSP | ERSSSS----- | 228 |
| CeresClone:582684 | LLNFPLRVNS | ----------- | ---GE----P | VRVKSKRSSS | PES-------- | 218 |

Figure 64 (continued)

```
gi|50911399          S-SSGSPKRR KRG-EAAAAS MAMALVPPPP PPAQAPVQLA LPAQPWFAAG    296
CeresClone:555364    --SSGSPKRR KRG-EAAAAS MAMALVPPPS ------QLS RPAQAWYPAA    273
CeresClone:1443683   SWASGSHKRR KRG-EAAAAN MAMALVPPPS ------QLN RPAQPWFPAA    259
CeresClone:1809375   --TSGSTKRR KRG-EAAAAT MAMALVPPPS ------QLN RPAQPWFPAA    281
gi|28274828          S-ESGSPKRR RKG-VAAKQA ELEVES---- ---------- ---RGPNV      223
gi|1208498           L-ENGSPKRR RKA-VAAKKA ELEVQS---- ---------- ---RSNA       214
gi|8809571           S-ENSLPKRR RKA-VAAKQA ELEVQS---- ---------- ---RSNV       218
Lead-CeresClone-6042 --ENGAPKKR RT--VAAGGG MDKGLT---- ---------- ----------     251
CeresClone:1926437   S-EQGLPKRR RKV-VAAGGG PVVGEA---- ---------- ---WLDMS      245
1446840              --DSGSPKRR KKVGGTAGAA TVVAKA---- ---------- ---GLEIG      263
gi|32401273          --ESASPKRR KK---APSA EEVVG PVAGQARP-- ---------- ----------  261
gi|92878372          --ESNSPAKR KKV-MTAQSC LKTGQV---- ------GLQ QVGNVVEGMQ    254
CeresClone:582684    --AAALPAKR --------- EQVGSQ---- ---------- ----GSQ       242
```

```
gi|50911399          P--------- ----IQQLVS ---           303
CeresClone:555364    PVEQVA---- MAPRAQQLVS ---           289
CeresClone:1443683   PVEQAA---- MAPRVEQLVV ---           275
CeresClone:1809375   AAEPAA---- MAPRVEQLVI ---           297
gi|28274828          MKVGCQ--MF QLASSYWLVK IWS           244
gi|1208498           MQVGCQ--ME QFPVGEQLLV S--           233
gi|8809571           MQVGCQ--ME QFPVGEQLLV S--           237
Lead-CeresClone-6042 --VKCE--VV EVARGDCLV L--            268
CeresClone:1926437   SAAAVEYEIG SRTNSNQLLI S--           266
1446840              NGVGCQ---- VGTHGEOMLV I--           280
gi|32401273          VGVGCQVGVG TMPLGDQLLV T--           282
gi|92878372          VAQQCT---- ---RGGQLLV S--           268
CeresClone:582684    -VAECT---- ---RGEQLLV S--           255
```

Figure 65

|  |  |  |  |  |  |  |
|---|---|---|---|---|---|---|
| gi\|21667487 | ---MEGEKPV | VGGAYWGVG- | ----- | ---ARACDS | CATEAARLFC | RADAAFLCAG | 43 |
| CeresClone:1755065 | MAAAVELEQK | PAVGYWGVA- | ----- | -GARPCDA | CAAEPARLHC | RADGAFLCPG | 46 |
| Lead-CeresClone-6639 | MGFGLESIKS | ISGG-WGAA- | ----- | ARSCDA | CKSVTAAVFC | RVDSAFLCIA | 44 |
| gi\|21281083 | MGFGLESIKS | ISGG-WGAA- | ----- | ARSCDA | CKSVTAAVFC | RVDSAFLCIA | 44 |
| gi\|9759262 | MGFGLESIKS | ISGG-WGAA- | ----- | ARSCDA | CKSVTAAVFC | RVDSAFLCIA | 44 |
| CeresClone:463157 | MGIERGGFKG | FRSA-MSVP- | ----- | -PKPCDS | CKLASAALFC | RPDSAFLCIA | 44 |
| gi\|92875402 | MGIERGGLKS | LRGG-WSVP- | ----- | -PKLCDS | CKLLTPAALFC | RSDSAFLCIN | 44 |
| CeresClone:1834027 | MGIETSGGTI | PGG-WGAA- | MAVAAKTLCDS | AKRCDS | CKSSAAAIFC | RTDWFLCLN | 49 |
| 1482536 | MGIEVESLKN | LTGG-WSVA- | ----- | -AKRCDS | CKTAAAAIFC | RADSAFLCLN | 44 |
| 1478227 | MGIEVESLKN | LTGG-WSVA- | ----- | -AKRCDS | CKTAAAAAFC | RADSAFLCLN | 44 |

|  |  |  |  |  |  |  |
|---|---|---|---|---|---|---|
| gi\|21667487 | CDARAH---- | ---GSGSRHAR | VWLCEVCEEHA | PAAVTCKADA | AMLCASCDAD | 87 |
| CeresClone:1755065 | CDARAH---- | ---GAGSRHAR | VWLCEVCEEHA | PAAVTCRADA | AALCAACDAD | 90 |
| Lead-CeresClone-6639 | CDTRIH---- | ---SFTRHER | VWCCEVCEQA | PAAVTCKADA | AALCVTCDAD | 87 |
| gi\|21281083 | CDTRIH---- | ---SFTRHER | VWCCEVCEQA | PAAVTCKADA | AALCVTCDAD | 87 |
| gi\|9759262 | CDTRIH---- | ---SFTRHER | VWCCEVCEQA | PAAVTCKADA | AALCVSCDAD | 87 |
| CeresClone:463157 | CDSNHCS--- | ---NKLASRHER | VWMCEVCEQA | PASVTCKADA | AALCVSCDAD | 91 |
| gi\|92875402 | CDSTLHSA-- | ---NKLSSRHER | VWMCEVCEQA | PAAVTCKADA | AALCVTCDSD | 91 |
| CeresClone:1834027 | CDSNFH---- | ---SGHER | VSMCEVCEQA | PAAVTCKADA | AALCVTCDSD | 90 |
| 1482536 | CDTKIHHSGV | NSKIMSRHER | VWMCEVCEQA | PAAVTCKADA | AALCVTCDAD | 94 |
| 1478227 | CDTKIHHSQV | NSKIMSRHER | VWMCEVCEQA | PAAVTCKADA | AALCVTCDAD | 94 |

|  |  |  |  |  |  |  |
|---|---|---|---|---|---|---|
| gi\|21667487 | HAANPLARR | HERVPVAPFF | GAAADAHKPF | ---PSSGAQ | ---AT---F | ---PSSGAQGD | 123 |
| CeresClone:1755065 | HSANPLARR | HERLPVAPFF | GALADAPQPF | -PSAA---F | AGGQSQGD | 135 |
| Lead-CeresClone-6639 | HSANPLASR | HERVPVETFF | DSAETAVAKI | SASST---F | GILGSSTTVD | 133 |
| gi\|21281083 | HSANPLASR | HERVPVETFF | DSAETAVAKI | SASST---F | GILGSSTTVD | 133 |
| gi\|9759262 | HSANPLAQR | HERVPVEPFF | DSAES--VKAS | -AAAT---F | GFLVPSDDGG | 136 |
| CeresClone:463157 | HSANPLARR | HERVPVEPFF | DSAESVKSS | SAAAAAASF | NFLVVPTDDGY | 141 |
| gi\|92875402 | HSANPLARR | HERVPVEPFF | DSADSVKSS | ---P---F | SFLVPTDHN | 132 |
| CeresClone:1834027 | HSANPLARR | HERVPIEPFY | DSAESVKTS | ---SA---F | NFLVPGDQNG | 137 |
| 1482536 | HSANPLARR | HERVPIEPFY | NSAESVKTS | ---TA---F | NILPGENG- | 136 |
| 1478227 | HSANPLARR | HERVPIEPFY | NSAESVKTS | ---TA---F | NILPGENG- | 136 |

Figure 65 (continued)

```
gi|21667487        AGAASAEDD  GSNDAEAASW  LLPEPDHKDG  ANGA------  -TADVFFA    164
CeresClone:1755065 AAAAADDD   GSNEAEAASW  LLPEPDTSHE  DSAA------  -ATDAFFA    176
Lead:CeresClone-6639 --------  ---LGLCPW   LLPN--DFNEP AKIEIGTENM  K-GSSDFMFS  177
gi|21281083        LTAVPVMADD ---LGLCPW   LLPN--DFNEP AKIEIGTENM  K-GSSDFMFS  177
gi|9759262         LTAVPVMADD ---LGLCPW   LIPNPNFGSK  LMDAPEI---  --KSKEIFFS  177
CeresClone:463157  ASDAFA-PDD ---SDAAAW   --PNPNFGSK  LNETQDI---  --KTREMFFS  176
gi|92875402        G-----QDD  ---AEAAAW   LLHGNHTTHD  -NCKQEIESN  -KGDEFFTC   176
CeresClone:1834027 GT-------  ---------   LLQSNHTTHD  LNTKINIENP  VVKTGDMFFS  150
1482536            VSAYDH-NDE ----EGVSW   LLHGNHTTHD  HNSKLQIENP  VVKTGDMFFS  182
1478227            VSGYDQ-NDD ----VEGVSW                                      181 gi|21667487        -------    DSDHYL-DL    -------     MDDIKAISVQ  LNGQPELD--  195
CeresClone:1755065 -------    DSDKYLGVDL   -------     MDGIKAJGV-  PVAPPELD--  208
Lead:CeresClone-6639 DFDRL-DF  EFPNS         NHHQ-------  GDSLVPVQTK TEPLPLTN-- 217
gi|21281083        DFDRL-DF   EFPNS         NHHQ-------  GDSLVPVQTK  TEPLPLTN-- 217
gi|9759262         DFDRL-DF   DYSNS-F       NHHQ-------  NDSVVPVQTK  TEPLPLTN-- 217
CeresClone:463157  EMDPFL-DF  DYSNS-F       QNNN--CSNAM  NDSVVPVQTP  SLAPPLINNH 217
gi|92875402        DMDPFL-DF  GYPNS---S     QHLH--DAA    MDSVVPVQNK  PTPAPMMN-- 217
CeresClone:1834027 EMDRFL-DF  EYQNSMDGRY    KQSHGGGAG   ADSVVPVQTK  KPVTPLIN-- 189
1482536            EMDPFL-EL  EYQNS DASY    EKIH--GGAG   ADSVVPVQNK  PAPLPVID-- 228
1478227            EIDPFL-EL                                        PAPLPVIN-- 225 gi|21667487        -------    ---LNGGNKG   F--YSDH-SM  NHSLSSS--E   AAVVPDAAA-  226
CeresClone:1755065 -------    ---I AAGA    F--YYPEH-SM NHSVSSS--E   VAVVPDVLA-  238
Lead:CeresClone-6639 NDHCFD   DFCRSKLSA    F--TYPSQ-SV SHSVSTSSIE   YGVVPDGNT   260
gi|21281083        NDHCFD     DFCRSKLSA    F--TYPSQ-SV SHSVSTSSIE   YGVVPDGNT   260
gi|9759262         NDHCFD     DFCRSKLSA    F--TYPSQ-TT -SVSTSSI-E   YGVVPDGNT   256
CeresClone:463157  HHHQSETCFD VDFCRSKLSS   F--NYPSN-SL SQSVSSSSLD   VGVVPDGNTV  265
gi|92875402        -HNSEGCFD  DFCRSKLSS    F--NYPSH-SI SHSVSSSSLD   VGVVPDGNTV  263
CeresClone:1834027 DGSCFD     --------      F--SYQTQSSL SHSVSSSSLE   VETVPDGNY-  224
1482536            HKNCFD     DFCRSKLTS    FSSYPSQ-SL  SHSVSSSSLD   VGVVPDGNSM  273
1478227            HESCFD     DFCRSKLTS    F--SYSSQ-SL SHSVSSSSLD   VGVVPDGNSM  269
```

Figure 65 (continued)

| ID | Seq1 | Seq2 | Seq3 | Seq4 | # |
|---|---|---|---|---|---|
| gi\|21667487 | ---------- | ---------- | ----AP | VMSR------GREREA | RLMRYREKRK 248 |
| CeresClone:1755065 | ---------- | ---------- | --GGVPAVP | VASR------GKEREA | RLMRYREKRK 265 |
| Lead-CeresClone-6639 | ---------- | ---------- | -NNSVNRST | TSSTTG--GD HQASSMDREA | RVLRYREKRK 297 |
| gi\|21281083 | ---------- | ---------- | -NNSVNRST | TSSTTG--GD HQASSMDREA | RVLRYREKRK 297 |
| gi\|9759262 | ---------- | ---------- | -NNSVNRST | TSSTTG--GD HQASSMDREA | RVLRYREKRK 293 |
| CeresClone:463157 | SDMSYSFGRN | SSDSGIVV | VSGNSVGQGA | TQL CGMDREA | RVMRYREKRK 314 |
| gi\|92875402 | SEISYNFG-- | SESMVSGGV | NSSNQGVQGA | TQL CGMDREA | RVLRYREKRK 310 |
| CeresClone:1834027 | ---------- | --HATQ | VGG------SJ DREA | RVLRYKEKRK 247 |
| 1482536 | SDISYPFGRS | MNTYTDPSMP | ISGSTTNQAA | AQL AGIDREA | RVLRYREKRK 323 |
| 1478227 | SDISYPFSRS | MNTTTDPSMP | LSGWTANQAA | TQL AGIDREA | RVLRYRERRK 319 |

| ID | Seq1 | Seq2 | Seq3 | Seq4 | # |
|---|---|---|---|---|---|
| gi\|21667487 | SRRFEKTIRY | ASRKAYAETR | PRVKGRFAKR | TG ADADALE EHEEMYSSAA | 298 |
| CeresClone:1755065 | NRRFDKTIRY | ASRKAYAETR | PRIKGRFAKR | CSAEAEDEDE AL--LEHEEG | 313 |
| Lead-CeresClone-6639 | NRKFEKTIRY | ASRKAYAESR | PRIKGRFAKR | TETENDDIFL SH--VYASAA | 345 |
| gi\|21281083 | NRKFEKTIRY | ASRKAYAETR | PRIKGRFAKR | TETENDDIFL SH--VYASAA | 345 |
| gi\|9759262 | NRKFEKTIRY | ASRKAYAESR | PRIKGRFAKR | TETENDDIFL SH--VYASAA | 341 |
| CeresClone:463157 | NRKFEKTIRY | ASRKAYAETR | PRIKGRFAKR | TEJDS-DV ER--LYSPG- | 358 |
| gi\|92875402 | NRKFEKTIRY | ASRKAYAETR | PRIKGRFAKR | TEJDS-DV DR--LYNPAD | 355 |
| CeresClone:1834027 | NRKFEKTIRY | ASRKAYAETR | PRIKGRFAKR | TETHNDDV-- DH--MFNNSS | 293 |
| 1482536 | NRKFEKTIRY | ASRKAYAETR | PRIKGRFAKR | TEMES-DM-- DT--LYNSPS | 368 |
| 1478227 | NRKFEKTIRY | ASRKAYAETR | PRIKGRFAKR | TEMES-DM-- DN--LYNSPS | 364 |

| ID | Seq1 | Seq2 | Seq3 | # |
|---|---|---|---|---|
| gi\|21667487 | AAVAALMAPG | PDHDGVDGV | VPTLV | 323 |
| CeresClone:1755065 | ACFSPAV--- | -SAPAASDGV | VPSFC | 334 |
| Lead-CeresClone-6639 | ---------- | -HAQY---GV | VPTF- | 355 |
| gi\|21281083 | ---------- | -HAQY---GV | VPTF- | 355 |
| gi\|9759262 | ---------- | -HAQY---GV | VPTF- | 351 |
| CeresClone:463157 | ---PAVLM-- | LDTPY---PY | VPSF- | 374 |
| gi\|92875402 | PLSVPSSML- | MDCPY---PY | VPTF- | 375 |
| CeresClone:1834027 | FAVGPAGFM- | AEITDY---DY | VPSF- | 313 |
| 1482536 | ----SVPFL- | ADTHY---HY | VPSF- | 384 |
| 1478227 | ----SVPFM- | ADTQY---GV | VPSF- | 380 |

Figure 66

```
CeresClone:892214    -MAAGKRTIG LAMDYSPSSK AAIRWVENL VKAGDRIILI HVLPKGADAS   49
gi|50913251          -MAAEKRTIG LGMDYSPSSK AAAKWAVDNL VKAGDRIILV HVLPKGADAS   49
CeresClone:1728645   MAAEGSRTVG GMDYSPTSK VAVRWAVDNL VCAGDHVVLI HVLSKSDHT    50
gi|92875130          --MAKAHIVG VAMDFSPTSK LALRWAVDNL NKNDQIIMI  NVQPPSADHT   48
Lead-CeresClone-7774 --MGKARTVG VGMDYSPTSK LALRWAAENL LEDGDTVILI HVQPQNADHT   48
1449565              --MEKARTVG IGMDYSSTSK AALRWAAENL GEGDRIILI  QVQPPNADHT   48

CeresClone:892214    HKGLWKSTGS PLIPLLEFME MNVQARYGVN PDKEVLEILQ AESKSKQ-VE   98
gi|50913251          HKELWKSTGS PLIPLLEFME MNVQARYGIN PDKEVLEILQ AESKSKQ-VE   98
CeresClone:1728645   EKQLWEEHGS PLIPLGEFED MNLTVRYGIS PDGEVLDILH TASETKG-VK   99
gi|92875130          RKELFEDTGS PLVPLEELRE NETKQYGIA  KDPEVIDILE TASKIKGQAK   98
Lead-CeresClone-7774 RKLFEETGS  PLIPLEEFRE VNLSKQYGLA YDPEVLDVLD TLSRAKK-VK   97
1449565              RKQLFECTGS PLVPLAEFRD NFSKQYGLT  YDPEVLDILD TVSRTKG-AE   97

CeresClone:892214    LAKIYWGDA  LKVDSVVLGC REKLCEAVDD RGLGPLKRAL LGSVSNYVVN  148
gi|50913251          VLAKVYWGDA LKVNTEVLGC REKLCEAVDD RGLGPLKRAL LGSVSNYVVN  148
CeresClone:1728645   VVSKIYWGDP LKLDSLVVGS REKICDAVEE RGLGAIKRVL LGSVSNYVVV  149
gi|92875130          VVAKVYWGDP LHDSLVIGS  REKLCNAVED RGLGTIKSVL LGSVSKHVVT  148
Lead-CeresClone-7774 VVAKVYWGDP LKLDSIVLGS REKLCDAVEN RGLGSLKRIL LGSVSNHVVT  147
1449565              VVAKVYWGDP LKLDSLVMGS REKLDAVED  RGLGAIKRVL LGSVSNYVVT  147

CeresClone:892214    NATCPVTVVR CPNGSLA--  165
gi|50913251          NATCPVTVVR APTVSNA--  165
CeresClone:1728645   HATCPVTVVK SNA------  162
gi|92875130          NASCPVTVVK CMQSSKERH  167
Lead-CeresClone-7774 NATCPVTVVK AN-------  159
1449565              NAPCPVTVVK CSKP-----  161
```

Figure 67

```
                         						                                                        50
Lead-CeresClone-8334     MDYKVSRSGE  IVEGEVEDSE  KIDLPPGFRF  HPTDEELITH  YLRPKVVNSF   50
gi|30984532              MDYKVSRSGE  IVEGEVEDSE  KIDLPPGFRF  HPTDEELITH  YLRPKVVNSF   50
CeresClone:1923641       ----------  ME------NVSSFRNEDE  QMELPPGFRF  HPTDEELITH  FLSKKVVDSF   42

Lead-CeresClone-8334     FSAIAIGEVD  LNKVEPWDLP  WKAKLGEKEW  YFFCVRDRKY  PTGLRTNRAT  100
gi|30984532              FSAIAIGEVD  LNKVEPWDLP  WKAKLGEKEW  YFFCVRDRKY  PTGLRTNRAT  100
CeresClone:1923641       FSAIAIGEVD  LNKCEPWDLP  WRAKMGEKEW  YFFCVRDRKY  PTGLRTNRAT   92

Lead-CeresClone-8334     KAGYWKATGK  DKEIFKGKSL  VGMKKTLVFY  KGRAPKGVKT  NWVMHEYRLE  150
gi|30984532              KAGYWKATGK  DKEIFKGKSL  VGMKKTLVFY  KGRAPKGVKT  NWVMHEYRLE  150
CeresClone:1923641       DAGYWKATGK  DKEIFKGKSL  VGMKKTLVFY  KGRAPKGQKT  NWVMHEFRLE  142

Lead-CeresClone-8334     GKYGJDNLPK  TAKNECVISR  VFHKRTDGTK  EHMSVGLPPL  MDSSPYLKSR  200
gi|30984532              GKFAIDNLSK  TAKNECVISR  VFHTRTDGTK  EHMSVGLPPL  MDSSPYLKSR  200
CeresClone:1923641       GQYSVYNLPK  TAKNEWMICR  VFQKSPNGKK  VHISFGLPPL  MDPSPH----  187

Lead-CeresClone-8334     GQDSLAGTTL  G-GLLSHVTY  FSDQTTDDKS  ---LVADFKT  TMFGSGSTN-  245
gi|30984532              GQDSLAGTTL  G-GLLSHVTY  FSDQTTDDKS  ---LVADFKT  TMFGSGSTN-  245
CeresClone:1923641       ---TSEARLVN  GAGETSNVIC  FSDPIEDRKA  VEEMMDSFDI  SLVPCSSSSV  235

Lead-CeresClone-8334     ----------  --FLPNIGSL  LDFDPLFLQN  NSSVLKMLLD  NEETQFKKNL  283
gi|30984532              ----------  --FLPNIGSL  LDFDPLFLQN  NSSVLKMLLD  NEETQFKKNL  283
CeresClone:1923641       NSLQKASYTT  NQIKSNMGN-  LQYPDCFWIQ  EPSLLLKTLIQ  SQGGRSKQNL  284
```

Figure 67 (continued)

| | | | | | |
|---|---|---|---|---|---|
| Lead-CeresClone-8334 | HNSGSSESEL | TASSWQGHNS | YGSTGPVNLD | CVWKF | 318 |
| gi\|30984532 | HNSGSSESEL | TASSWQGHNS | YGSTGPVNLD | CVWKF | 318 |
| CeresClone:1923641 | KPEFSQDSTV | SNPEMIQLPS | C-SAGAINLG | YFWGY | 318 |

Figure 68

```
                                                                          50
                                                                          43
Lead-CeresClone-963031  MAGGRGSSKS TAPKARKRVE AESKPETTNN NNINTLLRAK DGSAFAKCEG
gi|21554154             MAG--PSTTS NAPKQRKRVE AE-----TSS NTSTTLRRAK DGSAFALCEG 100
                                                                          93
Lead-CeresClone-963031  CNKNVAVALI SMHDCSLDAK RVNLEAQVV ETQTEAKKKP VERKKSTSDE
gi|21554154             CNKSVAVALI SMHNCSLDAK RVNLEAQVV ETQAEAKKKP AEKKKTTSDG 150
                                                                          141
Lead-CeresClone-963031  PKAKRLRKAK DDSKKKSSSS SNKPKRPLTX FFIFMXDFRK TFKEENPDAG
gi|21554154             PKPKRLKKTN DE---KKSSST SNKPKRPLTA FFIFMSDFRK TFKSEHNGSL 200
                                                                          191
Lead-CeresClone-963031  VKDVAKQGGE KWKSLDEEEK KVYLDKAAEL KAEYNKXLES SNDADEEEAD
gi|21554154             AKDAAKIGGE KWKSLTEEEK KVYLDKAAEL KAEYNKSLES NDADEEEDE 243
                                                                          241
Lead-CeresClone-963031  DADEKQSDEA EEKXADDE-- ----EAKENE AEKKEAEGK- EEEDEILDDY
gi|21554154             EKQSDDVDDA EEKQVDDDDE VEEKEVENTD DDKKEAEGKE EEEEILDDY
```

Figure 69

```
CeresClone:1887966      ---------   ---------   ---------   MAAASSAP    FFGLGDTQMQ   PPQGPS LQQN   SAAAA PGAA    37
Lead-CeresClone:9804    MSSSSYNTSV  IPSSSSSAQP  ---------   ---------   FFITSSGTGD   NDFNRKDTFM   SMI QQPNSS    49
CeresClone:1832094      ---------   ---------   ---------   ---------   ---------    -----MMQEQ   SSI AT PT SST 15

CeresClone:1887966      ---AAPPKKK  RNQPGNPNPD  AEVIALSPRT  LLATNRFVCE   VCNKGFQREQ               84
Lead-CeresClone:9804    ---APPPKKR  RNQPGNPNPD  AEVVALSPKT  MATNRFICD    VCNKGFQREQ               96
CeresClone:1832094      APTTAPQKRK  RNHPGTSYPD  AEVIALSPKT  LMATNRFICE   VCNKGFQREQ               65

CeresClone:1887966      NLQLHRRGHN  LPWKLKQKNP  KEARRVYLC   PEPTCVHHDP   SRALGDLTGD                134
Lead-CeresClone:9804    NLQLHRRGHN  LPWKLKQKST  KEVKRKVYLC  PEPTCVHHDP   SRALGDLTGI                146
CeresClone:1832094      NLQLHRRGHN  LPWKLTQKTT  KEVKRKVYLC  PEPTCVHHDP   SKALGDLTGI                115

CeresClone:1887966      XKHYCRKH    ---------   ---------   ---------    RCDCGTI FSR               142
Lead-CeresClone:9804    KKHYYRKHGE  KKWKCEKCSK  RYAVQSDWKA  HSKTCGTKEY    RCDCGTLFSR                196
CeresClone:1832094      KKHYSRKHGE  KKWKCEKCSK  RYAVQSDWKA  HSKTCGTREY   ----------                165

CeresClone:1887966      ---------   ---------   ---------       142
Lead-CeresClone:9804    FPFLRNSSSF  VDPLLISFSL  YVCLYIRT       224
CeresClone:1832094      ---------   ---------   ---------       165
```

Figure 70

```
gi|9294812              ----MGKSLF QESLKALEAD QYANTLALG  HPRDKEGGCF QMRLSYSPVA   46
CeresClone:1555943      ----MRKAY  RDSIKVLEAD QHANTLASE  FPRDYDGACL QMRLSYSPAA   45
CeresClone:467336       MYVASMRKSF KDSLKVLEAD QHANTLASD  FPREYDGACL QMRMSYSPAA   50
gi|90399248             MVLCSMRKSF KDSLKVLEAD QHANTLASD  FSRDYDGACL QMRMSYSPAA   50
CeresClone:1827510      ----MRKSSF KDSLKALEAD HHANTLAAD  FSRDYDGACL QMRLSYSPAA   46
Lead-CeresClone-99033   ----MAKLSF KDSLKALEAD QHANTLALD  YPREKDGARV QMRLSYSPTA   46
CeresClone:1840223      ----MGKLSF KDSLKALEAD QHANTLAFD  YPREKDGARL QMRLSYSPAA   46
CeresAnnot:1514944      ----MGKLSF KDSLKALEAD QHANTLALD  HPRENDGARL QMRLSYSPAA   46 gi|9294812              PLFLSLVQWT DYRLAGALGL LRILIYMTYG NGKTTISLYE RKASIRQFYS   96
CeresClone:1555943      HIFLFLVQWT DCSLAGALGL LRILIYKVYV DGTTTMSTHE RKASIKEFYA   95
CeresClone:467336       HLFLFLVQWT DCHLAGALGL LRILIYKVYV DGTTTMSTHE RKASIREFYA  100
gi|90399248             QFFLFLVQWT DCSLAGALGL LRILIYKVYV DGSTTMSTHE RKASIREFYA  100
CeresClone:1827510      HFFLFLVQWT DCSLAGALGL LRILIYKVYV DGSTTLSTHE RKASIREFYA   96
Lead-CeresClone-99033   QFFLFLVQWT DCKLAGFLGL LRVLIYMTYA DGKTTMSVYE RKASIREFQA   96
CeresClone:1840223      QFFLFLVQWT DCQLAGALGL LRILIYMTYA DGKTTMSVYE RKASIREFYA   96
CeresAnnot:1514944      QFFLFLVQWT DCNLAGALGL LRILIYLTYA DGKTTMSVQE RKASIREFYA   96 gi|9294812              IIFPALLQLQ KGVTDLEERK QKEVYANRYQ KKIDFKDRRE -SKIDIEREK  145
CeresClone:1555943      VIFPSLLQLQ RGITDVEDKK QKAICMEKYR KKDEDGRDTL -SDIDVEREE  144
CeresClone:467336       VIYPSLLQLE KGVTDEDKK  QKAVCMERYR RRDDEEYRQS -SDIDIEREED 149
gi|90399248             VIFPSLMQLH KGISDVDDRR QKAICTERYR RRDEDESKRH VSEIDVEREE  150
CeresClone:1827510      VIFPSLMQLP KGISDLDDRR QKAVCTERYR RRDQDESKRP VSEIDVEREE  146
Lead-CeresClone-99033   VIPSLSQLQ  RGVTDIDDSK QKEVCKMRYR KKDESEM--- -SEIEIEREE  142
CeresClone:1840223      VIFPSLLQLQ KGITSLEDRK QKEVCTMRYR KKDESERGKL -SDLEREE   145
CeresAnnot:1514944      VIFPSLLQLQ GGITDVDDRK QKEVCTMRYR RKDELEKGKL -SEVDIEREE  145
```

Figure 70 (continued)

```
gi|9294812          ECGVCLEVKA KVVLPNCCHQ MCFKCYREWC LRSQSCPFCR DSLKRVNSGD   195
CeresClone:1555943  ECGICMEMNS KVVLPNCTHA MCIRCYQDWS SRSQSCPFCR DNLKKTCPGD   194
CeresClone:467336   ECGICMDMNS KIVLPNCNHA MCLKCYREWR TISQSCPFCR DSLKRVNSGD   199
gi|90399248         ECGICMEMNN KVVLPNCSHA MCMKCYRQWR SRSQSCPFCR DSLKRVNSGD   200
CeresClone:1827510  ECGICMEMNS KVVLPTCSHA MCIKCYRQWR SRSQSCPFCR DSLKRVNSGD   196
Lead-CeresClone:99033 ECGICMEMNS KVVLPNCTHS LCIKCYRDWR GRSQSCPFCR DSLKRVDSGD 192
CeresClone:1840223  ECGICLEMSS MVVLPNCSHS LCLKCYRDWH GRSQSCPFCR DSLKRVNSGD   195
CeresAnnot:1514944  ECGICMEMNN KVVLPTCSHS LCLRCYRDWR GRSQSCPFCR GSLKRVNSGD   195 gi|9294812          LWIYTDTSDI VDVGTIFKEN CKLFLYIEK  PLIIPDPRH  --VSYDPFFR   243
CeresClone:1555943  LWIYVEDQDV VDMETVSSEN LRRLFMYISK PLIVPDMLF  -SVYDSHIK    242
CeresClone:467336   LWVFTDRRDV VDMATVTREN LRRLFMYIDK PLIVPDSLF  -DTYDSHIR    247
gi|90399248         LWMLTDDRDV IDMATIREN  LRRLFMYIEK PLVAPDNIF  --YAYDSHVK   248
CeresClone:1827510  LWMFTDCRDV VDMATVSREN LRRLFMYIEK PLVMPENIF  --YAYDSHVK   244
Lead-CeresClone:99033 LWMFLDQNDT VNLTAIFKEN QKRLFMYIEK PLVVPDQVY  ASSPYDFHVR 242
CeresClone:1840223  LWIYTEKSEI VDLSLILREN SNRLFMYIDK PLIVPDPVF  --VPYDVHVR   243
CeresAnnot:1514944  LWIYAEKSDV VDLALITRQN CKRLFMYIDK PLIIPDTVY  --MPYDSHVK   243 gi|9294812          -------               243
CeresClone:1555943  -------               242
CeresClone:467336   -------               247
gi|90399248         FLVVGCG               255
CeresClone:1827510  -------               244
Lead-CeresClone:99033 -------             242
CeresClone:1840223  -------               243
CeresAnnot:1514944  -------               243
```

Figure 71

| | | | | | | |
|---|---|---|---|---|---|---|
|CeresClone:118878|MASKALI LLG|LFSVLL VVSE|VSAARX SGMV|KPESEETVQP|EGYGGGHGGH|50|
|CeresClone:12459|MASKALI LLG|LFAI LL VVSE|VSAARQSGMV|KPESEETVQP|EGYHGGHGGH|50|
|CeresClone:1354021|MASKALI LLG|LFAI LL VVSE|VSAARQSGMV|KPESEATVQP|EGYHGGHGGH|50|
|CeresClone:24667|MASKALI LLG|LFSVLL VVSE|VSAARQSGMV|KPESEETVQP|EGYGGGHGGH|50|
|Lead-cDNA-ID233389966|MASKALI LLG|LFSVLL VVSE|VSAARX SGMV|KPESEETVQP|EGYGGGHGGH|50|
|gi|20197615|MASKALI LLG|LFSVLL VVSE|VSAARQSGMV|KPESEETVQP|EGYGGGHGGH|50|
|CeresClone:18215|MASKALI LLG|LFSVLL VVSE|VSSARQSGMV|KPESEETVQP|EGYGGGHGGH|50|
|CeresClone:105261|MASKALI LLG|LFSVLL VVSE|VSSARQSGMV|KPESEETVQP|EGYGGGHGGH|50|

| | | | | | | |
|---|---|---|---|---|---|---|
|CeresClone:118878|GGHG----|HGHGGHNGGG|GHGLDGYXGG|-GGHYGGGGG|HYGG------|91|
|CeresClone:12459|GGGHY GGG|HGHGGHNGGG|GHGLDGYGGG|HGGHYGGGGG|HYGG------|98|
|CeresClone:1354021|GGGHY GGG|HGHGGHNGGG|GHGLDGYGGG|HGGHYGGGGG|HYGGGGH---|98|
|CeresClone:24667|GGHG----|HGHGGHYGGG|GI----GH GGG|-CCHYGGGGG|GHCC-GGHYG|93|
|Lead-cDNA-ID233389966|GGHG----|HGHGGHNGGG|GHGLDGYGGG|-GGHYGGGGG|TYGG------|91|
|gi|20197615|GGHG----|HGHGGHNGGG|GHGLDGYGGG|-GGHYGGGGG|HYGGGGHYG|97|
|CeresClone:18215|GGHG----|HGHGGHNGGG|GHGLDGYGGG|-GGHYGGGGG|HYGG------|91|
|CeresClone:105261|GGHG----|HGHGGHNGGG|GHGLDGYGGG|-GGHYGGGGG|HYGGGGHYG|97|

| | | | | |
|---|---|---|---|---|
|CeresClone:118878|-GGGGY GGGG|GHHGRAESTP|LKPLSYQFLR||120|
|CeresClone:12459|-GGGGHY GGG|GHHGGGGHGL|NEPVQTKPGV||127|
|CeresClone:1354021|-GGGGHY GGG|GHHGGGGHGL|NEPVQTKPGV||127|
|CeresClone:24667|-GGGGY GGGG|GHYGGGGHGL|NEPVQTKPGV||123|
|Lead-cDNA-ID233389966|-GGGY GGGG|GHHGGGGHGL|NEPVQTKPGV||120|
|gi|20197615|-GGGHY GGG|GHHGGGGHGL|NEPVQTKPGV||127|
|CeresClone:18215|-GGGGY GGGG|GHHGGGGHGL|NEPVQTKPGV||120|
|CeresClone:105261|-GGGGY GGGG|GHHGGGGHGL|NEPVQTKPGV||127|

Figure 72

| | | | | | | | |
|---|---|---|---|---|---|---|---|
| CeresClone:1561415 | MGLSFGKLFS | RLFAKKEMRI | LMVGLDAAGK | TTI LYKLKLG | EI VTTI PTI G | 50 |
| CeresClone:380874 | | | MVGLDAAGK | TTI LYKLKLG | EI VTTI PTI G | 33 |
| CeresClone:416460 | MGLTFT KLFS | RLFAKKEMRI | LMVGLDAAGK | TTI LYKLKLG | EI VTTI PTI G | 50 |
| CeresClone:631823 | MGLTFT KLFS | RLFAKKEMRI | LMVGLDAAGK | TTI LYKLKLG | EI VTTI PTI G | 50 |
| CeresClone:1535974 | | MRI | LMVGLDAAGK | TTI LYKLKLG | EI VTTI PTI G | 33 |
| CeresClone:1428788 | MGLAFGKLFS | RLFAKKEMRI | LMVGLDAAGK | TTI LYKLKLG | EI VTTI PTI G | 50 |
| CeresClone:738726 | MGLTFT KLFS | RLFAKKEMRI | LMVGLDAAGK | TTI LYKLKLG | EI VTTI PTI G | 50 |
| CeresClone:276776 | | MRI | LMVGLDAAGK | TTI LYKLKLG | EI VTTI PTI G | 33 |
| CeresClone:240510 | | MRI | LMVGLDAAGK | TTI LYKLKLG | EI VTTI PTI G | 33 |
| CeresClone:529239 | | MRI | LMVGLDAAGK | TTI LYKLKLG | EI VTTI PTI G | 33 |
| Lead-CeresClone14909 | MGLSFGKLFS | KLFAKKEMRI | LMVGLDAAGK | TTI LYKLKLG | EI VTTI PTI G | 50 |

| | | | | | | | |
|---|---|---|---|---|---|---|---|
| CeresClone:1561415 | FNVETVEYKN | SFTVWDVGG | QDKI RPLWRH | YFQNTQGLI F | VVDSNDRERV | 100 |
| CeresClone:380874 | FNVETVEYKN | SFTVWDVGG | QDKI RPLWRH | YFQNTQGLI F | VVDSNDRDRV | 83 |
| CeresClone:416460 | FNVETVEYKN | SFTVWDVGG | QDKI RPLWRH | YFQNTQGLI F | VVDSNDRDRV | 100 |
| CeresClone:631823 | FNVETVEYKN | SFTVWDVGG | QDKI RPLWRH | YFQNTQGLI F | VVDSNDRDRV | 100 |
| CeresClone:1535974 | FNVETVEYKN | SFTVWDVGG | QDKI RPLWRH | YFQNTQGLI F | VVDSNDRDRV | 83 |
| CeresClone:1428788 | FNVETVEYKN | SFTVWDVGG | QDKI RPLWRH | YFQNTQGLI F | VVDSNDRDRV | 100 |
| CeresClone:738726 | FNVETVEYKN | SFTVWDVGG | QDKI RPLWRH | YFQNTQGLI F | VVDSNDRERV | 100 |
| CeresClone:276776 | FNVETVEYKN | SFTVWDVGG | QDKI RPLWRH | YFQNTQGLI F | VVDSNDRDRV | 83 |
| CeresClone:240510 | FNVETVEYKN | SFTVWDVGG | QDKI RPLWRH | YFQNTQGLI F | VVDSNDRDRV | 83 |
| CeresClone:529239 | FNVETVEYKN | SFTVWDVGG | QDKI RPLWRH | YFQXTQGLI F | VVDSNDRDRV | 83 |
| Lead-CeresClone14909 | FNVETVEYKN | SFTVWDVGG | QDKI RPLWRH | YFQNTQGLI F | VVDSNDRDRV | 100 |

Figure 72 (continued)

| | | | | | | |
|---|---|---|---|---|---|---|
| CeresClone:1561415 | VEARDELHRM | LNEDELRAPM | LVFPNNQDL | PNAMNAPEIT | ANLGLHSLRQ | 150 |
| CeresClone:380874 | VEAKDELHRM | LNEDELRDAV | LLVFANKQDL | PNAMNAAEIT | DKLGLHSLRQ | 133 |
| CeresClone:416460 | VEARDELHRM | LNEDELRDAV | LLVFANKQDL | PNAMNAAEIT | DKLGLHSLRQ | 150 |
| CeresClone:631823 | VEARDELHRM | LNEDELRDAV | LLVFANKQDL | PNAMNAAEIT | DKLGLHSLRQ | 150 |
| CeresClone:1535974 | VEARDELHRM | LNEDELRDAV | LLVFANKQDL | PNAMNAAEIT | DKLGLHSLRQ | 133 |
| CeresClone:1428788 | VEARDELHRM | LNEDELRDAV | LLVFANKQDL | PNAMNAAEIT | DKLGLHSLRQ | 150 |
| CeresClone:738726 | VEARDELHRM | LNEDELRDAV | LLVFANKQDL | PNAMNAAEIT | DKLGLHSLRQ | 150 |
| CeresClone:276776 | VEARDELHRM | LNEDELRDAV | LLVFANKQDL | PNAMNAAEIT | DKLGLHSLRQ | 133 |
| CeresClone:240510 | VEARDELHRM | LNEDELRDAV | LLVFANXQDL | PNAMNAAEIT | DKLGLHSLRQ | 133 |
| CeresClone:529239 | VEARDELHRM | LNEDELRDAV | LLVFANKQDL | PNAMNAAEIT | DKLGLHSLRQ | 133 |
| Lead-CeresClone14909 | VEARDELHRM | LNEDELRDAV | LLVFANKQDL | PNAMNAAEIT | DKLGLHSLRQ | 150 |

| | | | | | |
|---|---|---|---|---|---|
| CeresClone:1561415 | RHWSQSPCA | PSGEGLYEGL | DWLSTNISTK | S | 181 |
| CeresClone:380874 | RHWYIQSTCA | TGEGLYEGL | DWLSNNIANK | A | 164 |
| CeresClone:416460 | RHWYIQSTCA | TTGEGLYEGL | DWLSSNIASK | P | 181 |
| CeresClone:631823 | RHWYIQSTCA | TTGEGLYEGL | DWLSSNIASK | A | 181 |
| CeresClone:1535974 | RHWYIQSTCA | TGEGLYEGL | DWLSSNIASK | A | 164 |
| CeresClone:1428788 | RHWYIQSTCA | TTGEGLYEGL | DWLSNNIANK | A | 181 |
| CeresClone:738726 | RHWYIQSTCA | TSGEGLYEGL | DWLSNNIANK | S | 181 |
| CeresClone:276776 | RHWYIQSTCA | TSGEGLYEGL | DWLSNNIANK | S | 164 |
| CeresClone:240510 | RHWYIQSTCA | TSGEGLYEGL | DWLSNNIANK | A | 164 |
| CeresClone:529239 | RHWYIQSTCA | TSGEGLYEGL | DWLSNNIANK | A | 164 |
| Lead-CeresClone14909 | RHWYIQSTCA | TSGEGLYEGL | DWLSNNIANK | A | 181 |

Figure 73

```
                                                                                            50
gi|50919203         MHRSAGATMA  WNVFRFCTAL  RGLGSI MI LL  VLSI VGVTYY  AVVVM NYGPA  50
CeresClone:230342   MYRSAGVAMA  WNVFRFCTAL  RGLGSI MI LL  VLA  VGVTYY  AVVL CNYGPA  49
CeresClone:537080   MYRS- GAGMA WNVFRFCTAL  RGLGSI MI LM  VLGVVGVTYY  AVVLTNFGPA   49
Lead-CeresClone19340 MHRS- GTTMA WNVFKFCTAL  RGLGSI MI LL  VLGVVGVTYY  AVVLTNYGPP  49
CeresClone:573293   MHRS- GATMA WNVFKFCTAL  RGLGSI MI LL  VLGVVGA YY   AVVLTNYGPA  49

100
gi|50919203         LFAGGASTLL  ALVLLLFHF   LLVMLLWSYF   SVVFTDPGSV   PPNWNLDFDE   100
CeresClone:230342   LFTCGGTTLA  ALAVLLSF HF LLAMLLWSYF   SVVFTDPGSV   PPNWNLDFDV   100
CeresClone:537080   LFLGGLDTLI  SFVVLI LFHC LLVMLLWCYF   AVVFMDPGTV   PPNWKPAADE    99
Lead-CeresClone19340 SQGGLDSLA  ALTI   LFHF LLAMLLWSYF   SVVFTDPGV    PPNWRPST DE   99
CeresClone:573293   YAGGLDSLV   ALAVLI LFHS LLVMLLWSYF   SVVFTDPGSV   PPNWKPTI DE   99

150
gi|50919203         ERGETAPLSG  LDFNSQVNSQ  QSI AHNDTGH  PRARYCRKCN  QMKPPRCHHC   150
CeresClone:230342   EMGETAPLAS  SE CSQMNSQ  QSVALGNMT N  PRVRYCRKCN  QLKPPRCHHC   150
CeresClone:537080   ERGEVDPLNG  VELSNLQSDP  ------AN    QREFRYCRKCS QPKPPRCHHC   141
Lead-CeresClone19340 ERGESDPLNS LDFVGLQSDS  S ------- N PRVRFCRKCN  QLKPSRCHHC   143
CeresClone:573293   ERGEADPLVG  TEFSNLPSDP  ------- N   PRVRYCRKCN  QLKPPRCHHC   140

200
gi|50919203         SVCGRCVLKM  DHHCVWVVNC  VGALNYKYFL  LFLFYTFLET  TLVTLSLLPH  200
CeresClone:230342   SVCGRCVLKM  DHHCVWVVNC  VGALNYKYFL  LFLFYTFLET  TLVTLSLLPH  200
CeresClone:537080   SVCGRCVLKM  DHHCVWVVNC  VGALNYKYFL  LFLFYV FLET TLVTI SLLPH  191
Lead-CeresClone19340 SVCGRCVLKM DHHCVWVVNC VGALNYKYFL  LFLFYTFLET  TLVTLV MPH  193
CeresClone:573293   SVCGRCVLKM  DHHCVWVVNC  VGALNYKYFL  LFLFYTFLET  TLVTA SLLPH  190
```

Figure 73 (continued)

| | | | | | | | |
|---|---|---|---|---|---|---|---|
| gi\|50919203 | FI AFFSDI DI | PGSPAALATT | FLTFVLNLAF | SLSVLGFMI M | HVSLVSANTT | 250 |
| CeresClone:230342 | FI AFFSDAEI | PGSPAALATT | FLTFVLNLAF | SLSVLGFMI M | HI SLVSANTT | 250 |
| CeresClone:537080 | FKTYFSDGEI | PGTPGTLATT | FLTFVLNLAF | SLSVLGFLVL | HVSLVASNTT | 241 |
| Lead-CeresClone19340 | FI AFFSDEEI | PGTPGTLATT | FLAFVLNLAF | ALSVMGFLI M | HI SLVAGNTT | 243 |
| CeresClone:573293 | FI AFFSDGEI | PGTPGSLATT | FLAFVLNLAF | ALSVLGFLI M | HI SLVAANTT | 240 |

| | | | | | | |
|---|---|---|---|---|---|---|
| gi\|50919203 | TI EAYEKKTT | PRWMYDI GRK | RNFI QVFGND | KRYWFI PAYS | EEDLRRMPVL | 300 |
| CeresClone:230342 | TI EAYEKKTT | PHMLYDLGRK | RNFAQVFGND | RKYWFI PAYS | EEDLRRTPAL | 300 |
| CeresClone:537080 | TI EAYEKKTT | SKWRYDLGRR | KNFEQVFGMD | KRYWFI PAYS | EEDI RRMPVL | 291 |
| Lead-CeresClone19340 | TI EAYEKKTT | TKWRYDLGKK | KNFEQVFGMD | KRYWLPGYT | EEDLRRMPEL | 293 |
| CeresClone:573293 | TI EAYEKKTT | PKWRYDLGRR | KNFEQVFGMD | KKYWFI PAYS | DEDI RKMPAL | 290 |

| | | |
|---|---|---|
| gi\|50919203 | QGLDYPVRTD | LDGQEL | 316 |
| CeresClone:230342 | QGLDYPVRPD | FDGQEL | 316 |
| CeresClone:537080 | QGLEYPSTPD | FNAQEF | 307 |
| Lead-CeresClone19340 | QGLEYPSKPD | FDSQ-- | 307 |
| CeresClone:573293 | QGLDYPSKPD | FDSQ-- | 304 |

FIGURE 74

| | | | | | | |
|---|---|---|---|---|---|---|
| SEQ:ID:NO:2018-CLONE:824827 | MEPL----S60 | PELPVGVATA | GSQAYPPP-- | ---------- | AYPAPAMPA | A-IPPGSQP | 42 |
| SEQ:ID:NO:2015-CLONE:245683 | MDPNKSSTPP | PPPVMG---- | APVAYPPP-- | ---------- | AYPPG---V | A---AGAGAYP | 38 |
| SEQ:ID:NO:2016-CLONE:1283552 | MDPNKSSTPP | PPPVMG---- | APIAYPPP-- | ---------- | AYPPG---V | A---AGAGAYP | 38 |
| SEQ:ID:NO:2017-CLONE:272426 | MEPL-KSTTPP | PPPVMG---- | APIAYPPPPG | ---------- | AYPAGPYVH | A---PAAALYP | 43 |
| SEQ:ID:NO:2012-CLONE:659723 | METNQQQQQ | ---------- | GAQAQSGP-- | ---------- | YPVAGAGG | S-AGAGAGA | 35 |
| SEQ:ID:NO:2014-CLONE:1585988 | MDN---QPL | ---------- | YSTGQPPA-- | ---------- | -PGGAPV | AGMPGAAGLP | 31 |
| SEQ:ID:NO:1249-CDNA-2338311 | MDTNQQPPP | ---------- | SAAGIPPP- | ---------- | -PGTTIS | A---AGGGA | 31 |
| SEQ:ID:NO:2013-CLONE:953644 | MDNNQQPPP | PPTSVYPPAS | AATAIPPP- | ---------- | -PPSGSTPL | I---PGGGG | 42 |
| | | | | | | |
| SEQ:ID:NO:2018-CLONE:824827 | AVPFPANPAQ | LSAQHQLVYQ | QAQQQFHQQLQ | QQQQQQLREF | WATQMEEIEQ | 92 |
| SEQ:ID:NO:2015-CLONE:245683 | PQLYAPPAAA | AA-------- | ----QQAA | AAQQQQLQIF | WAEQYREIEA | 74 |
| SEQ:ID:NO:2016-CLONE:1283552 | PQLYAPPAAA | AA-------- | ----QQAA | AAQQQQLQIF | WAEQYREIEA | 74 |
| SEQ:ID:NO:2017-CLONE:272426 | PPPLPPAPPS | SQ-------- | ----QGAA | AAHQQQL--F | WAEQYREIEA | 77 |
| SEQ:ID:NO:2012-CLONE:659723 | PPPF------ | ---------- | ----QHLL | QQQQQAQLQMF | WSYQRQEIEH | 63 |
| SEQ:ID:NO:2014-CLONE:1585988 | PVPH------ | ---------- | ----HHLL | QQQQQAQLQAF | WAYQRQEAER | 59 |
| SEQ:ID:NO:1249-CDNA-2338311 | --SY------ | ---------- | ----HHLL | QQQQQLQQLF | WTYQRQEIEQ | 57 |
| SEQ:ID:NO:2013-CLONE:953644 | -ASY------ | ---------- | ---------- | QQQLQQLQMF | WSYQRKEIEQ | 69 |
| | | | | | | |
| SEQ:ID:NO:2018-CLONE:824827 | ---ATDFKNHT | LPLARIKKIM | KADEDVRMIS | AEAPVVFAKA | CEVFILELTL | 140 |
| SEQ:ID:NO:2015-CLONE:245683 | ---TTDFKNHH | LPLARIKKIM | KADEDVRMIA | AEAPVVFARA | CEMFILELTH | 122 |
| SEQ:ID:NO:2016-CLONE:1283552 | ---TTDFKNHH | LPLARIKKIM | KADEDVRMIA | AEAPVVFARA | CEMFILELTH | 122 |
| SEQ:ID:NO:2017-CLONE:272426 | ---TTDFKNHH | LPLARIKKIM | KADEDVRMIA | AEAPVVFSRA | CEMFILELTH | 125 |
| SEQ:ID:NO:2012-CLONE:659723 | ---VNDFKNHQ | LPLARIKKIM | KADEDVRMIS | AEAPILFAKA | CELFILELTI | 111 |
| SEQ:ID:NO:2014-CLONE:1585988 | ASASDFKNHQ | LPLARIKKIM | KADEDVRMIS | AEAPVLFAKA | CELFILELTI | 109 |
| SEQ:ID:NO:1249-CDNA-2338311 | ---VNDFKNHQ | LPLARIKKIM | KADEDVRMIS | AEAPILFAKA | CELFILELTI | 105 |
| SEQ:ID:NO:2013-CLONE:953644 | ---VNDFKNHQ | LPLARIKKIM | KADEDVRMIS | AEAPILFAKA | CELFILELTI | 117 |
| | | | | | | |
| SEQ:ID:NO:2018-CLONE:824827 | RSWMHTEENK | RRTLQKNDIA | AAITRTDIYD | FLVDIPRDD | MKEEGLGLPR | 190 |
| SEQ:ID:NO:2015-CLONE:245683 | RGMAHAEENK | RRTLQKSDIA | AAIARTEVFD | FLVDIVPRDD | GKDA------ | 166 |
| SEQ:ID:NO:2016-CLONE:1283552 | RGMAHAEENK | RRTLQKSDIA | AAIARTEVFD | FLVDIVPRDD | GKDA------ | 166 |
| SEQ:ID:NO:2017-CLONE:272426 | RGMAHAEENK | RRTLQKSDIA | AAVARTEVFD | FLVDIVPRDE | GKDA------ | 169 |
| SEQ:ID:NO:2012-CLONE:659723 | RSWLHAEENK | RRTLQKNDIA | AAIARTRTDIFD | FLVDIVPRDE | AKDA------ | 155 |
| SEQ:ID:NO:2014-CLONE:1585988 | RSWLHAEENK | RRTLQRNDVA | AAIARTDVFD | FLVDIVPREE | AKEE------ | 153 |
| SEQ:ID:NO:1249-CDNA-2338311 | RSWLHAEENK | RRTLQKNDIA | AAITRTDIFD | FLVDIVPRDE | KDE------ | 149 |
| SEQ:ID:NO:2013-CLONE:953644 | RSWLHAEENK | RRTLQKNDIA | AAITRTDIFD | FLVDIVPREE | KEE------ | 161 |

FIGURE 74 (Continued)

| | | | | | |
|---|---|---|---|---|---|
| SEQ-ID-NO-2018-CLONE-824827 | VGLPPAALG- | --------- | --------- | AYPPYYYVPA | QQ-VPGVGMM | 222 |
| SEQ-ID-NO-2015-CLONE-245683 | -DAAAAA--- | ---------APA | --------A | AGIPR--PAA | GV-------- | 186 |
| SEQ-ID-NO-2016-CLONE-1283552 | -DAAAAA--- | ---------AAA | --------A | AGIPR--PAA | GV-------- | 186 |
| SEQ-ID-NO-2017-CLONE-272426 | -DSAAMG--- | ---------AAA | --------A | AGIPH--PAA | GL-------- | 186 |
| SEQ-ID-NO-2012-CLONE-659723 | ---------- | --XRQWG----- | --------D | LLLPAHWTAC | RDDDWPPRRR | 187 |
| SEQ-ID-NO-2014-CLONE-1585988 | -PGSALG--- | -FAAPGTGVV-- | GAGAPGGAPA | AGMPYYYPPM | GQPAGPGGMM | 190 |
| SEQ-ID-NO-1249-CDNA-23383311 | -AAVLGGG-- | MVVAPT------ | --------- | SGVPYYYPPM | GQ-------- | 183 |
| SEQ-ID-NO-2013-CLONE-953644 | -EEAALGS-- | MVAAPA------ | --------V | SGVPYYYPPM | GQPAVPGGMM | 195 |

| | | | | | |
|---|---|---|---|---|---|
| SEQ-ID-NO-2018-CLONE-824827 | YGGQQGHPVA | ---------- | YAMQQ---- | PQGQ------ | -QAE------ | 244 |
| SEQ-ID-NO-2015-CLONE-245683 | ---PATDPLA | ---------- | YYYVP---- | QQ-------- | ---------- | 200 |
| SEQ-ID-NO-2016-CLONE-1283552 | ---PATDPLA | ---------- | YYYVP---- | QQ-------- | ---------- | 200 |
| SEQ-ID-NO-2017-CLONE-272426 | ---PAADPMG | ---------- | YYYVQ---- | PQ-------- | ---------- | 200 |
| SEQ-ID-NO-2012-CLONE-659723 | SRHRGLCPAA | LPGMAVRXAV | RCRGRFLMHR | RGRC------ | ---------- | 224 |
| SEQ-ID-NO-2014-CLONE-1585988 | ---PAPMM-- | ---------- | PAMHV---- | PA--WDPAWQ | QGAADVDQSG | 218 |
| SEQ-ID-NO-1249-CDNA-23383311 | IGRPAMDPNG | ---------- | VYVQP---- | PSQAWQSVWQ | TSTG--TGD- | 215 |
| SEQ-ID-NO-2013-CLONE-953644 | IGRPAMDPSG | ---------- | VYYAQP--- | PXQAWQSVWQ | NSA----AGD | 226 |

| | | | |
|---|---|---|---|
| SEQ-ID-NO-2018-CLONE-824827 | EAPEEQQQSP | SN-------- | 256 |
| SEQ-ID-NO-2015-CLONE-245683 | ---------- | ---------- | 200 |
| SEQ-ID-NO-2016-CLONE-1283552 | ---------- | ---------- | 200 |
| SEQ-ID-NO-2017-CLONE-272426 | ---------- | ---------- | 200 |
| SEQ-ID-NO-2012-CLONE-659723 | ---------- | ---------- | 225 |
| SEQ-ID-NO-2014-CLONE-1585988 | P--------- | AGHGGAASFP | PAPPTSE--- | 245 |
| SEQ-ID-NO-1249-CDNA-23383311 | SFSEEGQGFG | -GQGNLDGQG | ---------- | 234 |
| SEQ-ID-NO-2013-CLONE-953644 | DVSYGSGGSS | GGHGNLDNQG | ---------- | 246 |

Figure 75

```
Lead-CeresClone29637   MAAVQQQQAM QKNTLYVGGL ADEVNESILH AAFIPFGDIK DVKTPLDQAN  50
gi|34896798            -----MNQPV QKNTLYVGGL AEEVDEKILH AAFVPFGEIK DVKTPLDQAT  45

Lead-CeresClone29637   QKHRSFGFVT FLEREDASAA MDNMDGAELY GRVLTVNYAL PEKIKGGEQG  100
gi|34896798            QKHRSFGFVT FLEREDAAAA MDNMDGAELF GRVLTVNYAF PERIKGGEQG   95

Lead-CeresClone29637   WAAHPLWADA DTWFERQQQE KEILKMQAEN KAAMETAEEL HRKKLAEDRQ  150
gi|34896798            WAAQPIWADA DTWFERQQQE EEMQRLQAEQ RAAMQAAEKL HREKLAAEKE  145

Lead-CeresClone29637   GEMEEDTDTK DDPMARAEAD ALSHGDA                        177
gi|34896798            GEKEEETDTN ADPMAAAEAQ ALKQSS-                        171
```

Figure 76

|  |  |  |  |  |  | 50 |
|---|---|---|---|---|---|---|
| CeresClone:276776 | MGLSFGKLFS | RLFAKKEMRI | LMVGLDAAGK | TTILYKLKLG | EIVTTIPTIG | 50 |
| CeresClone:240510 | MGLSFGKLFS | RLFAKKEMRI | LMVGLDAAGK | TTILYKLKLG | EIVTTIPTIG | 50 |
| CeresClone:1535974 | MGLAFGKLFS | RLFAKKEMRI | LMVGLDAAGK | TTILYKLKLG | EIVTTIPTIG | 50 |
| gi|39653273 | MGLTFTKLFS | KLFAKKEMRI | LMVGLDAAGK | TTILYKLKLG | EIVTTIPTIG | 50 |
| Lead-cDNA-ID23384563 | MGLSFGKLFS | RLFAKKEMRI | LMVGLDAAGK | TTILYKLKLG | EIVTTIPTIG | 50 |
| CeresClone:33126 | MGLSFAKLFS | RLFAKKEMRI | LMVGLDAAGK | TTILYKLKLG | EIVTTIPTIG | 50 |
| CeresClone:1338585 | MGLSFAKLFS | RLFAKKEMRI | LMVGLDAAGK | TTILYKLKLG | EIVTTIPTIG | 50 |

|  |  |  |  |  |  | 100 |
|---|---|---|---|---|---|---|
| CeresClone:276776 | FNVETVEYKN | SFTVWDVGG | QDKIRPLWRH | YFQNTQGLIF | VVDSNDRERV | 100 |
| CeresClone:240510 | FNVETVEYKN | SFTVWDVGG | QDKIRPLWRH | YFQNTQGLIF | VVDSNDRERV | 100 |
| CeresClone:1535974 | FNVETVEYKN | SFTVWDVGG | QDKIRPLWRH | YFQNTQGLIF | VVDSNDRDRV | 100 |
| gi|39653273 | FNVETVEYKN | SFTVWDVGG | QDKIRPLWRH | YFQNTQGLIF | VVDSNDRDRV | 100 |
| Lead-cDNA-ID23384563 | FNVETVEYKN | SFTVWDVGG | QDKIRPLWRH | YFQNTQGLIF | VVDSNDRDRV | 100 |
| CeresClone:33126 | FNVETVEYKN | SFTVWDVGG | QDKIRPLWRH | YFQNTQGLIF | VVDSNDRDRV | 100 |
| CeresClone:1338585 | FNVETVEYKN | SFTVWDVGG | QDKIRPLWRH | YFQNTQGLIF | VVDSNDRDRV | 100 |

|  |  |  |  |  |  | 150 |
|---|---|---|---|---|---|---|
| CeresClone:276776 | VEARDELHRM | NEDELRDAV | LVFANKQDL | PNAMNAAEIT | DKLGLHSLRQ | 150 |
| CeresClone:240510 | VEARDELHRM | NEDELRDAV | LVFANKQDL | PNAMNAAEIT | DKLGLHSLRQ | 150 |
| CeresClone:1535974 | VEARDELHRM | NEDELRDAV | LVFANKQDL | PNAMNAAEIT | DKLGLHSLRQ | 150 |
| gi|39653273 | VEARDELHRM | NEDELRDAV | LVFANKQDL | PNAMNAAEIT | DKLGLHSLRQ | 150 |
| Lead-cDNA-ID23384563 | VEARDELHRM | NEDELRDAV | LVFANKQDL | PNAMNAAEIT | DKLGLHSLRQ | 150 |
| CeresClone:33126 | VEARDELHRM | NEDELRDAV | LVFANKQDL | PNAMNAAEIT | DKLGLHSLRQ | 150 |
| CeresClone:1338585 | VEARDELHRM | NEDELRDAV | LVFANKQDL | PNAMNAAEIT | DKLGLHSLRQ | 150 |

Figure 76 (continued)

| | | | | |
|---|---|---|---|---|
| RHWYI QSTCA | TSGEGLYEGL | DWLSNNI ANK | S | 181 |
| RHWYI QSTCA | TSGEGLYEGL | DWLSNNI ANK | S | 181 |
| RHWYI QSTCA | TTGEGLYEGL | DWLSSNI ASK | A | 181 |
| RHWYI QSTCA | TSGEGLYEGL | DWLSNNI ANK | A | 181 |
| RHWYI QSTCA | TSGEGLYEGL | DWLSNNI ASK | A | 181 |
| RHWYI QSTCA | TSGEGLYEGL | DWLSNNI ASK | A | 181 |
| RHWYI QSTCA | TSGEGLYEGL | DWLSNNI AGK | A | 181 |
| RHWYI QSTCA | TSGEGLYEGL | DWLSNNI AGK | A | 181 |

CeresClone:276776
CeresClone:240510
CeresClone:1535974
CeresClone:14909
gi|39653273
Lead-cDNA-ID23384563
CeresClone:33126
CeresClone:1338585

Figure 77

```
CeresClone:331400      MDSA-SSLVD  ASAVVDAAAEP  G------AEADS  GSGAAAVSVG  RALAVFAAAS  GTPLERMGSG   46
CeresClone:705041      MDSARSCLVD  ASAVMDAPEP   G------AEADS  G-------RV  KASPSPAAPA  TKPLQRVGSG   40
gi|50932645            MDST-SCLLD  ASAVMDAAEP   G------AEADS  G-GERRGGGG  SKALQRVGSG              36
CeresClone:597624      MDAI-SCLDE  ASAVVDSDGG   GGGSTEVEAES  R-------    PNRLCRVGSG   49
gi|33320073            MEGT-SSLDQ  TSSVIDGEN   G------VEAES  R-------    PESLCRMGSG   37
Lead-CeresClone38311                                              -------    -MRLYRMGSG    9
CeresClone:19561       MDS---SCIDE  GSSVVLDPEN  G------LETES  R-------    AKKLSPPPAA  ALRLYRMGSG  41

CeresClone:331400      AQIYERHQRV  WLGTFAGEAD  AARAYDVAAQ  GKLPSSRYKG  VVPQPNGRWG   92
CeresClone:705041      AQIYERHQRV  WLGTFTGEAE  ARAYDAAQ   GRLPSSKYKG  VVPQPNGRWG   79
gi|50932645            AQIYERHQRV  WLGTFTGEAE  ARAYDVAAQ  GKLPSSKYKG  VVPQPNGRWG   81
CeresClone:597624      SQIYEKHQRV  WLGTFNEEDE  AARAYDVAAQ  -KLPSSKYKG  VVPQPNGRWG   89
gi|33320073            AQIYEKHQRV  WLGTFNEENE  AARAYDVAAQ  -KLPSSKYKG  VVPQPNGRWG   73
Lead-CeresClone38311   TSSVIDGEN   WLGTFNEEEE  AASYDIAVR   -KLPSSKYKG  VVPQPNGRWG   45
CeresClone:19561       GSSVVLDSEN  WLGTFNEQEE  AARSYDIAAC  -KLPSSKYKG  VVPQPNGRWG   77

CeresClone:331400      AQIYERHQRV  WLGTFAGEAD  AARAYDVAAQ  RFRGRDAVTN  FRPLADA-DP  141
CeresClone:705041      AQIYERHQRV  WLGTFTGEAE  ARAYDAAQ   RFRGRDAVTN  FRSLTES-DP  128
gi|50932645            AQIYERHQRV  WLGTFTGEAE  ARAYDVAAQ  RFRGRDAVTN  FRPLAES-DP  130
CeresClone:597624      SQIYEKHQRV  WLGTFNEEDE  AARAYDVAAQ  RFRGKDAVTN  FKPLSGT---D 137
gi|33320073            AQIYEKHQRV  WLGTFNEENE  AARAYDVAAQ  RFRGRDAVTN  FKPLLENQES  123
Lead-CeresClone38311                WLGTFNEEEE  AASYDIAVR   RFRGRDAVTN  FKSQVDG---   92
CeresClone:19561       AQIYEKHQRV  WLGTFNEQEE  AARSYDIAAC  RFRGRDAVN   FKNVLE----  123
```

Figure 77 (continued)

```
CeresClone:331400      DAAAEL RFLA   SRSKAEVVDM   LRKHTYFDEL   AQNKRAFAAA   SAATASSLAN   191
CeresClone:705041      EDAAEL RFLA   ARSKAEVVDM   LRKHTYPDEL   AQYKRAYFAA   AAASSPTSSS   178
gi|50932645            EAAVEL RFLA   SRSKAEVVDM   LRKHTYLEEL   TQNKRAFAAI   SPPPPKHPAS   180
CeresClone:597624      DDDGESEFLN    SHSKSEIVDM   LRKHTYNDEL   EQSKR----   SRGFVRRRGS   182
gi|33320073            DDDVEIAFLN    SHSKAEIVDM   LRKHTYIDEL   EQSKKLFGYT   KDGTMAKNKD   173
Lead-CeresClone38311   NDAESAFLD     AHSKAEIVDM   LRKHTYADEF   EQSRRKF---   ----VNGD    132
CeresClone:19561       --DGDLAFLE    AHSKAEIVDM   LRKHTYADEL   EQNNK-----   RQLFLSVDAN  166

CeresClone:331400      NPSSYASLSP    ATATAA--A    AAREHLFDKT   VTPSDVGKLN   RLVIPKQHAE   239
CeresClone:705041      VPPAS----SP   SSAASPSP-A   ARREHLFDKT   VTPSDVGKLN   RLVIPKQHAE   224
gi|50932645            SPTSS-----    ----------S  AAREHLFDKT   VTPSDVGKLN   RLVIPKQHAE   216
CeresClone:597624      AAGAG----NG   NSISGACV--M  KAREQLFQKA   VTPSDVGKLN   RLVIPKQHAE   228
gi|33320073            GLIDISSFFG    GGGTLDKVNN   KVREQLFEKA   VTPSDVGKLN   RLVIPKQHAE   223
Lead-CeresClone38311   GKRSG--LET    ATYGNDAV-L   RAREVLFEKT   VTPSDVGKLN   RLVIPKQHAE   179
CeresClone:19561       GKRNG-----S   STTQNDKV-L   KTREVLFEKA   VTPSDVGKLN   RLVIPKQHAE   211

CeresClone:331400      KHFPLQLPSA    ---------   -----GGESK   GVLLNLEDAA   GKVWRFRYSY   274
CeresClone:705041      KHFPLQLPSA    G--------   --AAVSGECK   GMLLNFDDSA   GKVWRFRYSY   263
gi|50932645            KHFPLQLPPP    TTTSSVAAAA   DAAAGGGDCK   GVLLNFEDAA   GKVWKFRYSY   266
CeresClone:597624      KHFPLQSAAN    GV-------   --SATAAAAK   GVLLNFEDVG   GKVWRFRYSY   268
gi|33320073            KHFPLQN---    ---------   ---GNNSK    GVLINFEDLN   GKVWRFRYSY   255
Lead-CeresClone38311   KHFPLSAMT     AM-------   --GMNPSPTK   GVLINLEDRT   GKVWRFRYSY   219
CeresClone:19561       KHFPLPSPS-    ---------   --PAVTK     GVLINFEDVN   GKVWRFRYSY   245
```

Figure 77 (continued)

```
CeresClone:331400       WNSSQSYVLT KGWSRFVKEK GLQAGDVVGF YRSAAGADTK LFIDCKLRPN  324
CeresClone:705041       WNSSQSYVLT KGWSRFVKEK GLHAGDAVGF YRS-ASGSNQ LFIDCKLRSK  312
gi|50932645             WNSSQSYVLT KGWSRFVKEK GLHAGDAVGF YRA-AGKNAQ LFIDCKVRAK  315
CeresClone:597624       WNSSQSYVLT KGWSRFVKEK NLKAGDTVCF QRS--TGPDRQ LYIDWKTRNV  317
gi|33320073             WNSSQSYVLT KGWSRFVKEK NLKAGDIVSF QRS--TSGDKQ LYIDFKARNM  304
Lead·CeresClone38311    WNSSQSYVLT KGWSRFVKEK NLRAGDVVCF ERS--TGPDRQ LYIHWKVRS-  267
CeresClone:19561        WNSSQSYVLT KGWSRFVKEK NLRAGDVVTF ERS--TGLERQ LYIDWKVRSG  294

CeresClone:331400       SVVAAST--- ----AGPSP RAPVAK---A APAT------  357
CeresClone:705041       TTTMTTT--- FVNAAAAPSP -APVMR----T APA-------  348
gi|50932645             PTTAAAAAAF LSAVAAAAAP -PPAVK----A AAA-------  354
CeresClone:597624       VNEVALF--- --------- -GPVVEPIQM LPGS------  347
gi|33320073             APTNPVV--- ---TNQVQAQV QVPRVQ---M PATINNVVD  346
Lead·CeresClone38311    ---------  ---------- SPVQT----V V---------  284
CeresClone:19561        PRE------- ---------- NPVQV-----V V---------  314

CeresClone:331400       AAAAPAEAVA VAGCKRARDL GS-------PP QAAFKKQLVE LALV  395
CeresClone:705041       PSHVPEHEDC SMVPKTSKRS MDANAAATPA HAVWKKKRCD FALT  392
gi|50932645             PELQDAGGAA MTKSKRAMDA MA--ESQA HVVFKKKQCLE LALT  394
CeresClone:597624       DSI-ANNNNAS GCCNGKRR-E ME--LFSL -ECSKKP-KI IGAL  384
gi|33320073             NNNNNNNMA NCSGGKRMME ME--LLTF ESCRKKQRVI IDAL  386
Lead·CeresClone38311    SNEKPNDVAV ECVGKKRSRE DD--LFSL -GCSKKQ-AI INLL  322
CeresClone:19561        TTVKPNDVVA VCGGKRSRDV DD--MFAL -RCSNKQ-AI LNAL  352
```

Figure 78

```
                                                                    25
                        MADTPTSRMV       ------SMYQP  LQQ-----EAYCL  46
CeresClone:475016       ---------- HPFGDVPRQT PKQFLYSGNP QHLCHP----- 44
CeresClone:1571937      MVEQTVVR-- ---EHIKAR- VMSLVRSAEP SSYRNPKLYT LNENGNNGV 28
Lead-cDNA-ID23365746    ---------- ---------- -MSFIRRADP SITYADNLY- -HKFGTPNSN
gi|34907424

66
CeresClone:475016       PQYRTLNPQL ---------Y YHDGGHGTQF STPSSSELYC TLESSSVALY 87
CeresClone:1571937      PQ-RRYTVRS Q--------S HSPNNAGSQD HETHKQYTLE SSAASGCSRH 94
Lead-cDNA-ID23365746    SSAQIFDPDR SKNPCLTDDS YPSQSYEKYF LDSPTDEFVQ HPIGSGASVS 63
gi|34907424             FAARRYASDT QLF------R YGPEPY---- ---NPENSFYN Q-----QASPMP 109
CeresClone:475016       NSPSTVSFSP -NGSPISQQD SQSYPPDQYH SPEI------NT YGSPMSGSC- 124
CeresClone:1571937      GSPSSQSVHA GSGSPVSHDD SHSGST---- ------NG HGSPVSASC- 144
Lead-cDNA-ID23365746    SFGSLDSFPY QSRPVLGCSM EFQLPLDSTS TSSTRLLGDY QAVSYSPSMD 108
gi|34907424             YMVIADGHSP SSADNSCSDV AKDSPLVSNV SQQ------NS QSISDNQSSE 151
CeresClone:475016       TDDLSSFNL KHKLRELESV MLGPDSDNLD SYDSAIS--- -NGNNF 165
CeresClone:1571937      VTGE-DPTDL KQKLKDLEAV MLGTSETDPE IVNSLEI--- -SAANQ 194
Lead-cDNA-ID23365746    VVEEFDDEQM RSKIQELERA LLGDEDDKMV GIDNLMEDS EWSYQNESEQ 158
gi|34907424             LEVEFDEDDI RMKLQELEHA LLDDSDDILY ELSQAGSIND EWADPMKNVI 193
CeresClone:475016       VPLEMDGWKQ TMVAIS---- ------SKNLKH LIACAKAIS DDDLMAQML 206
CeresClone:1571937      LSLEPEEWEH MVSMP----- ---RGNLKE LIACARAVE RYNTYAIDLM 244
Lead-cDNA-ID23365746    HQDSPKESSS ADSNSHVSSK EVVSQATPKQ LISCARALS EGKLEEALSM 205
gi|34907424             LPNSPKESES SISCAGSNNG E----PRTPKQ LLFDCAMALS DYNVDEAQAI
```

Figure 78 (continued)

```
CeresClone:475016      MDELRQMVSV SGDPFORLGA YMLEGLVARL AASGSSIYKS LRCKEPESAE  243
CeresClone:1571937     TELRKMVSV  SGEPLERLGA YMVEGLVARL AASGSSIYKA LKCKEPRSSD  256
Lead·cDNA·ID23365746   VNELRQIVSI  QGDPSQRIAA YMVEGLAARM AASGKFIYRA LKCKEPPSDE  294
gi|34907424            TDLRQMVSI  QGDPSQRIAA YLVEGLAARI VASGKGIYKA LSCKEPPTLY  255

CeresClone:475016      LLSYMHILYE VCPYFKFGYM SANGAIAEAM KDEDRVHIID FQIGQGSQWI  293
CeresClone:1571937     LLSYMHLYE  ACPYFKFGYM SANGAIAEAI KGEDRIHIID FHIAQGAQWV  306
Lead·cDNA·ID23365746   RLAAMQVLFE VCPCFKFGFL AANGAILEAI KGEEEVHIID FDINQGNQYM  344
gi|34907424            QLSAMQILFE CPCFRFGFM  AANFAILEAC KGEDRVHIID FDINQGSQYI  305

CeresClone:475016      TLIQAFAARP GGPPHIRITG DDSISAYAR  GGGLHIVGRR LSKLAEHFKV  343
CeresClone:1571937     SLLQALAARP GGPPFVRVTG DDSVSAYAR  GGGLELVGRR LTHIAGLYKV  356
Lead·cDNA·ID23365746   TLIRSIAELP GKRPRLTG   DDPESVQRS  IGGLRIIGLR EQLAEDNGV   394
gi|34907424            QLIQFLKNNA NKPRHLRITG VDDPETVQRT VGGLKVIGQR LEKLAEDCGI  355

CeresClone:475016      PFEFHAAAIS GCDVQLHNLG VRPGEALAVN FAFMLHHMPD ESVSTQNHRD  393
CeresClone:1571937     PFQFDALAIS GSEVEEEHLG VVPGEAVAVN FTLELHHIPD ETVSTANHRD  406
Lead·cDNA·ID23365746   SFKFKAMPSK TSIVSPSTLG CKPGEDILVN FAFQLHHMPD ESVTTVNQRD  444
gi|34907424            SFEFRAVGAN IGDVTPAMLD CPGEALMVN  FAFQLHHLPD ESVSTMNERD  405

CeresClone:475016      RLLRLVRSLS PKVVTLVEQE SNTNTAAFFP RFLETLDYYT AMFESIDVTL  443
CeresClone:1571937     RILRLVKGLS PKVLTLVEQE SNTNTAPFAQ RFAETLDYYT AIFESIDLAL  456
Lead·cDNA·ID23365746   ELLHMVKSLN PKLVTVVEQD VNTNTSPFFP RFIEAYEYYS AVFESLDMTL  494
gi|34907424            QLRMVKGLQ  PKLVTLVEQD ANTNTAPFQT RFREVYDYYA ALFDSLDATL  455
```

Figure 78 (continued)

```
CeresClone:475016      SREHKERINV  EQHCLARDLV  NIACEGVER  VERHEVLGKW  RSRFAMAGFT   493
CeresClone:1571937     PRDDRERINI  EQHCLAREIV  NLVACEGEER VERHEVFGKW  KARLMMAGFS   506
Lead-cDNA-ID23365746   PRESQERMNV  ERQCLARDIV  NIVACEGEER ERYEAGKW    RARMMMAGFN   544
gi|34907424            PRESPDRMNV  ERQCLAREIV  NILACEGPDR VERYEVAGKW  RARMTMAGFT   505

CeresClone:475016      PYPLSSLVNG  TIKKLLENY   SDRYRLQERD GAYLGWMNR   DLVASCAWK    541
CeresClone:1571937     PSPLSALVNA  TIKTLLQSY   SPDYKLAERD GVYLGWKNR   PLIVSSAWH    554
Lead-cDNA-ID23365746   PKPMSAKVTN  NQNLIKQQY   CNKYKLKEEM GELHFCWEEK  SLIVASAWR    593
gi|34907424            PCPFSSNMIS  GIRSLLKSY   CDRYKFEEDH GGLHFGWGEK  TLIVSSAWQ    553
```

Figure 79

```
gi|50929507           ----------  ----------  ----------  -MVGGEVMCE  AAA-------  -------PRYR   16
CeresClone:273307     ----------  ----------  ----------  -MRRRGVAAA  DAD-------  -GD-VELRFR    20
Lead-CeresClone124720 ----------  ----------  ----------  MRKGRGSSVV  GPA---LPVTA  GGSVKEPRYR   28
CeresClone:975672     FHQLQTHRSL  LNHITSGSPT  ----------  MRKGRGSSAV  PPA---LP--  -GGS-KEPRYR   44
gi|57012880           ----------  ----------  ----------  MRRGRAAAAP  APVTGEPNGS  GGS-KERFR-    29
gi|56384582           ----------  ----------  ----------  MGRGGATTAA  AAV--EPV--  -FF-KEPRYR    24
CeresClone:1044385    ----------  ----------  ----MVK---  EKKNVVVKNK  KPN-------  NNADETHFR     25
gi|55419650           ----------  ----------  ----MA----  PRSKPSPISP  NPD-------  -PNSKEIRYR    24 gi|50929507           GVRKRPWGRF  AAEIRDPAKR  ARVWLGTYDS  AEAAARAYDV  AARNLRGPLA                 66
CeresClone:273307     GVRKRPWGRY  AAEIRDPAKK  ARVWLGTFDS  AEDAARAYDA  AARMRGPKA                  70
Lead-CeresClone124720 GVRKRPWGRF  AAEIRDPLKK  SRVWLGTFDS  AVDAARAYDT  AARNLRGPKA                 78
CeresClone:975672     GVRKRPWGRF  AAEIRDPLKK  SRVWLGTFDS  AEAAARAYDA  AARNLRGPKA                 94
gi|57012880           GVRKRPWGRF  AAEIRDPWKK  ARVWLGTFDS  AEAAARAYDT  AARALRGPKA                 79
gi|56384582           GVRKRPWGRF  AAEIRDPGKK  TRVWLGTFDT  AEDAARAYDT  AARNLRGPKA                 74
CeresClone:1044385    GVRKRPWGRY  AAEIRDPRKK  TRVWLGTFDT  AEEAARAYDA  AARNFRGPKA                 75
gi|55419650           GVRKRPWGRY  AAEIRDPRKK  TRVWLGTFDT  AEEAARAYDA  KAREFRGAKA                 74 gi|50929507           RTNFPLVSSL  PLP-SPHYHL  PGKA------  ----------  -YPTATG---                 89
CeresClone:273307     RTNFPLPAA-  -AALHHP---  HMPAAAA---  ----------  -HRLYGG---                 106
Lead-CeresClone124720 KTNFPIDCSP  SSPLQPLTYL  HNQNLCSPPV  IQNQIDPFMD  GGNFQ-----                 128
CeresClone:975672     KTNFQIDCSP  SSPLQPLHR-  YAHHHQ----  -NQIDPFMD   HRLYGG----                 128
gi|57012880           KTNFPLP---  -QPFYQN---  FNQGHN----  -PNNDPFFVD  SRFYP-----                 111
gi|56384582           KTNFPLA---  -DNNNN----  P---------  -EAGNPFGE   LRFYAGG---                 103
CeresClone:1044385    KTNFPVPPD-  -DNNAND---  VNVNKNKSVN  VKSHSPS---  ----------                 107
gi|55419650           KTNFA-----  ----------  F---------  -TRSPS---  ----------                  91
``` gi|50929507
CeresClone:273307
Lead-CeresClone124720
CeresClone:975672
gi|57012880
gi|56384582
CeresClone:1044385
gi|55419650

Figure 79 (continued)

```
gi|50929507         -AAAAPPVAG  PACSAL-SSTV  ESSSGPRG---  ----------  ---PRPAATAA  123
CeresClone:273307   -VVSTPPVAR  PACSSLSSTV   ESFSGARP---  ----------  ---RPVLPP-   139
Lead-CeresClone124720  EQQQQI-SR  PASSSMSSTV   KSCSGPRP---  ----------  --MEAAAASS   164
CeresClone:975672   EQEVL-SR    PASSSMSSTV   KSCSGVRP---  ----------  --ASSSVAKA   163
gi|57012880         -QDNPL-SQR  PTSSSMSSTV   ESFSGPRP---  ----------  --PPAPRQQT   146
gi|56384582         AGEGFQDHRR  PTSSGMSSTV   ESFGCPRP---  ----------  --VRPPMPPS   139
CeresClone:1044385  -QSSTVESAT  PEREATRRS    SAAIDRFPFL   PIQQQILMTH   PVAAPMRPVF   156
gi|55419650         -QSSTVESSS  P--PPLDLTL   ASPCSSLP---  ----------  ---VTAQRPVY  124 gi|50929507         AV------PRR  RVPRPAPPAP   DAGCHSDCAS-  SASVVD----  ----DADD-   158
CeresClone:273307   ----------   RFPP--PSTP   DGDCRSDCGS   SASVVD----  ----DDCTDA  169
Lead-CeresClone124720  SVAKPLHA-K  RYPRT-PPVA   PEDCHSDCDS   SSSVID----  ----DGDD-   203
CeresClone:975672   ----ATK    RYPRT-PPVA   PEDCRSDCDS   SSSVVE----  ----DGXD-   195
gi|57012880         -----SSR   KYTRS-PPVV   PDDCHSDCDS   SSSVVDHGDC   EKENDNDNDN  190
gi|56384582         -----TGR   RYPRT-PPVA   PGDCRSDCDS   SSSVVD----  ----DADNDN  175
CeresClone:1044385  FLDRAHFMTQ  SFP---LRFE   PGPVQSDSDS   SSMVVD----  ----CQP-    192
gi|55419650         FFDAFATGGS  GCP--------A  SGFAQSDSDS   SSSVVD----  ----FEGG-   158 gi|50929507         AST------VR  SRVAAFDLNL  PPPLDRDHVD   L--------   CTDLRL---   190
CeresClone:273307   AASASC----   PFPLPFDLNL  PPGGGGAGVG   FYADEEDELR   LTALRL---   211
Lead-CeresClone124720  IASSSS---RR  KTPFQFDLNF  PPLDG----VD  LFAGGIDDLH   CTDLRL---   244
CeresClone:975672   IASSSS---RR  KPPFEFDLNF  XPLDG----VD  LFVGA-DDXX   CTDLXL---   235
gi|57012880         IASSSF----   RKPLLFDLNL  PPP-------   MDDAGADDLH   CTALCL---   225
gi|56384582         AASSTMLSFK   RQPLPFDLNA  PPLEE----GD  VANGLGEDLH   CTLLCL---   218
CeresClone:1044385  ---------   KREINLDLNL  APPN------   EY--------   --------   208
gi|55419650         -------VR    RRVFDLDLNQ  LPAE------   MD--------   --------   176
```

Figure 80

```
CeresClone:471377      ------MAS SQSRKKVDA- XDSRAASVLV RAKDGSAFAR CDDCKKNVPV    42
CeresClone:207075      MAGPSTTSNA PKQRKRVEAE TSSNTSTTLR RAKDGSAFAL CEGCNKSVAV    50
gi|21554154            MAGPSTTSNA PKQRKRVEAE TSSNTSTTLR RAKDGSAFAL CEGCNKSVAV    50
gi|9759080             MAGPSTTSNA PKSRKRVEAE ----TVLK   RAKDGSAFAL CL--------    42
CeresClone:617111      -----MATAGNA PRSRKRVEA- ----TVLK   RSRDGSAFTR CEACNKDVAI    40
Lead-cDNA:ID23740209   MAGCKSTGNA ARSRKRVEA- ----TVLK   RARDGSAFTR CEACNKDVPV    43
gi|50940237            MAG----KSG ARTRKRVEA- ---TDSAVLK RARDGSAFTR CEACGKSVSV    42

CeresClone:471377      ALI DMHSCSL EAKI KMNLDA QVVEQAAEAK KPERKKPKSK EPMAKKAKV-    91
CeresClone:207075      ALI SMHNCSL DAKI RVNLEA QVVETQAEAK KKPAEKKTT  SDGPKPKRLK    100
gi|21554154            ALI SMHNCSL DAKI RVNLEA QVVETQAEAK KKPAEKKTT  SDGPKPKRLK    100
gi|9759080             ----CVF    GCCCCCSEA  QVVETQAEAK KKPAEKKKTT SDGPKPKRLK    85
CeresClone:617111      VLI DLHSCSL DSKI RLSLES QVVEKAVE-Q EKKRKTPSAA AGGKGKKKSK    90
Lead-cDNA:ID23740209   VLI DMHSCSL DEKI RMTLEA QVVEKTVEVA SADRKKSSAK GGGNKDA---    90
gi|50940237            VLI DMHNCSL DDKI RI SLEA QVVEQAVEVA ASKKKSGKNN NNN-------    85

CeresClone:471377      ---GKGKKVKD -PNMPKRPPT AFFVFLDDFR KSFKEANPDS KDVKRVGKEA   138
CeresClone:207075      KTNDEKKSSS TSNKPKRPLT AFFI FMSDFR KTFKSEH-NG SLAKDAAKI G   149
gi|21554154            KTNDEKKSSS TSNKPKRPLT AFFI FMSDFR KTFKSEH-NG SLAKDAAKI G   149
gi|9759080             KTNDEKKSSS TSNKPKRPLT AFFI FMSDFR KTFKSEH-NG SLAKDAAKI G   134
CeresClone:617111      ADGDGAKP-- ----KAKRPPT AFFLFMKDFR VEFKASHPDE KGVAAVGKAA    136
Lead-cDNA:ID23740209   ------      --KRKRSPT AFFLFMDDFR KEFKATHPDN KSVATVAKEG   127
gi|50940237            --GEGAK---  KGKRPPT   AFFLFMSDFR KEYKAEHPDN KSVSAVAKEG    127

CeresClone:471377      GEKWRSMTDE EKKPYLDKVA ELKEEYEKAM ESYEAGQDEE DQTVSDKETS    188
CeresClone:207075      GEKWKSLTEE EKKVYLDKAA ELKAEYNKSL ESNDADEEEE DEEKQSDDVD    199
gi|21554154            GEKWKSLTEE EKKVYLDKAA ELKAEYNKSL ESNDADEEEE DEEKQSDDVD    199
gi|9759080             GEKWKSMTEE EKKVYLDKAA ELKAEYNKSL ESNDADEEEE DEEKQSDDVD    184
CeresClone:617111      GERWKSMTEE EKKPYNDQAK ELKAEQFAN- -----GEGSA ENNVGDEEKA   179
Lead-cDNA:ID23740209   GERWKSMTDE EKKPYI EKAA ELKAEAEN-- -----GECSG ENNVATI-KKA  169
gi|50940237            GERWKSMSDE DKKPYLDKAA ELKAEYHN-- -----GERSD ENNVG----G   166
```

Figure 80 (continued)

```
CeresClone:471377    DKEAAAKEVA    IEV-       ---        ---EGKEEEEI   TDED  209
CeresClone:207075    DAEEKQVDDD    DEV-       ENTDDDKKEA  EGKEEEEEI    LDDY  241
gi|21554154          DAEEKQVDDD    DEV-EEKEV  ENTDDDKKEA  EGKEEEEEI    LDDY  241
gi|9759080           DAEEKQVDDD    DEV-EEKEV  ENTDDDKKEA  EGKEEEEEI    LDDY  226
CeresClone:617111    DADAEEVEDA    EQE-EEKEV  DKPEDAPEDE  EE--EEEKNEL  DDDI  216
Lead-cDNA-ID23740209 KTDDDQEVDQP   AKKLRKCKAL HEDEDDDGDQ  ED-EDEKNEL   DDDM  212
gi|50940237          NAGEQEVDQP    PKK----    GTDEDDQEDE  DGAEEEKNEL   DDDI  203
```

FIGURE 81

| SEQ ID | 1 | 2 | 3 | 4 | 5 | 6 | 50 |
|---|---|---|---|---|---|---|---|
| SEQ-ID-NO-1945-GI-1429228 | MATFELYRRS | TIGMCLTETL | DEMVQSGTVS | PELAIQVLVQ | FDKSMTEALE | | 50 |
| SEQ-ID-NO-1943-CLONE-530235 | MATFELYRRS | TIGMCLTETL | DEMVQNGTLS | PELAIQVLVQ | FDKSMTEALE | | 50 |
| SEQ-ID-NO-1944-CLONE-8364 | MATFELYRRS | TIGMCLTETL | DDMVQSGTLS | PELAIQVLVQ | FDKSMTEALE | | 50 |
| SEQ-ID-NO-1942-GI-57899877 | MATFELYRRS | TIGMCLTDTL | DDMVSSGALS | PELAIQVLVQ | FDKSMTSALE | | 50 |
| SEQ-ID-NO-1323-CLONE-225321 | MATFELYRRS | TIGMCLTETL | DEMVSNGTLS | PELAIQVLVQ | FDKSMTDALE | | 50 |
| SEQ-ID-NO-1939-CLONE-1541168 | MATFELYRRS | TIGMCLTETL | DEMVSSGTLS | PELAIQVLVQ | FDKSMTDALE | | 50 |
| SEQ-ID-NO-1940-CLONE-699465 | MATFELYRRS | TIGMCLTETL | DEMVSSGTLS | PELAIQVLVQ | FDKSMTEALE | | 50 |
| SEQ-ID-NO-1941-GI-55585039 | MATFELYRRS | TIGMCLTETL | DEMVSSGTLS | PELAIQVLFQ | FDKSMTEALE | | 50 |

| SEQ ID | | | | | | | 100 |
|---|---|---|---|---|---|---|---|
| SEQ-ID-NO-1945-GI-1429228 | SQVKTKVSIK | GHLHHLQVRD | NVWTFILQDA | MFKSMDRQEN | VSPVKIVASD | | 100 |
| SEQ-ID-NO-1943-CLONE-530235 | TQVKSKVSIK | GHLHTYRFCD | NVWTFILQDA | LFKSEDSQEI | VGRVKIVACD | | 100 |
| SEQ-ID-NO-1944-CLONE-8364 | SQVKTKVSIK | GHLHTYRFCD | NVWTFILQDA | MFKSDDRQEN | VSRVKIVACD | | 100 |
| SEQ-ID-NO-1942-GI-57899877 | HQVKSKVTVK | GHLHTYRFCD | NVWTFILTDA | LFKNEELTET | INKVKIVACD | | 100 |
| SEQ-ID-NO-1323-CLONE-225321 | NQVKSKVTVK | GHLHTYRFCD | NVWTFILTDA | SFKNEEATEQ | VGKVKIVACD | | 100 |
| SEQ-ID-NO-1939-CLONE-1541168 | NQVKSKVTVK | GHLHTYRFCD | NVWTFILTDA | SFKNEEATEQ | VGKVKIVACD | | 100 |
| SEQ-ID-NO-1940-CLONE-699465 | NQVKSKVTVK | GHLHTYRFCD | NVWTFILTDA | QFKNEETTEQ | VGKVKIVACD | | 100 |
| SEQ-ID-NO-1941-GI-55585039 | NQVKSKVSIK | GHLHTYRFCD | NVWTFILTEA | SFKNEETTEQ | VGKVKIVACD | | 100 |

| SEQ ID | | |
|---|---|---|
| SEQ-ID-NO-1945-GI-1429228 | SKLLTQ---- | 106 |
| SEQ-ID-NO-1943-CLONE-530235 | SKLLTQ---- | 106 |
| SEQ-ID-NO-1944-CLONE-8364 | SKLLTQ---- | 106 |
| SEQ-ID-NO-1942-GI-57899877 | SKLLETKEE- | 109 |
| SEQ-ID-NO-1323-CLONE-225321 | SKLLGQ---- | 106 |
| SEQ-ID-NO-1939-CLONE-1541168 | SKGRGQ---- | 106 |
| SEQ-ID-NO-1940-CLONE-699465 | SKLLSQ---- | 106 |
| SEQ-ID-NO-1941-GI-55585039 | SKLLSQ---- | 106 |

Figure 82

| | | | | | | |
|---|---|---|---|---|---|---|
| gi\|50726318 | MKARSRSSNG | DSRLSVRKTK | AEKDPNKPKR | PPSAFFVFME | QFRKDYKEKH | 50 |
| Lead-CeresClone333753 | MKSRARSGG | DSRLSVRKTK | VEKDPNKPKR | PPTFFVFME | EFRKDYKEKH | 50 |
| gi\|17017392 | MKSRARSTAG | DSRLSVRKTK | AEKDPNKPKR | PPSAFFVFME | EFRKDYKEKH | 50 |

| | | | | | | |
|---|---|---|---|---|---|---|
| gi\|50726318 | PNVKQVSVIG | KAGGDKWKSM | TDADKAPFVT | KAEKLKAEYT | KKIDAYNNKQ | 100 |
| Lead-CeresClone333753 | PNVKQVSVIG | KAGGDMWKSL | SDAEKAPYVS | KAEKLKVEYT | KKMDAYNNKQ | 100 |
| gi\|17017392 | PNVKQVSLIG | KAGGDKWKSL | SDAEKAPYVS | KAEKLKAEYT | KKIDAYNNKQ | 100 |

| | | | | |
|---|---|---|---|---|
| gi\|50726318 | A-CGPATSGD | SDKSKSEVND | EDECSGDE | 127 |
| Lead-CeresClone333753 | SGCGGPTLSGD | SDKSKSEVND | GDE-EGDE | 127 |
| gi\|17017392 | S-GDPTASGD | SDKSKSEVND | EDE-EGDE | 126 |

Figure 83

| | | | | | | |
|---|---|---|---|---|---|---|
| gi\|50251896 | MEQPKPPSVA | ASA----AEA | QNPNAFTCEL | PHSIYALAF- | SPSAP----- | 40 |
| CeresClone:783774 | MDQPKPTPSA | AASPAGADAA | PNPYAFTCEL | PHSIYALAF- | SPSAP----- | 44 |
| gi\|37544703 | MDPPKPPSSV | ASSS--GPET | PNPHAFTCEL | PHSIYALAF- | SPVAP----- | 42 |
| CeresClone:1151902 | MDNSAP---- | --DS----LS | RSETAVTYDS | PYPLYAMAFS | SLRSSSGH-- | 38 |
| gi\|10636051 | MDNSAP---- | --DS----LS | RSETAVTYDS | PYPLYAMAFS | SLRSSSGH-- | 38 |
| gi\|22324807 | MENSTQ---- | --ES----HP | RSDNSVTYES | AYTVYAMALS | STPSSTNINH | 40 |
| gi\|14270085 | MENSTQ---- | --ES----HL | RPENVVTYDS | PYPIYAMAL- | AVNRR----- | 35 |
| Lead-CeresClone475689 | MENSTQ---- | --ES----HL | RSENSVSYES | PYPIYGMSF- | SPSHPH---- | 35 |
| gi\|2290532 | MENSSQ---- | --ES----QHL | RSENSVTYDS | TYPIYSMAFS | SFPTPRR--- | 38 |
| gi\|6752886 | MENSTQ---- | --ES----HL | RAENSVTYES | PYPLYAMAFA | SPQTRTRHQH | 40 |

| | | | | | | |
|---|---|---|---|---|---|---|
| gi\|50251896 | -VLAAGSFLE | DLHNRVSLLS | FDPVHPTAAS | FRALPALSFD | HPYPPTKLQF | 89 |
| CeresClone:783774 | -VLAAGSFLE | DLHNRVSLLC | FDSVHPTAAS | FRAVPSLSFD | HPYPPTKLQF | 93 |
| gi\|37544703 | -VLASGSFLE | DLHNRVSLLS | FDPVRPSAAS | FRALPALSFD | HPYPPTKLMF | 91 |
| CeresClone:1151902 | -RIAVGSFLE | DYNNRIDILS | FD------SDSMT | VKPLPNLSFE | HPYPPTKLMF | 84 |
| gi\|10636051 | -RIAVGSFLE | DYNNRIDILS | FD------SDSMT | VKPLPNLSFE | HPYPPTKLMF | 84 |
| gi\|22324807 | -QRIALGSFLE | DYTNRVDILS | FD------PETLS | FKTHPKLAFD | HPYPPTKLMF | 87 |
| gi\|14270085 | -RVAVGSFVE | ELKNHVDILS | FS------EDSGS | KPVPSLSFD | HPYPPTKLLF | 81 |
| Lead-CeresClone475689 | -RLALGSFIE | EYTNRVDILS | FH------PDTLS | TPNPSLSFD | HPYPPTKLMF | 81 |
| gi\|2290532 | -RIAVGSFIE | ELNNRVELLS | FN------EETLT | NPIPNLSFD | HPYPPTKLMF | 84 |
| gi\|6752886 | -HRIAVGSFIE | EYSNRVDILS | FD------PDTLS | KPNPTLSFD | HPYPPTKLMF | 87 |

| | | | | | | |
|---|---|---|---|---|---|---|
| gi\|50251896 | HPR----AASA | ---PHLLASS | SDALRLWLAP | LDDLAATATA | AAPELRSVLD | 133 |
| CeresClone:783774 | NPR----AAS | ---TPLLASS | SDALRLWHAP | LDDL--SASA | PAPELRSVLD | 134 |
| gi\|37544703 | NPR----AAA | ---PSLLASS | ADTLRIWHTP | LDDL--SDTA | PAPELRSVLD | 132 |
| CeresClone:1151902 | SPPSLRRPSS | ---GDLLASE | GDFLRLWEIN | EDS----STVE | PI----SVLN | 124 |
| gi\|10636051 | SPPSLRRPSS | ---GDLLASE | GDFLRLWEIN | EDS----STVE | PI----SVLN | 124 |
| gi\|22324807 | QPNRKSASSS | SSC--SDLLAST | GDFLRLWEVR | E------SSIE | PV----TVLN | 128 |
| gi\|14270085 | HPS----VSAP | ---SNLLASS | GDYLRLWEVR | E------SSIV | AV----STLN | 116 |
| Lead-CeresClone475689 | HPRK--PPSSS | ---SDLATS | GDYLRLWEVK | D------NSVE | AV----SLFN | 118 |
| gi\|2290532 | HPNP--IKSN | ---NDILASS | GDYLRLWEVK | D------SSIE | PL----FTLN | 120 |
| gi\|6752886 | HPNPNALHKT | ---NDVLASS | GDYLRLWEVG | D------STVE | PI----QVLN | 125 |

Figure 83 (continued)

| | | | | | | |
|---|---|---|---|---|---|---|
| gi\|50251896 | NRKTSASEFC | APLTSFDWNE | AFPRRIGTAS | DTTCTIWDI | ERGVVETQLI | 183 |
| CeresClone:783774 | NRKASADFC | APLTSFDWNE | EPRRIGTAS | DTTCTVWDI | ERGVVETQLI | 184 |
| gi\|37544703 | NRKAS-SEFC | APLTSFDWNE | VEPRRIGTAS | DTTCTVWDI | DRGVVETQLI | 181 |
| CeresClone:1151902 | NSKTS--EFC | APLTSFDWNE | VEPKRLGTCS | DTTCTIWDI | EKSVVETQLI | 172 |
| gi\|10636051 | -----EFC | APLTSFDWNE | VEPKRLGTCS | DTTCTIWDI | EKSVVETQLI | 172 |
| gi\|22324807 | NSKTS--EYS | APLTSFDWND | VEPRRIGTSS | DTTCTIWDI | EKCVVETQLI | 176 |
| gi\|14270085 | NSKTS--EFC | APLTSFDWND | VEPRRIGTSS | DTTCTIWDI | EKGAVETQLI | 164 |
| Lead-CeresClone475689 | NSKTS--EFC | APLTSFDWND | DPNRIATSS | DTTCTIWDI | ERTLVETQLI | 166 |
| gi\|2290532 | NSKTS--EYC | APLTSFDWNE | VEPKRIGTSS | DTTCTIWDV | EKGVVETQLI | 168 |
| gi\|6752886 | NSKTS--EFC | APLTSFDWND | EPRRIGTSS | DTTCTIWDI | EKGVVETQLI | 173 |

| | | | | | | |
|---|---|---|---|---|---|---|
| gi\|50251896 | AHDKAVHDIA | WGENGIFASV | SADGSVRVFD | LRDKEHSTIF | YESPRPDTPL | 233 |
| CeresClone:783774 | AHDKAVHDIA | WGEAGVFASV | SADGSVRVFD | LRDKEHSTIV | YESPRPDTPL | 234 |
| gi\|37544703 | AHDKAVHDIA | WGEAGVFASV | SADGSVRVFD | LRDKEHSTIV | YESPRPDTPL | 231 |
| CeresClone:1151902 | AHDKEVHDIA | WGEARVFASV | SADGSVRIFD | LRDKEHSTII | YESPQPDTPL | 222 |
| gi\|10636051 | AHDKEVHDIA | WGEARVFASV | SADGSVRIFD | LRDKEHSTII | YESPQPDTPL | 222 |
| gi\|22324807 | AHDKEVYDIA | WGEAGVFASV | SADGSVRIFD | LRDKEHSTII | YESPQPDTPL | 226 |
| gi\|14270085 | AHDKEVYDIA | WGEAGVFASV | SADGSVRIFD | LRDKEHSTII | YESPMDTPL | 214 |
| Lead-CeresClone475689 | AHDKEVYDIA | WGEAGVFASV | SADGSVRIFD | LRDKEHSTII | YESPHPDTPL | 216 |
| gi\|2290532 | AHDKEVYDIA | WGEARVFASV | SADGSVRIFD | LRDKEHSTII | YESPTPDTPL | 218 |
| gi\|6752886 | AHDKEVYDIA | WGEARVFASV | SADGSVRIFD | LRDKEHSTII | YESPQPDTPL | 223 |

| | | | | | | |
|---|---|---|---|---|---|---|
| gi\|50251896 | LRLAWNRYDF | HYMATLLMDS | SAVVVLDMRA | PGVPVAELHR | HRACANAVAW | 283 |
| CeresClone:783774 | LRLAWNRYDL | RYMAALLMDS | NAVVVLDIRA | PGVPVAELHR | HGCCVNAVAW | 284 |
| gi\|37544703 | LRLAWNRSDL | RYMATLLMDS | SAVVVLDIRA | PGVPVAELHR | HRACANAVAW | 281 |
| CeresClone:1151902 | LRLAWNKQDL | RYMATILMDS | NKVVILDIRS | PTMPVAELER | HQASVNAIAW | 272 |
| gi\|10636051 | LRLAWNKQDL | RYMATILMDS | NKVVILDIRS | PTMPVAELER | HQASVNAIAW | 272 |
| gi\|22324807 | LRLAWNKQDL | KYMATILMDS | NKVVILDIRS | PTIPVAELER | HHASVNAIAW | 276 |
| gi\|14270085 | LRLAWNKQDL | RYMATIQMDS | NKIVILDIRS | PTIPVAELER | HSASVNAIAW | 264 |
| Lead-CeresClone475689 | LRLAWNKQDL | RYMATILMDS | NKVVILDIRS | PAMPVAELER | HRGSVNAIAW | 266 |
| gi\|2290532 | LRLAWNKQDL | RYMATILMDS | NKVVILDIRS | PTIPVAELER | HQASVNAIAW | 268 |
| gi\|6752886 | LRLAWNKQDL | RYMATILMDS | NKVVILDIRS | PTMPVAELER | HRGSVNAIAW | 273 |

Figure 83 (continued)

| | | | | | | |
|---|---|---|---|---|---|---|
| gi\|50251896 | APQAT RHL CS | AGDDGQALI W | ELPATPGAVP | AEGI DPVMVY | DAGAEI NQLQ | 333 |
| CeresClone:783774 | APQAA RHL CS | AGDDGQALI W | ELPEAPAAVP | PEGI DPVLVY | DAGAEI NQLQ | 334 |
| gi\|37544703 | APQAT RHL CS | AGDDGQALI W | ELPET AAAVP | AEGI DPVLVY | DAGAEI NQLQ | 331 |
| CeresClone:1151902 | APQSCKHI CS | GCDDT QALI W | ELPTVAG--- | PNGI DPMSVY | SAGSEI NQLQ | 319 |
| gi\|10636051 | APQSCKHI CS | GCDDT QALI W | ELPTVAG--- | PNGI DPMSVY | SAGSEI NQLQ | 319 |
| gi\|22324807 | APQSCKHI CS | AGDDT QALI W | ELPTVAG--- | PNGI DPLCVY | SAGYEI NQLQ | 323 |
| gi\|14270085 | APQSCKHI CS | AGDDGQSLL W | DLPTLAS--- | PNGI DPMT MY | SAGAEI NQLQ | 311 |
| Lead-CeresClone475689 | APHSTHI CS | ACDDT QALI W | ELPTVAG--- | PDVI DPVCMY | SAGCEI NQLQ | 313 |
| gi\|2290532 | APQSCRHI CS | GCDDGQALI W | ELPTVAG--- | PNGI DPMSMY | SAGAEI NQLQ | 315 |
| gi\|6752886 | APQSCRHI CS | AGDDT QALI W | DLPTVAG--- | PNGI DPMSMY | SAGAEI NQLQ | 320 |

| | | | |
|---|---|---|---|
| gi\|50251896 | WAAAY PEWI S | AFENKVQLL | RV | 355 |
| CeresClone:783774 | WVAGHPDWMG | SLENKVQLL | RV | 356 |
| gi\|37544703 | WAAHPDWMA | AFENKVQLL | RV | 353 |
| CeresClone:1151902 | WSSSQPDWI G | AFANKMQLL | RV | 341 |
| gi\|10636051 | WSSSQPDWI G | AFANKMQLL | RV | 341 |
| gi\|22324807 | WSAAQPDWI A | AFSNKLQLL | KV | 345 |
| gi\|14270085 | WSAAQPDWI A | AFANKMQLL | KV | 333 |
| Lead-CeresClone475689 | WSAVQPEWI A | AFSNKMQLL | KV | 335 |
| gi\|2290532 | WSPAQRDWI A | AFSNKLQLL | KV | 337 |
| gi\|6752886 | WSAAQPDWI S | AFSNKMQLL | KV | 342 |

Figure 85

```
                                                                                           41
gi|15810645           MDS--SCIDI-E    ISSSTSESES  A-------TIT  AKKLSPPPAA  ALRLYRMGSG      49
Lead-cDNA-ID23402435  MDAI-SCLDI-E    STTTESLSIS  QAKPSSTIMS   SEKASPSPPP  PNRLCRVGSA      37
gi|33320073           MEGTSSIDQE      STTSDSLSIA  P--------MT  TTK------P  PESLCRMGSG gi|15810645           GSSVV--LDPE     NG---LETES  RKLPSSKYKG   VVPQPNGRWG  AQIYEKHQRV      87
Lead-cDNA-ID23402435  ASAVVDSDGG      GGGSTEVES   RKLPSSKYKG   VVPQPNGRWG  SQIYEKHQRV      99
gi|33320073           TSSVI--DGE      NG---VEAES  RKLPSSKYKG   VVPQPNGRWG  AQIYEKHQRV      83 gi|15810645           WLGTFNEQEE      AARSYDIAAC  RFRGRDAVN    FKNVL-----  -EDGDLAFLE      131
Lead-cDNA-ID23402435  WLGTFNEEDE      AARAYDVAVQ  RFRGRDAVTN   FKPLSGTD--  DDDGESEFLN      147
gi|33320073           WLGTFNEENE      AARAYDVAAQ  RFRGRDAVTN   FKPLLENQES  DDDVEIAFLN      133 gi|15810645           AHSKAEIVDM      LRKHTYADEL  EQNNKRQLFL   SVDANGKRN-  ----------      170
Lead-cDNA-ID23402435  SHSKSEIVDM      LRKHTYNDEL  EQSKRSRGFV   RRRGSAACA-  ----------      186
gi|33320073           SHSKAEIVDM      LRKHTYIDEL  EQSKKLFGY    TKDGTMAKNK  DGLIDISSFF      182 gi|15810645           GSISTIQNDK      VLKTREVLFE  KAVTPSDVGK   LNRLVIPKQH  AEKHFPLPSP      219
Lead-cDNA-ID23402435  CNGNSISGAC      VMKAREQLFQ  KAVTPSDVGK   LNRLVIPKQH  AEKHFPLQSA      236
gi|33320073           GGGTIDKVN       N-KVREQLFE  KAVTPSDVGK   LNRLVIPKQH  AEKHFPLQNG      231 gi|15810645           SPAV------      TKGVLINFED  VNGKVWRFRY   SYWNSSQSYV  LTKGWSRFVK      263
Lead-cDNA-ID23402435  ANGVSATAAA     AKGVLLNFED  VGGKVWRFRY   SYWNSSQSYV  LTKGWSRFVK      286
gi|33320073           NN--------      SKGVLLNFED  LNGKVWRFRY   SYWNSSQSYV  LTKGWSRFVK      273
```

Figure 85 (continued)

```
gi|15810645      EKNLRAGDVV TFERSTGLER QLYIDWKVRS GPRENPV--- ---------  300
Lead-cDNA-ID23402435  EKNLKAGDIV CFQRSTGPDR QLYIDWKTRN VVNEVALFGP VVEP-----  330
gi|33320073      EKNLKAGDIV SFQRSTSGDK QLYIDFKARN MAPTNPVVTN QVQAQVQVPR  323 gi|15810645      QVVVRLFGVD FNVTTV---- -------KPN DVVAVCGGKR SRDVDDMFAL  340
Lead-cDNA-ID23402435  QMVRLFGVN LKLPGS---- ---DSIANNN NASGCCNGKR -REM-ELFSL  372
gi|33320073      VQMMRLFGVN CKIPATI NN VVDNNNNNNN NMANCSGGKR MMEM-ELITF  372 gi|15810645      R-CSKKQA-- NAL  352
Lead-cDNA-ID23402435  E-CSKKPK-- GAL  384
gi|33320073      ESCRKKQRV-  DAL  386
```

Figure 86

```
CeresClone:354956     ----------------  ----------------  -MASAGGRRR  SKAKPRARAG  GKAKKRTKYL  SLTELLVKA-   38
gi|22854970           ----------------  ----------------  ----------  ------MLKQ  ESNWAQACDT  CRSAACTVYC  RADSAYLCTS   34
gi|22854950           ----------------  ----------------  ----------  ------MLKQ  ESNWAQACDT  CRSAACTVYC  RADSAYLCTS   34
Lead-cDNA-ID23385230  ----------------  ----------------  -MVFHDLVPE  MSTEDQAESY  EVEEQLIFEV  PVMNSMVEEQ   39
gi|25405956           ----------------  ----------------  ----------  ---MISKYQE  DVKQPRACEL  CLNKHAVWYC  ASDDAFLCHV   37
gi|30694486           MTSHQNIKIS        EKIMISKYQE        DVKQPRACEL  CLNKHAVWYC  ASDDAFLCHV   50

CeresClone:354956     ---HAQVGASP  RSPWEDEEAV  AAEV----KPE  ----------  -----DDHHH  ----------   76
gi|22854970           C--DAQIHAAN  RLASRHERVR  VCESCERAPA  LCTACDSQIH   83
gi|22854950           C--DAQIHAAN  RLASRHERVR  VCESCERAPA  LCTACDSQIH   83
Lead-cDNA-ID23385230  CFNQSLEKQN   EFPMM--PLS  FKSS-----   DE          GLFPTD----   80
gi|25405956           C--DESVHSAN  HVATKHERVC  LRTN-----   EIS         SVWHSGFRRK   83
gi|30694486           C--DESVHSAN  HVATKHERVC  LRTN-----   EIS         SVWHSGFRRK   96

CeresClone:354956     HHHEASTLFE   AVPAPSLSD   LGPSPPESPA  GSGSG--ALP  GAEEEDLPRR  124
gi|22854970           SANPLARRHQ   RVPILPISGC  VATNHHSSET  TEPENIVVVG  QEEEDEAEAA  133
gi|22854950           SANPLARRHQ   RVPILPISGC  VATNHHSSET  TEPENIVVVG  QEEEDEAEAA  133
Lead-cDNA-ID23385230  -MELAQ--FT   A-DVETLLGG  GDREFHSIEE  -GLGEMLKIE  KEEVEEEEGV  126
gi|25405956           ARTPRSR-YE   KKPQQKJDDE  RRREDPRVPE  PGGEVMFFIP  EANDDDMTSL  132
gi|30694486           ARTPRSR-YE   KKPQQKJDDE  RRREDPRVPE  PGGEVMFFIP  EANDDDMTSL  145

CeresClone:354956     A---------   ----------  ----------  ----------  VGEEYLDLVD  LRGRARERWV  135
gi|22854970           SWLLPSSVK-   ----NCGDN   NNNTENNRFS  ----------  VGEEYLDLVD  YSSSIDKRFT  177
gi|22854950           SWLLPSSVK-   ----NCGDN   NNNTENNRFS  ----------  VGEEYLDLVD  YSSSIDKRFX  177
Lead-cDNA-ID23385230  V----TR---   ----EVHDQ   DEGDETSPFE  LS-----FD   YEYTHKITFD  158
gi|25405956           VPEFEGFTEM   GFFLSNHNGT  EETTKQFNFE  EEADTMEDLY  YNGEEEDKTD  182
gi|30694486           VPEFEGFTEM   GFFLSNHNGT  EETTKQFNFE  EEADTMEDLY  YNGEEEDKTD  195
```

Figure 87

```
CeresClone:894637      -MYSPKPESS FGPNPNSGLH QQQMELLGAN MGPGNGAN-- -NNTNMAGRQ    46
gi|50725048            ---------- ---------- ---MELGGNN MGPDNGAN-- -NNSNLAARQ    24
Lead-CeresClone115924  ---------- ---------- ---------- MEADNGG--- -PNSSHASKQ    16
CeresClone:477003      MYHSKNVPSA SLIGGNSLSH GQHDCGGST- MDPGSGGNGL SNNSNLTSKQ    50

CeresClone:894637      RLRWTNELHE RFVEAVTQLG GPDRATPKGV KDPGDLLAGL YHVKSHLQK     96
gi|50725048            RLRWTNELHE RFVEAVTQLG GPDRATPKGV KDPGDLLAGL YHVKSHLQK     74
Lead-CeresClone115924  RLRWTHELHE RFVDAVAQLG GPDRATPKGV KESGDMLSGL YHVKSHLQK     66
CeresClone:477003      RLRWTHELHE RFVDAVAQLG GPDRATPKGV KETGDMLSNL YHVKSHLQK    100

CeresClone:894637      YRLAKYIPDA STD-GNKTDN KYLQKIIEEQ EGSSGLQISE ALKLQMEVQK   145
gi|50725048            YRLAKYIPDS SAD-GNKAEN KYLKKIIEEQ EGSSSGLQISE ALKLQMEVQK  123
Lead-CeresClone115924  YRLAKYLPDS SSE-GKKTDK KYLKKIIEEQ DGSSGMQITE ALKLQMEVQK   115
CeresClone:477003      YRLAKYLPDS SSDEGKKADK KYLKKIIEEQ DGSSGMQITE ALKLQMEVQK   150

CeresClone:894637      RLHEQLEVQR QLQLRIEAQG ESPTQVGASN QRLTGVKSET PAGGASVTVS   195
gi|50725048            RLHEQLEVQR QLQLRIEAQG ESPTQVGVPSN QRLGGVKSET PAAGASVTLP  173
Lead-CeresClone115924  RLHEQLEVQR QLQLRIEAQG ESPLQ----- QRLSGVLGE- ---PSAPVT   160
CeresClone:477003      RLHEQLEVQR QLQLRIEAQG ---------- QRLSGVLSEA PCSGAVAVVP  200

CeresClone:894637      SDQFPDSE-R TEPSTPAPAS RDTGDRTEAT KSTCHGDSLS              244
gi|50725048            SDQFPDSE-R TDPSTPAPTS RDNGGQNEAT KSPQRDDSLS              222
Lead-CeresClone115924  GD-------- SDPATPAPTS DKSGKDCGPD KSLSVDESLS              197
CeresClone:477003      GDACQEPDNK TDPSTPDP-- EKAAKDRAPA KSLSIFESFS              237
```

Figure 88

| | | | | | | |
|---|---|---|---|---|---|---|
| CeresClone:1459729 | MGRSPCCEKD | HTNKGAWTKE | EDQKLISYIK | SHGEGCWRSL | PASAGLLRCG | 50 |
| Lead-cDNA-ID23449314 | MGRSPCCEKA | HDNKGAWTKE | EDERLVAYIK | AHGEGCWRSL | PKAAGLLRCG | 50 |
| gi|56749359 | MGRSPCCEKA | HTNKGAWTKE | EDERLVAYIR | AHGEGCWRSL | PKAAGLLRCG | 50 |
| gi|1167484 | MGRSPCCEKA | HTNKGAWTKE | EDDRLIAYIK | AHGEGCWRSL | PKAAGLLRCG | 50 |
| gi|50726662 | MGRSPCCEKA | HTNKGAWTKE | EDDRLTAYIK | AHGEGCWRSL | PKAAGLLRCG | 50 |
| gi|19053 | MGRSPCCEKA | HTNKGAWTKE | EDDRLTAYIK | AHGEGCWRSL | PKAAGLLRCG | 50 |
| gi|47680445 | MGRSPCCEKA | HTNKGAWTKE | EDDKLIAYIK | AHGEGCWRSL | PKAAGLLRCG | 50 |
| gi|39725415 | MGRSPCCEKA | HTNKGAWTKE | EDDRLIAYIK | AHGEGCWRSL | PKAAGLLRCG | 50 |
| gi|31980095 | MGRSPCCEKA | HTNKGAWTKE | EDDRLVAYIR | AHGEGCWRSL | PKAAGLLRCG | 50 |
| gi|13346194 | MGRSPCCEKA | HTNKGAWTKE | EDDRLIAYIR | AHGEGCWRSL | PKAAGLLRCG | 50 |

| | | | | | | |
|---|---|---|---|---|---|---|
| CeresClone:1459729 | KSCRLRWINY | LRPDLKRGNF | TLEEDDLIIK | LHSLLGN-KW | SLIARLPGR | 99 |
| Lead-cDNA-ID23449314 | KSCRLRWINY | LRPDLKRGNF | TEEEDELIIK | LHSLLGN-KW | SLIAGRLPGR | 99 |
| gi|56749359 | KSCRLRWINY | LRPDLKRGNF | TEEEDELIIK | LHSLLGN-KW | SLIAGRLPGR | 99 |
| gi|1167484 | KSCRLRWINY | LRPDLKRGNF | TEEEDELIIK | LHSLLGN-KW | SLIAGRLPGR | 99 |
| gi|50726662 | KSCRLRWINY | LRPDLKRGNF | TEEEDELIIK | LHSLLGN-KW | SLIAGRLPGR | 99 |
| gi|19053 | KSCRLRWINY | LRPDLKRGNF | SHEEDELIIK | LHSLLGN-KW | SLIAGRLPGR | 99 |
| gi|47680445 | KSCRLRWINY | LRPDLKRGNF | SDEEDELIIK | LHSLLGN-KW | SLIAGRLPGR | 99 |
| gi|39725415 | KSCRLRWINY | LRPDLKRGNF | TEEEDELIIK | LHSLLGN-KW | SLIAGRLPGR | 99 |
| gi|31980095 | KSCRLRWINY | LRPDLKRGNF | TEAEDELIIK | LHSLLGNSRW | SLIAGRLPGR | 100 |
| gi|13346194 | KSCRLRWINY | LRPDLKRGNF | TEEEDELIIK | LHSLLGN-KW | SLIAGRLPGR | 99 |

| | | | | | | |
|---|---|---|---|---|---|---|
| CeresClone:1459729 | TDNEIKNYWN | THMKRKLLRG | GIDPATHRPI | KARRDASEAR | ETEDSLVKV- | 148 |
| Lead-cDNA-ID23449314 | TDNEIKNYWN | THIRRKLINR | GIDPTSHRPI | QESSASQDSK | PTQLEPVTSN | 149 |
| gi|56749359 | TDNEIKNYWN | THIRRKLINR | GIDPTSHRPI | QESSASQDSK | PTQLEPVTSN | 149 |
| gi|1167484 | TDNEIKNYWN | THIRRKLLSR | GIDPTTHRS | NDPTTPKVT- | PT------- | 140 |
| gi|50726662 | TDNEIKNYWN | THIRRKLLSR | GIDPVTHRPI | NDSASNIT-- | --------- | 137 |
| gi|19053 | TDNEIKNYWN | THIRRKLLSR | GIDPVTHRAI | NSDHAASNI- | --------- | 139 |
| gi|47680445 | TDNEIKNYWN | THIRRKLLSR | GIDPVTHRLI | NSDHAASNI- | --------- | 139 |
| gi|39725415 | TDNEIKNYWN | THIRRKLLTSR | GIDPATHRLI | NEPAQDHHDE | --------- | 141 |
| gi|31980095 | TDNEIKNYWN | THIRRKLLNR | GIDPATHRLI | NEPVQEATT- | --------- | 140 |
| gi|13346194 | TDNEIKNYWN | THIRRKLLSR | GIDPATHRPL | NEASQDV-T- | --------- | 138 |

| | | | |
|---|---|---|---|
| CeresClone:14597729 | L---NTSSVL | DYTSLEMN | 271 |
| Lead-cDNA-ID23449314 | LAKKETTSLL | GFRSLEMK | 282 |
| gi56749359 | LAKKETTSLL | GFRSLEMK | 282 |
| gi1167484 | L---KTNGLL | DYRTLETK | 273 |
| gi50726662 | L-----RTAML | DFRSLEMK | 251 |
| gi19053 | L-----RTAML | DFRSIEMK | 267 |
| gi47680445 | L-----RTAML | DFRSLEMK | 265 |
| gi39725415 | L-----KASVL | DYRS---- | 255 |
| gi31980095 | M-----KSGVL | DYRSLEMK | 270 |
| gi13346194 | L-----KSGIL | EYRSLEMK | 264 |

Figure 89

| | | | | | | |
|---|---|---|---|---|---|---|
| Lead-CeresClone12071 | MEGKRSQGQG | YMKKKSYLVE | EDMETD---TD | EEEEVGRDRV | RGSRGSINRG | | 48 |
| gi\|62856979 | MNLGKVDGSC | YQKMVKKEAE | EDQVSD----E | ELVESGVEEE | KKKKGVVGSG | | 47 |
| gi\|55419652 | ---------- | ----MQEEEE | -----HG | FPDDEKKKKK | YGRRGAAGGG | | 34 |
| gi\|1183866 | MDTSKGEGKR | VIKLPGSQEQ | EGVGGDEEEEE | IGEDSKKTRA | LTPSGKRASG | | 46 |
| CeresClone:538817 | MDGSWSEGKR | SMSYKEEDEY | EEEEEEVSE | YGDDGKKKRV | VSNKRGSKAG | | 50 |
| gi\|30577630 | MEASRAEGKR | SFMEEEEDQE | EEEEEE---- | ---EKREMST | SSSRRASGSG | | 43 |

| | | | | | |
|---|---|---|---|---|---|
| Lead-CeresClone12071 | GSL---RLCQV | DRCTADMKEA | KLYHRRHKVC | EVHAKASSVF | LSGLNQRFCQ | 96 |
| gi\|62856979 | GK---RCCQA | EKCTADLSDG | KQYHKRHKVC | EHHAKAQVVL | VGGMRQRFCQ | 94 |
| gi\|55419652 | GGVSPPACQV | EKCGLDLSDA | KPYHRRHKVC | EDHAKAPEVV | VAGLRQRFCQ | 84 |
| gi\|1183866 | STQ--RSCQV | ENCAAEMTNA | KPYHRRHKVC | EFHAKAPVVL | HSGLQQRFCQ | 94 |
| CeresClone:538817 | GSV-PPSCQV | DGCNADLSEA | KHYHRRHKVC | EYHAKAPAVV | IGDQHQRFCQ | 99 |
| gi\|30577630 | GST-PPTCQV | ENCNADLTDA | KHYHRRHKVC | ESHAKAPIVY | VAGQKRFCQ | 92 |

| | | | | | |
|---|---|---|---|---|---|
| Lead-CeresClone12071 | QCSRFHDLQE | FDEAKRSCRR | RLAGHNERRR | KSSGESTYGE | GSCRRG--- | 142 |
| gi\|62856979 | QCSRFHELSE | FDETKRSCRR | RLAGHNERRR | ENTAES-HAE | GSSRKG--TG | 141 |
| gi\|55419652 | QCSRFHELPE | FDEAKRSCRR | RLAGHNERRR | KSSAESSSAA | ESSNRRGMMI | 134 |
| gi\|1183866 | QCSRFHELSE | FDDSKRSCRR | RLAGHNERRR | KSSHDT-H-- | ---------- | 131 |
| CeresClone:538817 | QCSRFHDLSE | FDEYKKSCRK | RLAGHNERRR | KNASEY-HGL | ---------- | 138 |
| gi\|30577630 | QCSRFHDLSE | ---------- | RLAGHNERRR | KSSSDF-HRE | GSN------ | 134 |

| | | | | | |
|---|---|---|---|---|---|
| Lead-CeresClone12071 | ---NGQVVM | QNQERSRVEM | TLPMPNSSFK | RPQIR | | 174 |
| gi\|62856979 | THQLKDIVCG | QVDDRGRIQI | T-I HENSTYK | HFQIR | | 175 |
| gi\|55419652 | SAQLKESHYL | ADDQRARVNP | MAIHGSSSFK | RSQIR | | 169 |
| gi\|1183866 | ---------- | ---------- | ---------- | ----- | | 131 |
| CeresClone:538817 | ---------- | ---------- | ---------- | ----- | | 138 |
| gi\|30577630 | ---------- | ---------- | ---------- | ----- | | 134 |

Figure 90

```
Lead-CeresClone12997  MAVEARHMNL FSSQYITNRE CVKSQTNMNN GQQIAGGGFP LTIGDRN---   47
CeresClone:465893     MAVEAHRLLL AGGHRQQQQQ ---------- QQLASAGWP WAGADEDRCA   39

Lead-CeresClone12997  ---------- -------LQY ---------- IDPINSFNKS ESELTAISKR   70
CeresClone:465893     TTARPSQHHH HQQQPQQEL RLHNASCVGV LAPRVSTIAA GGQMFLGDAA   89

Lead-CeresClone12997  QRDSTFDSDA LIASQKRRAI AFSPASLIDA E--------- ------LVSQ  105
CeresClone:465893     ESDVTFGGGG AAARQEVTAV APAPKRKRKRA EQQQTPPVFQ VCAADDVAAQ  139

Lead-CeresClone12997  QQQNSEIDR FVAQQTETLR IELEARQRTQ TRMLASAVQN AILKKLKAKD  155
CeresClone:465893     FQQHIVDVNR LVFQQTANMW AALTELRRRQ ARQVVAAVEA AAATRLRARE  189

Lead-CeresClone12997  EEIIRMGKLN WVLQERVKNL YVENQIWRDL AQTNEATANN LRSNLEQVLA  205
CeresClone:465893     EEVQRTARIN GTLEERARSL YVEAQLWRDL ARANEATANE LRAELQQAL-  238

Lead-CeresClone12997  QVDDLDAFRR PLVEEADDA ESSCGSCDGG DVTAVVNGGC KRCGQLTASV  254
CeresClone:465893     -DDQRTRGA PGAGADADDA GSCCRGGEDG GTGTSLARTC XVXGLSAADV  286

Lead-CeresClone12997  LVLPCRHLCL CTVCGSSALL RTCPVCDMVM TASVHVNMSS-          294
CeresClone:465893     LLLPCRHLCA CAPCAGAA-- RACPACGCAK NGSVCVNFSI-          323
```

Figure 91

```
                                                                                        46
                                                                                        41
                                                                                        43
                                                                                        49
                                                                                        43
                                                                                        44
                                                                                        49
CeresClone:1537388      MATAAAAVAA  TFRTLQHAA  ACGA----PVP  LPSVRFQSLQ  -RHRVGLRRL
gi|3550485              ----MATAVV  AFRSFLHPTA  TAAA---IPLP  PSHFNLNNFQ  -GHCLGLR--
gi|50934311             ----MAAV    AFRSLLHPAA  AALTERVPLP  PAHLRLQGLH  -RHRVGVLNL
Lead-CeresClone14246    -MSSAYCSSA  VAVSAAATAS  SAATFNPLLS  SHSNSQLFYR  FTPKSFKLVA
CeresClone:511197       ----MAAV    SSSICNRIYN  LSFT--HPSLS  LTTCNFRQRP  ISQKPFTLNL
gi|311952               ----MSVAA   TASTCSTSSL  YLFTQKPKFS  VEHLSLSTYN  -AHFNFKINS
gi|20005                MSGCCFSFAA  TASTSSTSLL  YLFTQKPKFS  VDHLSLSTYN  -THFNFKINS 84
                                                                                        80
                                                                                        86
                                                                                        94
                                                                                        87
                                                                                        90
                                                                                        95
CeresClone:1537388      APP-------  ----RGRPVLT  PPFAAEDFSS  YVDDFSGDDG  E---EHFDEEE
gi|3550485              ------LFS   SHRSHPLLLP  ASASAASGQE  FSSD--GEYY  S---EEYVEEE
gi|50934311             ------FVA   SGHRRRLLLP  LAAAGGEFSS  EEEYANEEE   EEGEEYVEEE
Lead-CeresClone14246    NCPNPLILHS  NIRRHRFF--  -CAAETEASS  ADDEIQASVE  EEE--EEVEEE
CeresClone:511197       KSQSFTLSFF  PLHR-----LP  PPSAAFDGFE  VAQDTTEFQQ  D---EPETEPV
gi|311952               TKLKAHFPIS  SLYRSSIFLS  TCASVSDGVE  VVQE--DDEE  E---VALSAEE
gi|20005                TKLKAHFPIS  SLYRSSIFLS  TCASVSDGVE  VVQE--DDEE  E---VALSAEE 130
                                                                                        126
                                                                                        136
                                                                                        134
                                                                                        123
                                                                                        127
                                                                                        132
CeresClone:1537388      GSEPEEEAE-  ---APRAYSS  PRSRPPPRGDD  PGRLFVGNLP  YTYTSEELAQ
gi|3550485              GEEAEPEVE-  ---AVRGYYP  PRNRPAL GQE  PGRIYVGNLP  YTFTAAELTA
gi|50934311             EEDGEEEAA   AVAAPRGYYP  PRSRPAL GQE  PGRLFVGNLP  YTMTSGEISQ
Lead-CeresClone14246    GDEGEEEVE-  ------E     EKQTTQASGE  EGRLYVGNLP  YTITSSELSQ
CeresClone:511197       EKTEQEEEQ-  --------    KVSDSYD     AGRLYVGNLP  YSITNSALAE
gi|311952               EEEIEEKEE-  --------    SVESESVE    GGRLYVGNLP  FSMTSSQLSE
gi|20005                EEEIEEKEE-  --------    RVESESVE    GGRLYVGNLP  FSMTSSQLSE
```

Figure 91 (continued)

| | | | | | | |
|---|---|---|---|---|---|---|
| CeresClone:1537388 | VFSEAGRVDD | AQIIYDKVTN | RSRGFAFVTM | ATAEEAAKAI | QMFDGALLGG | 180 |
| gi|3550485 | AFSEAGSVDD | VQIIYDKITD | RSRGFAFVTM | ATAEEAAKAV | QMFNGALLGG | 176 |
| gi|50934311 | TFSEAGRVDN | VQIIYDKVTD | RSRGFAFVTM | ATAEEAATAI | QMFNGALLGG | 186 |
| Lead-CeresClone14246 | LFGEAGTVVD | VQIVYDKVTD | RSRGFGFVTM | GSIEEAKEAM | QMFNSSQIGG | 184 |
| CeresClone:511197 | LFGEAGTVAS | VEIMYDRVTD | RSRGFAFVTM | GNVEDAKEAI | RMFDGSQVGG | 173 |
| gi|311952 | IFAEAGTVAN | VEIVYDRVTD | RSRGFAFVTM | GSVEEAKEAI | RLFDGSQVGG | 177 |
| gi|20005 | IFAEAGTVAN | VEIVYDRVTD | RSRGFAFVTM | GSVEEAKEAI | RLFDGSQVGG | 182 |

| | | | | | | |
|---|---|---|---|---|---|---|
| CeresClone:1537388 | RTARVNYPEV | PRGGERRTVT | MSG-RRR--- | -DDGTYKIYA | GNLGWGVRAD | 225 |
| gi|3550485 | RTVRVNYPEV | PRGGERRAVAS | AAVARTSLRV | VDDGTYKVYA | GNLGWGVRAD | 226 |
| gi|50934311 | RTARVNYPEV | PRGGERAVGS | AAATRENRRI | -DDGTFKIYA | GNLGWGVRAD | 234 |
| Lead-CeresClone14246 | RTVKVNFPEV | PKGGERNEVMR | TKI-RDNNRS | YVDSPHKVYA | GNLGWNLTSQ | 233 |
| CeresClone:511197 | RTVKVNFPEV | PRGGERLVMG | SKI-RNSYRG | FVDSPHKLYA | GNLGWGLTSQ | 222 |
| gi|311952 | RTVKVNFPEV | PRGGEREVMS | AKI-RSTYQG | FVDSPHKLYV | ANLSWALTSQ | 226 |
| gi|20005 | RTVKVNFPEV | PRGGEREVMS | AKI-RSTYQG | FVDSPHKLYV | ANLSWALTSQ | 231 |

| | | | | | | |
|---|---|---|---|---|---|---|
| CeresClone:1537388 | TLRNVFEGRA | GLLDARVIFE | RETGRSRGFG | FVSFSTAEDA | QAALESLDGV | 275 |
| gi|3550485 | ALKTAFEGQP | GLVGARVIFE | RDTGRSRGFG | FVSFHTLQDA | KAALQAMDGV | 276 |
| gi|50934311 | ALRAAFEGQP | GLLDARVIFE | RDSGRSRGFG | FVSFRTAEDA | QAALEALDGV | 284 |
| Lead-CeresClone14246 | GLKDAFGDQP | GVLGAKVIYE | RNTGRSRGFG | FISFESAENV | QSALATMNGV | 283 |
| CeresClone:511197 | GLREAFAEQP | GVLSAKVIYE | RDSGRSRGFG | FVSFETAESA | QAALDMNGV | 272 |
| gi|311952 | GLRDAFADQP | GFMSAKVIYD | RSSGRSRGFG | FITFSSAEAM | KSALDTMNEV | 276 |
| gi|20005 | GLRDAFADQP | GFMSAKVIYD | RSSGRSRGFG | FITFSSAEAM | NSALDTMNEV | 281 |

Figure 91 (continued)

| | | | | |
|---|---|---|---|---|
| CeresClone:1537388 | ELEGRPLRLS | LAEQNPPPGS | PPSTAQAQQE | ETDSGAPAGA | GTE---AASS | 322 |
| gi\|3550485 | ELDGRPLRLS | LAAQNPPAGS | TPSTAQSQQE | KTASRG-SEA | EPQVDNNTIT | 325 |
| gi\|50934311 | ELEGRPLRLS | MAEQNP-TAG | SPSTVQSQEE | ETASES-SDA | ETE---QSIT | 329 |
| Lead-CeresClone14246 | EVEGRARLN | LASEREKPTV | SPPSVEGET | E--------- | ---------- | 314 |
| CeresClone:511197 | EVQGRPLRLN | LAEARA-P-S | SPPVI QKNV- | ---------- | ---------- | 299 |
| gi\|311952 | ELEGRPLRLN | VAGQKA-PLS | SPSMVETSP- | ---------- | ---------- | 304 |
| gi\|20005 | ELEGRPLRLN | VAGQKA-PVS | SPPVETSP- | ---------- | ---------- | 309 |

| | | | |
|---|---|---|---|
| CeresClone:1537388 | SEPSEAEVGE | SNLQTAANY | 341 |
| gi\|3550485 | SGQFGGEMEK | SNLQATASY | 344 |
| gi\|50934311 | SEPSEAETEE | SNLQTAASY | 348 |
| Lead-CeresClone14246 | ----EASLES | NEVLSNVSA | 329 |
| CeresClone:511197 | ----GSNVES | SELVSSAST | 314 |
| gi\|311952 | ----ENDSEN | NELLSSLSS | 319 |
| gi\|20005 | ----ENDSDN | SELLSSLSS | 324 |

Figure 92

```
                                                                                        50
                                                                                        34
                                                                                        24
CeresClone-833872       MDEAGRASAP AVVIVTASAA APSPPPPPP ATATAAADP PSPDPDALYE
CeresClone-1579587      MAAPSCGGGG GAGEGSSSAA AA-------- MTIGAHGVDQ VT--------
Lead-CeresClone-149496  MRTPMSDIQH VQSSLVSIRS SDK------- ---------- ----------

100
                                                                                        81
                                                                                        73
CeresClone-833872       EGMWQQMAMS SGATMQSGPY PVRPGEPDCT YYLRTGLCRF GMSCRFNHPQ
CeresClone-1579587      EAMWQ----MN LGDAMELGPY PERVGDPDCS YYMRTGMCRF GMTCKFNHPA
Lead-CeresClone-149496  EDAFRKMKVN ETGVEELNPY PDRPGERDCQ FYLRTGLCGY GSSCRYNHP- 150
                                                                                        131
                                                                                        122
CeresClone-833872       DRNIAIASAR MKGEYPERVG QPECQYYLKT GTCKFGPTCK FHHPREKAGI
CeresClone-1579587      DRKLAVAAAR MKGEYPQRIG QPECQYYLKT GTCKFGATCK FHHPREKAAM
Lead-CeresClone-149496  --THLPQDVAY YKEELPERIG QPDCEYFLKT GACKYGPTCK YHHPKDRNGA 200
                                                                                        181
                                                                                        171
CeresClone-833872       AGMVQLNTLG YPLRPNEREC AYYLKTGQCK YGNTCKFNHP ELFNAVASSR
CeresClone-1579587      ATRVQLNELG YPLRLNEKEC AYYLRTGQCK FGSTCKFHHP QPSTMMVAVR
Lead-CeresClone-149496  QP-VMFNVLG LPMRLGEKPC PYYLRTGTCR FGVACKFHHP QPDNGHSTAY 249
                                                                                        230
                                                                                        209
CeresClone-833872       GSPYPPVHN SGSTGPHSYT GTMASWTYPR -GSFIPSPRW QSPSNYTPMI
CeresClone-1579587      GSI-VYSPGQS ATSPGHHAYQ GAVTSWPLSR SASFIASPRW PGHSSYAQVI
Lead-CeresClone-149496  GMSSFPAADL RYASGLTMMS ---------- --TYGTLPRP QVPQSYVPIL 296
                                                                                        277
                                                                                        239
CeresClone-833872       VPI--QGLVQV PNWNSYPGQM VPVSSPESRL QSPGAQQYYG TSRQ-GEASA
CeresClone-1579587      VPI--PGLVQV PGWSPYAAQI GSSSS-DDQQ RTPGAAQYYT GSRQSGTPGI
Lead-CeresClone-149496  VSPSQGFLPP QGWAPYMAAS NSMYNVKNQP ---------- ----------
```

Figure 92 (continued)

```
CeresClone-833872      GNQGMQSPYR  SSSFPAPQYA  LQRENVFPER  PDQPECLYYI  KTGDCKFGAV   346
CeresClone-1579587     GDRGMFSSYQ  AGSVPVGLYA  VQTENVFPER  PDQPECQFYM  KTGDCKFGSV   327
Lead·CeresClone-149496 -------YY   SGSSASMAMA  VALNRGLSES  SDQPECRFFM  NTGTCKYGDD   281

CeresClone-833872      CKFHHPRVRS  QPPPDCILSP  MGLPLRPGEE  LCKFYSRYGI  CKFGVNCKFD   396
CeresClone-1579587     CKFHHPRERI  IPTPNCALSP  LGLPLRPGEP  CSFYNRYGM   CKFGPNCKFH   377
Lead·CeresClone-149496 CKYSHPGVRI  SQPPSLINP   LVLPARPGQP  ACGNFRSYGF  CKFGPNCKFD   331

CeresClone-833872      HPMAAPMGVY  AYGYSASASP  NAPMGRRLLE  -----SP     -SGSAYAS--   435
CeresClone-1579587     HPMGNPM---  -YGHASSPTS  EAQTSRRMLA  HVPSHPEVSP  DSGSGRSRR    423
Lead·CeresClone-149496 HPMLPYPGLT  MATSLPTPFA  SPVTTHQRLS  PTPNRSDSKS  LSNGKPDVKK   381

CeresClone-833872      ----------  VHSDSQQIPS  VERITEREAS  ---         435
CeresClone-1579587     ESSETEKPDN  GEVQDLSEDA  ---         443
Lead·CeresClone-149496                         SSP         404
```

Figure 93 (continued)

```
Lead-cDNA-ID23358452   QSKKTEYAVT  MQQYNMELAN  GNKT-TGDDE  ----------  ------KQE   120
CeresClone:873113      ETKKTEYTKT  MQKYNMKLAN  GTST-AGDDD  SDKSKSEVND  EAEGA--SEE  136
CeresClone:956177      ETKKTEYAKT  MQKYNMKLAN  GTST-AGDDD  SDKSKSEVND  EEDAA--SDE  135
gi|7446231             EKKKEEYDKS  LAYNRKLEG-  KNP--SEEEK  SDKSKSEVND  EDED----EE  136
CeresClone:686294      EKLKAEYTKK  NAYNNPQAG-  EASG------  SDKSKSEVND  ED------    119
gi|50726318            EKLKAEYTKK  JDAYNNKQAG  GP---ATSGD  SDKSKSEVND  EDECS----   124
gi|2894109             EKRKAEYQKN  MDAYNKKLAA  GD---ADEE-  SDKSKSEVHD  DDEDDDGSEQ  137
gi|1052956             EKRKQEYEKS  MQAYNRKQAC  EA---ADEEE  SDKSRSEVND  DEEDEDCSAE  137
gi|729736              EKRKQEYEKN  LQAYNKKQAA  GA---AEEEE  SDKSRSEVND  DDEDQDGSGE  137
gi|729737              LKKKEEYEKT  LQAYNKKLEG  K----DDEEG  SDKSKSEVND  DEDEE-DEE-  144
CeresClone:1060767     DKRKVEYEKT  MKAYNKKLEE  GPK--EDEEE  SDKSVSEVND  EDDADDGSDE  140
gi|436424              EKRKAEYEKS  MKSYNKKQAE  GPAAVEEEEE  SEKSESEVHD  ENDDEESEE-  149
CeresClone:721511      EKRKVEYEKN  MRAYNKKQAE  GPTG-GDEEE  SEKSVSEVND  DDDEEGSCE-  147
CeresClone:641329      EKRKVEYEKN  MRAYNKKQAE  GPTG-GDEEE  SEKSVSEVND  DDDEEGSGE-  147
CeresClone:782784      EKRKVEYEKN  MRAYNKKQAE  GPTG-GDEEE  SEKSVSEVND  DDDEEGSGE-  147
gi|18645               EKRKVEYEKN  MRAYNKKQAE  GPTG-GDEEE  SEKSVSEVND  EDDDEEGSGE  147
```

```
Lead-cDNA-ID23358452   KAADD------   125
CeresClone:873113      EEDDD------   141
CeresClone:956177      EEDDD------   140
gi|7446231             DQDDE------   141
CeresClone:686294      SEGDE------   124
gi|50726318            --GDE------   127
gi|2894109             EDDD-------   141
gi|1052956             DDDDDDDDE--   146
gi|729736              DDSEDDD----   144
gi|729737              DEDDD------   149
CeresClone:1060767     EEDDE------   145
gi|436424              EEDDE------   154
CeresClone:721511      EEDDD------   152
CeresClone:641329      EEDDD------   152
CeresClone:782784      EEDDD------   152
gi|18645               EEDDD------   152
```

Figure 94

```
CeresClone:212775      MEV LA PAQH  D -GLHA F GP    NPF D  GVGG D   GRI SS LSSL    GGDRF CG----    46
Lead-CeresClone207419  MEKLAASTVT   DLACVTAINS      PPPLSPISE        QSFSNKHQEE     FAASFASLYN      50
gi|12597770            MEKLAASTVT   DLACVTAINS      SPPPLSPISE       QSFNNKHQEE     FAASFASLYN      50

CeresClone:212775      --YS T TASLF   VNS PG LS SSPS   PR AD SLSRGS     SDSGSVVDDG     DDAAATAP S V    94
Lead-CeresClone207419  SIFSPESQFS   PSPPSSSSPP      SRVD----                        --------TT      76
gi|12597770            SIFSPE-SLS   PSPPSSSSPP      SRVD----                        --------TT      75

CeresClone:212775      A ER RL RL ARL  A  QY QE V N R    FELCLSY AD       A  NE AA AL RQ   ENDE L RVA N E   144
Lead-CeresClone207419  TEHRLLQAKL   LEYDELNDH       YELCLNRLQS       MTELDSLRH      ENDSLRFENS     126
gi|12597770            TEHRLLQAKL   LEYDELNEH       YELCLNRLQS       MTELDSLRH      ENDSLRFENS     125

CeresClone:212775      Y  ARR  NV VG  G--------- R    ---------        A DEFS GL RL    A EE HI T PPPL    176
Lead-CeresClone207419  DLLKLI HI ST  SSSSSVSPPA      PIHNRQFRHQ       SDSRSAKRN      NQERNS----     172
gi|12597770            DLLKLI R  ST  SSSSSVSPPA      PIHNRQFRHQ       SDSRSAKRN      NQERNS----     171

CeresClone:212775      SPLPAAPV MP  KSISVRS P GY     LKM Q--NGK       H RA S KPTKG S   R VL VGM E GG V   224
Lead-CeresClone207419  -------LP   KSISVRSQGY      LKINHGFEAS       DRQTSQLSSN     SVLSSQKVCV     214
gi|12597770            -------LP   KSISVRSQGY      LKINHGFEAS       D  QTSQLSSN    SV SSQKVCV     213

CeresClone:212775      K EE EKLNGG L  Q FE VY N QGML    TG L CP Y GN QC   QFAHGI A ELR      274
Lead-CeresClone207419  VQTKGEREAL   ELEVYRQGMM      KTELCNKWQE       TGACCYGDNC     QFAHGIDELR     264
gi|12597770            VQTKGEREAL   ELEVYRQGMM      KTELCNKWQE       TGACCYGDNC     QFAHGIDELR     263
```

Figure 94 (continued)

| | | | | | |
|---|---|---|---|---|---|
| CeresClone:212775 | PVIRHPRYKT | EVCRMVLAGV | VCPYGHRCHF | RHSITPAD-- | --LELPRP | 318 |
| Lead-CeresClone207419 | PVIRHPRYKT | EVCRMIVTGA | MCPYGHRCHF | RHSLTDQERM | MMMMLTR- | 311 |
| gi12597770 | PVIRHPRYKT | EVCRMMVTGA | MCPYGHRCHF | RHSLTDQERM | MMMMLTR- | 310 |

Figure 95

```
Lead-CeresClone20769   ------MFGRH SI P-NNQI G TASASA EDH V ASAT SGH  P DDME IPH    44
CeresClone:477718      MEPSAMY GPS QPLNIPSRI G A ER DGSG- -NE PAVDGHH HHI QYETHAL   48
CeresClone:518521      MEPSAMY GHS QPLSMPSQI G GGESDDGSG- -NE AVDGHH HHI QYETHAL    48

Lead-CeresClone20769   PDSI Y GAASD LI PDG QLVA HR DG SELLV SRPPE GANQL TI SFRGQVYV    94
CeresClone:477718      DDGAAG G AV- VVEDVTSDAV YVSGGGG---- ---PEESSQL TLSFRGQVYV    91
CeresClone:518521      ED---- GAAV- VVEDVTSDAV YVSGGGG---- --- V ESSQL TLSFRGQVYV    88

Lead-CeresClone20769   FDAV GADKVD AVLS LLGGST ELA PG QVME LAQQQN HMPV VEYQS RCSLP   144
CeresClone:477718      FDAVTPDKVQ AVLLLLGGCE LSSGGSPCVD PGAQQNQRGS MEF  PKCSLP   140
CeresClone:518521      FDAVTPDKVQ AVLLLLGGCE LSSGGSPCVD PGAQ NQRGS MEF  PKCSLP   137

Lead-CeresClone20769   QRAQSL DRFR KKRN ARCFEK KVRY G VRQEV ALRMA RNKGQ FTSSK MT DGA   194
CeresClone:477718      QRAASL DRFR QKRKERCFDK KVRYSVRQEV ALRMHRNKGQ FTSSKKQDGA    190
CeresClone:518521      HRAASL RFR  QKRKERCFDK KVRYSVRQEV ALRMHRNKGQ FTSSKKQDGA    187

Lead-CeresClone20769   YN GTDQDSA QDDAHPE SC THCGI SSK T PMMRRGPSGP RTLCNACGLF     244
CeresClone:477718      NSYGTDQDSG QDDSQSETSC KHCGT SSKST PMMRRGPSGP RSLCNACGLF    240
CeresClone:518521      NSYGTDQDSG QDDSQSETSC THCGI SSKST PMMRRGPSGP RSLCNACGLF    237

Lead-CeresClone20769   WANRG L RDL SKK EENQ A LMK PDGGSV ADAANNLNTE AASVEE HI SM    294
CeresClone:477718      WANRGALRDL SKRNQEHSLP PVEQVDGGND PDCRT----- AADPAQNNL      285
CeresClone:518521      WANRGALRDL SKRNQEHSLP PVEQVD GND SDCRT----- A  ADPAHNNL    282
```

Figure 95 (continued)

```
                    VSLANGDNSN  LLGDH ----   309
                    AAFSEPVNPA  LVADRKVFQS  QKMLE  310
                    PAFSEHDNPA  LVADHKVFQS  QKMLK  307

Lead-CeresClone20769
CeresClone:477718
CeresClone:518521
```

Figure 96

```
Annot-ID:1471763      MALKERSPET PKTSSKNPRV AVRSIDTYAA QCDKCLKWRV ATEEEYEEI   50
Lead-CeresClone:21374 MSMK------ ---------- ---------- ---------- -SEVEYKRT  13

Annot-ID:1471763      RSKMEESPFV CNRKPGVSCD DPADIEYNAT RTWVIDRPGI PKTPEGFKRS  100
Lead-CeresClone:21374 R--------F ARRKKVCPVK MLEILNYDSS RTWVIDKPGL PRTPRGFKRS  56

Annot-ID:1471763      LVLRRDFSKM DAYYITPTGK KLRTRNEIAA FIDANPKYKD VNLSDFNFTS  150
Lead-CeresClone:21374 LILRKDYSKM DAYYITPTGK KLKSRNEIAA FIDANQDYXY ALLGDFNFTV  106

Annot-ID:1471763      PKVMEDTIPE DAVRKVSSSG NGNKRKALKD AA                      182
Lead-CeresClone:21374 PKVMEETVPS GILSDRTPKP S---RKVTID --                      133
```

Figure 97

```
CeresClone:637282        MASLGSP--TP--------SSF WCYRCNRLVR V------PQNH AVLLCPDCNS    35
Lead-cDNA:ID23369680     MPS--TPTTP TTTTPITASY WCYSCTRFVS VWADQGTTTV GSVACPHCDG    48
gi|34902106              MAS---SP-- --------VSY WCYHCSRFVR V--------SP STVVCPECDG    31
CeresClone:677852        MAS---SP-- --------VSY WCYHCSRFVR V--------SP ATVVCPDCDG    31

CeresClone:637282        GFLEE----- -------LQT PPHSRRSTR- ---------G GGGSPFNPVI    63
Lead-cDNA:ID23369680     GFIEQNDSS  SAATELTIPA STEVRSINNN RRSVIRRRRS CRRPSFNPVI    98
gi|34902106              GFLEQ----- -------FPQ PPP-RGGGG- ---------S GRRGAMNPVI    58
CeresClone:677852        GFLEQ----- -------FPQ PPPPRGGGG- ---------- GRRGAMNPVI    59

CeresClone:637282        VLRNAN---- ----DVVSPE TRNFELYYND AVSGSSGPSS LRPLPQGVSE   105
Lead-cDNA:ID23369680     VLQGGAGERE EGEEGDAARD RRAFEFYYDD --------SG LRPLPDSVSE   143
gi|34902106              VLRGGS---- ---------- LSGFELYYDD --------DG LRPLPGDVSH    89
CeresClone:677852        VLRGGS---- ---------- LSGFELYYED --------DG LRPLPGDVSH    90

CeresClone:637282        FLMGSGFDNV LDH---LDAA AGGAGALPPT AASKAAIESM PVVKILASHT   152
Lead-cDNA:ID23369680     LMGSGFERL  LEQLSQIEAS ATGLGRSGNP PASKSAIESL PRVEISDCH-   193
gi|34902106              LMGSGFHRL  LDQFSRLEAA A------PRP PASKAAVESM PSVTVA----   129
CeresClone:677852        LMGSGFHRL  LDQFSRLEAA A------PRP PASKAAVESM PSVTVAG---   131

CeresClone:637282        YAESHCAVCM ENFELXCDAR EMPCGHVYHS ECIVPWLSVR NSCPVCRHEV   202
Lead-cDNA:ID23369680     GSEANCAVCT ELFETETEAR EMPCKHLFHD DCIVPWLSIR NSCPVCRFEL   243
gi|34902106              GSGAHCAVCQ EAFEPGASAR EMPCKHVYHQ DCILPWLSLR NSCPVCRREL   179
CeresClone:677852        GGAHCAVCQ  EAFEPGAAAR EMPCKHVYHQ DCILPWLSLR NSCPICRSEL   181
```

Figure 97 (continued)

| | | | | | | | |
|---|---|---|---|---|---|---|---|
| CeresClone:637282 | PSDVEESNN | NTVGLTIWRL | PCGGFAVGRF | IGG--RELPL | VYTEMDGGFN | | 250 |
| Lead-cDNA-ID23369680 | P-------- | ---------- | ---------- | ---------- | ---------- | | 244 |
| gi|34902106 | PAAAPESEA | DA-GLTIWRL | PRGGFAVGRF | AGGPREQLPV | VYTELDGGFS | | 228 |
| CeresClone:677852 | PAAAVPEAEA | DA-GLTIWRL | PRGGFAVGRF | AGGPREQLPV | VYTELDGGFS | | 230 |

| | | | | | | | |
|---|---|---|---|---|---|---|---|
| CeresClone:637282 | GANGVPRRVA | MDSSVGRSRE | NRG-FGAAFR | NVFSYIGRVR | SSEFSRRTRNS | | 299 |
| Lead-cDNA-ID23369680 | ---------- | ---------- | ---------- | ---------- | ---------- | | 244 |
| gi|34902106 | NGVG-PRRVT | WPEGDGHVDG | GEGRIRRVFR | NLF------- | GCFGRSSRPE | | 270 |
| CeresClone:677852 | NGVG-PRRVT | WPEGEGQVDG | GEGRIRRVFR | NLF------- | GCFGRGGRPE | | 272 |

| | | |
|---|---|---|
| CeresClone:637282 | RANGRSRS- | 307 |
| Lead-cDNA-ID23369680 | --------- | 244 |
| gi|34902106 | SSSSQSRSG | 279 |
| CeresClone:677852 | -SSSQSRSG | 280 |

Figure 98

```
gi|34909836        ----------MSS|EQQASA---G QPVLCASGCG FYGNPATLDM CSVCYRQHCL  40
gi|5031281         ----------MEH EETGCQPHPE GPILCVNNCG FFGSVATRNM CSKCHKDMML  43
gi|35187687        ----------MEH KETGCQQ-PK GPILCINNCG FFGSAATMNM CSKCHKEMIM  42
Lead-cDNA-ID23371050 -------MGSEQ NDSTSFS-PS EPKLCVKGCG FFGSPSNMNL CSKCYRDIRA  44
CeresClone:962327  -------MGSEQ NNSTSFP-PT EPKLCDNGCG FFGSPSNMNL CSKCYRS-RA  44
CeresClone:1101577 ----------MA EEHRCQ---- APRFCANNCG FFGSPATQNM CSKCYRDFQL  38
CeresClone:634261  MAQESW-KES EET-VQT-PE APILCVNNCG FFGSSMTNNM CSKCYRDF--  46
gi|34978689        MAQESWKKEA EETGVHT-PE APILCVNNCG FFGSRMTENM CSKCYRDTV-  48 gi|34909836        LNGATMATGP SSSVAAASAA ----TVATG  AVISDSCSVP SAEVNGAAFS  85
gi|5031281         KEEQAKLAAS SFGNIVNGTS NSNGNEPVVA AGVDVQAHLV EPKTISLQPS  93
gi|35187687        KQEQAKLAAS SIDSIVNGGD --SGKEPIIA GHAEVAVAQV EVKTLVAQPA  90
Lead-cDNA-ID23371050 TEEQTASAKA AVEKSLN-PN KPKTQ      PQQSQELTQC VLGSGSSSSS  88
CeresClone:962327  EEDQTAVAKA AVKNSLKLPS CSLIITPEQK QPLETKPASV VVTAEPSSVP  94
CeresClone:1101577 KEEQSSNAKM VLNQSLV-PS ----PPPAV  ISQPSSSS-- SAAVDPSSAV  80
CeresClone:634261  KATTMAAP   VVE------- ----KKVFS  VASSSSVTLE QAKADEV-PA  81
gi|34978689        KAKTVAT    VVEK------ ----KPLAS  LSSTPLMTEV ----TDGGSGS 81 gi|34909836        SKNNPEPATV VEKKAPA--N RCASCKKKVG LLGFACRCGA TYCGTHRYPE  133
gi|5031281         FSFGSGSGGS GEAK-PEGPK RCGTCNKRVG TGFNCRCGS LFCAVHRYSD  142
gi|35187687        EIAGPSEGVT VNPKGREGPN RCSTCRKRVG LIGFNCRCGN LYCAMHRYSD  140
Lead-cDNA-ID23371050 TRGGDSAAAP LDPP-KSTAT RCLSCNKKVG VTGFKCRCCGS TFCGTHRYPE  137
CeresClone:962327  ATGQEEAEP  SKPA-RT--N RCFSCNKKVG VMGFKCKCCGS TFCGSHRYPE  141
CeresClone:1101577 VDDAPRESEE VKAP-QQ--N RCMTCRRRVG LTGFKCRCGM MLCGTHRYPE  127
CeresClone:634261  VAVADSQAAQ EPPKPPS--N RCLSCRKKI  TGFQCRCGG TFCSMHRYAD  129
gi|34978689        VADGKQVMEE DTPKPPS--N RCLSCRKKVG LTGFKCRCGG TFCSMHRYAD  129
```

Figure 98 (continued)

| | | | | |
|---|---|---|---|---|
| gi\|34909836 | KHACGFDFKG | ASRDAI ARAN | PLIKGEKLTN | KI | 165 |
| gi\|5031281 | KHDCPYDYHT | AARDAIV AKAN | PVVKADKL-E | KI | 173 |
| gi\|35187687 | KHDCQFDYRT | AARDAI AKAN | PVVKAEKL-D | KI | 171 |
| Lead-cDNA-ID23371050 | SHECQFDFKG | VAREAI AKAN | PVVKADKV-D | RI | 168 |
| CeresClone:962327 | KXECSFDFKX | VGRDAI AKAN | PVIKADKV-E | RI | 172 |
| CeresClone:1101577 | QHACEFDFKG | MGREQI AKAN | PVVKGEKL-D | KI | 158 |
| CeresClone:634261 | SHECTFDYKK | AGREQI AKQN | PVVIAKKI-N | KI | 160 |
| gi\|34978689 | SHKCTFDYKQ | VGREQI AKQN | PLVKADKI-T | KI | 160 |

```
gi|50253268      TAAAEHHQQQ QQQYGSGSP AADDVSGYPP MEGGIGNDDF MDEEA--FEL   219
CeresClone:707775 DDGGQGLS-- ---------- ---------- ---ERREEY- YEDE--LNM   165
Lead-532H5       ---------- ---------- ---------- ---------- ---SFDL      125
gi|55824656      QECVEAVAVA VADT------ ---------- TTATAQGVFY MEEEEQVLDM   195
gi|37993864      DAKRSENT-- ---------- ---------- --EMEKGFY- ---LFGT      176
gi|41351817      GLDMEETTVE VIV------- ---------- TEEEQSEGFY MDEEA--MFGM  179
gi|66269671      KQENKWTT-- ---------- ---------- -ESAPEDVFY MDEEA--VFAM  190
gi|37147896      SSSTPESM-- ---------- ---------- -------FF MDEEA--LFCM  176
gi|45826359      SENVQESS-- ---------- ---------- -------DF VDEEA--FFM   170
gi|45826360      SENVQESS-- ---------- ---------- -------DF VDEEA--FSM   178
gi|38257023      NTNSNSSS-- ---------- ---------- -------AF SDELSE-VEL   158
gi|33638194      PDGSDDASAG ---------- ---------- SASPPPPPDA ADDA---FDL   175
gi|21908034      EEPAAKDGAA PEEAAADAQA PVPVALPPPA ASRPGTPSSG VEDERQLFDL   240 gi|50253268      PQLLRNMAAG ---------- M--------- MSPPRLSPTT SDVSPEPSEA   251
CeresClone:707775 PNLLDEMARG ---------- Q--------- VSPRI-TSYS SDDSPGNSDG  197
Lead-532H5       RGSGFKLCCG Y--------- ---------- --KSGC----- ----         140
gi|55824656      PELLRNMV-- ---------- M--------- MSPTHC---LG YEYEDADLDA  222
gi|37993864      QRFWANMAAG ---------- M--------- MSPPRSGHDG GWEEHEVDDY  208
gi|41351817      PRLLANMAEG L--------- L--------- LPPPSVQWGH NYDCDGDADV  211
gi|66269671      PGLLTNMAEG L--------- M--------- LPPPPQC-VAG SGGEDGEMDA  221
gi|45826359      PGLLANMAEG L--------- M--------- LPPPPQCAEIG DHVETADADT  208
gi|45826360      PGLLANMAEG L--------- M--------- LPPPPQCAEMG DHCVETDAYM  202
gi|38257023      PALGTSYDGG VGVGGEFVFV ESELESAAWL YQPPWVQSLQ DHYV-ELADV   209
gi|33638194      PDLLDLRYG- ---------- ---------- -PPSSGLSCA EDYDDIDGDG   208
gi|21908034      PDLLDIRDG- F--------- ---------G RFPPMWAPLT SSWEDEVGLI   204
                                                                          DVEDVVNAE L 272
```

Figure 99 (continued)

| | | | | | |
|---|---|---|---|---|---|
| gi\|50253268 | GE------ | ------ | ------ | ---SL WS | YRDP | 261 |
| CeresClone:707775 | D------- | ------ | ------ | ---NL WS | YTL- | 205 |
| Lead-532H5 | -------- | ------ | ------ | -------- | ---- | 140 |
| gi\|55824656 | QDA----- | ------ | ------ | -EV SL WN | F SI- | 234 |
| gi\|37993864 | -------- | ------ | ------ | -V PL WS | Y SI- | 216 |
| gi\|41351817 | -------- | ------ | ------ | ---SL WS | Y--- | 216 |
| gi\|66269671 | ADV----- | ------ | ------ | ---SL WS | F SI- | 231 |
| gi\|37147896 | -------- | ------ | ------ | ---PL WS | Y SI- | 215 |
| gi\|45826359 | -------- | ------ | ------ | -I T L WN | Y SI- | 210 |
| gi\|45826360 | -------- | ------ | ------ | -MPL WN | Y SI- | 220 |
| gi\|38257023 | HAY----- | SNGFKGFV | ------ | -----FD | Y--- | 229 |
| gi\|33638194 | DCGKLGMGFV | FRLEEPL WE | Y--- | 225 |
| gi\|21908034 | SGAGAAAGV | ---EPL WE | ---- | 281 |
| | RLE----- | | | | |

Figure 100

```
Lead-CeresClone25795  MFRSDKAEKM DKRRRRQSKA KASCSEEVSS EWEAVKMSE EEEDLI SRMY  50
CeresClone:1104601    ---------M DRRRRRQSKA KASCSEEVSS EWEAVKMTE EEEDLI SRMY  41

Lead-CeresClone25795  KLVGDRWELI AGRIPGRTPE EIERYWLMKH GVVFANRRRD FFRK  94
CeresClone:1104601    KLVGDRWELI AGRIPGRTPE EIERYWLMKH GVVFANRPRD FVRR  85
```

Figure 101

```
Annot-ID:1486918      MSGSSSSRTD QESGASAARK KFKGVRRRKW GKWVSEIRIP GKQDRLWLGS   50
Lead-CeresClone:26867 ---------- -------MD YRESTGESQS KYKGIRRRKW GKWVSEIRVP GTRDRLWLGS   42

Annot-ID:1486918      YSTPEAAAVA HDIASYCLRG PSSIESLNFP LMLPASVRED MSPKSIQKAA  100
Lead-CeresClone:26867 FSTAEGAAVA HDVAFFCLHQ PDSLESLNFP HLLNPSLVSR TSPRSIQQAA   92

Annot-ID:1486918      SDAGMAIDAQ MILNRVPENE VKFWTASGGV NHGLEIELCE PAGGDHGGNW  150
Lead-CeresClone:26867 SNAGMAIDAG V--------- -------HSTSV NSG------C- ---GDTTTYY  120

Annot-ID:1486918      HGNNTGMREG DISIEDYL-- -----HDHV               168
Lead-CeresClone:26867 ENGADQVEPL NISVYDYLGG                          144
```

Figure 102

```
gi|4519671              MNDDDALTSN WNDI MLDTGI ADAEPKMQYQ EQKQPSNFPV HQGQPLQQVP           50
gi|32470645             ---------- ---------- ---------- ---MDRMYSG G--GDMGYGY              15
CeresClone:677527       ---------- ---------- ---------- ------MFPP GLIHHRTDGP              14
Lead-cDNA:ID23792467    ---------- ---------- ---------- ------MFPS SKKQASTGAA              14
CeresClone:537360       ---------- ---------- ---------- ---MERMFPP KKPSTMNS--              15
gi|4835766              ---------- ---------- ---------- ---MFHA KKPSSMNGSY                14 gi|4519671              TASVETSAIV P--ASSTASG ASSKQRMRWT PELHEAFVEA VNKLGGSERA              98
gi|32470645             ---------- ---ENGVVMT RDPKPRLRWT ADLHDRFVDA VIKLGGPDKA              52
CeresClone:677527       GPGEVPRSG- G--APSLVLT ADPKPRLRWT ADLHERFVDA VAQLGGPEKA              61
Lead-cDNA:ID23792467    NPNDRPMCGQ GGDSGLVLT  TDPKPRLRWT PELHDRFVDA VAQLGGPDKA              64
CeresClone:537360       --HDRPMCVQ G--DSGLVLT TDPKPRLRWT VELHERFVDA VTQLGGPDKA              61
gi|4835766              --ENRAMCVQ G--DSGLVLT TDPKPRLRWT VELHERFVDA VAQLGGPDKA              60 gi|4519671              TPKGVLKLMK VEGLTIYHVK SHLQKYRLAR YKPEALEGS- ---------- NRENIGESFR   137
gi|32470645             TPKSVLRLMG LKGLTLYHLK SHLQKYRLGQ QTKKQNAAEQ ---SKDGS--YL           102
CeresClone:677527       TPKTIMRVMG VKGLTLFHLK SHLQKYRMGK QTGKETPEQ- ---------- ----TAM     108
Lead-cDNA:ID23792467    TPKTIMRVMG VKGLTLYHLK SHLQKFRLGK Q-HKELGDH- ---------- IKDGMRASAL 105
CeresClone:537360       TPKTIMRVMG VKGLTLYHLK SHLQKFRLGK QPHKDFNDHS ---------- TKEGSRASAM 111
gi|4835766              TPKTIMRVMG VKGLTLYHLK SHLQKFRLGK QPHKEYGDHS ----------            110 gi|4519671              -SEKKESSIG DISALDLK-- -TGIEITEAL RLQMEVQKQL HEQLEIQRNL               183
gi|32470645             QFSLH-SSGP SITSSMDGM  QGEAPISEAL RCQIEVQKRL HEQLEVQQKL               151
CeresClone:677527       DAQGGMSLSP RVSTQDAK-- EISQEVKEAL RAQMEVQRSL HEQLEVQKHV               155
Lead-cDNA:ID23792467    EMQRSVASSS GMIARSMN-- DRSVNNEAL  RIQMEVQRRL HGELEVQKHL               153
CeresClone:537360       ELQRNIASSS AMIGRNMN-- ---------- EMQIEVQRRL HEQLEVQKHF                149
gi|4835766              DIQRNVASSS GMMSRNMN-- DNSHQVG-L  RMQMEVQRRL HEQLEVQRHL               157
```

Figure 102 (continued)

```
gi|4519671        ----------  QLRI EAQGRY  LQEMFERQCK  SI PSTDLVKA  SSSI AED---  ----------  220
gi|32470645       ----------  QMRI EAQGKY  LQAI LDKAQK  SLSTDMNSPS  AVDETRAQLT  DF--------  193
CeresClone:677527 ----------  DI RMDATTY   NTLLEKACK   I VSEQF---A  SSGFSVS---  ----------  189
Lead-cDNA:ID23792467 -------  QMRVEAQGKY  MQSI VEKATQ  ALGSSDCATW  PAGYRTL---  GSQGVLDI GT  200
CeresClone:537360 ----------  QLRI EAQGKY  MQSI LEKAYQ  TLAGENMASA  ATNLKSA-VP  HHQGI PDMGV  199
gi|4835766        ----------  QLRI EAQGKY  MQSI LERACQ  TLAGENMAAA  TAA--AAVGG  CYKGNLGSSS  205 gi|4519671        ----------  ----------  ---ASAQSTDA  VQRSSNKNDP  AVPPSN----  ----------  244
gi|32470645       ----------  ----------  ---MHGHNGDE  TSAGERTQDD  TNK-------  ----------  224
CeresClone:677527 ----------  ----------  GI MCGTATD-  ----------  ----------  ----------  208
Lead-cDNA:ID23792467 -------  DQSL PEL SSG  QCFYGGSSHM  DQLLHQMERP  M---DGFL--  ----------  236
CeresClone:537360 S--------   STSFSSVQDL  EN YGG---NQ  PLQQNMEKP   SLDHGFM---  ----------  241
gi|4835766        VMKEFGS---  PLGFSSFQDL  -N YGNTTDQ   MLDHHNFHHQ  NI ENHFTGNN  ----------  254
                  LSAAVGPPPH  PLSFPPFQDL gi|4519671        POEAGDYI--  ----------  ----------  ----------  ----------  ----------  253
gi|32470645       DLQRSLYL--  ----------  ----------  ----------  ----------  ----------  233
CeresClone:677527 ALSSSVFF--  ----------  ----------  ----------  ----------  ----------  215
Lead-cDNA:ID23792467 TL GESCFI GS  ADNKKDPNNH  CSSSS-GKSSM  MWAS----EE  QQAKSGN---  ----------  278
CeresClone:537360 PL NESLCL G-  ---KKRSNNP  YSGS-GKNPL  WSDDLRLQD   LGGPASSCLG  ----------  286
gi|4835766        AADTNI YLG-  ---KKRPNPN  FGNDVRKGLL  MWSD-----QD  HDLSANQSI D  ----------  296 gi|4519671        ----------  ----EGEQ--  QKVGEKQK--  ----------  ----------  -----E QEREDL GNLE  272
gi|32470645       ----------  ---HQ-----  KKI MNI KLEE  ----------  ----------  SSYDF GM-S SAALEAKHFS  276
CeresClone:677527 ----------  ----------  LSVSSI NMHS  ----------  ----------  ------P GGKPSPSGME   238
Lead-cDNA:ID23792467 -------  DQ--------  LQMGSSTRME  TSVSF DLNSR  SBYDF GM-S  VTCLYEGAVS GDSMDSKGFE  320
CeresClone:537360 PQDDPFKGDQ QI APPGSLD   GAGI DVMDPV  RGAST DI DP-  MSEI YDSK-P  VLQSEEKKFD  334
gi|4835766        DE--------  HR--------  QI----QMA   THVST DLDS-  LSEI YERK-S  GLSGDEG--N  332
``` gi|4519671
gi|32470645
CeresClone:677527
Lead-cDNA:ID23792467
CeresClone:537360
gi|4835766

Figure 102 (continued)

```
gi|4519671        TNNSSSSNTP PTKRAK DE- ---------- ---------- ----------  291
gi|32470645       NCRLEI---- ---------- ---------- ---------- ----------  282
CeresClone:677527 -GQLL QRSP ---------- ---------- ---------- ----------  255
Lead-cDNA-ID23792467 GSNSRLE MKP EFKRKSSC-- ---------- ---------- ----------  344
CeresClone:537360 ASSMKLE-RP PAQQAPVGSQ R RI----- RMSPMI STGT MAQGRGSPFG  373
gi|4835766        NGGKLLE-RP SPRRSPLSP- M NP----NGG LI QGRNSPFG  367
                                       SPRRAPLQPE
```

Figure 103

```
CeresClone:543289      MAKS-STEKN   GL--KKGPWT   PEEDQKLIDY   QKHGHGKWR   TLPKNAGLKR    47
gi|30575840            MGRAPCCDKT   GLLMKKGPWS   QEEDQKLLDY   QKYGYGNWR   TLPTNAGLQR    50
Lead-cDNA-ID23377150   MARSPCCEKN   GL--KKGPWT   SEEDQKLVDY   QKHGYGNWR   TLPKNAGLQR    48
gi|22795039            MGRAPCCEKN   GL--KRGPWT   PDEDQKLIGY   QKHGYGNWR   TLPKNAELQR    48

CeresClone:543289      CGKSCRLRWA   NYLRPDIKRG   RFSFEEEEA    QLHSVLGNK   WST-AANLPG    97
gi|30575840            CGKSCRLRWT   NYLRPDIKRG   RFSFEEEETI   RLHSILGNK   WSL-AARLPG   100
Lead-cDNA-ID23377150   CGKSCRLRWT   NYLRPDIKRG   RFSFEEEETI   QLHSFLGNK   WSAIAARLPG    98
gi|22795039            CGKSCRLRWT   NYLRPDIKRG   RFSFEEEETI   QLHGILGNK   WSAIAARLPG    98

CeresClone:543289      RTDNEIKNYW   NTHIKKKLLK   MGIDPVTHTP   RLDVIQ-ASI   LNTSLYNSAP   147
gi|30575840            RTDNEIKNYW   NTNIRKRLLR   MGIDPVTHSP   RLQLDLSTI    NSSLCNNSP   150
Lead-cDNA-ID23377150   RTDNEIKNFW   DTNRRHHQQH   MGIDPVTHSP   RLDLLDISSI   LASSLYNSS S   148
gi|22795039            RTDNEIKNYW   NTHIRKRLLR   MGIDPVTHSP   RLDLLDLSSI   LNSPLYDSS-   147

CeresClone:543289      -QFNYPSLS-   ------GIGR   SVINPSHMLG   LLTTLLS---   CQNRNYNPDV   186
gi|30575840            TQMNFSRL--   -------Q     PRFNPE--LLR   FAASLFS--SN   CQSQDFPMQN   187
Lead-cDNA-ID23377150   HHMNMSRLMM   DTNRRHHQQH   PLVNPE--LLK   LATSLFS----   D-T-QDFA PN   184
gi|22795039            -RMNMSRIL-   ------GVQ   PLGDPE--LLR   LATSLLSSQR   ----------   187

CeresClone:543289      LNNNQLSGGS   TLLQNQHQCS   RMQLDSTQAF   QPNQPQVSLQ   ENHIAKSNSN   236
gi|30575840            QITSNNQIPP   PFMQTSVQDV   AVLPD-----   ---LCA----   -DTNLGTSF    223
Lead-cDNA-ID23377150   ----QNQNQ-   -QNQNQ----   IHQANQFQPA   GQEMPACT--   ----------   189
gi|22795039            GHQENHLSSP   QVHQNQNQSL   IHQANQFQPA   GQEMPACT--   ---ATTTPCV   233

CeresClone:543289
gi|30575840
Lead-cDNA-ID23377150
gi|22795039
```

Figure 103 (continued)

```
CeresClone:543289   PLNMEPQVMK TTLENQITPL ATPFSQQNT- PNLWHYNTEG HDSDLPTMAQ  286
gi|30575840         SVHDEVQEFQ QNPAGYGMPS AIT------- ---------G EYVPVLNDGY  257
Lead-cDNA-ID23377150 ---------- ---------- ---------- ---------- ----------  189
gi|22795039         TFSNEAQQMD PNGDQYHST- TTFSPNSQ  VSTHDQWQSN RMGSNLSEDY  283

CeresClone:543289   SSSAMQCFSS PKFNSIYNNL LENQNLCNN- -NEGMPNFNX SSLLSSTPSS  334
gi|30575840         YGSCDQPFVD PTPSSVT--- ---SNF---- QSYCSNSLGF QSIFSTPPSS  297
Lead-cDNA-ID23377150 ---------- -EPCGGS--- ---------- ---------- ----------  195
gi|22795039         YVPAVSYNS  ADNCRGTDLV DPSSEASTFI SNNSNQTFGF ASVLSTPSS  333

CeresClone:543289   SSPI ST LNSS SSLTFVNGTT EDERDTYGSS MLMYNSNGL NDSGLL     380
gi|30575840         PTP-------- STYVNSCSST EDETESYNS MWKFEIPDNL RLNDFM     340
Lead-cDNA-ID23377150 ---------- ---------- ---------- ---------- ----------  195
gi|22795039         PAP-------LNSN STYIN-CSST EDERDSYCSN FLKFEIPD L DVSNFM     375
```

CeresClone:543289
gi|30575840
Lead-cDNA-ID23377150
gi|22795039

Figure 104

```
CeresClone:108509        MD SRRES----KT EASS REKRIYE KDQ MNQ SFI EGL AEEFRLPI TH    44
Lead-CeresClone333416    MESKQ WGKTP QEV GA GGR QV------- ---DI DEEDD LEEFRLPMGH    39
CeresClone:764678        MER PGHGG--- --- GSGGGS KNPPPSG KDE YGGGY DRL DE EVEFRLP RGH    45

CeresClone:108509        RV TENVD ED VEQASL D KI SSSNVGFRLL QKMGWK GKG LGKQEQGI LE    93
Lead-CeresClone333416    RPTENLDTEG LQQASV T QL TASNVGFRLL QKMGWKTGKG LGKNEQGI LE    89
CeresClone:764678        RP ENLDTEG LEQASVDTRL ASSNVGFRLL QKMGWKSGKG LGKNEQGI LE    95

CeresClone:108509        PI KSGI RDRR LGLGKQEEDD YFTAEENI QR KKLDI EI EET EEL AKKREVL   143
Lead-CeresClone333416    PI RAD MRDAK LGVGKQEEDD FFTSEENVQR KKLNI ELEET EEHI KKREVI   139
CeresClone:764678        PI KAGI RDAK LGVGKQEEDD FFTAEDNVQR KRLNVELEET EEHI KKREV T   145

CeresClone:108509        AEREQKI QSD VKEI RKVFYC EL CSKQYR L V MKFE GHLSSY DHNHKKRFKE   193
Lead-CeresClone333416    AERE QK I RSE VKEI QKVFFC NLCNKQYKLA HEFESHLSSY DHNHRKRFKE   189
CeresClone:764678        AEREQKI RSE VKEI QK T FFC SLCNKQYKLA YEFESHLSSY DHNHRKRFKE   195

CeresClone:108509        MKEMH--GAS GRDDRKKREQ QRQEREM T KM ADARKQ HQMQ QSQQE VPENV    241
Lead-CeresClone333416    MREMQS--S SG SRDDRQKREQ QREEKELAKI AQLADAHRKQ QKDKQEKSE T    238
CeresClone:764678        MKEMQSG GSG NRDDRQKREQ QREEKELAK F AQLADAHRKQ QKEKQE QPDI    245

CeresClone:108509        PVSAP A KTT V APLA M DQRK TLKFGF S SKS GII SKSQPT S SL KKPKVA--   289
Lead-CeresClone333416    -- EDAA P KNM AAS NQDQRQ TLKFGFSKMA PI--SKVL VGS ASKKPKVATK   284
CeresClone:764678        SGE QA T SKNL PTPGNQDQRR TLKFGFSKMT PI--SKA P VGS MSKKPKI ATK   293
```

CeresClone:108509
Lead-CeresClone333416
CeresClone:764678

Figure 105

```
Lead-ME-LINE-ME01130    ------MGRTTWF  DVDGLRKGEW  TAEEDRKLVV  YINEHGLGEW   37
CeresClone:975220       MNVAVIGLVG  LRKMGRKTWV  DGDGMKKGEW  TAEEDQNLVA  YINEHGVSDW   50

Lead-ME-LINE-ME01130    GSLPKRAGLQ  RCGKSCRLRW  LNYLRPGIKR  GKFTPQEEEE  IKYHALLGN    87
CeresClone:975220       RSLPKRAGLQ  RCGKSCRLRW  LNYLRPGIKR  GKFTPQEEEE  IKLHAVLGN   100

Lead-ME-LINE-ME01130    RWAAIAKQMP  NRTDNNIKNH  WNSCLKKRLA  KKGIDPMTHE  PTTTTSLTVD  137
CeresClone:975220       RWAAIAKEMD  NRTDNDIKNH  WNSCLKKRLS  RKGIDPMTHE  PIINNLTVT   149

Lead-ME-LINE-ME01130    VTSSTTSSP   TPSPTSSSFS  SCSSTGSARF  LNKLAAGISS  RKHGLESIKT  187
CeresClone:975220       TNEECGSSS   ITFSPTS--   -SPSGSACX   LNKLATGISX  RQHDLDKIKS  195

Lead-ME-LINE-ME01130    VILAEQPREA  VDEEKMMTIN  MKEKELISCY  MEIDETMSID  ELPCDDSTSG  237
CeresClone:975220       LLEPRIASS   DQDEKE----E VKRDXXIGGG  EEGDDFLIWD  ----DEEVRR  238

Lead-ME-LINE-ME01130    FVAFDDYSLI  DPYRDSVYVS  DFYDETEHLD  LFLL   271
CeresClone:975220       FMESDEME--  -YGTTPYVS   XFYESTHVLD  DLL-   267
```

Figure 106

```
                         MGVV- - - - - - - - - - - -GSGAQ  LAYGSNPYQP GQITGPPGSV  VTSVGTIQST   39
CeresClone:573215        MDHQGHSQNP SMGVVGSGAQ  LAYGSNPYQP GQITGPPGSV  VTSVGTIQST   50
CeresClone:474481        MDQQ- - - - - - - - - -GQSSA  MNYGSNPYQT NAMTTTPT- -              27
Lead-CeresClone36272     - - - - - - - - - - - - - - - - -  - - - - - - - - - -  - MSTTAATV - - - - - - - - - -    8
gi|1922964               MDQQDH- - - -GQSGA  MNYGTNPYQT NPMSTTAATV - - - - - - - - - -   31
gi|6289057               MDQQDH- - - -GQSGA  MNYGTNPYQT NPMSTTAATV - - - - - - - - - -   31
CeresClone:1911          MDQQDH- - - -GQSGA  MNYGTNPYQT NPMSTTAATV - - - - - - - - - -   31
gi|23505813

CeresClone:573215        - - PAGAQLGQ HQLAYQH- H- -  QQQHQLQQQ  LQQFWSNQYQ EIEKVTDFKN   86
CeresClone:474481        GQPAGAQLCQ HQLAYQH- H- -  QQQHQLQQQ  LQQFWSSQYQ EIEKVTDFKN   99
Lead-CeresClone36272     - - - - -GSDHP- AYHQI H- -  QQQQQLTQQ  LQSFWETQFK EIEKTTDFKN   68
gi|1922964               - - - - AGGAAQP GQLAFHQI HQ   QQQQQLAQQ  LQAFWENQFK EIEKTTDFKN   55
gi|6289057               - - - - AGGAAQP GQLAFHQI HQ   QQQQQLAQQ  LQAFWENQFK EIEKTTDFKK   78
CeresClone:1911          - - - - AGGAAQP GQLAFHQI HQ   QQQQQLAQQ  LQAFWENQFK EIEKTTDFKN   78
gi|23505813              - - - - AGGAAQP GQLAFHQI HQ   QQQQQLAQQ  LQAFWENQFK EIEKTTDFKN   78

CeresClone:573215        HSLPLARIKK MKADEDVRM  SAEAPVIFA  RACEMFILEL TLRSWNHTEE  136
CeresClone:474481        HSLPLARIKK MKADEDVRM  SAEAPVIFA  RACEMFILEL TLRSWNHTEE  149
Lead-CeresClone36272     HSLPLARIKK MKADEDVRM  SAEAPVVFA  RACEMFILEL TLRSWNHTEE  118
gi|1922964               HSLPLARIKK MKADEDVRM  SAEAPVVFA  RACEMFILEL TLRSWNHTEE  105
gi|6289057               HSLPLARIKK MKADEDVRM  SAEAPVVFA  RACEMFILEL TLRSWNHTEE  128
CeresClone:1911          HSLPLARIKK MKADEDVRM  SAEAPVVFA  RACEMFILEL TLRSWNHTEE  128
gi|23505813              HSLPLARIKK MKADEDVRM  SAEAPVVFA  RACEMFILEL TLRSWNHTEE  128
```

Figure 106 (continued)

```
CeresClone:573215      NKRRTLQKND PADALPYCYM AAAITRTDI FDFLVDIVPR EDLKDEVLAS PRGTMPVAG   186
CeresClone:474481      NKRRTLQKND PADALPYCYM AAAITRTDI FDFLVDIVPR EDLKDEVLAS PRGTMPVAG   199
Lead-CeresClone36272   NKRRTLQKND TAAGYPYGYL AAAVTRTDI FDFLVDIVPR EDLRDEVLG- ---GVGAEAA  164
gi|1922964             NKRRTLQKND -AAGYPYGYL AAAVTRTDI FDFLVDIVPR EDLRDEVLGS PRGTVPEAA   155
gi|6289057             NKRRTLQKND -AAGYPYGYL AAAVTRTDI FDFLVDIVPR EDLRDEVLGS PRGTVPEAA   178
CeresClone:1911        NKRRTLQKND -AAGYPYGYL AAAVTRTDI FDFLVDIVPR EDLRDEVLGS PRGTVPEAA   178
gi|23505813            NKRRTLQKND -AAGYPYGYL AAAVTRTDI FDFLVDIVPR EDLRDEVLGS PRGTVPEAA   178

CeresClone:573215      PADALPYCYM PPQHASQVGA AGVIMGKP-- VMDPNMYAQQ SHPYMAPQMW   234
CeresClone:474481      PADALPYCYM PPQHPSQVGA AGVIMGKP-- VMDPNMYAQQ SHPYMAPQMW   247
Lead-CeresClone36272   TAAGYPYGYL PPGTAP---- PGMVMGNP-LG AYPPN----- --PYMGQPMW  205
gi|1922964             -AAGYPYGYL PAGTAP---- PGMVMGNPGG AYPPN----- --PYMGQPMW  196
gi|6289057             -AAGYPYGYL PAGTAP---- PGMVMGNPGG AYPPN----- --PYMGQPMW  219
CeresClone:1911        -AAGYPYGYL PAGTAP---- PGMVMGNPGG AYPPN----- --PYMGQPMW  219
gi|23505813            -AAGYPYGYL PAGTAP---- PGMVMGNPGG AYPPN----- --PYMGQPMW  219

CeresClone:573215      PQPPDQRQSS PEH   247
CeresClone:474481      PQPPDQRQSS PEH   260
Lead-CeresClone36272   QQPGPE-QQD PDN   217
gi|1922964             QQQAPD-QPD QEN   208
gi|6289057             QQQAPD-QPD QEN   231
CeresClone:1911        QQQAPD-QPD QEN   231
gi|23505813            QQQAPD-QPD QEN   231
```

FIGURE 107

| | | | | | | | |
|---|---|---|---|---|---|---|---|
| SEQ·ID·NO·2055·GI·37991859 | ------ | ---- | ---- | MDG--- | ------ | ------ | AAAAAEDGKVL | HAFQTSFVQV | QSLLDQNRVL | 37 |
| SEQ·ID·NO·1585·CDNA·23814706 | ------ | -G-- | ETTLSGFGGA | -MEG--- | ------ | ------ | GAPGVDTKVL | HAFQTSFVQV | QTLLDQNRLL | 44 |
| SEQ·ID·NO·2054·CLONE·327449 | ------ | -GDG | ETTLSGFG-- | MEGGDG | ------ | ------ | -VGGVDTKVL | HAFQTSFVQV | QTLLDQNRLL | 43 |
| SEQ·ID·NO·2053·CLONE·476445 | ------ | ---- | DTFGELG--- | MDG--- | ------ | ------ | NSTQVDSRLL | QVFQKSL-QA | QDILNDQNRLL | 40 |
| SEQ·ID·NO·2052·CLONE·1066463 | MESRMEG | ---- | DVFSGFG-- | ------ | ------ | ------ | ERYQMDGKVL | QNFQKSFVQV | QDILDQNRLL | 44 |
| SEQ·ID·NO·2046·CLONE·1349 | -MEG-- | ---- | DVLSGFG-- | ------ | ------ | ------ | DRHNMDGKLL | QSFQKSFVDV | QDILDQNRLL | 40 |
| SEQ·ID·NO·2051·CLONE·1099781 | -MEG-- | ---- | DVFSGFG-- | ------ | ------ | ------ | ERHNMDXKLL | QSFQKSFVDV | QDILDXNRLX | 40 |

| | | | | | | | |
|---|---|---|---|---|---|---|---|
| SEQ·ID·NO·2055·GI·37991859 | NEINQNHES | KVPGDLSRNV | GLIRELNNNI | RRVVDLYADL | SSLFAASSP- | 86 |
| SEQ·ID·NO·1585·CDNA·23814706 | NEINHNHES | KVPGDLSRNV | GLIRELNNNI | RRVVDLYADL | SSLFAAADGG | 94 |
| SEQ·ID·NO·2054·CLONE·327449 | SEINHNHES | KVPGDLSRNV | GLIRELNSNI | RRVVDLYADL | SSLFAASDG- | 92 |
| SEQ·ID·NO·2053·CLONE·476445 | NEINQNHES | KMPDNLSRNV | GLIRELNNNI | RRVVDLYADL | SNSFTKSRE- | 89 |
| SEQ·ID·NO·2052·CLONE·1066463 | NEINQNHES | KQADHLGRNV | GLIRELNNNI | RTVASLYGDL | SHSFAKSID- | 93 |
| SEQ·ID·NO·2046·CLONE·1349 | NEINQNHES | KQPDNLGRNV | GLIKELNNNI | RRVASLYGDL | SHSFARSVD- | 89 |
| SEQ·ID·NO·2051·CLONE·1099781 | NEINQNHES | KQPDNLGRNV | GLIKELNNNI | RRVASLYGDL | SHSFARSMX- | 89 |

| | | | | | |
|---|---|---|---|---|---|
| SEQ·ID·NO·2055·GI·37991859 | -GPAASEGAS | VGTAVRH--- | AGHKRVRSTH | LD | 114 |
| SEQ·ID·NO·1585·CDNA·23814706 | GGRAASEGGS | VGT-VRHQAG | AGHKRIRSG- | LD | 124 |
| SEQ·ID·NO·2054·CLONE·327449 | -ASEGGS | VGT-VRQAGA | AGHKRIRSG- | LD | 118 |
| SEQ·ID·NO·2053·CLONE·476445 | -ASEGDS | SGT-LKSDGK | VNQKRIRSS- | -- | 114 |
| SEQ·ID·NO·2052·CLONE·1066463 | -ASEGES | TGT------- | NNQKRFRSG- | -- | 112 |
| SEQ·ID·NO·2046·CLONE·1349 | -ASEGES | SGT-LKSDGK | ANQKRFRSG- | -- | 114 |
| SEQ·ID·NO·2051·CLONE·1099781 | -ASEGES | SGT-LKSDGK | XXQKRFRSG- | -- | 114 |

Figure 108

```
Lead-CeresClone:41439    MALEAMNTPT  SSFTRI ETKE  DLMNDAVFIE  P---------  MLKRKRSKRQ   41
CeresClone:701379        MAVEAVLEAA  TMI PSPPSKE  MEASSST SEE  ASALLGQAEG  WSKRKRSRRQ   50
CeresClone:638614        MALET LNSPT  TAPSFPFDD    PT P------  ----------  WAKRKRSKRC   34

Lead-CeresClone:41439    RSHSPSSSSS  SPPRSRPKSQ  NQDLTEEEYL  ALCLLMLAKD  QPSQTRFHQQ   91
CeresClone:701379        RAL DPS---  ----------  -----EEEYL  ALCLLMLAHC  ------H--   72
CeresClone:638614        SRDHPS----  ----------  -----EEEYL  ALCLI MLARG  ------GTT   58

Lead-CeresClone:41439    SQSLTPPPES  KNLP------Y  KCNVCEKAFP  SYQALGGHKA  SHRI KPPTV  136
CeresClone:701379        -RDSAPAAAP  EQQ-------H  GCSVCGKVFA  SYQALGGHKA  SHR--KPTAA  113
CeresClone:638614        RRVSTPPPQP  TPDPSTKLSY   KCSVCNKSFP  ALCLI MLARG  SHR----KLA  104

Lead-CeresClone:41439    STI ADDS---  ---TAPTISL V  AGEKHPI AAS  GKI HECSI CH  KVFPTGQALG  181
CeresClone:701379        PAGAEDQKPL  AAVAAASSSG  SGEAAVSAGG  GKVHECNVCR  KTFPTGQALG  163
CeresClone:638614        ASGGEDQ---  -----PTTTSS  AASSANTASG  GRTHECSI CH  KSFPTGQALG  147

Lead-CeresClone:41439    GHKRCHYEGN  I GGGGGGGSK   SI -SHSGSVS  STVSEERSHR   GFI DLNL PAL  230
CeresClone:701379        GHKRCHYDGT  I GSAAAAGPTQ  KL-AAKAAAAA  SATAASQG--   --FDLNL PAL  208
CeresClone:638614        GHKRCHYEGN  SNGNNNNSNS   SVI TAASEGVG  STHTVSFGHH   RDFDLNI PAF  197

Lead-CeresClone:41439    PELSL HHNPI   VDE-EI LSPL  TGKKPLLL TD  HDQVI KEDL   SL KI         273
CeresClone:701379        PDI PERCAVT   EDGEEVLSPA  SFKKPRLM--  ---VI KPK I   LAA          239
CeresClone:638614        PDFSTK I--VG  EDEVESPHPV   -MKKPRPF--  ---VI EI      PQYQ         233
```

Figure 109

```
                                                                                    50
Lead-CeresClone42530  MAGMASDGTQ YDPRQFDTKM NALGEEGEE TFYTNYDEVC DSFDAMELQP          50
CeresClone:30700      MAGSAPEGTQ FDARQFDQKL NEVL--EGQD EFFTSYDDVH ESFDAMGLQE          48
gi|19698881           MAGSAPEGTQ FDARQFDQKL NEVL--EGQD EFFTSYDDVH ESFDAMGLQE          48
gi|25809054           MAGVAPEGSQ FDAKQFDLKM NELLT-EGQD -FYTYEEVY DSFDAMGLQE           49
gi|2119932            MAGAAPEGSQ FDARQYDSKM TELLNAEGQE -FFTSYDEVY HSFDAMGLQE          49
gi|19697              MACSAPEGSQ FDARQFDAKM TELLGTEQEE -FFTSYDEVY DSFDAMGLQE          49
gi|475216             MAGLAPEGSQ FDARQYDAKM TELLGTEQEE -FFTSYDEVY DSFDAMGLQE          49
gi|2119933            MAGLAPEGSQ FDARQYDAKM TELLGTEQQE -FFTSYDEVY DSFDAMGLQE          49

100
Lead-CeresClone42530  DLLRGIYAYG FEKPSAIQQR GIIPFCKGLD VIQQAQSGTG KTATFCSGVL          100
CeresClone:30700      NLLRGIYAYG FEKPSAIQQR GIVPFCKGLD VIQQAQSGTG KTATFCSGVL          98
gi|19698881           NLLRGIYAYG FEKPSAIQQR GIVPFCKGLD VIQQAQSGTG KTATFCSGVL          98
gi|25809054           NLLRGIYAYG FEKPSAIQQR GIVPFCKGLD VIQQAQSGTG KTATFCSGIL          99
gi|2119932            NLLRGIYAYG FEKPSAIQQR GIVPFCKGLD VIQQAQSGTG KTATFCSGVL          99
gi|19697              NLLRGIYAYG FEKPSAIQQR GIVPFCKGLD VIQQAQSGTG KTATFCSGVL          99
gi|475216             NLLRGIYAYG FEKPSAIQQR GIVPFCKGLD VIQQAQSGTG KTATFCSGVL          99
gi|2119933            NLLRGIYAYG FEKPSAIQQR GIVPFCKGLD VIQQAQSGTG KTATFCSGVL          99

150
Lead-CeresClone42530  QQLDISLVQC QALVLAPTRE LAQQIEKVMR ALGDYLGVKA QACVGGTSVR          150
CeresClone:30700      QQLDFSLIQC QALVLAPTRE LAQQIEKVMR ALGDYLGVKV HACVGGTSVR          148
gi|19698881           QQLDFSLIQC QALVLAPTRE LAQQIEKVMR ALGDYLGVKV HACVGGTSVR          148
gi|25809054           QQLDYSVTEC QALVLAPTRE LAQQIEKVMR ALGDYLGVKV HACVGGTSVR          149
gi|2119932            QQLDYELLEC QALVLAPTRE LAQQIEKVMR ALGDYLGVKV HACVGGTSVR          149
gi|19697              QQLDYSLVEC QALVLAPTRE LAQQIEKVMR ALGDYLGVKV HACVGGTSVR          149
gi|475216             QQLDYSLVEC QALVLAPTRE LAQQIEKVMR ALGDYLGVKV HACVGGTSVR          149
gi|2119933            QQLDYSLVEC QALVLAPTRE LAQQIEKVMR ALGDYLGVKV HACVGGTSVR          149
```

Figure 109 (continued)

| | | | | | | |
|---|---|---|---|---|---|---|
| Lead-CeresClone42530 | EDQRVLQSGV | HVVVGTPGRV | FDLLRRQSLR | ADAI KMFVLD | EADEMLSRGF | 200 |
| CeresClone:30700 | EDQRI LQAGV | HVVVGTPGRV | FDMLKRQSLR | ADNI KMFVLD | EADEMLSRGF | 198 |
| gi|19698881 | EDQRI LQAGV | HVVVGTPGRV | FDMLKRQSLR | ADNI KMFVLD | EADEMLSRGF | 198 |
| gi|25809054 | EDQRI LSSGV | HVVVGTPGRV | FDMLRRQSLR | PDYI KMFVLD | EADEMLSRGF | 199 |
| gi|2119932 | EDQRI LSSGV | HVVVGTPGRV | FDMLRRQSLR | PDHI KMFVLD | EADEMLSRGF | 199 |
| gi|19697 | EDQRI LQSGV | HVVVGTPGRV | FDMLRRQSLR | PDHI KMFVLD | EADEMLSRGF | 199 |
| gi|475216 | EDQRI LQSGV | HVVVGTPGRV | FDMLRRQSLR | PDHI KMFVLD | EADEMLSRGF | 199 |
| gi|2119933 | EDQRI LQSGV | HVVVGTPGRV | FDMLRRQSLR | PDNI KMFVLD | EADEMLSRGF | 199 |

| | | | | | | |
|---|---|---|---|---|---|---|
| Lead-CeresClone42530 | KDQI YDI FQL | LPSKVQVGVF | SATMPPEALE | TRKFMNKPV | RI LVKRDELT | 250 |
| CeresClone:30700 | KDQI YDI FQL | LPPKI QVGVF | SATMPPEALE | TRKFMSKPV | RI LVKRDELT | 248 |
| gi|19698881 | KDQI YDI FQL | LPPKI QVGVF | SATMPPEALE | TRKFMSKPV | RI LVKRDELT | 248 |
| gi|25809054 | KDQI YDI FQL | LPSKI QVGVF | SATMPPEALE | TRKFMNKPV | RI LVKRDELT | 249 |
| gi|2119932 | KDQI YDI FQL | LPPKI QVGVF | SATMPPEALE | TRKFMNKPV | RI LVKRDELT | 249 |
| gi|19697 | KDQI YDI FQL | LPPKI QVGVF | SATMPPEALE | TRKFMNKPV | RI LVKRDELT | 249 |
| gi|475216 | KDQI YDI FQL | LPPKI QVGVF | SATMPPEALE | TRKFMNKPV | RI LVKRDDVT | 249 |
| gi|2119933 | KDQI YDI FQL | LPPKI QVGVF | SATMPPEALE | TRKFMNKPV | RI LVKRDELT | 249 |

| | | | | | | |
|---|---|---|---|---|---|---|
| Lead-CeresClone42530 | LEGI KQFYVN | VDKEEWKLET | LCDLYETLAI | TQSVI FVNTR | RKVDWLTDKM | 300 |
| CeresClone:30700 | LEGI KQFYVN | VEKEEWKLET | LCDLYETLAI | TQSVI FVNTR | RKVDWLTDKM | 298 |
| gi|19698881 | VEGI KQFYVN | VEKEEWKLET | LCDLYETLAI | TQSVI FVNTR | RKVDWLTDKM | 298 |
| gi|25809054 | LEGI KQFYVN | VDKEEWKLET | LCDLYETLAI | TQSVI FVNTR | RKVDWLTDKM | 299 |
| gi|2119932 | LEGI KQFYVN | VDKEEWKLET | LCDLYETLAI | TQSVI FVNTR | RKVDWLTDKM | 299 |
| gi|19697 | LEGI KQFYVN | VDKEEWKLET | LCDLYETLAI | TQSVI FVNTR | RKVDWLTDKM | 299 |
| gi|475216 | LEGI KQFYVN | VDKEEWKLET | LCDLYETLAI | TQSVI FVNTR | RKVDWLTDKM | 299 |
| gi|2119933 | LEGI KQFYVN | VDKEEWKLET | LCDLYETLAI | TQSVI FVNTR | RKVDWLTDKM | 299 |

Figure 109 (continued)

| | | | | | | |
|---|---|---|---|---|---|---|
| Lead-CeresClone42530 | RSRDHTVSAT | HGDMDQNTRD | IMREFRSGS | SRVLITTDLL | ARGIDVQQVS | 350 |
| CeresClone:30700 | RSRDHTVSAT | HGDMDQNTRD | IMREFRSGS | SRVLITTDLL | ARGIDVQQVS | 348 |
| gi\|19698881 | RSRDHTVSAT | HGDMDQNTRD | IMREFRSGS | SRVLITTDLL | ARGIDVQQVS | 348 |
| gi\|25809054 | RSRDHTVSAT | HGDMDQNTRD | IMREFRSGS | SRVLITTDLL | ARGIDVQQVS | 349 |
| gi\|2119932 | RSRDHTVSAT | HGDMDQNTRD | IMREFRSGS | SRVLITTDLL | ARGIDVQQVS | 349 |
| gi\|19697 | RSRDHTVSAT | HGDMDQNTRD | IMREFRSGS | SRVLITTDLL | ARGIDVQQVS | 349 |
| gi\|475216 | RSRDHTVSAT | HGDMDQNTRD | IMREFRSGS | SRVLITTDLL | ARGIDVQQVS | 349 |
| gi\|2119933 | RGRDHTVSAT | HGDMDQNTRD | IMREFRSGS | SRVLITTDLL | ARGIDVQQVS | 349 |

| | | | | | | |
|---|---|---|---|---|---|---|
| Lead-CeresClone42530 | LVINFDLPTQ | PENYLHRIGR | SGRFGRKGVA | NFMTSEDER | MMADIQRFYN | 400 |
| CeresClone:30700 | LVINFDLPTQ | PENYLHRIGR | SGRFGRKGVA | NFVTRDDER | MLFDIQKFYN | 398 |
| gi\|19698881 | LVINFDLPTQ | PENYLHRIGR | SGRFGRKGVA | NFVTRDDER | MLFDIQKFYN | 398 |
| gi\|25809054 | LVINYDLPTQ | PENYLHRIGR | SGRFGRKGVA | NFVTKDDER | MLFDIQRFYN | 399 |
| gi\|2119932 | LVINYDLPTQ | PENYLHRIGR | SGRFGRKGVA | NFVTKDDER | MLSDIQKFYN | 399 |
| gi\|19697 | LVINYDLPTQ | PENYLHRIGR | SGRFGRKGVA | NSVTKDDER | MLFDIQRFYN | 399 |
| gi\|475216 | LVINYDLPTQ | PENYLHRIGR | SGRFGRKGVA | NFVTKDDER | MLSDIQKFYN | 399 |
| gi\|2119933 | LVINYDLPTQ | PENYLHRIGH | SGRFGRKGVS | NFVTKDDER | MLFDIQKFYN | 399 |

| | | |
|---|---|---|
| Lead-CeresClone42530 | VVVEELPSNV | ADLL | 414 |
| CeresClone:30700 | VVVEELPSNV | ADLL | 412 |
| gi\|19698881 | VVVEELPSNV | ADLL | 412 |
| gi\|25809054 | VLIEELPSNV | AELL | 413 |
| gi\|2119932 | VVIEELPANV | ADLL | 413 |
| gi\|19697 | VVIEELPANV | ADLL | 413 |
| gi\|475216 | VVIEELPANV | ADLL | 413 |
| gi\|2119933 | VVIEELPANV | ADLL | 413 |

Figure 110

```
CeresClone:1360570    MSSEQNNSTS  FPPTEPKLCD  NGCGFFGSPS  NMNLCSKCYR  SLRAEEDQTA   50
Lead-CeresClone45     MGSEENNSTS  FPPTEPKLCD  NGCGFFGSPS  NMNLCSKCYR  SLRAEEDQTA   50
CeresClone:962327     MSSEQNNSTS  FPPTEPKLCD  NGCGFFGSPS  NMNLCSKCYR  SLRAEEDQTA   50

CeresClone:1360570    VAKAAVEKSL  KLPSCNLI TA  PEPKQPLETK  PASLETVVIA  GTSSVPPVAT  100
Lead-CeresClone45     VAKAAVKNSL  KLPSCSLI IA  PGQKHPLEDK  PAHLETVVVT  AEPSSVPVAA   99
CeresClone:962327     VAKAAVKNSL  KLPSCSLI IT  PEQKQPLETK  PA--SVVVT   AEPSSVPIAT   97

CeresClone:1360570    GQDEGEPSKP  TRP-NRCFSC  NKKVGVMGFK  CKCGSTFCGS  HRYPEKHECS  149
Lead-CeresClone45     EQDEAEPSRP  VRPNNRCFSC  NKKVGVMGFK  CKCGSTFCGS  HRYPEKHECS  149
CeresClone:962327     GQEEAEPSKP  ART-NRCFSC  NKKVGVMGFK  CKCGSTFCGS  HRYPEKXECS  146

CeresClone:1360570    FDFKEVGRGA  AKANPVVKA   DKVQRI                              175
Lead-CeresClone45     FDFKEVGRDA  AKANPLVKA   DKVQRI                              175
CeresClone:962327     FDFKXVGRDA  AKANPVIKA   DKVERI                              172
```

Figure 111

```
                                                                                    21
                                                                                    48
                                                                                    50
Lead-CeresClone560731   M------- -------- ----- DSVL ALEL PCL GMSA VFI
CeresClone:4267         MHYTRI SPAL  VPSL SPT --A AAESSDGGTM ATVF MALLL PCVGMCI VFL
CeresClone:1377336      MHYTRI SPI   LPSPPPI TA  TVESSGRGTM ATLF MALLL PCVGMCI VFL 67
                                                                                    98
                                                                                   100
Lead-CeresClone560731   VYMCL WYAT  NHHSDP---- LPAKPVSDTG SPSQLDKLP RITGKDLLM
CeresClone:4267         YLFLL WCST  RRRI ERLRFA EPVKPVAGKG SVLELEKI P KLTGRELAV
CeresClone:1377336      YLFFL WCST  RRRI ERLRFS EPVKL VTGKG SVSELEKLP KLTGKELALE 115
                                                                                   148
                                                                                   150
Lead-CeresClone560731   --GNE CAVCL  DEI GTEQPVR VVPGCNHAFH LECADTWLSK HPL CPLCRAK
CeresClone:4267         ARSTE CAVCL  EDI ESGQSTR LVPGCNHGFH QLCADTWLSN HTVCPVCRAE
CeresClone:1377336      VRSTE CPVCL  ENI ESCQSAR LVPGCNHGFH QLCADTWLSN HTVCPVCRGD 128
                                             163
                                             165
Lead-CeresClone560731   DPSL--FSS SQNPC
CeresClone:4267         LAPNL PQCNE NQSPC
CeresClone:1377336      LAQRV PQL SN NHSPC
```

Figure 112

```
Lead-CeresClone6397  -MSSSDSVNN GVNSRMYFRN PSFSNVI--- NDNWSDLPLS VDDSQDMAY    47
gi|57012876          MYQPISI--- -EFPVYHRT SSFSSLMPCL TDTWGDLPLK VDDSEDMVIY    45
gi|33422111          MDQQLPPTNF PVDFPVYRRN SSFSRLIPCL TEKWGDLPLK VDDSEDMVIY    50

Lead-CeresClone6397  NILRDAVSSA WTP------ ------SMP PVTSPAEEDK PPATKASCSH    83
gi|57012876          GLLSDALTIG WTPFNLTSTE KAEPREEIE PATSPVPSVA PPAETTTA-Q    94
gi|33422111          GLLKDALSVG WSPFNFTAGE VKSEPREEIE SSPEFSPS--- -PAETTAAPA    97

Lead-CeresClone6397  APRQKGMQYR GVRRRPWGKF AAEIRDPKKN GARVWLGTYE TPEDAAVAYD   133
gi|57012876          AVVPKGRHYR GVRQRPWGKF AAEIRDPAKN GARVWLGTYE TAEEAALAYD   144
gi|33422111          AETPKGRHYR GVRQRPWGKF AAEIRDPAKN GARVWLGTYE TAEEAAIAYD   147

Lead-CeresClone6397  RAAFQLRGSK AKLNFPHLIG SCKMEPVRIR PRRR-SPEPS VS----DQL   177
gi|57012876          KAAYRMRGSK ALLNFPHRIG LNEPEPVRLT VKRR-SPEPA SSSISPA-EN   193
gi|33422111          KAAYRMRGSK AHLNFPHRIG LNEPEPVRVT AKRRASPEPA SS----SGN   192

Lead-CeresClone6397  TSEQKRESHV DDGKSSIMVP -----ELDF TVDQFYFDGS LLMDQSECSY   221
gi|57012876          SLPKRRRKAV AAKQAELEVQ SRSNVMQVGC QMEQFPVGEQ LLVS------   237
gi|33422111          GSMKRRRKAV --QKCDGEMA SRSSVMQVGC QIEQLTGVHQ LLVI------   234

Lead-CeresClone6397  SDNRI   226
gi|57012876          -----   237
gi|33422111          -----   234
```

Figure 113

```
CeresClone:763852        -MAMNPLSQE HPNAWPMGVA MYTNL----- ---------- ---HYQQYHY   31
Lead-CeresClone:660003   MSSIHHYS-- -PETTLYWTS DHQQQQQQQQ QQQQAATWL SNSHTPRFNL   47
Annot-ID:1508184         -MSINHFSTD LQETLSWWAQ QHQQQQPIME ---------- ---PNPNQQQ   36

CeresClone:763852        ---------- ---------- ----EKEHLF EKATPSDVG KLNRLVIPKQ   57
Lead-CeresClone:660003   NEPDDEEDDV VVSDKATNNL AQEQEKEAMF EKPLTPSDVG KLNRLVIPKQ   97
Annot-ID:1508184         DETQQEQEVL VL-------- ----DKEPMF EKPLTPSDVG KLNRLVIPKQ   74

CeresClone:763852        HAERCFPL-- -GGDS-GEKG LLLSFDDEAG KPWRFRYSYW TSSQSYVLTK  103
Lead-CeresClone:660003   HAEKYFPLDS SGGDSAAAKG LLLSFEDESG KCWRFRYSYW NSSQSYVLTK  147
Annot-ID:1508184         HAEKYFPL-- -SGDS-VDKG LLLSFEDESG RYWKFRYSYW NSSQSYVLTK  120

CeresClone:763852        GWSRYVKEKH LEAGDVHFE RVRGLGTGDR LFIGC--RRRG DVSAPTAVAP  152
Lead-CeresClone:660003   GWSRYVKDKR LHAGDVVLFH RHR--AHPQR FFISCT RHQP NPNPPAHVS-  194
Annot-ID:1508184         GWSRYVKEKQ LDAGDVVLFE RHR---TDGDR LFIGW-RRRG ESGSNSGVM-  166

CeresClone:763852        PPAVHVVPAS CQSPREQQQH QQPWSPMCYS TSTSYPTSPA TSHAYRRS-A  201
Lead-CeresClone:660003   -----RSS-- S--------- ---------- YS-------- -HHHHHLP-F  216
Annot-ID:1508184         -----VQGS- CGG------- ------VWS RGILYPSSSS GPHHL STANV  196

CeresClone:763852        EHDHSDMHHA GESQWDADTR SCSPASAPTR RLRLFGVNLD CAPE------  245
Lead-CeresClone:660003   PYQPHSLHAP GGGSQGQNET TPXGNSSSGR VIRLFGVNME COPD------  260
Annot-ID:1508184         PYQPYCLHA- --GSJAQNQT TPLGNS---K RLRLFGVNLE CQLDGSEPST  240
```

CeresClone:763852
Lead-CeresClone:660003
Annot-ID:1508184

PEAEAV---  -PATPAMY--  ---GYVHQSP  YAAVSPVPSN  WGSS
NDNDSQNST H ECSYTHLYHH QTSSYPSSNP HHHMLPQQP-  ----
PDGSSVSSLQ GPGHPQFYSQ --SSYSNST  HGQMENLFTY  SH--
```

CeresClone:763852
Lead-CeresClone:660003
Annot-ID:1508184

Figure 114

```
                                                                            49
Annot-ID:1471330        MEQPPYTED  DPTTNSPEAA  TAKTHQNSET  PRGSGTRNPV  YRGVRKRRWG
Lead-CeresClone:681088  MDHQPP---- ----PCPAAA  SA-----TDN  PRG-GTRHPM  YRGVRKRRWG
                                                                            36

99
Annot-ID:1471330        KWVSEIREPR  KKSRIWLGSF  PVPEMAAKAY  DVAAYCLKGC  KAQLNFPDEV
Lead-CeresClone:681088  KWVSEIREPR  KKNRIWLGSF  PVPEMAARAY  DVAAYCLKGR  KAQLNFPDDV
                                                                            86

149
Annot-ID:1471330        DDLPRPSTCT  ARDIQAAAAK  AAHSVLLPTK  KSIETNSDNS  VDGEVADDDF
Lead-CeresClone:681088  DSLPLPSSRT  ARDIQTAAAQ  AAR---MMKAS GNDEKSGIAS  DDGDSGCDDF
                                                                            134

195
Annot-ID:1471330        WGEIELPELL  TSNS---CCW  NSCGWSTTFA  SDSSTWQQD-  -GEGLPQFMA
Lead-CeresClone:681088  WGEIELPELM  DGECYWGCPA  GASSWTSS--  GDLAEWPEEE  LSPQQPSFMA
                                                                            182

CLY        198
Annot-ID:1471330        CL-        184
Lead-CeresClone:681088
```

Figure 115 (continued)

```
Lead-CeresClone:691319   RQRQQRQQQQ  QQQQQPSSLL  QQLYYNAQFA  SLQSPSMLSS  SPSFSSSVSP    399
CeresClone:1475648       ----------  ----------  PRLYDQAPAA  TVPSAASGSA  SSSF------P   277

Lead-CeresClone:691319   APFPLFTTSA  SFPLFSSQQM  GYFQPPESRN  PAGGVPL-EFP  TSTWSDTSSQ   448
CeresClone:1475648       VLFRFGGGGE  SSGAASSQWW  TQGSRSVSQE  GAGSPPASWA   DSAWWPAPPR   327

Lead-CeresClone:691319   PPPSG-       453
CeresClone:1475648       DPPR-        331
```

Figure 116

```
                         RTIYVGNLPG DIRKCEVEDL FYKYGPVDI  DLKIPPRPPG    46
Lead-cDNA-ID23380615     RTIYVGNLPG DIRKCEVEDL FYKYGPVDI  DLKIPPRPPG    46
CeresClone:7559          RTIYVGNLPG DIRKCEVEDL FYKYGPVDI  DLKIPPRPPG    46
CeresClone:541062        RTVYVGNLPG DIREREIEDL FLKYGHTH   DLKVPPRPPG    46
CeresClone:844350        RTIYVGNLPE DIREREVDDL FYKYGPVDI  DLKIPPRPPG    47
gi|521400013             CTIYVGNLPG DIREREVDDL FYKYGRIVEI DLKIPPRPPG    46
gi|521400015             CTIYVGNLPG DIREREVDDL FYKYGRIVEI DLKIPPRPPG    46
gi|521400010             RTIYVGNLPG DIREREVEDL FYKYGRILDI DLKIPPRPPG    46
gi|521400009             RTIYVGNLPG DIREREVEDL FYKYGRILDI DLKIPPRPPG    46
CeresClone:298172        RTIYVGNLPG DIREREVEDL FYKYGRILDI DLKIPPRPPV    49

YAFVEFEDPR DADDAIYGRD GYDFDGCRLR VEIAHGGRRF SPSVDRYSSS   96
Lead-cDNA-ID23380615     YAFVEFEDPR DADDAIYGRD GYDFDGCRLR VEIAHGGRRF SPSVDRYSSS   96
CeresClone:7559          YAFVEFEDPR DADDAIYGRD GYDFDGHRLR VELAHGGRRF SPSVDRYSSS   96
CeresClone:541062        YAFVEFEDAQ DAEDAIYGRD GYDFDGHKLR VEPAHGGRGH SSSKDRHNSH   96
CeresClone:844350        YAFVEFEDAR DADDAIYGRD GYDFDGHRLR VELAHGGKKG -PYFLR-PSS   94
gi|521400013             FAFVEFEDAR DAEDAIYGRD GYNFDGHRLR VELAHGGRG- TSSFDR-SSS   94
gi|521400015             FAFVEFEDAR DAEDAIYGRD GYNFDGHRLR VELAHGGRG- TSSFDR-SSS   94
gi|521400010             YAFVEFEDPR DADDAIYGRD GYNFDGYRLR VELAHGGRGQ SYSYDR-SSS   95
gi|521400009             YAFVEFEDPR DADDAIYGRD GYNFDGYRLR VELAHGGRGQ SYSYDR-SSS   95
CeresClone:298172        YAFVEFEDPR DADDAIYGRD GYNFDGYRLR VELAHGGRGQ SYSYDR-SSS   98

YSAS--RAPS RRSDYRVLVT GLPPSASWQD LKDHMRKAGD VCFSEVFPDR  144
Lead-cDNA-ID23380615     YSAS--RAPS RRSDYRVLVT GLPPSASWQD LKDHMRKAGD VCFSEVFPDR  144
CeresClone:7559          SNGRGGRGAV RRSEYRVLVT GLPSSASWQD LKDHMRKAGD VCFSQVFHDG  146
CeresClone:541062        YSSGRHGAV  RRSDYRVI VT GLPSSASWQD LKDHMRRAGD VCFSDVYPEA  144
CeresClone:844350        YSSAGQRGAS KRSDYRVMVT GLPSSASWQD LKDHMRRAGD VCFTDVYREA  144
gi|521400013             YSSAGORGAS KRSDYRVMVT GLPSSASWQD LKDHMRRAGD VCFTDVYREA  144
gi|521400015             YSSACRGGVS RRSDFRVMVT GLPSSASWQD LKDHMRRAGD VCFSDVYREA  144
gi|521400010             YSSACRGGVS RRSDFRVMVT GLPSSASWQD LKDHMRRAGD VCFSDVYREA  145
gi|521400009             YSSACRGGVS RRSDFRVMVT GLPSSASWQD LKDHMRRAGD VCFSDVYREA  145
CeresClone:298172        YSSACRGGVS RRSDFRVMVT GLPSSASWQD LKDHMRRAGD VCFSDVYREA  148
```

| | | | |
|---|---|---|---|
| Lead-cDNA-ID23380615 | XSRSNS-PVS | PVI SG | 270 |
| CeresClone:7559 | XSRSNS-PVS | PVI SG | 270 |
| CeresClone:541062 | RSPSRSRS | KSLSR | 310 |
| CeresClone:844350 | RSRSL PRSQS | PVKSE | 269 |
| gi|52140013 | ---QCEDLG | IALVG | 253 |
| gi|52140015 | PCWT S HVG | Y FVC | 264 |
| gi|52140010 | --- | --- | 241 |
| gi|52140009 | RSRSA SRSRS | PVRSD | 260 |
| CeresClone:298172 | RSRSA SRSRS | PVRSD | 263 |

Figure 117

```
gi|38260618      ----MAAFEESTD LDA OGHLFE  DFMVSDGFMG DFDFNASFVS GLWCI EPVMN    49
gi|45642990      MGSPQE TCTS    DLI RQHLFD ESLDQT---- CFSFETTQTS NLDDI ASFFN    46
CeresClone:548557 ----MQSI SQSE  QI TDYLIPQ  EVPS------ QFQFPDMSNN NI PMNHTNL-   42
CeresClone:92102  ----MATKQEALA DFI SQHLLT  DFVSM----- ETDHPSLFTN QLHNFHS---    41
CeresClone:965028 ----MASSQDQSA LDI TQHLLT  DFPS------ ---LEITFVS SIHQSIT---    36
gi|40060531      MG-----EEASSI LQLI HHLLLS  DFDSMETFVS HVSHSLRSSA SDSSVSTDDI    47 gi|38260618      QVPKQEPDSP VLDPDSFVKE FLQVE----- -AESSTSTGT TELNSSSQET    93
gi|45642990      ATS-------K  TEYDGFEFE AKRHV----- -IHSNSPKQ- SNLRERKPSL    83
CeresClone:548557 ---------Q-- --MPQIT---  ---------- -SFSKPPRSS SNLSNRKPSL    67
CeresClone:92102  -----------  ---ETGPRT-  ---------- -ITNQSPKPN STLSQRKPPL    66
CeresClone:965028 -----------  ----------  ---------- ---------- ---------- 46
gi|40060531      IQVSEYPKLH EDESNAFLFD  YSTSSPSAVF QFQTESPKP- SRLSHRRPPV    96 gi|38260618      ----DQSISTR  ----------  ----------  ---K--KSKRF EEQEEEEPRH   116
gi|45642990      NVAIPAK----  ----------  ----------  -PVV------V VENVEIEKKH   104
CeresClone:548557 RNITIPSITS  GLTTTMSQTT  TTTIATTMY  NNNQVTSSSD ETNNIKENKH   117
CeresClone:92102  ---PNL-----  ----------  ----------  -SVSRIVSIT  KTEKEEEERH   87
CeresClone:965028 ATISVPTITA  ----------  ----------  -PVV------  -QEDDHRH     65
gi|40060531      SISLPPP----  ----------  ----------  -PISHTPSS-  L--DSGERRH   119 gi|38260618      YRGVRRRPWG  KFAAEI RDPA  KKGSRI WLGT FESDVDAARA YDCAAFKLRG  166
gi|45642990      YRGV-RQRPWG KFAAEI RDPN  RKGTRVWLGT FDTAVDAAKA YDRAAFKLRG   154
CeresClone:548557 YRGVRRRPWG  KYAAEI RDPN  RKGSRVWLGT FDTAI EAAKA YDKAAFKMRG   167
CeresClone:92102  YRGVRRRPWG  KKGAEI RDPN  KKGCRI WLGT YDTAVEACRA YDQAAFQLRG  137
CeresClone:965028 YRGVRRRPWG  KYAAEI RDPN  KKGVRVWLGT FDTAVEAARC YDRAAFKLRG   115
gi|40060531      YRGVRRRPWG  KFAAEI RDPN  RRCSRVWLGT FETAI EAARA YDRAAFKMRG   169
```

Figure 117 (continued)

```
gi|38260618      RKAVLNFPLD AGKYE----- -APANSGRKR KRSDVQCEL Q RS-------        202
gi|45642990      SKAILNFPLE VANF------ -------KQ- -RE QNDETKTETK SSGSKRVRGE        190
CeresClone:548557 SKAILNFPLE IGESEESVSS CIKVGVK-RE REEESKSNNY EKSEF-----        211
CeresClone:92102  RKAILNFPLD VRVTSETCSG EGVICLCKRK RDKSSPEEE KAARVKVEEE        187
CeresClone:965028 SKAILNFPLE AGKHEDN--- -NTVALKSKR KRPETODENH ---------        151
gi|40060531      SKAVLNFPLE AGNMSDS--- -DPPATSIRK REREESEER EQPEIKVLKQ        215 gi|38260618      -QSNSSSSS DGETTCE--- --------- AAAPLTPSSW STIWD--EK- --GIFEVPPL  218
gi|45642990      TEELVIKKER KIEERVLPT AVCPLTPSCM KGFWD---TDV MGTFSVPPL  235
CeresClone:548557 -NNNNNSNKH VKKEECSPK- --------- PVVPLTPSSW MGFWD--VGA CDGIFSIPPL  257
CeresClone:92102  ESNTSETTEA EVE------- --------- EACPLTPSSW MGFWDGVDGI GTGLXSXPPL  228
CeresClone:965028 -GRNLISHKA VIREXTEAQG --------- EASPLTPSSW RTVWE--ERD MDGAFHMPPL  200
gi|40060531      EEASPDSDSP VVAEAANVL- --------- EASPLTPSSW RTVWE--ERD MDGAFHMPPL  262 gi|38260618      SPLSQ----- ------                                              218
gi|45642990      SPLSP----- LVM                                                 244
CeresClone:548557 SPTSP----- LMV                                                266
CeresClone:92102  -----N     FSVISVT                                            241
CeresClone:965028 XPIYPS---XG HXQLGVK                                           214
gi|40060531      TPLSPHPWIG YSRL--S                                             278
```

Figure 118

```
                                                                              46
CeresClone:596510  MASAGYVFRQ  GL----PEVC  AAGKLHVLAV  DDSHVDRKV   ERLLKISSCK   50
Lead:ME05220       MAEVMLPMKM  EMANDPSKFT  SPDLLHVLAV  DDSHVDRKFI  ERLLKVSSCK   50
gi|28466913        MAEVMLPRKM  EILNHSSKFG  SPDPLHVLAV  DDSHVDRKFI  ERLLRVSSCK 96
CeresClone:596510  VTVVESGSRA  LQYLGLDGEK  SSIGLDSVKV  NLIMTDYSMP  GMTGYELLKK  100
Lead:ME05220       VTVVDSATRA  LQYLGLDVNE  KPIGCCKDLKV GCCKDLKV   NLIMTDYSMP  GMTGYELLKK  100
gi|28466913        VTVVDSATRA  LQYLGLDVEE  KSVGFEDLKV  NLIMTDYSMP  GMTGYELLKK 146
CeresClone:596510  KESSVFREV   PVVVMSSENI  LTRIDSCLEE  GAEEFLLKPV  KLSDVKRVTD  150
Lead:ME05220       KESSAFRDV   PVVVMSSENI  LSRIDRCLEE  GAEDFLLKPV  KLSDVRRIRD  150
gi|28466913        KESSAFREV   PVVIMSSENI  LPRIDRCLEE  GAEDFLLKPV  KLSDVKRLRD 196
CeresClone:596510  FIMRGEGMKG  VKISKKRSRS  DDCTPSLSTA  FSSVSHPCDI  SSPPSPTEEI  190
Lead:ME05220       SLIKVEDLSF  TKSINKRELE  TENVYSLDSS  VPLQLKRTKI  ----------  186
gi|28466913        SLMKVEDLSF  TKSIQKRELE  TENVYPVHS-  ---QLKRAKI  ----------
```

FIGURE 119

```
                                                                                          50
                                                                                          50
                                                                                          50
                                                                                          50
                                                                                          50
SEQ·ID·NO·1996·CLONE·727056       MRTICDVCES  AVAVLFCAAD  EAALCRPCDE  KVHMCNKLAS  RHVRVGLADP
SEQ·ID·NO·1995·CLONE·1548279      MRTICDVCES  APAVLFCAAD  EAALCRPCDE  KVHMCNKLAS  RHVRVGLADP
SEQ·ID·NO·1993·GI·52077327        MRTICDVCES  APAVLFCVAD  EAALCRSCDE  KVHMCNKLAR  RHVRVGLADP
SEQ·ID·NO·1994·CLONE·1044645      MRTLCDVCES  AAAILFCAAD  EAALCSACDH  KIHMCNKLAS  RHVRVGLADP
SEQ·ID·NO·1722·CDNA·23498685      MRLCDACES   AAAIVFCAAD  EAALCCSCDE  KVHKCNKLAS  RHLRVGLADP 100
                                                                                          100
                                                                                          100
                                                                                          100
                                                                                          100
SEQ·ID·NO·1996·CLONE·727056       NKLVRCDICE  SSPAFFYCDI  DGTSLCLSCD  MAVHVGGKRT  HGRYLLLRQR
SEQ·ID·NO·1995·CLONE·1548279      NKLVRCDICE  NSPAFFYCEI  DGTSLCLSCD  MTVHVGGKRT  HGRYLLLRQR
SEQ·ID·NO·1993·GI·52077327        NKVQRCDICE  NAPAFFYCEI  DGTSLCLSCD  MTVHVGGKRT  HGRYLLLRQR
SEQ·ID·NO·1994·CLONE·1044645      TDVPRCDICE  NAPAFFYCEI  DGSSLCLQCD  MIVHVGGKRT  HGRYLLLRQR
SEQ·ID·NO·1722·CDNA·23498685      SNAPSCDICE  NAPAFFYCEI  DGSSLCLQCD  MVVHVGGKRT  HRRFLLLRQR 149
                                                                                          145
                                                                                          150
                                                                                          150
                                                                                          129
SEQ·ID·NO·1996·CLONE·727056       VEFPGDKPGH  MDDVAMQOME  SENPRDQNNA  -HSVEKEQMV  NHHHNAYDPA
SEQ·ID·NO·1995·CLONE·1548279      VEFPGDKPGH  MDDVPMEIQD  PENQRDQKKP  P---KEQTA   NHHN-GDDPA
SEQ·ID·NO·1993·GI·52077327        VEFPGDKPGH  MDDVAMQQKD  PENRTDQKKA  PHSVTKEQMA  NHHNVSDDPA
SEQ·ID·NO·1994·CLONE·1044645      AQFPGDKPAQ  MEELELQPMD  QNESRRDESQ  SLKLKTRDSQ  QNHSVSPFPR
SEQ·ID·NO·1722·CDNA·23498685      EFPGDKPNH   ADQLGLRCQK  ASSGRGQES   -----       -----

199
                                                                                          194
                                                                                          199
                                                                                          200
                                                                                          170
SEQ·ID·NO·1996·CLONE·727056       SDGNCNGQGA  DSKMFDLNM   RPARNGQGS   SSQTHGVDHS  HNNHDSSGV
SEQ·ID·NO·1995·CLONE·1548279      TDGNCDDQGN  DSKMIDLNM   RPVRTHGQES  NSQTQGVGLS  -VNNHDSPGV
SEQ·ID·NO·1993·GI·52077327        SDGNCDDQGN  DSKMIDLNM   RPVRTHGQGS  NSQTQGVDVS  -VNNHDSPGV
SEQ·ID·NO·1994·CLONE·1044645      QENNPGHGK   MDRKKLIDLNT RPLRLNGSAP  NNQEQCMDIL  RGNNHESASM
SEQ·ID·NO·1722·CDNA·23498685      NGNGD       HDHNMIDLNS  NPQRVHEPGS  HNQEEGIDVN  NANNHE

SEQ·ID·NO·1996·CLONE·727056       VPTCNYDGAT  DK   211
SEQ·ID·NO·1995·CLONE·1548279      VPTSNSERDT  SK   206
SEQ·ID·NO·1993·GI·52077327        VPTCNFEREA  NK   211
SEQ·ID·NO·1994·CLONE·1044645      PPVESFKQES  EK   212
SEQ·ID·NO·1722·CDNA·23498685                  HE   172
```

Figure 120

```
Lead-cDNA-ID236653450-5109C6    MAGFSLYCFK NPRLFTLPS ESPLFVLGSD KC--SPATRR PSRKTRGFV    48
CeresClone:918824               ----MALLQLH PPPLAALGRS ---VLPC    RP--FPSATA TARRSLASVA   39
gi|50938747                     ----MAP     PPPLAALRPA PFPLPRLLPC PA-------- SAAARRGAVA  35
CeresClone:458156               ----MALQL   PRPLAAARPS ----LLPS   PAHGASASAT PLHARAGGVA  42

Lead-cDNA-ID236653450-5109C6    TYAHSNPKII  NPKKKSRYGQ TLSPY----- DSPEDD----  -DDDDDDDD    88
CeresClone:918824               FSLQTNVRLL  KPNRRSR--R SRYPYYDLDD DEEEED----  -EEYDEDDEE   81
gi|50938747                     FSLQTNVRLL  KPNRRSR--R SRYPYYDHDE DEDDDEAEFE  FEEGEEEED    83
CeresClone:458156               FSLQTNVRLL  KPNRRVR--R SRDPYYDLDE DDEEEA----E FDEDDEDDEE  87

Lead-cDNA-ID236653450-5109C6    DWLNDDEAE  VLEYEKKKPK SHKQTARKS  VKKGVKPEE  SETDEDDLDL    138
CeresClone:918824               -----SEDDLSG LEYLGVLYTN NPRAPNKRAG RKTQLKENW  EGRRPKTRDK   128
gi|50938747                     GYETDDDLSG LEYPGVLYSN NPRAPIKKPG REKPALKQNW  EGRQPKTRDR   133
CeresClone:458156               GYESDDDLSG LEYPGVLYSN SPRASSKKPG LQTPMVKENW  EGRQTKTHDK   137

Lead-cDNA-ID236653450-5109C6    GISPNATSEK KKESW----- ----RLDGRG KMSSRKYVEK LYPRLAEELD   179
CeresClone:918824               HASPGRSNSL QPRSKINRTL LNLTSMNSEV ELKNESISRL FEKLQEEYD    178
gi|50938747                     CDTSKKVDAL HAKSKASRS- TGLVDIDNEV ELKNESISRS  LFQKLQEEYD   182
CeresClone:458156               YGSPGRSKSM HPRSKVGRSS TDLKNMDREV ELKNASISRS  LFQKLQEEYD   187

Lead-cDNA-ID236653450-5109C6    IDPKCVPLLD YLSTFGLKES HFVQMYERHM PSLQINVFSA QERLDYLLSV   229
CeresClone:918824               FDDKWLPLID YLCSFGLRES HFTYIYERHM ACLQINRASA EERLEFLLSV   228
gi|50938747                     FDDKWLPLID YLCTFGLKES HFTNMYERHM ACFQISQASA EERLEFLLSV   232
CeresClone:458156               FDDKWLPLID YLCTFGLKES HFTYIYERHM ACFQISQASA EERLDFLLNA   237
```

Figure 120 (continued)

| | | | | | |
|---|---|---|---|---|---|
| Lead-cDNA-ID236653450-5109C6 | GVKHRDIKRM | LRQPQILQY | TVENNLKAHI | SFLMGLGIPN | SKIGQIVAAT | 279 |
| CeresClone:918824 | GVKSKDLKRM | LVRQPQILEY | TL--SNLKSHV | AFLAGIGVPD | ARMGQIISSA | 277 |
| gi|50938747 | GVKSKDMKRM | LVRQPQILEY | TL--SNLKSHV | AFLVGIGVPS | ARIGQIISAA | 281 |
| CeresClone:458156 | GVKSKDMKRI | LVRQPQILEY | TL--GNLKSHV | DFLVSLGVPN | RRIGQIISAA | 286 |

| | | | | | |
|---|---|---|---|---|---|
| Lead-cDNA-ID236653450-5109C6 | PSLFSYSVEN | SLRPTIRYLI | EEVGIKETDV | GKVVQLSPQI | LVQRLDITWN | 329 |
| CeresClone:918824 | PSFLSYSIEQ | SLKPTISYLI | EEVGIEERDV | GKVVQLSPQI | LVQRIDNAWK | 327 |
| gi|50938747 | PSFFSYSVEQ | SLKPTIRYLI | EEVGIEESDV | GKVVQLSPQI | LVQRIDSAWK | 331 |
| CeresClone:458156 | PSMFSYSVEQ | SLKPTVRYLI | EEVGIEESDV | GKVVQLSPQI | LVQKIDSAWK | 336 |

| | | | | | |
|---|---|---|---|---|---|
| Lead-cDNA-ID236653450-5109C6 | TRYMFLSKEL | GAPRDSVVKM | VKKHPQLLHY | SIDDGFLPRI | NFLRSIGMCN | 379 |
| CeresClone:918824 | SRFLFLSKEL | GAPKDSIVKM | VTKHPQLLHY | SIEEGILPRI | NFLRSIGMRN | 377 |
| gi|50938747 | SRFLFLSKEL | GAPKDNIVKM | VTKHPQLLHY | SIEDGILPRI | NFLRSIGMRD | 381 |
| CeresClone:458156 | SRSLFLSKEL | DAPKHSIVKM | VTKHPQLLHY | SIEDGILPRL | NFLRSIGMRN | 386 |

| | | | | | |
|---|---|---|---|---|---|
| Lead-cDNA-ID236653450-5109C6 | SDILKVLTSL | TQVLSLSLED | NLKPKYMYLV | NELNNEVHIL | TKYPMYLSLS | 429 |
| CeresClone:918824 | SDILKILTSL | TQVLSLSVEK | NLKPKYLYLV | NDLKNEAQSL | TKYPMYLSLS | 427 |
| gi|50938747 | TDVLKVLTSL | TQVLSLSLEE | NLKPKYLYLV | NDLKNDVQSL | TKYPMYLSLS | 431 |
| CeresClone:458156 | SDILKVLTSL | TQVLSLSLED | NLKPKYLYLV | NDLKNEVQSL | TKYPMYLSLS | 436 |

| | | | | | |
|---|---|---|---|---|---|
| Lead-cDNA-ID236653450-5109C6 | LDQRIRPRHR | FLVELKKVRK | GPFPLSSLVP | NDESFCQQWA | GTSVDIYLAF | 479 |
| CeresClone:918824 | LEQRIRPRHR | FLVSLKKAPK | GPFPLSSFVL | TDERFCQRLA | GTSLEKYHTF | 477 |
| gi|50938747 | LDQRIRPRHR | FLVSLKKAPK | GPFPLSSFVP | TDERFCKRWA | GTSLEKYHTF | 481 |
| CeresClone:458156 | LDQRIRPRHR | FLVSLKKAPK | GPFPLSSFVP | TDERFCQRWA | GTSLEAYHTF | 486 |

Figure 120 (continued)

| | | |
|---|---|---|
| RQRLLKEFA | NKYDKRG--- | -- | 496
| RQSLLLTGFE | DKTGRKPLAS | RR | 499
| RQSMLLKGFS | EKTGRKTLTS | RR | 503
| RQRLLLTSFT | EKSGRKTLVS | RR | 508

Lead-cDNA:ID23653450-5109C6
CeresClone:918824
gi|50938747
CeresClone:458156

| | | | | | | | |
|---|---|---|---|---|---|---|---|
| CeresClone:592713 | | | | | | REHPKVEREF | HAPP--- 81 |
| Lead-cDNA-ID23401690 | | | | | ---H | FEHPSEAHDV | NAPP--- 62 |
| CeresClone:605218 | | | | | ---S | EDATAVVARD | HAPP--- 72 |
| CeresClone:944101 | | | | | ---D | LESTRR---- | ------- 45 |
| CeresClone:6397 | | | | | ---S | VPPVTSPAEE | ------- 78 |
| CeresClone:282666 | | | SSYHP--CSY | DGSPCFGLLD | | PEPPLTPGTT | DKPPATK--- 123 |
| gi|50927517 | KPEPVRSPDS | | SSYDGSSCC | FGFADVSEPV | | TPSDAASGAA | TPGRG----- 134 |
| CeresClone:555364 | KPEPLL-SPD | | ------SCY | VGFL---EPE | | TPPATSPGES | EAAAAAAT-- 127 |
| CeresClone:569593 | KPEPLLPSPD | | ------SCY | VGFL---EPE | | TPPATSPGGS | EEEAAAAFM-- 127 |
| gi|32401273 | KPEPLLPSPD | | --------- | ---------- | | PEPVDSPVSS | EEEAAAAFM-- 124 |
| gi|3342211 | GSPAPVTV-- | | --------- | ---------- | ---K | PEFSPSPAET | PAPVRVAGG-- 96 |
| gi|57012759 | KSEPREEIES | | --------- | ---------- | ---S | IEPATLPVPS | TAAP------- 85 |
| gi|57012876 | KAEPRE---- | | --------- | ---------- | ---E | IEPATSPVPS | VAPPAE----- 89 |
| | KAEPRE---- | | | | | | VAPPAE----- |

| | | | | | | |
|---|---|---|---|---|---|---|
| CeresClone:592713 | ---------- | ---AWKRYR | GVRRRPWGKF | AAEI RDPKKN | GARI WLGTYE | 117 |
| Lead-cDNA-ID23401690 | ---------- | ---KWRRYR | GVRRRPWGKF | AAEI RDPKKN | GSRVWLGTYV | 98 |
| CeresClone:605218 | ---------- | ---TWKHYR | GVRRRPWGKF | AAEI RDPKKN | GARVWLGTYD | 108 |
| CeresClone:944101 | ---------- | ---RGGNFK | GVRRRPWGKF | AAEI RDPNKH | GARI WLGTYE | 81 |
| CeresClone:6397 | ----ASGSH | APRQKGMQYR | GVRQRPWGKF | AAEI RDPARN | GARVWLGTYD | 123 |
| CeresClone:282666 | ----QEEAA | AAMARGKHYR | GVRQRPWGKF | AAEI RDPAKN | GARVWLGTFD | 168 |
| gi|50927517 | AEHGKEEAA | AAVARGKHYR | GVRRRPWGKF | AAEI RDPAKN | GARVWLGTYD | 184 |
| CeresClone:555364 | ----GE--AA | AAVARGKHYR | GVRRRPWGKF | AAEI RDPAKN | GARVWLGTFD | 171 |
| CeresClone:569593 | ----GEEAA | AAPARGKHYR | GVRQRPWGKF | AAEI RDPAKN | GARVWLGTYD | 172 |
| gi|32401273 | ----EAPVA | AETPKGRHYR | GVRQRPWGKF | AAEI RDPAKN | GARVWLGTFE | 169 |
| gi|3342211 | -------A | AVVPKGRHYR | GVRQRPWGKF | AAEI RDPAKN | GARVWLGTYE | 137 |
| gi|57012759 | ---TTTAQ | AVVPKGRHYR | GVRQRPWGKF | AAEI RDPAKN | GARVWLGTYE | 130 |
| gi|57012876 | ---TTTAQ | AVVPKGRHYR | GVRQRPWGKF | AAEI RDPAKN | GARVWLGTYE | 134 |

| | | | | | | |
|---|---|---|---|---|---|---|
| CeresClone:592713 | LNRLAKNRKQ | VEVFEMSL-- | ------HASND | VNVDQWWSN | 223 |
| Lead-cDNA-ID23401690 | LNNLAKNKSQ | AKVVEMALEA | NEVEQWNEL- | NDCTLFWCS | 211 |
| CeresClone:605218 | LNKLAKNRSQ | VK-------- | VEC------- | --------- | 202 |
| CeresClone:944101 | NLTAR----- | ---------- | VPCLAFHYFX | NIDXTTWC- | 166 |
| CeresClone:6397 | KSSLVVPELD | FTVDQFYFDG | SLLMDQSECS | YSDNRI--- | 226 |
| CeresClone:282666 | MALVPSPSQL | NRPAQPWFP- | AAPVEQAAMA | PRVEQIVV- | 277 |
| gi|50927517 | MPLVPPPSQL | NWPVQAWYPA | AAPVEQVAIT | PRVEQLV-- | 318 |
| CeresClone:555364 | MALVPPPSQL | SRPAQAWYP- | AAPAEQVAMA | PRVEQLV-- | 289 |
| CeresClone:569593 | MALVPPSSQL | SRPAHAWYP- | AVPAEQVAMA | PCVQQLVS- | 290 |
| gi|32401273 | GQARPGLQQV | GNVVEGMQVG | VGCQVGVGTM | PLGDLLVT | 282 |
| gi|3342211 | QKCDGEMASR | SSVMQ----- | VGC---QIEQL | TGVHQLLVI | 234 |
| gi|57012759 | KKAELEVQSR | SNAMQ----- | VGC---QMEQF | PVGEQLLVS | 233 |
| gi|57012876 | KQAELEVQSR | SNVMQ----- | VGC---QMEQF | PVGEQLLVS | 237 |

Figure 123

| | | | | | | |
|---|---|---|---|---|---|---|
| gi\|1568513 | ---- | ---- | MGR | GKI EI KRI EN | NT NRQVTFCK | RRNGLLKKAY | ELSVLCDAEI | 43 |
| Lead-cDNA-ID23556617 | ---- | ---- | MGR | GKI EI KRI EN | ST NRQVTFCK | RRNGLLKKAY | ELSVLCDAEV | 43 |
| gi\|3646326 | ---- | ---- | MGR | GKI EI KRI EN | TT NRQVTFCK | RRNGLLKKAY | ELSILCDAEV | 43 |
| gi\|20385590 | ---- | ---- | MGR | GKI EI KRI EN | TT NRQVTFCK | RRNGLLKKAY | ELSVLCDAEV | 43 |
| gi\|60100358 | ---- | ---- | MGR | GKI EI KRI EN | TT NRQVTFCK | RRNGLLKKAY | ELSVLCDAEV | 43 |
| CeresClone:1044034 | ---- | ---- | MGR | GKI EI KRI EN | TT NRQVTFCK | RRNGLLKKAY | ELSVLCDAEV | 43 |
| gi\|23194453 | ---- | ---- | MGR | GKI EI KRI EN | TT NRQVTFCK | RRNGLLKKAY | ELSVLCDAEV | 43 |
| gi\|4103342 | ---- | ---- | MGR | GKI EI KRI EN | TT NRQVTFCK | RRNGLLKKAY | ELSVLCDAEV | 43 |
| gi\|27763670 | ---- | ---- | MGR | GKI EI KRI EN | TT NRQVTFCK | RRNGLLKKAY | ELSVLCDAEV | 43 |
| gi\|42794560 | MQKREGD | MGR | GKI EI KRI EN | TT NRQVTFCK | RRNGLLKKAY | ELSVLCDAEV | 50 |
| gi\|48727598 | ---- | ---- | MGR | GKI EI KRI EN | TT NRQVTFCK | RRNGLLKKAY | ELSVLCDAEV | 43 |
| gi\|21955182 | ---- | ---- | MGR | GKI EI KRI EN | TT NRQVTFCK | RRNGLLKKAY | ELSVLCDAEV | 43 |
| gi\|57157565 | ---- | ---- | MGR | GKI EI KRI EN | TT NRQVTFCK | RRNGLLKKAY | ELSVLCDAEV | 43 |
| gi\|29467048 | ---- | ---- | MGR | GKI EI KRI EN | TT NRQVTFCK | RRNGLLKKAY | ELSVLCDAEV | 43 |

| | | | | | | |
|---|---|---|---|---|---|---|
| gi\|1568513 | ALI VFSTRGR | VYEYANNN-- | KGTI ERYKKA | TAETSNACTT | QELNAQ--FYQ | 91 |
| Lead-cDNA-ID23556617 | ALI VFSTRGR | LYEYANNN-- | RSTI ERYKKA | CSDSTNTSTV | QEI NAA--YYQ | 91 |
| gi\|3646326 | ALI VFSSRGR | LYEYSNNN--S | RNTI DRYKKA | CSDSTGSSSV | TEI NA---YYQ | 88 |
| gi\|20385590 | ALI VFSTRGR | VYEYSNNN-- | KSTI DRYKKA | SDDSTNGGFT | MEI NAQ--YYQ | 91 |
| gi\|60100358 | ALI VFSSRGR | LYEYSNNN-- | RSTI ERYKKA | CSDHSSTSTT | TEI NAQ--YYQ | 91 |
| CeresClone:1044034 | ALI VFSSRGR | LYEYSNNN-- | RSTI DRYKKA | CSDHSSASTT | TEI NAQ--YYQ | 91 |
| gi\|23194453 | ALI VFSSRGR | LYEYSNNN-- | RSTI ERYKKA | CSDTSNTNTV | TEI NAQ--YYQ | 91 |
| gi\|4103342 | ALI VFSSRGR | LYEYSNNN-- | KTTI ERYKKA | CSDSSATSSV | TELNTQ--YYQ | 91 |
| gi\|27763670 | ALI VFSSRGR | LYEYSNNN-- | KATI DRYKKA | CSDSSATSSV | TELNTQ--YYQ | 91 |
| gi\|42794560 | ALI VFSSRGR | LYEYSNNN--V | KSTI ERYKKA | CADTSNTGSV | SEANAQ--FYQ | 98 |
| gi\|48727598 | ALI VFSTRGR | LYEFSNNS-- | KSTI ERDKKA | SADSSNTTSI | TEANAH--YYQ | 92 |
| gi\|21955182 | ALI VFSSRGR | LYEYANNS-- | KSTI ERYKKA | CADSSSSNAV | --EVNTQRYYQ | 92 |
| gi\|57157565 | ALI VFSSRGR | LYEYSNNS-- | KSTI ERYKKA | CADSSNSNAV | --EVNSQQYYQ | 92 |
| gi\|29467048 | ALI VFSTRGR | LYEYSNNS-- | KSTI ERYKKA | CADSSNSTAV | VEVNTQQYYQ | 92 |

Figure 123 (continued)

| | | | | | | |
|---|---|---|---|---|---|---|
| gi\|1568513 | QESKKLRQQI | QLLQNTN---- | RHLVGEGLS | ALNVRELKQL | ENRLERGITR | 137 |
| Lead-cDNA-ID23556617 | QESAKLRQQI | QTQNSN------ | RNLMGDSLS | SLSVKELKQV | ENRLEKASR | 137 |
| gi\|3646326 | ---------- | ---QNSN------ | RNLMGDSLA | TLTVKELKQV | ENRLERGITR | 121 |
| gi\|20385590 | QESAKLRQQI | QMLQNSN------ | RNLMGDSLA | SLTVKELKQL | ENRLERGITR | 137 |
| gi\|60100358 | QESAKLRQQI | QMLQNSN------ | RNLMGDALS | TLTVKELKQL | ENRLERGITR | 137 |
| CeresClone:1044034 | QESAKLRQQI | QMLQNSN------ | RNLMGDALS | SLTVKELKQL | ENRLERGITR | 137 |
| gi\|23194453 | QESAKLRQQI | QMLQNSN------ | RNLMGDSLS | ALTVKELKQV | ENRLERGITR | 137 |
| gi\|4103342 | QESAKLRQQI | QMLQNSN------ | RNLMGDSLS | ALTVKELKQL | ENRLERGITR | 137 |
| gi\|277763670 | QESSKLRQQI | VLQNSN------- | VRHLMGEALS | AMTVKELKQL | EGRLEKGISR | 141 |
| gi\|42794560 | HEATKLRQQI | QNLQAN------- | ROLMGESLD | SLTVKELKQL | ENRLERGLTR | 137 |
| gi\|48727598 | QEASKLRQQI | QILQNAN------ | RHLMGDSLS | PLNVKELKQL | ETRLERGITR | 144 |
| gi\|21955182 | QEAAKLRQQI | QILQNAN------ | RHLMGDSLS | SLTVKELKQL | ENRLERGITR | 138 |
| gi\|71577565 | QEAAKLRHQI | QSLQNSN------ | RHLMGDSLS | SLSIKELKQL | ENRLERGITR | 138 |
| gi\|29467048 | | | | | | 138 |

| | | | | | | |
|---|---|---|---|---|---|---|
| gi\|1568513 | RSKKHEMIL | AETENLQKRE | QLEQENIFL | RSKIAENERL | QELS--MMPAT--S | 186 |
| Lead-cDNA-ID23556617 | RSKKHELLL | VETENAQKRE | ELDNENIYL | RTKVAEVERL | QQHHQMV--S | 186 |
| gi\|3646326 | RSKKHELLL | AEIEYLQKRE | ELENENVYF | RTKVSEVERL | QQAN---MV--S | 168 |
| gi\|20385590 | RSKKHEMLL | AEIEYFQKRE | ELENESVYL | RTKIAEVERL | QQAN---MV--S | 184 |
| gi\|60100358 | RSKKHEMLL | AEIEYFQKRE | ELENENLCL | RTKIAEIERL | QQVN---MV--S | 184 |
| CeresClone:1044034 | RSKKHEMLL | AEIEYFQKRE | ELENENLCL | RTKIAEVERV | QQVN---MV--S | 184 |
| gi\|23194453 | RSKKHEMLL | AEIEYLQKRE | ELENENVCL | RTKIAEVERV | QQAN---MV--S | 184 |
| gi\|4103342 | RSKKHEMLL | AEIEYLQKRE | ELENENVCL | RTKIAEVERV | QQAN---MV--S | 184 |
| gi\|277763670 | RSKKNEMLF | QEIMF------ | DMQNDNMYL | RAKIAENERA | QQHM--SMMP | 188 |
| gi\|42794560 | RSKKHELLL | AEIEYMQKRE | VELQKENMYL | RAKIAENENA | QQTS---MV--P | 185 |
| gi\|48727598 | RSKKQEIMF | AELEYMQKRE | VELQTDNMYL | RAKIGENERA | SMMP | 191 |
| gi\|21955182 | VRSKKHELLL | AELEYMQKRE | AELQNDNMYL | RAKISENERA | HQAS--VVQA--P | 186 |
| gi\|71577565 | RSKKHELLF | AELEYMQKRE | AELQNDNMYL | RAKITDNERA | HQVS--VVQP--P | 186 |
| gi\|29467048 | RSKKHELLF | AEIEYMQKRE | AELQNDNMYL | RAKITDNERA | HQVS--VVQS | 186 |

| | | | | 375 |
|---|---|---|---|---|
| KRHWKPSEDM | QFVVMDPSHP | HYYMDNVLGN | PFPMDLSHPM | L |
| KRHWKPSEDM | QFVVMDAGHP | HYYMDNVLGN | PFPMDISHTL | L 369 |

Lead-CeresClone:541719
Annot-ID:1535677

Figure 125

```
CeresClone:486120      -------MSSRRS------              SSHGN SED EMNELVSKLQ ALLPSSRRR  35
gi|50912765            -------MSSRRF------              SSRGS SEE EINELI SKLQ SLLPNSR-RR  33
CeresClone:503296      -------MSSRRP------              SSRGN SED EINELI SKLQ ALLPSSR-RR  34
gi|50929085            MSSRRRSRRAGSSVPSSS               SSSRI SDD QI AELLSKLQ ALLPESQARN  50
Lead-cDNA-ID23557650   MSSRRRSR---QA------              SSSRI SDD QITDLI SKLR QSI PEI RQNR  39
CeresClone:1033993     MSSRRRSR---QA------              SSSRI SDD QITDLI SKLR QSI PEI RQNR  39
CeresClone:653656      MSSRRRSR---QT------              SSSRI TDD QI NDLVSKLR QLLPEI R-DR  39
CeresClone:703180      MSSRRRSR---QQ------              SASTRI SDD QI DLVSKLR QLVPEI R-DR  37
CeresClone:560681      MSSRRRSR---QQ------              SASTRI SDD QI DLVSKLR QLVPEI R-DR  37
CeresClone:560948      MSSRRRSR---QH------              SGSTRI SDD QI ELVSKLR QLVPEI R-NR  37

CeresClone:486120      GSGQASTAKL KETCSYI KS LQREVDDLSD RLSDLLSTMD HNSPAAE I R   85
gi|50912765            GSSQASTTKL KETCNYI KS LHREVDDLSD RLSDL MATMD HNSPGAE I R   83
CeresClone:503296      GSGQASTTKL KETCSYI RS LHREVDDLSD RLSDL MATMD HNSPGAE I R   84
gi|50929085            GAHRGSAARV QETCSYI RS LHQEVDNLSE TLAQLLASPD VTSDQAAVI R  100
Lead-cDNA-ID23557650   RSNTVSASKV QETCNYI RN LNKEADDLSD RLTQLLESI D PNSPQAAVI R   89
CeresClone:1033993     RSETVSASKV QETCNYI RN LNKEADDLSD RLSQLLETI D PNSPQAAI I R   89
CeresClone:653656      RSDKVSASKV QETCNYI RS LHREVDDLSE RLSELLATI D ---TAQAAI I R   87
CeresClone:703180      RSDKVSASKV QETCNYI RS LHREVDDLSE RLSQLLATI D ADSPEAAI I R   87
CeresClone:560681      RSDKVSASKV QETCNYI RS LHREVDDLSE RLSQLLATI D ADSPEAAI I R   87
CeresClone:560948      RSDKVSASKV QETCNYI RG LHREVSDLSE RLSQLLTI D ADSAEAG I R   87

CeresClone:486120      SI LRS     90
gi|50912765            SI LRS     88
CeresClone:503296      SI LRS     89
gi|50929085            SLLM-     104
Lead-cDNA-ID23557650   SLI NG     94
CeresClone:1033993     SLI NE     94
CeresClone:653656      NLLMQ     92
CeresClone:703180      SLI N-     91
CeresClone:560681      SLI N-     91
CeresClone:560948      SLLNQ     92
```

Figure 126

```
Lead-CeresClone:519    MSGRRSRSRQ SSGTSRISED QINDLIIKLQ QLLPELRDSR RSDKVSAARV  50
CeresClone:1247092     MSGRRSRSRQ SSG---SED  QINDLIIKLQ QLLPELRNSR RSDKVSASRV  47
CeresClone:951040      MSNRR--SRQ SSSAPRISDD QIIDLVTKLR QILPEIGQRR RSDKVSASKV  48
CeresClone:703180      MSSRR--SRQ QSASTRISDD QIIDLVSKLR QLVPEIRD-R RSDKVSASKV  47

Lead-CeresClone:519    LQDTCNYIRN LHREVDDLSE RLSELLA--N SDTAQAALIR SLLI--      91
CeresClone:1247092     LQETCNYIRN LHREVDDLSE RLSELLA--N TDTAQAALIR SLLTQ       90
CeresClone:951040      LQETCNYIRN LNREVDNLSE RLAQLLESVD EDSPQAAVIR SLLM-       92
CeresClone:703180      LQETCNYIRS LHREVDDLSE RLSQLLATID ADSPEAAIIR SLIN-       91
```

Figure 127

|  |  |  |  | 33<br>50 |
|---|---|---|---|---|
| CeresClone-106887<br>CeresClone-1796871 | -----MQEAA<br>MQGGGDQGGS | LGMMG----<br>LGMDVGFAGG | ------ASV<br>AECSSSSAAA | GGDGDAAVVA<br>AAAAAAAEA | EQNRQLKGEI<br>EERQLLKGEI |

|  |  |  |  | 83<br>100 |
|---|---|---|---|---|
| CeresClone-106887<br>CeresClone-1796871 | ATHPMYEQLL<br>AVHPLCEQLV | AAHVACLRVA<br>TAHVGCLRVA | TPIDQLPIIE<br>TPIDHLPLID | AQLSQSHHLL<br>AQLAQSSGLL | RSYASTAVGY<br>HSYAAHHRPF |

|  |  |  |  | 131<br>150 |
|---|---|---|---|---|
| CeresClone-106887<br>CeresClone-1796871 | H---HDRHELD<br>LSPHDKHDLD | NFLAQYVMVL<br>SFLAQYLMLL | CSFKEQLQQH<br>CSFREQLQQH | VRVHAVEAVM<br>VRVHAVEAVM | ACREIENNLH<br>ACREIEQSLQ |

|  |  |  |  | 181<br>197 |
|---|---|---|---|---|
| CeresClone-106887<br>CeresClone-1796871 | SLTGATLGEG<br>DLTGATLEEG | SGATMSEDED<br>TGATMSEDED | DLPMDFSSDN<br>EPPMLEGALD | SGVDFSGGHD<br>MGSD---GQD | MTGFGPLLPT<br>MMGFGPLLPT |

|  |  |  |  | 231<br>247 |
|---|---|---|---|---|
| CeresClone-106887<br>CeresClone-1796871 | ESEKSLMERV<br>DSERSLMERV | RQELKLELKQ<br>RQELKIELKQ | GFKSRIEDVR<br>GFKSRIEDVR | EEIMRKRRAG<br>EEILRKRRAG | KLPGDTTTVL<br>KLPGDTTSIL |

|  |  |  |  | 281<br>297 |
|---|---|---|---|---|
| CeresClone-106887<br>CeresClone-1796871 | KNWWQQHCKW<br>KQWWQQHSKW | PYPTEDDKAK<br>PYPTEDDKAK | LVEETGLQLK<br>LVEETSLQLK | QINNWFINQR<br>QINNWFINQR | KRNWHNNSHS<br>KRNWHNNSQT |

|  | 291<br>306 |
|---|---|
| CeresClone-106887<br>CeresClone-1796871 | LTSLKSKRKH<br>ST-LKSKRKR |

Figure 128

```
                                                                              50
                                                                              29
CeresClone-1881639    MMGSNSGGGG GGPGGGMGPG MGGPTGGGGD GRHDDEAALT EFLSLLMDYT
Lead-CeresClone-25793 ---------- -----MNHG  QQ-----SGE AKHEDDAALT EFLASLMDYT 100
                                                                              79
CeresClone-1881639    PTIPDELVEH YLGRSGFHCP DLRLTRLVAV ATQKFLSDIA SDSLQHCKAR
Lead-CeresClone-25793 PTIPDDLVEH YLAKSGFQCP DVRLIRLVAV ATQKFVADVA SDALQHCKAR 150
                                                                              127
CeresClone-1881639    VAAPIKDNKS KQPKDRRLVL TMDDLSKALR EHGVNLKHAE YFADSPSAGM
Lead-CeresClone-25793 PAPVVKDKK- QQKDKRLVL  TMEDLSKALR EYGVNVKHPE YFADSPSTGM 157
                                                                              134
CeresClone-1881639    APSTREE
Lead-CeresClone-25793 DPATRDE
```

Figure 129

```
                                                                                              50
gi|71041096|gb|AAZ20436.1|    MRKPEPSSAA  AGKNNKENNS  NSKLRKGLWS  PEEDDKLMRY  MINGQGCWS       46
gi|39725413|emb|CAE09057.1|   ---MGMAMGI  KEKAS-SNPH  NHKLRKGLWS  PEEDEKLMRY  MLTNGQGCWS      49
Lead-Annot-ID:1493072         MRKPDLMARD  RVPIN-NNMN  RAKLRKGLWS  PEEDEKLIQY  MLTNGQGCWS 100
gi|71041096|gb|AAZ20436.1|    DVARNAGLQR  CGKSCRLRWI  NYLRPDLKRG  AFLPQEEELI   HLHSLLGNR      96
gi|39725413|emb|CAE09057.1|   DIARNAGLQR  CGKSCRLRWI  NYLRPDLKRG  AFSPQEEELI   VHLHNILGNR     99
Lead-Annot-ID:1493072         EIARNAGLQR  CGKSCRLRWI  NYLRPDLKRG  AFSPQEEELI   HLHSILGNR 150
gi|71041096|gb|AAZ20436.1|    WSQIAARLPG  RTDNEIKNFW  NSTIKKRLKN  LSSSNGSPNT   SDSSPEAKDH     143
gi|39725413|emb|CAE09057.1|   WSQIAARLPG  RTDNEIKNFW  NSTLKKRLKM  NSATSSI--N   ESDLSNPQDF     149
Lead-Annot-ID:1493072         WSQIAARLPG  RTDNEIKNFW  NSTLKKRFKI  NSTSTSSPND   SSDSSEPRDH 195
gi|71041096|gb|AAZ20436.1|    RVVAASRFI   PG--QEHGMV  PLYMDSTSS-  --FMQSAVLS   HMFDPFPALD     189
gi|39725413|emb|CAE09057.1|   ----AAGIM   PSFHAQYDVL  ATCMDSSPAP  FPPMDNISAP   NQFDPFPTLN     193
Lead-Annot-ID:1493072         ----WGNI M  PM--HDHDVM  TLCKDSSSSP  SISMHGVTG    NQFDPFTVLS 245
gi|71041096|gb|AAZ20436.1|    IDQGGLTLPG  AGGYYNANPC  ITQREIGVGG  GDDCYNFGGN   GGFGSGDVDJ     226
gi|39725413|emb|CAE09057.1|   ---NRCDTWE  GVGFFTFPSG  APVSMGD---  -DSSY------  -NLEHAKV       234
Lead-Annot-ID:1493072         ---NRYDVSG  AASLFDMSTC  TQVGMGDGF   YGDHY------  GILEGNNKI 292
gi|71041096|gb|AAZ20436.1|    GVEG-EIFVP  PLESV--SIE  DQNIKTETTY  CDSKNNNIYY   NNINSILTCN     275
gi|39725413|emb|CAE09057.1|   GLLGSEFSVP  PLASSTTTE   ENNYRS-IGC  GMDGKGENSF   SNNNDSCFSN     279
Lead-Annot-ID:1493072         GLES-DLSLP  PLESR--SIE  ENNAVSNNRI  GVKSSNDNH    -HFDSTCF-N
```

Figure 129 (continued)

```
gi|71041096|gb|AAZ20436.1|    KTNKNL KGE- SI GVGNYFD DDQEE T MGD WDLED L MKDV SS S SFPFLDY   341
gi|39725413|emb|CAE09057.1|   TT TA SFKA ED DM S GF GNN L Q A-- ANLRIGE WDLEGLMDDL --P SF PFLDF   321
Lead-Annot-ID:1493072         NT DQ RF KVE- DMLGL E NHWQ G-- E NVRMGE WDLEGLMENI -- S SFPFLDF   324 gi|71041096|gb|AAZ20436.1|    Q S-    343
gi|39725413|emb|CAE09057.1|   ---    321
Lead-Annot-ID:1493072         Q VL    327
```

Figure 130

```
                                                                               39
                                                                               46
                                                                               50
                                                                               50
gi|92899044         M  SEL---------Y  Q YVKTI VLF  TYM  EL I V  CYL KST KNP
Lead·CeresClone·5398  MGLQGQLSDV  SSDSI PMLL  SLLAVF  NHL  RSFL LRLTS-  ---KSNPNL P
CeresClone:1836567  MGLQSQLNDV  SSDSI PLLLV  AI I ANCVGYL  RRLL FASLHL  GLL PCP DQP
1458988             MGLQNQLNDV  SSESI PLLLI  AF  ANCVACL  RSFF SVFHS  VGV HR LDQAH 69
                                                                               87
                                                                               95
                                                                               100
gi|92899044         T  T  Q-----  I----Y NF   EEKNPTT RLK  KLA------  ---AEHI DCR
Lead·CeresClone·5398  V DDVS---  A SGLANI VL  ADQLSLNRLF  SYR---CG---  D GGGGSDCV
CeresClone:1836567  T  DD -VGVL  GSGLASLI VL  AEQLNLNK AF  SYKY--CG---  GGV GKGSDCV
1458988             V MDDRL MGSM  GSGLAG LI VL  AEQ RK LNRVF  AYKYC CGRDD  GNDKGGSDCV 119
                                                                               135
                                                                               143
                                                                               148
gi|92899044         VCLSEF EEGD  I VRS  NCE HT  FHKDCL DKWF  LQEQYCA T CPI  LCRNKVLSDD
Lead·CeresClone·5398  VCLSKLKEGE  EVRKLECRHV  FHK CLEGWL  ---HQF NFT CP  LCRSAL VSDD
CeresClone:1836567  VCL CSL RDGE  QVRKLDC CHV  FHKDCF DGWL  ---DQL KF NCP  VCRSPLK I DQ
1458988             VCL CT L RDGD  QVRKLDCRHV  FHKECF DGWL  ---D L NF NCP  LCR WPLVSDE gi|92899044         V VSKYCL L Q N  QVEF DVI D DE  FMTLLSSLRG  GSI WYRYL       157
Lead·CeresClone·5398  CVSK---  TQR  S V GRDLI S-  ----------  ---CF SLH         155
CeresClone:1836567  RVGF---  TRR  RVGQDLLA-  ----------  ---WF SLG         163
1458988             RVEE---  TRR  RVGENLVE-  ----------  ---WF SLR         168
```

Figure 131

| | | | | | | |
|---|---|---|---|---|---|---|
| gi\|7443216 | MAST QCFLHQ | HALSSSAART | TSSMVSSQ-RY | VSSLKPNQLV | CRAQKQSSPQ | 49 |
| CeresClone:982579 | MAYSACFLHP | STLTDSSTARS | SSFPSSL-TH | VSFSRPVHL V | CRAQ------ | 44 |
| gi\|11133887 | MAYSPSFLHQ | SALASSAGRS | SSSSSSSFRH | VSLSRPVHL V | CRAQ------ | 45 |
| CeresClone:1139782 | MAYSPSFLHQ | SALASSAGRS | SSSSSSSFRH | VSLSRPVHL V | CRAQ------ | 45 |
| gi\|42569485 | MAYSACFLHQ | SALASSTARS | SSSSSSSQ-RY | VSLSKPVHL V | CKAQ------ | 45 |
| gi\|211133 | MAYSACFLHQ | SALASSAARS | SPSSSSSSS | VSISK---L V | CKAQ------ | 41 |
| CeresClone:1063835 | MAYSACFLHQ | SALASSAARS | SSSSSSSQ-RY | VSLSKPVQVV | CKAQ------ | 44 |
| CeresClone:1027529 | MAYSACFLHQ | SALASSAARS | SSSSSSSQ-RY | VSLSKPVQVV | CKAQ------ | 44 |
| Lead-cDNA-ID23367406 | MAYSACFLHQ | SALASSAARS | SSSSSSSQ-RH | VSLSKPVQI I | CKAQ------ | 44 |
| CeresClone:142681 | MAYSACFLHQ | SALASSAARS | SSSSSSSQ-RH | VSLSKPVQI I | CKAQ------ | 44 |

| | | | | | | |
|---|---|---|---|---|---|---|
| gi\|7443216 | EDDGNSVVVS | RRLALTVLI G | AAAI GSKVSP | AD-AAYGEAA | NVFGKPKENT | 98 |
| CeresClone:982579 | AQEEANSAI S | RRLALTFLVG | AALGSKVSP | AD-AAYGEAA | NVFGKPKKNT | 93 |
| gi\|11133887 | SQENNNSAVF | RRLALTLLVG | AAAI GSKVSP | APXAAYGEAA | NVFGKPKKNT | 95 |
| CeresClone:1139782 | SQENNNSAVF | RRLALTLLVG | AAAI GSKVSP | AP------ | PMVKPPKKNT | 87 |
| gi\|42569485 | THEEDNSTVS | RRLALTLLVG | AAAVGSKVSP | AP-PM---VK | PLMCLPKKNT | 91 |
| gi\|211133 | SHEDDNPAVS | RRLALTLLVG | AAAVGSKVSP | AD-AAYGEAA | NVFGKPKKNT | 90 |
| CeresClone:1063835 | SHEDDNPAVS | RRLALTLLVG | AAAVDSKVSP | AD-AAYGEAA | NVFGKPKKNT | 93 |
| CeresClone:1027529 | SHEDDNSAVS | RRLALTLLVG | AAAVGSKVSP | AD-AAYGEAA | NVFGKPKKNT | 93 |
| Lead-cDNA-ID23367406 | SHEDDNSAVS | RRLALTLLVG | AAAVGSKVSP | AD-AAYGEAA | NVFGKPKTNT | 93 |
| CeresClone:142681 | SHEDDNSAVS | RRLALTLLVG | AAAVGSKVSP | AD-AAYGEAA | NVFGKPKKNT | 93 |

| | | | | | | |
|---|---|---|---|---|---|---|
| gi\|7443216 | DFLAYNGDGF | KLQVPAKWNP | SKEVEFPGQV | LRYEDNFDST | SNLVLVTPT | 148 |
| CeresClone:982579 | DFMPYNGEGF | KI EI PSKWNP | SKEVEYPGQV | LRYEDNFDAT | SNVSVMI TPT | 143 |
| gi\|11133887 | DFLPYTGEGF | KI QI PSKWNP | SKEI EYPGQV | LRFEDNFDAT | SNVSVMI TPT | 145 |
| CeresClone:1139782 | DFLPYTGEGF | KI QI PSKWNP | SKEI EYPGQV | LRFEDNFDAT | SNVSVMI TPT | 137 |
| gi\|42569485 | DFLPYTGEGF | KI QI PSKWNP | SKEI EYPGQV | LRYEDNFDAT | SNVSVMI TPT | 141 |
| gi\|211133 | DFTAYSGDGF | QVQVPAKWNP | SREVEYPGQV | LRYEDNFDAT | SNLNVMVTPT | 140 |
| CeresClone:1063835 | DFT PYNGDGF | QVQVPAKWNP | SREVEYPGQV | LRYEDNFDAT | SNLNVMVTPT | 143 |
| CeresClone:1027529 | DFT PYNGDGF | KVQVPAKWNP | SKEI EYPGQV | LRYEDNFDAT | SNLNVMVTPT | 143 |
| Lead-cDNA-ID23367406 | DFLPYNGDGF | KVQVPAKWNP | SKEI EYPGQV | LRFEDNFDAT | SNLNVMVTPT | 143 |
| CeresClone:142681 | DFLPYNGDGF | KVQVPAKWNP | SKEI EYPGQV | LRYEDNFDAT | SNLNVMVTPT | 143 |

Figure 131 (continued)

| | | | | | | | |
|---|---|---|---|---|---|---|---|
| gi\|7443216 | DKKSI TDYGS | PEEFLTQVDF | LGKQAYFGK | TDSEGGFESG | AVATANL LET | 198 |
| CeresClone:982579 | DKKTI ADYGS | PEQFLSQVSY | LLGKQAYFGE | TAFEGGFDAN | AVATANI XET | 193 |
| gi\|11133887 | DKKSI TDYGS | PEQFLSQVNY | LLGKQAYFGE | TASEGGFDAN | AVATANI LET | 195 |
| CeresClone:1139782 | DKKSI TDYGS | PEQFLSQVNY | LLGKQAYFGE | TASEGGFDNN | AVATANI LET | 187 |
| gi\|42569485 | DKKSI TDYGS | PEEFLSQVNY | LLGKQAYFGE | TASEGGFDNN | AVATANI LET | 191 |
| gi\|21133 | DKKSI TDYGS | PEEFLSQVNY | LLGKQAYVGE | TASEGGFDNN | AVATANI LET | 190 |
| CeresClone:1063835 | DKKSI TDYGS | PEEFLSQVNY | LLGKQAYFGE | TASEGGFDNN | AVATANI LET | 193 |
| CeresClone:1027529 | DKKSI TDYGS | PEEFLSQVNY | LLGKQAYFGE | TASEGGFDNN | AVATANI LET | 193 |
| Lead-cDNA-ID23367406 | DKKSI TDYGS | PEEFLSQVNY | LLGKQAYFGE | TASEGGFDNN | AVATANI LES | 193 |
| CeresClone:142681 | DKKSI TDYGS | PGEEFLSQVNY | LLGKQAYFGE | TASEGGFDNN | AVATANI LES | 193 |

| | | | | | | | |
|---|---|---|---|---|---|---|---|
| gi\|7443216 | SSSTVGGKEY | YLSVLTRTA | DGDEGGKHQL | SATVNGGKL | YI CKAQAGDK | 248 |
| CeresClone:982579 | STQXVGGKKY | YYLSVLTRTA | DGEGGKHQL | XAXVNGGKL | YI CKXQAGDK | 243 |
| gi\|11133887 | ST QEI GGKEY | YYLSVLTRTA | DGEGGKHQL | TATVNGGKL | YI CKAQAGDK | 245 |
| CeresClone:1139782 | ST QEI GGKEY | YYLSVLTRTA | DGEGGKHQL | TATVNGGKL | YI CKAQAGDK | 237 |
| gi\|42569485 | ST QEI GGKPY | YYLSVLTRTA | DGEGGKHQL | TATVNGGKL | YI CKAQAGDK | 241 |
| gi\|21133 | NI QDVGGKPY | YYLSVLTRTA | DGEGGKHQL | TATVNGGKL | YI CKAQAGDK | 240 |
| CeresClone:1063835 | NVQDVGGKPY | YYLSVLTRTA | DGEGGKHQL | TATVNGGKL | YI CKAQAGDK | 243 |
| CeresClone:1027529 | NVQDVGGKPY | YYLSVLTRTA | DGEGGKHQL | TATVNGGKL | YI CKAQAGDK | 243 |
| Lead-cDNA-ID23367406 | SSQEVGGKPY | YYLSVLTRTA | DGEGGKHQL | TATVNGGKL | YI CKAQAGDK | 243 |
| CeresClone:142681 | SSQEVGGKPY | YYLSVLTRTA | DGEGGKHQL | TAXVGGKX | YI CKAQAGDK | 243 |

| | | | | |
|---|---|---|---|---|
| gi\|7443216 | RWFKGARKFV | ENAATSFSVA | ------ | 268 |
| CeresClone:982579 | RWFKGARKFV | ENAATSFSVA | ------ | 263 |
| gi\|11133887 | RWFKGARKFV | ENAATSFSVA | ------ | 265 |
| CeresClone:1139782 | RWFKGARKFV | ENAATSFSVA | ------ | 257 |
| gi\|42569485 | RWFKGARKFV | ENAATSFSVA | ------ | 261 |
| gi\|21133 | RWFKGANKFV | EKAATSFSVA | ------ | 260 |
| CeresClone:1063835 | RWFKGANKFV | EKAATSFSVA | ------ | 263 |
| CeresClone:1027529 | RWFKGARKFV | ESAATSFSVA | ------ | 263 |
| Lead-cDNA-ID23367406 | RWFKGARKFV | ESAATSFSVA | ------ | 263 |
| CeresClone:142681 | RWFKGARKFV | ESAATSFSVA | XXESNTT | 270 |

PHENYLPROPANOID RELATED REGULATORY PROTEIN-REGULATORY REGION ASSOCIATIONS

CROSS-REFERENCE TO RELATED APPLICATIONS

This application claims priority under 35 USC §119(e) to U.S. Provisional Patent Application Ser. No. 60/854,825, filed on Oct. 27, 2006, the entire contents of which are hereby incorporated by reference.

STATEMENT AS TO FEDERALLY SPONSORED RESEARCH

Funding for the work described herein was provided by the federal government (U.S. Department of Energy Grant No. DE-FG02-05ER64111), which has certain rights in the invention.

INCORPORATION-BY-REFERENCE & TEXTS

The material on the accompanying diskette is hereby incorporated by reference into this application. The accompanying compact discs contain one file, 11696231001SequenceListing.txt, which was created on Oct. 29, 2007. The file named 11696231001 SequenceListing.txt is 5,719 KB. The file can be accessed using Microsoft Word on a computer that uses Windows OS.

TECHNICAL FIELD

This document relates to materials and methods for modulating expression of nucleic acid sequences of interest, including both endogenous and exogenous nucleic acid sequences, such as those involved in phenylpropanoid (e.g., lignin) biosynthesis. For example, this document provides materials and methods for identifying regulatory protein and regulatory region pairs, e.g., transcription factor-promoter pairs, as well as materials and methods for using such associated pairs to modulate (e.g., increase or decrease) lignin content in plants.

BACKGROUND

Phenylpropanoids are plant-derived organic compounds that are biosynthesized from the amino acid phenylalanine. Intermediates and end products of this pathway include compounds having important roles in plants, such as phytoalexins, antiherbivory compounds, antioxidants, ultra-violet protectants, pigments, and aroma compounds. Many of the components derived from this pathway such as flavonoids, flavonols, isoflavones, and anthocyanins are known to have nutritional value and are believed to prevent cardiovascular disease, cancer, diabetes, and other diseases related to oxidative stress. The majority of the carbon in the phenylpropanoid pathway is channeled toward the synthesis of lignin. As the second most abundant polymer on earth, exceeded only by cellulose, lignin is a major carbon sink in the biosphere, accounting for about 30% of the carbon sequestered into terrestrial plant material each year (Battle et al., *Science*, 287:2467 (2000)).

Lignin is a major structural component of secondarily thickened cell walls of tissues with conducting and/or mechanical functions. Angiosperm lignin is composed of three main units named p-hydroxyphenyl (H), guaiacyl (G), and syringyl (S) units. These components originate from the polymerization of three monolignols, p-coumaryl, coniferyl, and sinapyl alcohols, respectively. The monolignols are synthesized from phenylalanine through successive deamination, reduction, hydroxylation, and methylation steps. The proportions of H, G, and S units in the cell wall vary according to plant species and tissue type.

As a major polymer of cell walls, lignin has a direct impact on the characteristics of plants and plant products, such as wood. Highly lignified wood is durable and therefore a good raw material for many applications. Since lignin yields more energy when burned than cellulose, lignified wood is also an excellent fuel. The mechanical support provided by lignin prevents lodging, a problem in many agronomically important plants. On the other hand, lignin is detrimental to paper manufacture and must be removed from pulp before paper can be manufactured. This is costly both in terms of energy and the environment.

Lignin also makes it difficult to break down biomass for conversion into cellulosic ethanol biofuel. Cellulosic ethanol, which exhibits a net energy content three times higher than corn ethanol, can be produced from a wide variety of cellulosic biomass feedstocks including agricultural plant wastes, plant wastes from industrial processes and energy crops grown specifically for fuel production. Cellulosic biomass is composed largely of cellulose, hemicellulose and lignin, with smaller amounts of proteins, lipids and ash. Processing cellulosic biomass aims to extract fermentable sugars from the feedstock, which requires disruption of the hemicellulose/lignin sheath that surrounds the cellulose in plant material. Technological developments that increase the yield and drive down the production cost of cellulosic ethanol can help to reduce our oil dependency in a sustainable way. Given the role of lignin in the recalcitrance of biomass for conversion to biobased fuels, in addition to the many other roles of lignin, it is desirable to have the ability to produce plants with modulated levels of lignin.

SUMMARY

The present invention relates to materials and methods for modulating expression of nucleic acid sequences, such as those encoding polypeptides involved in phenylpropanoid (e.g., lignin) biosynthesis. For example, the invention relates to the identification of regulatory proteins that are associated with regulatory regions, e.g., regulatory proteins that are capable of modulating expression of nucleic acid sequences that are operably linked to regulatory regions from genes encoding enzymes involved in lignin biosynthesis. Modulation of expression can include up-regulation or activation, e.g., an increase of expression relative to basal or native states, e.g., a control level. In some cases, modulation of expression can include down-regulation or repression, e.g., a decrease of expression relative to basal or native states, such as the level in a control. In many cases, a regulatory protein is a transcription factor and its associated regulatory region is a promoter. Regulatory proteins identified as being associated with regulatory regions of genes encoding enzymes involved in lignin biosynthesis can be used to create transgenic plants such as trees having increased amounts of lignin in thickened secondary cell walls to sequester carbon, and biomass energy crops having decreased lignin to improve the efficiency of conversion to ethanol. Such plants can have modulated, e.g., increased or decreased, amounts and/or rates of biosynthesis of lignin. In addition, the structure and/or composition of lignin produced by such plants can vary from that produced by corresponding wild-type plants. Regulatory proteins can also be used along with their cognate promoters to modulate expression of one or more endogenous sequences, e.g., lignin biosynthesis genes, in a plant cell. Given the many functions of lignin, it would be useful to control selective expression of one or more polypeptides, including enzymes, regulatory proteins, and other auxiliary polypeptides, involved in lignin biosynthesis, e.g., to regulate biosynthesis of one or more lignin monomers, or monolignols, and/or to regulate polymerization of lignin monomers into lignin.

Reducing the lignin content in dedicated energy crops such as switchgrass can improve the yield and facilitate the production of ethanol from cellulosic feedstock. Reducing lignin in forage crops such as alfalfa can improve the quality and digestibility of such crops. In trees, a reduction in lignin content can improve paper pulp production. Increasing the lignin content in plants can also be useful. For example, increasing lignin in plants can enhance long-term carbon sequestration in plant biomass, which, in turn, may reduce atmospheric carbon dioxide and global warming. An increased lignin content can also prevent plant lodging, make vegetables more firm and crunchy, enhance the fiber content of foodstuffs, confer plants with improved pathogen resistance, and increase the amount of energy that can be obtained by burning wood.

In one aspect, a method of producing a plant is provided. The method comprises growing a plant cell comprising an exogenous nucleic acid. The exogenous nucleic acid comprises a regulatory region operably linked to a nucleotide sequence encoding a polypeptide. The Hidden Markov Model (HMM) bit score of the amino acid sequence of the polypeptide is greater than about 20, using an HMM generated from the amino acid sequences depicted in one of FIGS. 1 to 51 or 53 to 131. The plant has a difference in lignin content as compared to the corresponding lignin content of a control plant that does not comprise said nucleic acid.

In another aspect, a method of producing a plant is provided. The method comprises growing a plant cell comprising an exogenous nucleic acid. The exogenous nucleic acid comprises a regulatory region operably linked to a nucleic acid encoding a polypeptide. The polypeptide comprises a polypeptide sequence having 80% or greater sequence identity to a polypeptide sequence selected from the group consisting of SEQ ID NO:96, SEQ ID NOs:98-100, SEQ ID NO:102, SEQ ID NO:104, SEQ ID NO:106, SEQ ID NO:108, SEQ ID NOs:110-112, SEQ ID NOs:114-117, SEQ ID NOs:119-122, SEQ ID NO:124, SEQ ID NOs:126-128, SEQ ID NOs:130-132, SEQ ID NOs:134-137, SEQ ID NO:139, SEQ ID NO:141, SEQ ID NO:143, SEQ ID NOs:145-147, SEQ ID NO:149, SEQ ID NOs:151-155, SEQ ID NO:157, SEQ ID NO:159, SEQ ID NO:161, SEQ ID NO:163, SEQ ID NOs:165-168, SEQ ID NO:170, SEQ ID NOs:172-176, SEQ ID NOs:178-194, SEQ ID NO:196, SEQ ID NOs:198-215, SEQ ID NO:217, SEQ ID NO:219, SEQ ID NOs:221-251, SEQ ID NO:253, SEQ ID NOs:255-256, SEQ ID NO:258, SEQ ID NO:260, SEQ ID NOs:262-265, SEQ ID NO:267, SEQ ID NOs:269-270, SEQ ID NOs:272-273, SEQ ID NOs:275-277, SEQ ID NOs:279-280, SEQ ID NO:282, SEQ ID NO:284, SEQ ID NOs:286-287, SEQ ID NOs:289-290, SEQ ID NO:292, SEQ ID NOs:294-298, SEQ ID NO:300, SEQ ID NO:302, SEQ ID NO:304, SEQ ID NO:306, SEQ ID NOs:308-313, SEQ ID NOs:315-316, SEQ ID NOs:318-319, SEQ ID NO:321, SEQ ID NO:323, SEQ ID NOs:325-326, SEQ ID NO:328, SEQ ID NO:330, SEQ ID NO:332, SEQ ID NOs:334-335, SEQ ID NO:337, SEQ ID NO:339-341, SEQ ID NO:343, SEQ ID NO:345, SEQ ID NO:347-351, SEQ ID NO:353, SEQ ID NO:355, SEQ ID NO:357-359, SEQ ID NOs:361-368, SEQ ID NO:370, SEQ ID NO:372, SEQ ID NOs:374-375, SEQ ID NO:377, SEQ ID NO:379, SEQ ID NOs:381-385, SEQ ID NOs:387-389, SEQ ID NOs:391-392, SEQ ID NOs:394-398, SEQ ID NO:400, SEQ ID NOs:402-403, SEQ ID NO:405, SEQ ID NO:407, SEQ ID NO:409, SEQ ID NO:411, SEQ ID NO:413, SEQ ID NO:415, SEQ ID NOs:417-430, SEQ ID NOs:432-434, SEQ ID NO:436, SEQ ID NO:438, SEQ ID NO:440, SEQ ID NOs:442-443, SEQ ID NOs:445-447, SEQ ID NO:449, SEQ ID NOs:451-452, SEQ ID NOs:454-457, SEQ ID NO:459, SEQ ID NOs:461-463, SEQ ID NOs:465-468, SEQ ID NOs:470-471, SEQ ID NO:473, SEQ ID NOs:475-476, SEQ ID NOs:478-481, SEQ ID NOs:483-485, SEQ ID NOs:487-488, SEQ ID NO:490, SEQ ID NO:492, SEQ ID NO:494, SEQ ID NOs:496-499, SEQ ID NOs:501-502, SEQ ID NOs:504-506, SEQ ID NO:508, SEQ ID NOs:510-514, SEQ ID NO:516, SEQ ID NO:518, SEQ ID NOs:520-522, SEQ ID NO:524, SEQ ID NOs:526-527, SEQ ID NOs:529-533, SEQ ID NO:535, SEQ ID NO:537, SEQ ID NO:539, SEQ ID NO:541, SEQ ID NO:543, SEQ ID NOs:545-546, SEQ ID NOs:548-551, SEQ ID NO:553, SEQ ID NOs:555-561, SEQ ID NOs:563-564, SEQ ID NOs:566-568, SEQ ID NO:570, SEQ ID NO:572, SEQ ID NOs:574-576, SEQ ID NOs:578-579, SEQ ID NO:581, SEQ ID NO:583, SEQ ID NOs:585-588, SEQ ID NOs:590-591, SEQ ID NOs:593-594, SEQ ID NOs:596-597, SEQ ID NO:599, SEQ ID NO:601, SEQ ID NOs:603-604, SEQ ID NO:606, SEQ ID NO:608, SEQ ID NO:610, SEQ ID NO:612, SEQ ID NOs:614-617, SEQ ID NO:619, SEQ ID NOs:621-636, SEQ ID NOs:638-648, SEQ ID NO:650, SEQ ID NOs:652-654, SEQ ID NOs:656-657, SEQ ID NO:659, SEQ ID NOs:661-663, SEQ ID NOs:665-669, SEQ ID NOs:671-673, SEQ ID NOs:675-676, SEQ ID NO:678, SEQ ID NO:680, SEQ ID NO:682, SEQ ID NO:684, SEQ ID NOs:686-687, SEQ ID NOs:689-693, SEQ ID NOs:695-696, SEQ ID NO:698, SEQ ID NOs:700-701, SEQ ID NO:703, SEQ ID NO:705, SEQ ID NO:707, SEQ ID NOs:709-711, SEQ ID NO:713, SEQ ID NOs:715-716, SEQ ID NO:718, SEQ ID NO:720, SEQ ID NO:722, SEQ ID NOs:724-728, SEQ ID NOs:730-735, SEQ ID NOs:737-740, SEQ ID NO:742, SEQ ID NOs:744-745, SEQ ID NOs:747-751, SEQ ID NO:753, SEQ ID NOs:755-758, SEQ ID NOs:760-763, SEQ ID NOs:765-777, SEQ ID NO:779, SEQ ID NOs:781-784, SEQ ID NOs:786-788, SEQ ID NOs:790-791, SEQ ID NOs:793-794, SEQ ID NO:796, SEQ ID NO:798, SEQ ID NO:800, SEQ ID NOs:802-806, SEQ ID NOs:808-809, SEQ ID NOs:811-812, SEQ ID NO:814, SEQ ID NOs:816-818, SEQ ID NO:820, SEQ ID NO:822, SEQ ID NOs:824-826, SEQ ID NO:828, SEQ ID NOs:830-831, SEQ ID NO:833, SEQ ID NOs:835-836, SEQ ID NOs:838-839, SEQ ID NO:841, SEQ ID NOs:843-847, SEQ ID NOs:849-850, SEQ ID NOs:852-853, SEQ ID NOs:855-857, SEQ ID NO:859, SEQ ID NOs:861-863, SEQ ID NOs:865-866, SEQ ID NOs:868-883, SEQ ID NOs:885-888, SEQ ID NO:890, SEQ ID NO:892, SEQ ID NO:894, SEQ ID NO:896, SEQ ID NO:898, SEQ ID NOs:900-902, SEQ ID NOs:904-905, SEQ ID NOs:907-910, SEQ ID NO:912, SEQ ID NOs:914-915, SEQ ID NO:917, SEQ ID NO:919, SEQ ID NOs:921-925, SEQ ID NO:927, SEQ ID NOs:929-932, SEQ ID NO:934, SEQ ID NO:936, SEQ ID NOs:938-941, SEQ ID NO:943 SEQ ID NOs:945-957, SEQ ID NOs:959-962, SEQ ID NO:964, SEQ ID NO:966, SEQ ID NOs:968-971, SEQ ID NO:973, SEQ ID NOs:975-978, SEQ ID NO:980, SEQ ID NOs:982-992, SEQ ID NOs:994-1005, SEQ ID NOs:1007-1009, SEQ ID NOs:1011-1014, SEQ ID NOs:1016-1026, SEQ ID NOs:1028-1029, SEQ ID NOs:1031-1033, SEQ ID NOs:1035-1048, SEQ ID NO:1050, SEQ ID NOs:1052-1053, SEQ ID NOs:1055-1056, SEQ ID NO:1058, SEQ ID NO:1060, SEQ ID NO:1062, SEQ ID NOs:1064-1066, SEQ ID NOs:1068-1069, SEQ ID NOs:1071-1076, SEQ ID NOs:

1078-1079, SEQ ID NO:1081, SEQ ID NO:1083, SEQ ID NO:1085, SEQ ID NOs:1087-1089, SEQ ID NOs:1091-1092, SEQ ID NO:1094, SEQ ID NO:1096, SEQ ID NOs:1098-1102, SEQ ID NOs:1104-1107, SEQ ID NOs:1109-1115, SEQ ID NOs:1117-1120, SEQ ID NOs:1122-1123, SEQ ID NOs:1125-1127, SEQ ID NO:1129, SEQ ID NOs:1131-1132, SEQ ID NO:1134, SEQ ID NOs:1136-1137, SEQ ID NOs:1139-1141, SEQ ID NOs:1143-1147, SEQ ID NOs:1149-1154, SEQ ID NOs:1156-1157, SEQ ID NO:1159, SEQ ID NO:1161, SEQ ID NO:1163, SEQ ID NOs:1165-1169, SEQ ID NO:1171, SEQ ID NOs:1173-1174, SEQ ID NOs:1176-1181, SEQ ID NO:1183, SEQ ID NOs:1185-1207, SEQ ID NO:1209, SEQ ID NO:1211, SEQ ID NO:1213, SEQ ID NO:1215, SEQ ID NO:1217, SEQ ID NO:1219, SEQ ID NO:1221, SEQ ID NO:1223, SEQ ID NOs:1225-1235, SEQ ID NO:1237, SEQ ID NO:1239, SEQ ID NO:1241, SEQ ID NO:1243, SEQ ID NO:1245, SEQ ID NO:1247, SEQ ID NO:1249, SEQ ID NO:1251, SEQ ID NO:1253, SEQ ID NO:1255, SEQ ID NO:1257, SEQ ID NO:1259, SEQ ID NO:1261, SEQ ID NO:1263, SEQ ID NO:1265, SEQ ID NO:1267, SEQ ID NO:1269, SEQ ID NO:1271, SEQ ID NO:1273, SEQ ID NO:1275, SEQ ID NO:1277, SEQ ID NO:1279, SEQ ID NO:1281, SEQ ID NO:1283, SEQ ID NOs:1285-1290, SEQ ID NO:1292, SEQ ID NO:1294, SEQ ID NO:1296, SEQ ID NO:1298, SEQ ID NO:1300, SEQ ID NOs:1302-1309, SEQ ID NO:1311, SEQ ID NO:1313, SEQ ID NO:1315, SEQ ID NO:1317, SEQ ID NO:1319, SEQ ID NO:1321, SEQ ID NO:1323, SEQ ID NO:1325, SEQ ID NO:1327, SEQ ID NO:1329, SEQ ID NO:1331, SEQ ID NO:1333, SEQ ID NO:1335, SEQ ID NO:1337, SEQ ID NO:1339, SEQ ID NO:1341, SEQ ID NO:1343, SEQ ID NO:1345, SEQ ID NO:1347, SEQ ID NO:1349, SEQ ID NO:1351, SEQ ID NO:1353, SEQ ID NO:1355, SEQ ID NO:1357, SEQ ID NO:1359, SEQ ID NOs:1361-1367, SEQ ID NO:1369, SEQ ID NO:1371, SEQ ID NO:1373, SEQ ID NO:1375, SEQ ID NO:1377, SEQ ID NO:1379, SEQ ID NO:1381, SEQ ID NO:1383, SEQ ID NO:1385, SEQ ID NO:1387, SEQ ID NO:1389, SEQ ID NO:1391, SEQ ID NO:1393, SEQ ID NO:1395, SEQ ID NO:1397, SEQ ID NO:1399, SEQ ID NO:1401, SEQ ID NO:1403, SEQ ID NOs:1405-1410, SEQ ID NO:1412, SEQ ID NOs:1414-1415, SEQ ID NO:1417, SEQ ID NO:1419, SEQ ID NO:1421, SEQ ID NOs:1423-1429, SEQ ID NO:1431, SEQ ID NO:1433, SEQ ID NOs:1436-1442, SEQ ID NOs:1444-1463, SEQ ID NO:1465, SEQ ID NO:1467, SEQ ID NO:1469, SEQ ID NO:1471, SEQ ID NO:1473, SEQ ID NO:1475, SEQ ID NO:1477, SEQ ID NO:1479, SEQ ID NO:1481, SEQ ID NO:1483, SEQ ID NO:1485, SEQ ID NOs:1487-1491, SEQ ID NOs:1493-1500, SEQ ID NO:1502, SEQ ID NOs:1504-1516, SEQ ID NO:1518, SEQ ID NO:1520, SEQ ID NO:1522, SEQ ID NO:1524, SEQ ID NO:1526, SEQ ID NOs:1528-1534, SEQ ID NO:1536, SEQ ID NO:1538, SEQ ID NO:1540, SEQ ID NO:1542, SEQ ID NO:1544, SEQ ID NO:1546, SEQ ID NO:1548, SEQ ID NO:1550, SEQ ID NO:1552, SEQ ID NO:1554, SEQ ID NO:1556, SEQ ID NO:1558, SEQ ID NO:1560, SEQ ID NO:1562, SEQ ID NO:1564, SEQ ID NO:1566, SEQ ID NO:1568, SEQ ID NOs:1570-1571, SEQ ID NO:1573, SEQ ID NO:1575, SEQ ID NO:1577, SEQ ID NO:1579, SEQ ID NO:1581, SEQ ID NO:1583, SEQ ID NO:1585, SEQ ID NO:1587, SEQ ID NO:1589, SEQ ID NO:1591, SEQ ID NO:1593, SEQ ID NOs:1595-1608, SEQ ID NO:1610, SEQ ID NO:1612, SEQ ID NO:1614, SEQ ID NO:1616, SEQ ID NO:1618, SEQ ID NOs:1620-1622, SEQ ID NO:1624, SEQ ID NO:1626, SEQ ID NO:1628, SEQ ID NO:1630, SEQ ID NOs:1632-1635, SEQ ID NOs:1637-1651, SEQ ID NOs:1653-1655, SEQ ID NO:1657, SEQ ID NO:1659, SEQ ID NO:1661, SEQ ID NO:1663, SEQ ID NO:1665, SEQ ID NO:1667, SEQ ID NO:1669, SEQ ID NO:1671, SEQ ID NO:1673, SEQ ID NOs:1675-1679, SEQ ID NO:1681, SEQ ID NOs:1683-1690, SEQ ID NO:1692, SEQ ID NO:1694, SEQ ID NO:1696, SEQ ID NO:1698, SEQ ID NO:1700, SEQ ID NO:1702, SEQ ID NO:1704, SEQ ID NO:1706, SEQ ID NO:1708, SEQ ID NO:1710; SEQ ID NO:1712, SEQ ID NO:1714, SEQ ID NO:1716, SEQ ID NO:1718, SEQ ID NO:1720, SEQ ID NO:1722, SEQ ID NO:1724, SEQ ID NO:1726, SEQ ID NOs:1728-1731, SEQ ID NO:1733, SEQ ID NOs:1735-1747, SEQ ID NOs:1749-1750, SEQ ID NOs:1752-1765, SEQ ID NOs:1767-1775, SEQ ID NO:1777, SEQ ID NO:1779, SEQ ID NO:1781, SEQ ID NO:1783, SEQ ID NOs:1785-1804, SEQ ID NOs:1806-1820, SEQ ID NO:1822, SEQ ID NO:1824, SEQ ID NO:1826, SEQ ID NO:1828, SEQ ID NO:1830, SEQ ID NO:1832, SEQ ID NO:1834, SEQ ID NO:1836, SEQ ID NO:1838, SEQ ID NO:1840, SEQ ID NO:1842, SEQ ID NO:1844, SEQ ID NO:1846, SEQ ID NO:1848, SEQ ID NO:1850, SEQ ID NO:1852, SEQ ID NO:1854, SEQ ID NO:1856, SEQ ID NO:1858, SEQ ID NO:1860, SEQ ID NO:1862, SEQ ID NO:1864, SEQ ID NO:1866, SEQ ID NO:1868, SEQ ID NO:1870, SEQ ID NO:1872, SEQ ID NO:1874, SEQ ID NO:1876, SEQ ID NO:1878, SEQ ID NO:1880, SEQ ID NO:1882, SEQ ID NO:1884, SEQ ID NO:1886, SEQ ID NO:1888, SEQ ID NO:1890, SEQ ID NOs:1892-1895, SEQ ID NO:1897, SEQ ID NO:1899, SEQ ID NOs:1901-1902, SEQ ID NO:1904, SEQ ID NO:1906, SEQ ID NO:1908, SEQ ID NOs:1921-2059, SEQ ID NO:2061, SEQ ID NO:2063, SEQ ID NOs:2065-2083, SEQ ID NO:2085, SEQ ID NO:2087, SEQ ID NO:2089, SEQ ID NO:2091, SEQ ID NO:2093, SEQ ID NO:2095, SEQ ID NO:2097, SEQ ID NO:2099, SEQ ID NO:2101, SEQ ID NO:2103, SEQ ID NO:2105, SEQ ID NO:2107, SEQ ID NO:2109, SEQ ID NO:2111, SEQ ID NO:2113, SEQ ID NO:2115, SEQ ID NO:2117, SEQ ID NO:2119, SEQ ID NO:2121, SEQ ID NO:2123, SEQ ID NO:2125, SEQ ID NO:2127, SEQ ID NO:2129, SEQ ID NO:2131, SEQ ID NO:2133, SEQ ID NO:2135, SEQ ID NO:2137, SEQ ID NO:2139, SEQ ID NO:2141, SEQ ID NO:2143, SEQ ID NO:2145, SEQ ID NO:2147, SEQ ID NO:2149, SEQ ID NO:2151, SEQ ID NO:2153, SEQ ID NO:2155, SEQ ID NO:2157, SEQ ID NO:2159, SEQ ID NO:2161, SEQ ID NO:2162, SEQ ID NO:2164, SEQ ID NO:6168, SEQ ID NO:2170, SEQ ID NO:2172, SEQ ID NO:2174, SEQ ID NO:2176, SEQ ID NO:2178, SEQ ID NO:2180, SEQ ID NO:2182, SEQ ID NO:2184, SEQ ID NO:2186, SEQ ID NO:2188, SEQ ID NO:2190, SEQ ID NO:2192, SEQ ID NO:2194, SEQ ID NO:2196, SEQ ID NO:2198, SEQ ID NO:2200, SEQ ID NO:2202, SEQ ID NO:2204, SEQ ID NO:2206, SEQ ID NO:2208, SEQ ID NO:2210, SEQ ID NO:2212, SEQ ID NO:2214, SEQ ID NO:2216, SEQ ID NO:2218, SEQ ID NO:2220, SEQ ID NO:2222, SEQ ID NO:2224, SEQ ID NO:2226, SEQ ID NO:2228, SEQ ID NO:2230, SEQ ID NO:2232, SEQ ID NO:2234, SEQ ID NO:2236, SEQ ID NO:2238, SEQ ID NO:2240, SEQ ID NO:2242, SEQ ID NO:2244, SEQ ID NO:2246, SEQ ID NO:2248, SEQ ID NO:2250, SEQ ID NO:2252, SEQ ID NO:2254, SEQ ID NO:2256, SEQ ID NO:2258, SEQ ID NO:2260, SEQ ID NO:2262, SEQ ID NO:2264, SEQ ID NO:2266, SEQ ID NO:2268, SEQ ID NO:2270, SEQ ID NO:2272, SEQ ID NO:2274, SEQ ID NO:2276, SEQ ID NO:2278, SEQ ID NO:2280, SEQ ID NO:2282, SEQ ID NO:2284, SEQ ID NO:2286, SEQ ID NO:2288, SEQ ID NO:2290, SEQ ID NO:2292, SEQ ID NO:2294, SEQ ID NO:2296, SEQ ID NO:2298, SEQ ID NO:2300, SEQ ID NO:2302, SEQ ID NO:2304, SEQ ID NO:2306, SEQ ID

NO:2308, SEQ ID NO:2310, SEQ ID NO:2312, SEQ ID NO:2314, SEQ ID NO:2316, SEQ ID NO:2318, SEQ ID NO:2320, SEQ ID NO:2322, SEQ ID NO:2324, SEQ ID NO:2326, SEQ ID NO:2328, SEQ ID NO:2330, SEQ ID NO:2332, SEQ ID NO:2334, SEQ ID NO:2336, SEQ ID NO:2338, SEQ ID NO:2340, SEQ ID NO:2342, SEQ ID NO:2344, SEQ ID NO:2346, and SEQ ID NO:2348; where a tissue of a plant produced from the plant cell has a difference in lignin content as compared to the corresponding lignin content in tissue of a control plant that does not comprise the nucleic acid.

In a further aspect, a method of producing a plant is provided. The method comprises growing a plant cell comprising an exogenous nucleic acid. The exogenous nucleic acid comprises a regulatory region operably linked to a nucleotide sequence having 95% or greater sequence identity to a nucleotide sequence selected from the group consisting of SEQ ID NO:95, SEQ ID NO:97, SEQ ID NO:101, SEQ ID NO:103, SEQ ID NO:105, SEQ ID NO:107, SEQ ID NO:109, SEQ ID NO:113, SEQ ID NO:118, SEQ ID NO:123, SEQ ID NO:125, SEQ ID NO:129, SEQ ID NO:133, SEQ ID NO:138, SEQ ID NO:140, SEQ ID NO:142, SEQ ID NO:144, SEQ ID NO:148, SEQ ID NO:150, SEQ ID NO:156, SEQ ID NO:158, SEQ ID NO:160, SEQ ID NO:162, SEQ ID NO:164, SEQ ID NO:169, SEQ ID NO:171, SEQ ID NO:177, SEQ ID NO:195, SEQ ID NO:197, SEQ ID NO:216, SEQ ID NO:218, SEQ ID NO:220, SEQ ID NO:252, SEQ ID NO:254, SEQ ID NO:257, SEQ ID NO:259, SEQ ID NO:261, SEQ ID NO:266, SEQ ID NO:268, SEQ ID NO:271, SEQ ID NO:274, SEQ ID NO:278, SEQ ID NO:281, SEQ ID NO:283, SEQ ID NO:285, SEQ ID NO:288, SEQ ID NO:291, SEQ ID NO:293, SEQ ID NO:299, SEQ ID NO:301, SEQ ID NO:303, SEQ ID NO:305, SEQ ID NO:307, SEQ ID NO:314, SEQ ID NO:317, SEQ ID NO:320, SEQ ID NO:322, SEQ ID NO:324, SEQ ID NO:327, SEQ ID NO:329, SEQ ID NO:331, SEQ ID NO:333, SEQ ID NO:336, SEQ ID NO:338, SEQ ID NO:342, SEQ ID NO:344, SEQ ID NO:346, SEQ ID NO:352, SEQ ID NO:354, SEQ ID NO:356, SEQ ID NO:360, SEQ ID NO:369, SEQ ID NO:371, SEQ ID NO:373, SEQ ID NO:376, SEQ ID NO:378, SEQ ID NO:380, SEQ ID NO:386, SEQ ID NO:390, SEQ ID NO:393, SEQ ID NO:399, SEQ ID NO:401, SEQ ID NO:404, SEQ ID NO:406, SEQ ID NO:408, SEQ ID NO:410, SEQ ID NO:412, SEQ ID NO:414, SEQ ID NO:416, SEQ ID NO:431, SEQ ID NO:435, SEQ ID NO:437, SEQ ID NO:439, SEQ ID NO:441, SEQ ID NO:444, SEQ ID NO:448, SEQ ID NO:450, SEQ ID NO:453, SEQ ID NO:458, SEQ ID NO:460, SEQ ID NO:464, SEQ ID NO:469, SEQ ID NO:472, SEQ ID NO:474, SEQ ID NO:477, SEQ ID NO:482, SEQ ID NO:486, SEQ ID NO:489, SEQ ID NO:491, SEQ ID NO:493, SEQ ID NO:495, SEQ ID NO:500, SEQ ID NO:503, SEQ ID NO:507, SEQ ID NO:509, SEQ ID NO:515, SEQ ID NO:517, SEQ ID NO:519, SEQ ID NO:523, SEQ ID NO:525, SEQ ID NO:528, SEQ ID NO:534, SEQ ID NO:536, SEQ ID NO:538, SEQ ID NO:540, SEQ ID NO:542, SEQ ID NO:544, SEQ ID NO:547, SEQ ID NO:552, SEQ ID NO:554, SEQ ID NO:562, SEQ ID NO:565, SEQ ID NO:569, SEQ ID NO:571, SEQ ID NO:573, SEQ ID NO:577, SEQ ID NO:580, SEQ ID NO:582, SEQ ID NO:584, SEQ ID NO:589, SEQ ID NO:592, SEQ ID NO:595, SEQ ID NO:598, SEQ ID NO:600, SEQ ID NO:602, SEQ ID NO:605, SEQ ID NO:607, SEQ ID NO:609, SEQ ID NO:611, SEQ ID NO:613, SEQ ID NO:618, SEQ ID NO:620, SEQ ID NO:637, SEQ ID NO:649, SEQ ID NO:651, SEQ ID NO:655, SEQ ID NO:658, SEQ ID NO:660, SEQ ID NO:664, SEQ ID NO:670, SEQ ID NO:674, SEQ ID NO:677, SEQ ID NO:679, SEQ ID NO:681, SEQ ID NO:683, SEQ ID NO:685, SEQ ID NO:688, SEQ ID NO:694, SEQ ID NO:697, SEQ ID NO:699, SEQ ID NO:702, SEQ ID NO:704, SEQ ID NO:706, SEQ ID NO:708, SEQ ID NO:712, SEQ ID NO:714, SEQ ID NO:717, SEQ ID NO:719, SEQ ID NO:721, SEQ ID NO:723, SEQ ID NO:729, SEQ ID NO:736, SEQ ID NO:741, SEQ ID NO:743, SEQ ID NO:746, SEQ ID NO:752, SEQ ID NO:754, SEQ ID NO:759, SEQ ID NO:764, SEQ ID NO:778, SEQ ID NO:780, SEQ ID NO:785, SEQ ID NO:789, SEQ ID NO:792, SEQ ID NO:795, SEQ ID NO:797, SEQ ID NO:799, SEQ ID NO:801, SEQ ID NO:807, SEQ ID NO:810, SEQ ID NO:813, SEQ ID NO:815, SEQ ID NO:819, SEQ ID NO:821, SEQ ID NO:823, SEQ ID NO:827, SEQ ID NO:829, SEQ ID NO:832, SEQ ID NO:834, SEQ ID NO:837, SEQ ID NO:840, SEQ ID NO:842, SEQ ID NO:848, SEQ ID NO:851, SEQ ID NO:854, SEQ ID NO:858, SEQ ID NO:860, SEQ ID NO:864, SEQ ID NO:867, SEQ ID NO:884, SEQ ID NO:889, SEQ ID NO:891, SEQ ID NO:893, SEQ ID NO:895, SEQ ID NO:897, SEQ ID NO:899, SEQ ID NO:903, SEQ ID NO:906, SEQ ID NO:911, SEQ ID NO:913, SEQ ID NO:916, SEQ ID NO:918, SEQ ID NO:920, SEQ ID NO:926, SEQ ID NO:928, SEQ ID NO:933, SEQ ID NO:935, SEQ ID NO:937, SEQ ID NO:942, SEQ ID NO:944, SEQ ID NO:958, SEQ ID NO:963, SEQ ID NO:965, SEQ ID NO:967, SEQ ID NO:972, SEQ ID NO:974, SEQ ID NO:979, SEQ ID NO:981, SEQ ID NO:993, SEQ ID NO:1006, SEQ ID NO:1010, SEQ ID NO:1015, SEQ ID NO:1027, SEQ ID NO:1030, SEQ ID NO:1034, SEQ ID NO:1049, SEQ ID NO:1051, SEQ ID NO:1054, SEQ ID NO:1057, SEQ ID NO:1059, SEQ ID NO:1061, SEQ ID NO:1063, SEQ ID NO:1067, SEQ ID NO:1070, SEQ ID NO:1077, SEQ ID NO:1080, SEQ ID NO:1082, SEQ ID NO:1084, SEQ ID NO:1086, SEQ ID NO:1090, SEQ ID NO:1093, SEQ ID NO:1095, SEQ ID NO:1097, SEQ ID NO:1103, SEQ ID NO:1108, SEQ ID NO:1116, SEQ ID NO:1121, SEQ ID NO:1124, SEQ ID NO:1128, SEQ ID NO:1130, SEQ ID NO:1133, SEQ ID NO:1135, SEQ ID NO:1138, SEQ ID NO:1142, SEQ ID NO:1148, SEQ ID NO:1155, SEQ ID NO:1158, SEQ ID NO:1160, SEQ ID NO:1162, SEQ ID NO:1164, SEQ ID NO:1170, SEQ ID NO:1172, SEQ ID NO:1175, SEQ ID NO:1182, SEQ ID NO:1184, SEQ ID NO:1208, SEQ ID NO:1210, SEQ ID NO:1212, SEQ ID NO:1214, SEQ ID NO:1216, SEQ ID NO:1218, SEQ ID NO:1220, SEQ ID NO:1222, SEQ ID NO:1224, SEQ ID NO:1236, SEQ ID NO:1238, SEQ ID NO:1240, SEQ ID NO:1242, SEQ ID NO:1244, SEQ ID NO:1246, SEQ ID NO:1248, SEQ ID NO:1250, SEQ ID NO:1252, SEQ ID NO:1254, SEQ ID NO:1256, SEQ ID NO:1258, SEQ ID NO:1260, SEQ ID NO:1262, SEQ ID NO:1264, SEQ ID NO:1266, SEQ ID NO:1268, SEQ ID NO:1270, SEQ ID NO:1272, SEQ ID NO:1274, SEQ ID NO:1276, SEQ ID NO:1278, SEQ ID NO:1280, SEQ ID NO:1282, SEQ ID NO:1284, SEQ ID NO:1291, SEQ ID NO:1293, SEQ ID NO:1295, SEQ ID NO:1297, SEQ ID NO:1299, SEQ ID NO:1301, SEQ ID NO:1310, SEQ ID NO:1312, SEQ ID NO:1314, SEQ ID NO:1316, SEQ ID NO:1318, SEQ ID NO:1320, SEQ ID NO:1322, SEQ ID NO:1324, SEQ ID NO:1326, SEQ ID NO:1328, SEQ ID NO:1330, SEQ ID NO:1332, SEQ ID NO:1334, SEQ ID NO:1336, SEQ ID NO:1338, SEQ ID NO:1340, SEQ ID NO:1342, SEQ ID NO:1344, SEQ ID NO:1346, SEQ ID NO:1348, SEQ ID NO:1350, SEQ ID NO:1352, SEQ ID NO:1354, SEQ ID NO:1356, SEQ ID NO:1358, SEQ ID NO:1360, SEQ ID NO:1368, SEQ ID NO:1370, SEQ ID NO:1372, SEQ ID NO:1374, SEQ ID NO:1376, SEQ ID NO:1378, SEQ ID NO:1380, SEQ ID NO:1382, SEQ ID NO:1384, SEQ ID NO:1386, SEQ ID NO:1388, SEQ ID NO:1390, SEQ ID NO:1392, SEQ ID NO:1394, SEQ ID NO:1396, SEQ ID NO:1398, SEQ ID NO:1400, SEQ ID NO:1402, SEQ ID NO:1404, SEQ ID NO:1411, SEQ ID NO:1413, SEQ ID NO:1416, SEQ ID NO:1418, SEQ ID NO:1420, SEQ ID NO:1422, SEQ ID NO:1430, SEQ ID NO:1432, SEQ ID NO:1434, SEQ ID NO:1435, SEQ ID NO:1443, SEQ ID NO:1464, SEQ ID NO:1466, SEQ ID NO:1468, SEQ ID NO:1470, SEQ ID NO:1472, SEQ ID NO:1474, SEQ ID NO:1476, SEQ ID NO:1478, SEQ ID NO:1480, SEQ ID NO:1482, SEQ ID NO:1484, SEQ ID NO:1486, SEQ ID NO:1492, SEQ ID NO:1501, SEQ ID NO:1503, SEQ ID NO:1517, SEQ ID NO:1519, SEQ ID NO:1521, SEQ ID NO:1523, SEQ ID NO:1525, SEQ ID NO:1527, SEQ ID NO:1535, SEQ ID NO:1537, SEQ ID NO:1539, SEQ ID NO:1541, SEQ ID NO:1543, SEQ ID NO:1545, SEQ ID NO:1547, SEQ ID NO:1549, SEQ ID NO:1551, SEQ ID NO:1553, SEQ ID NO:1555, SEQ ID NO:1557, SEQ ID NO:1559, SEQ ID NO:1561, SEQ ID NO:1563, SEQ ID NO:1565, SEQ ID NO:1567, SEQ ID NO:1569, SEQ ID NO:1572, SEQ ID NO:1574, SEQ ID NO:1576, SEQ ID NO:1578, SEQ ID NO:1580, SEQ ID NO:1582, SEQ ID NO:1584, SEQ ID NO:1586, SEQ ID NO:1588, SEQ ID NO:1590, SEQ ID NO:1592, SEQ ID NO:1594, SEQ ID NO:1609, SEQ ID NO:1611, SEQ ID NO:1613, SEQ ID NO:1615, SEQ ID NO:1617, SEQ ID NO:1619, SEQ ID NO:1623, SEQ ID NO:1625, SEQ ID NO:1627, SEQ ID NO:1629, SEQ ID NO:1631, SEQ ID NO:1636, SEQ ID NO:1652, SEQ ID NO:1656, SEQ ID NO:1658, SEQ ID NO:1660, SEQ ID NO:1662, SEQ ID NO:1664, SEQ ID NO:1666, SEQ ID NO:1668, SEQ ID NO:1670, SEQ ID NO:1672, SEQ ID NO:1674, SEQ ID NO:1680, SEQ ID NO:1682, SEQ ID NO:1691, SEQ ID NO:1693, SEQ ID NO:1695, SEQ ID NO:1697, SEQ ID NO:1699, SEQ ID NO:1701, SEQ ID NO:1703, SEQ ID NO:1705, SEQ ID NO:1707, SEQ ID NO:1709, SEQ ID NO:1711, SEQ ID NO:1713, SEQ ID NO:1715, SEQ ID NO:1717, SEQ ID NO:1719, SEQ ID NO:1721, SEQ ID NO:1723, SEQ ID NO:1725, SEQ ID NO:1727, SEQ ID NO:1732, SEQ ID NO:1734, SEQ ID NO:1748, SEQ ID NO:1751, SEQ ID NO:1766, SEQ ID NO:1776, SEQ ID NO:1778, SEQ ID NO:1780, SEQ ID NO:1782, SEQ ID NO:1784, SEQ ID NO:1805, SEQ ID NO:1821, SEQ ID NO:1823, SEQ ID NO:1825, SEQ ID NO:1827, SEQ ID NO:1829, SEQ ID NO:1831, SEQ ID NO:1833, SEQ ID NO:1835, SEQ ID NO:1837, SEQ ID NO:1839, SEQ ID NO:1841, SEQ ID NO:1843, SEQ ID NO:1845, SEQ ID NO:1847, SEQ ID NO:1849, SEQ ID NO:1851, SEQ ID NO:1853, SEQ ID NO:1855, SEQ ID NO:1857, SEQ ID NO:1859, SEQ ID NO:1861, SEQ ID NO:1863, SEQ ID NO:1865, SEQ ID NO:1867, SEQ ID NO:1869, SEQ ID NO:1871, SEQ ID NO:1873, SEQ ID NO:1875, SEQ ID NO:1877, SEQ ID NO:1879, SEQ ID NO:1881, SEQ ID NO:1883, SEQ ID NO:1885, SEQ ID NO:1887, SEQ ID NO:1889, SEQ ID NO:1891, SEQ ID NO:1896, SEQ ID NO:1898, SEQ ID NO:1900, SEQ ID NO:1903, SEQ ID NO:1905, SEQ ID NO:1907, SEQ ID NO:1919, SEQ ID NO:1920, SEQ ID NO:2060, SEQ ID NO:2062, SEQ ID NO:2064, SEQ ID NO:2084, SEQ ID NO:2088, SEQ ID NO:2090, SEQ ID NO:2092, SEQ ID NO:2094, SEQ ID NO:2096, SEQ ID NO:2098, SEQ ID NO:2100, SEQ ID NO:2102, SEQ ID NO:2104, SEQ ID NO:2106, SEQ ID NO:2108, SEQ ID NO:2110, SEQ ID NO:2112, SEQ ID NO:2114, SEQ ID NO:2116, SEQ ID NO:2118, SEQ ID NO:2120, SEQ ID NO:2122, SEQ ID NO:2124, SEQ ID NO:2126, SEQ ID NO:2128, SEQ ID NO:2130, SEQ ID NO:2132, SEQ ID NO:2134, SEQ ID NO:2136, SEQ ID NO:2138, SEQ ID NO:2140, SEQ ID NO:2142, SEQ ID NO:2144, SEQ ID NO:2146, SEQ ID NO:2148, SEQ ID NO:2150, SEQ ID NO:2152, SEQ ID NO:2154, SEQ ID NO:2156, SEQ ID NO:2158, SEQ ID NO:2160, SEQ ID NO:2161, SEQ ID NO:2163, SEQ ID NO:2165, SEQ ID NO:6167, SEQ ID NO:2169, SEQ ID NO:2171, SEQ ID NO:2173, SEQ ID NO:2175, SEQ ID NO:2177, SEQ ID NO:2179, SEQ ID NO:2181, SEQ ID NO:2183, SEQ ID NO:2185, SEQ ID NO:2187, SEQ ID NO:2189, SEQ ID NO:2191, SEQ ID NO:2193, SEQ ID NO:2195, SEQ ID NO:2197, SEQ ID NO:2199, SEQ ID NO:2201, SEQ ID NO:2203, SEQ ID NO:2205, SEQ ID NO:2207, SEQ ID NO:2209, SEQ ID NO:2211, SEQ ID NO:2213, SEQ ID NO:2215, SEQ ID NO:2217, SEQ ID NO:2219, SEQ ID NO:2221, SEQ ID NO:2223, SEQ ID NO:2225, SEQ ID NO:2227, SEQ ID NO:2229, SEQ ID NO:2231, SEQ ID NO:2233, SEQ ID NO:2235, SEQ ID NO:2237, SEQ ID NO:2239, SEQ ID NO:2241, SEQ ID NO:2243, SEQ ID NO:2245, SEQ ID NO:2247, SEQ ID NO:2249, SEQ ID NO:2251, SEQ ID NO:2253, SEQ ID NO:2255, SEQ ID NO:2257, SEQ ID NO:2259, SEQ ID NO:2261, SEQ ID NO:2263, SEQ ID NO:2265, SEQ ID NO:2267, SEQ ID NO:2269, SEQ ID NO:2271, SEQ ID NO:2273, SEQ ID NO:2275, SEQ ID NO:2277, SEQ ID NO:2279, SEQ ID NO:2281, SEQ ID NO:2283, SEQ ID NO:2285, SEQ ID NO:2287, SEQ ID NO:2289, SEQ ID NO:2291, SEQ ID NO:2293, SEQ ID NO:2295, SEQ ID NO:2297, SEQ ID NO:2299, SEQ ID NO:2301, SEQ ID NO:2303, SEQ ID NO:2305, SEQ ID NO:2307, SEQ ID NO:2309, SEQ ID NO:2311, SEQ ID NO:2313, SEQ ID NO:2315, SEQ ID NO:2317, SEQ ID NO:2319, SEQ ID NO:2321, SEQ ID NO:2323, SEQ ID NO:2325, SEQ ID NO:2327, SEQ ID NO:2329, SEQ ID NO:2331, SEQ ID NO:2333, SEQ ID NO:2335, SEQ ID NO:2337, SEQ ID NO:2339, SEQ ID NO:2341, SEQ ID NO:2343, SEQ ID NO:2345, SEQ ID NO:2347, and SEQ ID NO:2349-2690; where a tissue of a plant produced from the plant cell has a difference in lignin content as compared to the corresponding lignin content in tissue of a control plant that does not comprise the nucleic acid.

Plant cells comprising an exogenous nucleic acid are provided herein. The exogenous nucleic acid comprises a regulatory region operably linked to a nucleotide sequence encoding a polypeptide. The HMM bit score of the amino acid sequence of the polypeptide is greater than about 20, using an HMM generated from the amino acid sequences depicted in one of FIGS. 1 to 51 or 53 to 131. A tissue of a plant produced from the plant cell has a difference in lignin content as compared to the corresponding lignin content of a control plant that does not comprise the nucleic acid. A transgenic plant comprising such a plant cell also is provided.

In another aspect, the plant cell comprises an exogenous nucleic acid comprising a regulatory region operably linked to a polynucleotide encoding a polypeptide comprising an amino acid sequence having 80% or greater sequence identity to an amino acid sequence selected from the group consisting of SEQ ID NO:96, SEQ ID NOs:98-100, SEQ ID NO:102, SEQ ID NO:104, SEQ ID NO:106, SEQ ID NO:108, SEQ ID NOs:110-112, SEQ ID NOs:114-117, SEQ ID NOs:119-122, SEQ ID NO:124, SEQ ID NOs:126-128, SEQ ID NOs:130-132, SEQ ID NOs:134-137, SEQ ID NO:139, SEQ ID NO:141, SEQ ID NO:143, SEQ ID NOs:145-147, SEQ ID NO:149, SEQ ID NOs:151-155, SEQ ID NO:157, SEQ ID NO:159, SEQ ID NO:161, SEQ ID NO:163, SEQ ID NOs: 165-168, SEQ ID NO:170, SEQ ID NOs:172-176, SEQ ID NOs:178-194, SEQ ID NO:196, SEQ ID NOs:198-215, SEQ ID NO:217, SEQ ID NO:219, SEQ ID NOs:221-251, SEQ ID NO:253, SEQ ID NOs:255-256, SEQ ID NO:258, SEQ ID NO:260, SEQ ID NOs:262-265, SEQ ID NO:267, SEQ ID NOs:269-270, SEQ ID NOs:272-273, SEQ ID NOs:275-277, SEQ ID NOs:279-280, SEQ ID NO:282, SEQ ID NO:284, SEQ ID NOs:286-287, SEQ ID NOs:289-290, SEQ ID NO:292, SEQ ID NOs:294-298, SEQ ID NO:300, SEQ ID NO:302, SEQ ID NO:304, SEQ ID NO:306, SEQ ID NOs: 308-313, SEQ ID NOs:315-316, SEQ ID NOs:318-319, SEQ ID NO:321, SEQ ID NO:323, SEQ ID NOs:325-326, SEQ ID NO:328, SEQ ID NO:330, SEQ ID NO:332, SEQ ID NOs: 334-335, SEQ ID NO:337, SEQ ID NO:339-341, SEQ ID NO:343, SEQ ID NO:345, SEQ ID NO:347-351, SEQ ID NO:353, SEQ ID NO:355, SEQ ID NO:357-359, SEQ ID NOs:361-368, SEQ ID NO:370, SEQ ID NO:372, SEQ ID NOs:374-375, SEQ ID NO:377, SEQ ID NO:379, SEQ ID NOs:381-385, SEQ ID NOs:387-389, SEQ ID NOs:391-392, SEQ ID NOs:394-398, SEQ ID NO:400, SEQ ID NOs:402-403, SEQ ID NO:405, SEQ ID NO:407, SEQ ID NO:409, SEQ ID NO:411, SEQ ID NO:413, SEQ ID NO:415, SEQ ID NOs:417-430, SEQ ID NOs:432-434, SEQ ID NO:436, SEQ ID NO:438, SEQ ID NO:440, SEQ ID NOs:442-443, SEQ ID NOs:445-447, SEQ ID NO:449, SEQ ID NOs:451-452, SEQ ID NOs:454-457, SEQ ID NO:459, SEQ ID NOs:461-463, SEQ ID NOs:465-468, SEQ ID NOs:470-471, SEQ ID NO:473, SEQ ID NOs:475-476, SEQ ID NOs:478-481, SEQ ID NOs:483-485, SEQ ID NOs:487-488, SEQ ID NO:490, SEQ ID NO:492, SEQ ID NO:494, SEQ ID NOs:496-499, SEQ ID NOs:501-502, SEQ ID NOs:504-506, SEQ ID NO:508, SEQ ID NOs:510-514, SEQ ID NO:516, SEQ ID NO:518, SEQ ID NOs:520-522, SEQ ID NO:524, SEQ ID NOs:526-527, SEQ ID NOs:529-533, SEQ ID NO:535, SEQ ID NO:537, SEQ ID NO:539, SEQ ID NO:541, SEQ ID NO:543, SEQ ID NOs:545-546, SEQ ID NOs:548-551, SEQ ID NO:553, SEQ ID NOs:555-561, SEQ ID NOs:563-564, SEQ ID NOs:566-568, SEQ ID NO:570, SEQ ID NO:572, SEQ ID NOs:574-576, SEQ ID NOs:578-579, SEQ ID NO:581, SEQ ID NO:583, SEQ ID NOs:585-588, SEQ ID NOs:590-591, SEQ ID NOs:593-594, SEQ ID NOs:596-597, SEQ ID NO:599, SEQ ID NO:601, SEQ ID NOs:603-604, SEQ ID NO:606, SEQ ID NO:608, SEQ ID NO:610, SEQ ID NO:612, SEQ ID NOs:614-617, SEQ ID NO:619, SEQ ID NOs:621-636, SEQ ID NOs:638-648, SEQ ID NO:650, SEQ ID NOs:652-654, SEQ ID NOs:656-657, SEQ ID NO:659, SEQ ID NOs:661-663, SEQ ID NOs:665-669, SEQ ID NOs: 671-673, SEQ ID NOs:675-676, SEQ ID NO:678, SEQ ID NO:680, SEQ ID NO:682, SEQ ID NO:684, SEQ ID NOs: 686-687, SEQ ID NOs:689-693, SEQ ID NOs:695-696, SEQ ID NO:698, SEQ ID NOs:700-701, SEQ ID NO:703, SEQ ID NO:705, SEQ ID NO:707, SEQ ID NOs:709-711, SEQ ID NO:713, SEQ ID NOs:715-716, SEQ ID NO:718, SEQ ID NO:720, SEQ ID NO:722, SEQ ID NOs:724-728, SEQ ID NOs:730-735, SEQ ID NOs:737-740, SEQ ID NO:742, SEQ ID NOs:744-745, SEQ ID NOs:747-751, SEQ ID NO:753, SEQ ID NOs:755-758, SEQ ID NOs:760-763, SEQ ID NOs: 765-777, SEQ ID NO:779, SEQ ID NOs:781-784, SEQ ID NOs:786-788, SEQ ID NOs:790-791, SEQ ID NOs:793-794, SEQ ID NO:796, SEQ ID NO:798, SEQ ID NO:800, SEQ ID NOs:802-806, SEQ ID NOs:808-809, SEQ ID NOs:811-812, SEQ ID NO:814, SEQ ID NOs:816-818, SEQ ID NO:820, SEQ ID NO:822, SEQ ID NOs:824-826, SEQ ID NO:828, SEQ ID NOs:830-831, SEQ ID NO:833, SEQ ID NOs:835-836, SEQ ID NOs:838-839, SEQ ID NO:841, SEQ ID NOs: 843-847, SEQ ID NOs:849-850, SEQ ID NOs:852-853, SEQ ID NOs:855-857, SEQ ID NO:859, SEQ ID NOs:861-863, SEQ ID NOs:865-866, SEQ ID NOs:868-883, SEQ ID NOs: 885-888, SEQ ID NO:890, SEQ ID NO:892, SEQ ID NO:894, SEQ ID NO:896, SEQ ID NO:898, SEQ ID NOs: 900-902, SEQ ID NOs:904-905, SEQ ID NOs:907-910, SEQ ID NO:912, SEQ ID NOs:914-915, SEQ ID NO:917, SEQ ID NO:919, SEQ ID NOs:921-925, SEQ ID NO:927, SEQ ID NOs:929-932, SEQ ID NO:934, SEQ ID NO:936, SEQ ID NOs:938-941, SEQ ID NO:943 SEQ ID NOs:945-957, SEQ ID NOs:959-962, SEQ ID NO:964, SEQ ID NO:966, SEQ ID NOs:968-971, SEQ ID NO:973, SEQ ID NOs:975-978, SEQ ID NO:980, SEQ ID NOs:982-992, SEQ ID NOs:994-1005, SEQ ID NOs:1007-1009, SEQ ID NOs:1011-1014, SEQ ID NOs:1016-1026, SEQ ID NOs:1028-1029, SEQ ID NOs: 1031-1033, SEQ ID NOs:1035-1048, SEQ ID NO:1050, SEQ ID NOs:1052-1053, SEQ ID NOs:1055-1056, SEQ ID NO:1058, SEQ ID NO:1060, SEQ ID NO:1062, SEQ ID NOs:1064-1066, SEQ ID NOs:1068-1069, SEQ ID NOs: 1071-1076, SEQ ID NOs:1078-1079, SEQ ID NO:1081, SEQ ID NO:1083, SEQ ID NO:1085, SEQ ID NOs:1087-1089, SEQ ID NOs:1091-1092, SEQ ID NO:1094, SEQ ID NO:1096, SEQ ID NO:1098-1102, SEQ ID NOs:1104-1107, SEQ ID NOs:1109-1115, SEQ ID NOs:1117-1120, SEQ ID NOs:1122-1123, SEQ ID NOs:1125-1127, SEQ ID NO:1129, SEQ ID NOs:1131-1132, SEQ ID NO:1134, SEQ ID NOs:1136-1137, SEQ ID NOs:1139-1141, SEQ ID NOs: 1143-1147, SEQ ID NOs:1149-1154, SEQ ID NOs:1156-1157, SEQ ID NO:1159, SEQ ID NO:1161, SEQ ID NO:1163, SEQ ID NOs:1165-1169, SEQ ID NO:1171, SEQ ID NOs:1173-1174, SEQ ID NOs:1176-1181, SEQ ID NO:1183, SEQ ID NOs:1185-1207, SEQ ID NO:1209, SEQ ID NO:1211, SEQ ID NO:1213, SEQ ID NO:1215, SEQ ID NO:1217, SEQ ID NO:1219, SEQ ID NO:1221, SEQ ID NO:1223, SEQ ID NOs:1225-1235, SEQ ID NO:1237, SEQ ID NO:1239, SEQ ID NO:1241, SEQ ID NO:1243, SEQ ID NO:1245, SEQ ID NO:1247, SEQ ID NO:1249, SEQ ID NO:1251, SEQ ID NO:1253, SEQ ID NO:1255, SEQ ID NO:1257, SEQ ID NO:1259, SEQ ID NO:1261, SEQ ID NO:1263, SEQ ID NO:1265, SEQ ID NO:1267, SEQ ID NO:1269, SEQ ID NO:1271, SEQ ID NO:1273, SEQ ID NO:1275, SEQ ID NO:1277, SEQ ID NO:1279, SEQ ID NO:1281, SEQ ID NO:1283, SEQ ID NOs:1285-1290, SEQ ID NO:1292, SEQ ID NO:1294, SEQ ID NO:1296, SEQ ID NO:1298, SEQ ID NO:1300, SEQ ID NOs:1302-1309, SEQ ID NO:1311, SEQ ID NO:1313, SEQ ID NO:1315, SEQ ID NO:1317, SEQ ID NO:1319, SEQ ID NO:1321, SEQ ID NO:1323, SEQ ID NO:1325, SEQ ID NO:1327, SEQ ID NO:1329, SEQ ID NO:1331, SEQ ID NO:1333, SEQ ID NO:1335, SEQ ID NO:1337, SEQ ID NO:1339, SEQ ID NO:1341, SEQ ID NO:1343, SEQ ID NO:1345, SEQ ID NO:1347, SEQ ID NO:1349, SEQ ID NO:1351, SEQ ID NO:1353, SEQ ID NO:1355, SEQ ID NO:1357, SEQ ID NO:1359, SEQ ID NOs:1361-1367, SEQ ID NO:1369, SEQ ID NO:1371, SEQ ID NO:1373, SEQ ID NO:1375, SEQ ID NO:1377, SEQ ID NO:1379, SEQ ID NO:1381, SEQ ID NO:1383, SEQ ID NO:1385, SEQ ID NO:1387, SEQ ID NO:1389, SEQ ID NO:1391, SEQ ID NO:1393, SEQ ID NO:1395, SEQ ID NO:1397, SEQ ID NO:1399, SEQ ID NO:1401, SEQ ID NO:1403, SEQ ID NOs:1405-1410, SEQ ID NO:1412, SEQ ID NOs:1414-1415, SEQ ID NO:1417, SEQ ID NO:1419, SEQ ID NO:1421, SEQ ID NOs:1423-1429, SEQ ID NO:1431, SEQ ID NO:1433, SEQ ID NOs: 1436-1442, SEQ ID NOs:1444-1463, SEQ ID NO:1465, SEQ ID NO:1467, SEQ ID NO:1469, SEQ ID NO:1471, SEQ ID NO:1473, SEQ ID NO:1475, SEQ ID NO:1477, SEQ ID NO:1479, SEQ ID NO:1481, SEQ ID NO:1483, SEQ ID NO:1485, SEQ ID NOs:1487-1491, SEQ ID NOs:1493-1500, SEQ ID NO:1502, SEQ ID NOs:1504-1516, SEQ ID NO:1518, SEQ ID NO:1520, SEQ ID NO:1522, SEQ ID NO:1524, SEQ ID NO:1526, SEQ ID NOs:1528-1534, SEQ ID NO:1536, SEQ ID NO:1538, SEQ ID NO:1540, SEQ ID NO:1542, SEQ ID NO:1544, SEQ ID NO:1546, SEQ ID NO:1548, SEQ ID NO:1550, SEQ ID NO:1552, SEQ ID NO:1554, SEQ ID NO:1556, SEQ ID NO:1558, SEQ ID NO:1560, SEQ ID NO:1562, SEQ ID NO:1564, SEQ ID NO:1566, SEQ ID NO:1568, SEQ ID NOs:1570-1571, SEQ ID NO:1573, SEQ ID NO:1575, SEQ ID NO:1577, SEQ ID NO:1579, SEQ ID NO:1581, SEQ ID NO:1583, SEQ ID NO:1585, SEQ ID NO:1587, SEQ ID NO:1589, SEQ ID NO:1591, SEQ ID NO:1593, SEQ ID NOs:1595-1608, SEQ ID NO:1610, SEQ ID NO:1612, SEQ ID NO:1614, SEQ ID NO:1616, SEQ ID NO:1618, SEQ ID NOs:1620-1622, SEQ ID NO:1624, SEQ ID NO:1626, SEQ ID NO:1628, SEQ ID NO:1630, SEQ ID NOs:1632-1635, SEQ ID NOs:1637-1651, SEQ ID NOs:1653-1655, SEQ ID NO:1657, SEQ ID NO:1659, SEQ ID NO:1661, SEQ ID NO:1663, SEQ ID NO:1665, SEQ ID NO:1667, SEQ ID NO:1669, SEQ ID NO:1671, SEQ ID NO:1673, SEQ ID NOs:1675-1679, SEQ ID NO:1681, SEQ ID NOs:1683-1690, SEQ ID NO:1692, SEQ ID NO:1694, SEQ ID NO:1696, SEQ ID NO:1698, SEQ ID NO:1700, SEQ ID NO:1702, SEQ ID NO:1704, SEQ ID NO:1706, SEQ ID NO:1708, SEQ ID NO:1710; SEQ ID NO:1712, SEQ ID NO:1714, SEQ ID NO:1716, SEQ ID NO:1718, SEQ ID NO:1720, SEQ ID NO:1722, SEQ ID NO:1724, SEQ ID NO:1726, SEQ ID NOs:1728-1731, SEQ ID NO:1733, SEQ ID NOs:1735-1747, SEQ ID NOs:1749-1750, SEQ ID NOs:1752-1765, SEQ ID NOs:1767-1775, SEQ ID NO:1777, SEQ ID NO:1779, SEQ ID NO:1781, SEQ ID NO:1783, SEQ ID NOs:1785-1804, SEQ ID NOs:1806-1820, SEQ ID NO:1822, SEQ ID NO:1824, SEQ ID NO:1826, SEQ ID NO:1828, SEQ ID NO:1830, SEQ ID NO:1832, SEQ ID NO:1834, SEQ ID NO:1836, SEQ ID NO:1838, SEQ ID NO:1840, SEQ ID NO:1842, SEQ ID NO:1844, SEQ ID NO:1846, SEQ ID NO:1848, SEQ ID NO:1850, SEQ ID NO:1852, SEQ ID NO:1854, SEQ ID NO:1856, SEQ ID NO:1858, SEQ ID NO:1860, SEQ ID NO:1862, SEQ ID NO:1864, SEQ ID NO:1866, SEQ ID NO:1868, SEQ ID NO:1870, SEQ ID NO:1872, SEQ ID NO:1874, SEQ ID NO:1876, SEQ ID NO:1878, SEQ ID NO:1880, SEQ ID NO:1882, SEQ ID NO:1884, SEQ ID NO:1886, SEQ ID NO:1888, SEQ ID NO:1890, SEQ ID NOs:1892-1895, SEQ ID NO:1897, SEQ ID NO:1899, SEQ ID NOs:1901-1902, SEQ ID NO:1904, SEQ ID NO:1906, SEQ ID NO:1908, SEQ ID NOs:1921-2059, SEQ ID NO:2061, SEQ ID NO:2063, SEQ ID NOs:2065-2083, SEQ ID NO:2085, SEQ ID NO:2087, SEQ ID NO:2089, SEQ ID NO:2091, SEQ ID NO:2093, SEQ ID NO:2095, SEQ ID NO:2097, SEQ ID NO:2099, SEQ ID NO:2101, SEQ ID NO:2103, SEQ ID NO:2105, SEQ ID NO:2107, SEQ ID NO:2109, SEQ ID NO:2111, SEQ ID NO:2113, SEQ ID NO:2115, SEQ ID NO:2117, SEQ ID NO:2119, SEQ ID NO:2121, SEQ ID NO:2123, SEQ ID NO:2125, SEQ ID NO:2127, SEQ ID NO:2129, SEQ ID NO:2131, SEQ ID NO:2133, SEQ ID NO:2135, SEQ ID NO:2137, SEQ ID NO:2139, SEQ ID NO:2141, SEQ ID NO:2143, SEQ ID NO:2145, SEQ ID NO:2147, SEQ ID NO:2149, SEQ ID NO:2151, SEQ ID NO:2153, SEQ ID NO:2155, SEQ ID NO:2157, SEQ ID NO:2159, SEQ ID NO:2161, SEQ ID NO:2162, SEQ ID NO:2164, SEQ ID NO:2166, SEQ ID NO:6168, SEQ ID NO:2170, SEQ ID NO:2172, SEQ ID NO:2174, SEQ ID NO:2176, SEQ ID NO:2178, SEQ ID NO:2180, SEQ ID NO:2182, SEQ ID NO:2184, SEQ ID NO:2186, SEQ ID NO:2188, SEQ ID NO:2190, SEQ ID NO:2192, SEQ ID NO:2194, SEQ ID NO:2196, SEQ ID NO:2198, SEQ ID NO:2200, SEQ ID NO:2202, SEQ ID NO:2204, SEQ ID NO:2206, SEQ ID NO:2208, SEQ ID NO:2210, SEQ ID NO:2212, SEQ ID NO:2214, SEQ ID NO:2216, SEQ ID NO:2218, SEQ ID NO:2220, SEQ ID NO:2222, SEQ ID NO:2224, SEQ ID NO:2226, SEQ ID NO:2228, SEQ ID NO:2230, SEQ ID NO:2232, SEQ ID NO:2234, SEQ ID NO:2236, SEQ ID NO:2238, SEQ ID NO:2240, SEQ ID NO:2242, SEQ ID NO:2244, SEQ ID NO:2246, SEQ ID NO:2248, SEQ ID NO:2250, SEQ ID NO:2252, SEQ ID NO:2254, SEQ ID NO:2256, SEQ ID NO:2258, SEQ ID NO:2260, SEQ ID NO:2262, SEQ ID NO:2264, SEQ ID NO:2266, SEQ ID NO:2268, SEQ ID NO:2270, SEQ ID NO:2272, SEQ ID NO:2274, SEQ ID NO:2276, SEQ ID NO:2278, SEQ ID NO:2280, SEQ ID NO:2282, SEQ ID NO:2284, SEQ ID NO:2286, SEQ ID NO:2288, SEQ ID NO:2290, SEQ ID NO:2292, SEQ ID NO:2294, SEQ ID NO:2296, SEQ ID NO:2298, SEQ ID NO:2300, SEQ ID NO:2302, SEQ ID NO:2304, SEQ ID NO:2306, SEQ ID NO:2308, SEQ ID NO:2310, SEQ ID NO:2312, SEQ ID NO:2314, SEQ ID NO:2316, SEQ ID NO:2318, SEQ ID NO:2320, SEQ ID NO:2322, SEQ ID NO:2324, SEQ ID NO:2326, SEQ ID NO:2328, SEQ ID NO:2330, SEQ ID NO:2332, SEQ ID NO:2334, SEQ ID NO:2336, SEQ ID NO:2338, SEQ ID NO:2340, SEQ ID NO:2342, SEQ ID NO:2344, SEQ ID NO:2346, and SEQ ID NO:2348; where a tissue of a plant produced from the plant cell has a difference in lignin content as compared to the corresponding lignin content in tissue of a control plant that does not comprise the nucleic acid. A transgenic plant comprising such a plant cell also is provided.

The plant cell can further comprise a sequence of interest operably linked to a regulatory region associated with the polypeptide. The sequence of interest can inhibit expression of an endogenous gene involved in lignin biosynthesis. The sequence of interest can be in antisense orientation relative to the regulatory region. The sequence of interest can be transcribed into an interfering RNA. The endogenous gene can comprise a coding sequence for a regulatory protein involved in lignin biosynthesis. The endogenous gene can comprise a coding sequence for a lignin biosynthesis enzyme. The enzyme can be 4-(hydroxy)cinnamoyl CoA ligase (4CL; EC 6.2.1.12), p-coumarate 3-hydroxylase (C3H), cinnamate 4-hydroxylase (C4H; EC 1.14.13.11), cinnamyl alcohol dehydrogenase (CAD; EC 1.1.1.195), caffeoyl CoA O-methyltransferase (CCoAOMT; EC 2.1.1.104), cinnamoyl CoA reductase (CCR; EC 1.2.1.44), caffeic acid/5-hydroxyferulic acid O-methyltransferase (COMT; EC 2.1.1.68), hydroxycinnamoyl CoA:quinate hydroxycinnamoyltransferase (CQT; EC 2.3.1.99), hydroxycinnamoyl CoA:shikimate hydroxycinnamoyltransferase (CST; EC 2.3.1.133), ferulate 5-hydroxylase (F5H), phenylalanine ammonia-lyase (PAL; EC 4.3.1.5), p-coumaryl CoA 3-hydroxylase (pCCoA3H), sinapyl alcohol dehydrogenase (SAD), a peroxidase enzyme (EC 1.11.1.x), laccase (EC 1.10.3.2), coniferyl-alcohol glucosyltransferase (EC 2.4.1.111), or coniferin β-glucosidase (EC 3.2.1.126). The regulatory region and its associated polypeptide can be effective for increasing lignin biosynthesis. The regulatory region and its associated polypeptide can be effective for decreasing lignin biosynthesis.

The polypeptide can modulate the expression of an endogenous gene involved in lignin biosynthesis. The endogenous gene can comprise a coding sequence for a lignin biosynthesis enzyme. The endogenous gene can comprise a coding sequence for a regulatory protein involved in lignin biosynthesis. The modulation of the endogenous gene can be an increase in expression of the endogenous gene.

The plant cell can further comprise a nucleic acid encoding a second polypeptide operably linked to a regulatory region, where the second polypeptide encodes a regulatory protein. The nucleic acid can be on a second recombinant nucleic acid construct.

In another aspect, the plant cell comprises an exogenous nucleic acid comprising a regulatory region operably linked to a nucleic acid sequence having 95% or greater sequence identity to an nucleic acid sequence selected from the group consisting of SEQ ID NO:95, SEQ ID NO:97, SEQ ID NO:101, SEQ ID NO:103, SEQ ID NO:105, SEQ ID NO:107, SEQ ID NO:109, SEQ ID NO:113, SEQ ID NO:118, SEQ ID NO:123, SEQ ID NO:125, SEQ ID NO:129, SEQ ID NO:133, SEQ ID NO:138, SEQ ID NO:140, SEQ ID NO:142, SEQ ID NO:144, SEQ ID NO:148, SEQ ID NO:150, SEQ ID NO:156, SEQ ID NO:158, SEQ ID NO:160, SEQ ID NO:162, SEQ ID NO:164, SEQ ID NO:169, SEQ ID NO:171, SEQ ID NO:177, SEQ ID NO:195, SEQ ID NO:197, SEQ ID NO:216, SEQ ID NO:218, SEQ ID NO:220, SEQ ID NO:252, SEQ ID NO:254, SEQ ID NO:257, SEQ ID NO:259, SEQ ID NO:261, SEQ ID NO:266, SEQ ID NO:268, SEQ ID NO:271, SEQ ID NO:274, SEQ ID NO:278, SEQ ID NO:281, SEQ ID NO:283, SEQ ID NO:285, SEQ ID NO:288, SEQ ID NO:291, SEQ ID NO:293, SEQ ID NO:299, SEQ ID NO:301, SEQ ID NO:303, SEQ ID NO:305, SEQ ID NO:307, SEQ ID NO:314, SEQ ID NO:317, SEQ ID NO:320, SEQ ID NO:322, SEQ ID NO:324, SEQ ID NO:327, SEQ ID NO:329, SEQ ID NO:331, SEQ ID NO:333, SEQ ID NO:336, SEQ ID NO:338, SEQ ID NO:342, SEQ ID NO:344, SEQ ID NO:346, SEQ ID NO:352, SEQ ID NO:354, SEQ ID NO:356, SEQ ID NO:360, SEQ ID NO:369, SEQ ID NO:371, SEQ ID NO:373, SEQ ID NO:376, SEQ ID NO:378, SEQ ID NO:380, SEQ ID NO:386, SEQ ID NO:390, SEQ ID NO:393, SEQ ID NO:399, SEQ ID NO:401, SEQ ID NO:404, SEQ ID NO:406, SEQ ID NO:408, SEQ ID NO:410, SEQ ID NO:412, SEQ ID NO:414, SEQ ID NO:416, SEQ ID NO:431, SEQ ID NO:435, SEQ ID NO:437, SEQ ID NO:439, SEQ ID NO:441, SEQ ID NO:444, SEQ ID NO:448, SEQ ID NO:450, SEQ ID NO:453, SEQ ID NO:458, SEQ ID NO:460, SEQ ID NO:464, SEQ ID NO:469, SEQ ID NO:472, SEQ ID NO:474, SEQ ID NO:477, SEQ ID NO:482, SEQ ID NO:486, SEQ ID NO:489, SEQ ID NO:491, SEQ ID NO:493, SEQ ID NO:495, SEQ ID NO:500, SEQ ID NO:503, SEQ ID NO:507, SEQ ID NO:509, SEQ ID NO:515, SEQ ID NO:517, SEQ ID NO:519, SEQ ID NO:523, SEQ ID NO:525, SEQ ID NO:528, SEQ ID NO:534, SEQ ID NO:536, SEQ ID NO:538, SEQ ID NO:540, SEQ ID NO:542, SEQ ID NO:544, SEQ ID NO:547, SEQ ID NO:552, SEQ ID NO:554, SEQ ID NO:562, SEQ ID NO:565, SEQ ID NO:569, SEQ ID NO:571, SEQ ID NO:573, SEQ ID NO:577, SEQ ID NO:580, SEQ ID NO:582, SEQ ID NO:584, SEQ ID NO:589, SEQ ID NO:592, SEQ ID NO:595, SEQ ID NO:598, SEQ ID NO:600, SEQ ID NO:602, SEQ ID NO:605, SEQ ID NO:607, SEQ ID NO:609, SEQ ID NO:611, SEQ ID NO:613, SEQ ID NO:618, SEQ ID NO:620, SEQ ID NO:637, SEQ ID NO:649, SEQ ID NO:651, SEQ ID NO:655, SEQ ID NO:658, SEQ ID NO:660, SEQ ID NO:664, SEQ ID NO:670, SEQ ID NO:674, SEQ ID NO:677, SEQ ID NO:679, SEQ ID NO:681, SEQ ID NO:683, SEQ ID NO:685, SEQ ID NO:688, SEQ ID NO:694, SEQ ID NO:697, SEQ ID NO:699, SEQ ID NO:702, SEQ ID NO:704, SEQ ID NO:706, SEQ ID NO:708, SEQ ID NO:712, SEQ ID NO:714, SEQ ID NO:717, SEQ ID NO:719, SEQ ID NO:721, SEQ ID NO:723, SEQ ID NO:729, SEQ ID NO:736, SEQ ID NO:741, SEQ ID NO:743, SEQ ID NO:746, SEQ ID NO:752, SEQ ID NO:754, SEQ ID NO:759, SEQ ID NO:764, SEQ ID NO:778, SEQ ID NO:780, SEQ ID NO:785, SEQ ID NO:789, SEQ ID NO:792, SEQ ID NO:795, SEQ ID NO:797, SEQ ID NO:799, SEQ ID NO:801, SEQ ID NO:807, SEQ ID NO:810, SEQ ID NO:813, SEQ ID NO:815, SEQ ID NO:819, SEQ ID NO:821, SEQ ID NO:823, SEQ ID NO:827, SEQ ID NO:829, SEQ ID NO:832, SEQ ID NO:834, SEQ ID NO:837, SEQ ID NO:840, SEQ ID NO:842, SEQ ID NO:848, SEQ ID NO:851, SEQ ID NO:854, SEQ ID NO:858, SEQ ID NO:860, SEQ ID NO:864, SEQ ID NO:867, SEQ ID NO:884, SEQ ID NO:889, SEQ ID NO:891, SEQ ID NO:893, SEQ ID NO:895, SEQ ID NO:897, SEQ ID NO:899, SEQ ID NO:903, SEQ ID NO:906, SEQ ID NO:911, SEQ ID NO:913, SEQ ID NO:916, SEQ ID NO:918, SEQ ID NO:920, SEQ ID NO:926, SEQ ID NO:928, SEQ ID NO:933, SEQ ID NO:935, SEQ ID NO:937, SEQ ID NO:942, SEQ ID NO:944, SEQ ID NO:958, SEQ ID NO:963, SEQ ID NO:965, SEQ ID NO:967, SEQ ID NO:972, SEQ ID NO:974, SEQ ID NO:979, SEQ ID NO:981, SEQ ID NO:993, SEQ ID NO:1006, SEQ ID NO:1010, SEQ ID NO:1015, SEQ ID NO:1027, SEQ ID NO:1030, SEQ ID NO:1034, SEQ ID NO:1049, SEQ ID NO:1051, SEQ ID NO:1054, SEQ ID NO:1057, SEQ ID NO:1059, SEQ ID NO:1061, SEQ ID NO:1063, SEQ ID NO:1067, SEQ ID NO:1070, SEQ ID NO:1077, SEQ ID NO:1080, SEQ ID NO:1082, SEQ ID NO:1084, SEQ ID NO:1086, SEQ ID NO:1090, SEQ ID NO:1093, SEQ ID NO:1095, SEQ ID NO:1097, SEQ ID NO:1103, SEQ ID NO:1108, SEQ ID NO:1116, SEQ ID NO:1121, SEQ ID NO:1124, SEQ ID NO:1128, SEQ ID NO:1130, SEQ ID NO:1133, SEQ ID NO:1135, SEQ ID NO:1138, SEQ ID NO:1142, SEQ ID NO:1148, SEQ ID NO:1155, SEQ ID NO:1158, SEQ ID NO:1160, SEQ ID NO:1162, SEQ ID NO:1164, SEQ ID NO:1170, SEQ ID NO:1172, SEQ ID NO:1175, SEQ ID NO:1182, SEQ ID NO:1184, SEQ ID NO:1208, SEQ ID NO:1210, SEQ ID NO:1212, SEQ ID NO:1214, SEQ ID NO:1216, SEQ ID NO:1218, SEQ ID NO:1220, SEQ ID NO:1222, SEQ ID NO:1224, SEQ ID NO:1236, SEQ ID NO:1238, SEQ ID NO:1240, SEQ ID NO:1242, SEQ ID NO:1244, SEQ ID NO:1246, SEQ ID NO:1248, SEQ ID NO:1250, SEQ ID NO:1252, SEQ ID NO:1254, SEQ ID NO:1256, SEQ ID NO:1258, SEQ ID NO:1260, SEQ ID NO:1262, SEQ ID NO:1264, SEQ ID NO:1266, SEQ ID NO:1268, SEQ ID NO:1270, SEQ ID NO:1272, SEQ ID NO:1274, SEQ ID NO:1276, SEQ ID NO:1278, SEQ ID NO:1280, SEQ ID NO:1282, SEQ ID NO:1284, SEQ ID NO:1291, SEQ ID NO:1293, SEQ ID NO:1295, SEQ ID NO:1297, SEQ ID NO:1299, SEQ ID NO:1301, SEQ ID NO:1310, SEQ ID NO:1312, SEQ ID NO:1314, SEQ ID NO:1316, SEQ ID NO:1318, SEQ ID NO:1320, SEQ ID NO:1322, SEQ ID NO:1324, SEQ ID NO:1326, SEQ ID NO:1328, SEQ ID NO:1330, SEQ ID NO:1332, SEQ ID NO:1334, SEQ ID NO:1336, SEQ ID NO:1338, SEQ ID NO:1340, SEQ ID NO:1342, SEQ ID NO:1344, SEQ ID NO:1346, SEQ ID NO:1348, SEQ ID NO:1350, SEQ ID NO:1352, SEQ ID NO:1354, SEQ ID NO:1356, SEQ ID NO:1358, SEQ ID NO:1360, SEQ ID NO:1368, SEQ ID NO:1370, SEQ ID NO:1372, SEQ ID NO:1374, SEQ ID NO:1376, SEQ ID NO:1378, SEQ ID NO:1380, SEQ ID NO:1382, SEQ ID NO:1384, SEQ ID NO:1386, SEQ ID NO:1388, SEQ ID NO:1390, SEQ ID NO:1392, SEQ ID NO:1394, SEQ ID NO:1396, SEQ ID NO:1398, SEQ ID NO:1400, SEQ ID NO:1402, SEQ ID NO:1404, SEQ ID NO:1411, SEQ ID NO:1413, SEQ ID NO:1416, SEQ ID NO:1418, SEQ ID NO:1420, SEQ ID NO:1422, SEQ ID NO:1430, SEQ ID NO:1432, SEQ ID NO:1434, SEQ ID NO:1435, SEQ ID NO:1443, SEQ ID NO:1464, SEQ ID NO:1466, SEQ ID NO:1468, SEQ ID NO:1470, SEQ ID NO:1472, SEQ ID NO:1474, SEQ ID NO:1476, SEQ ID NO:1478, SEQ ID NO:1480, SEQ ID NO:1482, SEQ ID NO:1484, SEQ ID NO:1486, SEQ ID NO:1492, SEQ ID NO:1501, SEQ ID NO:1503, SEQ ID NO:1517, SEQ ID NO:1519, SEQ ID NO:1521, SEQ ID NO:1523, SEQ ID NO:1525, SEQ ID NO:1527, SEQ ID NO:1535, SEQ ID NO:1537, SEQ ID NO:1539, SEQ ID NO:1541, SEQ ID NO:1543, SEQ ID NO:1545, SEQ ID NO:1547, SEQ ID NO:1549, SEQ ID NO:1551, SEQ ID NO:1553, SEQ ID NO:1555, SEQ ID NO:1557, SEQ ID NO:1559, SEQ ID NO:1561, SEQ ID NO:1563, SEQ ID NO:1565, SEQ ID NO:1567, SEQ ID NO:1569, SEQ ID NO:1572, SEQ ID NO:1574, SEQ ID NO:1576, SEQ ID NO:1578, SEQ ID NO:1580, SEQ ID NO:1582, SEQ ID NO:1584, SEQ ID NO:1586, SEQ ID NO:1588, SEQ ID NO:1590, SEQ ID NO:1592, SEQ ID NO:1594, SEQ ID NO:1609, SEQ ID NO:1611, SEQ ID NO:1613, SEQ ID NO:1615, SEQ ID NO:1617, SEQ ID NO:1619, SEQ ID NO:1623, SEQ ID NO:1625, SEQ ID NO:1627, SEQ ID NO:1629, SEQ ID NO:1631, SEQ ID NO:1636, SEQ ID NO:1652, SEQ ID NO:1656, SEQ ID NO:1658, SEQ ID NO:1660, SEQ ID NO:1662, SEQ ID NO:1664, SEQ ID NO:1666, SEQ ID NO:1668, SEQ ID NO:1670, SEQ ID NO:1672, SEQ ID NO:1674, SEQ ID NO:1680, SEQ ID NO:1682, SEQ ID NO:1691, SEQ ID NO:1693, SEQ ID NO:1695, SEQ ID NO:1697, SEQ ID NO:1699, SEQ ID NO:1701, SEQ ID NO:1703, SEQ ID NO:1705, SEQ ID NO:1707, SEQ ID NO:1709, SEQ ID NO:1711, SEQ ID NO:1713, SEQ ID NO:1715, SEQ ID NO:1717, SEQ ID NO:1719, SEQ ID NO:1721, SEQ ID NO:1723, SEQ ID NO:1725, SEQ ID NO:1727, SEQ ID NO:1732, SEQ ID NO:1734, SEQ ID NO:1748, SEQ ID NO:1751, SEQ ID NO:1766, SEQ ID NO:1776, SEQ ID NO:1778, SEQ ID NO:1780, SEQ ID NO:1782, SEQ ID NO:1784, SEQ ID NO:1805, SEQ ID NO:1821, SEQ ID NO:1823, SEQ ID NO:1825, SEQ ID NO:1827, SEQ ID NO:1829, SEQ ID NO:1831, SEQ ID NO:1833, SEQ ID NO:1835, SEQ ID NO:1837, SEQ ID NO:1839, SEQ ID NO:1841, SEQ ID NO:1843, SEQ ID NO:1845, SEQ ID NO:1847, SEQ ID NO:1849, SEQ ID NO:1851, SEQ ID NO:1853, SEQ ID NO:1855, SEQ ID NO:1857, SEQ ID NO:1859, SEQ ID NO:1861, SEQ ID NO:1863, SEQ ID NO:1865, SEQ ID NO:1867, SEQ ID NO:1869, SEQ ID NO:1871, SEQ ID NO:1873, SEQ ID NO:1875, SEQ ID NO:1877, SEQ ID NO:1879, SEQ ID NO:1881, SEQ ID NO:1883, SEQ ID NO:1885, SEQ ID NO:1887, SEQ ID NO:1889, SEQ ID NO:1891, SEQ ID NO:1896, SEQ ID NO:1898, SEQ ID NO:1900, SEQ ID NO:1903, SEQ ID NO:1905, SEQ ID NO:1907, SEQ ID NO:1919, SEQ ID NO:1920, SEQ ID NO:2060, SEQ ID NO:2062, SEQ ID NO:2064, SEQ ID NO:2084, SEQ ID NO:2088, SEQ ID NO:2090, SEQ ID NO:2092, SEQ ID NO:2094, SEQ ID NO:2096, SEQ ID NO:2098, SEQ ID NO:2100, SEQ ID NO:2102, SEQ ID NO:2104, SEQ ID NO:2106, SEQ ID NO:2108, SEQ ID NO:2110, SEQ ID NO:2112, SEQ ID NO:2114, SEQ ID NO:2116, SEQ ID NO:2118, SEQ ID NO:2120, SEQ ID NO:2122, SEQ ID NO:2124, SEQ ID NO:2126, SEQ ID NO:2128, SEQ ID NO:2130, SEQ ID NO:2132, SEQ ID NO:2134, SEQ ID NO:2136, SEQ ID NO:2138, SEQ ID NO:2140, SEQ ID NO:2142, SEQ ID NO:2144, SEQ ID NO:2146, SEQ ID NO:2148, SEQ ID NO:2150, SEQ ID NO:2152, SEQ ID NO:2154, SEQ ID NO:2156, SEQ ID NO:2158, SEQ ID NO:2160, SEQ ID NO:2161, SEQ ID NO:2163, SEQ ID NO:2165, SEQ ID NO:6167, SEQ ID NO:2169, SEQ ID NO:2171, SEQ ID NO:2173, SEQ ID NO:2175, SEQ ID NO:2177, SEQ ID NO:2179, SEQ ID NO:2181, SEQ ID NO:2183, SEQ ID NO:2185, SEQ ID NO:2187, SEQ ID NO:2189, SEQ ID NO:2191, SEQ ID NO:2193, SEQ ID NO:2195, SEQ ID NO:2197, SEQ ID NO:2199, SEQ ID NO:2201, SEQ ID NO:2203, SEQ ID NO:2205, SEQ ID NO:2207, SEQ ID NO:2209, SEQ ID NO:2211, SEQ ID NO:2213, SEQ ID NO:2215, SEQ ID NO:2217, SEQ ID NO:2219, SEQ ID NO:2221, SEQ ID NO:2223, SEQ ID NO:2225, SEQ ID NO:2227, SEQ ID NO:2229, SEQ ID NO:2231, SEQ ID NO:2233, SEQ ID NO:2235, SEQ ID NO:2237, SEQ ID NO:2239, SEQ ID NO:2241, SEQ ID NO:2243, SEQ ID NO:2245, SEQ ID NO:2247, SEQ ID NO:2249, SEQ ID NO:2251, SEQ ID NO:2253, SEQ ID NO:2255, SEQ ID NO:2257, SEQ ID NO:2259, SEQ ID NO:2261, SEQ ID NO:2263, SEQ ID NO:2265, SEQ ID NO:2267, SEQ ID NO:2269, SEQ ID NO:2271, SEQ ID NO:2273, SEQ ID NO:2275, SEQ ID NO:2277, SEQ ID NO:2279, SEQ ID NO:2281, SEQ ID NO:2283, SEQ ID NO:2285, SEQ ID NO:2287, SEQ ID NO:2289, SEQ ID NO:2291, SEQ ID NO:2293, SEQ ID NO:2295, SEQ ID NO:2297, SEQ ID NO:2299, SEQ ID NO:2301, SEQ ID NO:2303, SEQ ID NO:2305, SEQ ID NO:2307, SEQ ID NO:2309, SEQ ID NO:2311, SEQ ID NO:2313, SEQ ID NO:2315, SEQ ID NO:2317, SEQ ID NO:2319, SEQ ID NO:2321, SEQ ID NO:2323, SEQ ID NO:2325, SEQ ID NO:2327, SEQ ID NO:2329, SEQ ID NO:2331, SEQ ID NO:2333, SEQ ID NO:2335, SEQ ID NO:2337, SEQ ID NO:2339, SEQ ID NO:2341, SEQ ID NO:2343, SEQ ID NO:2345, SEQ ID NO:2347, and SEQ ID NO:2349-2690; where a tissue of a plant produced from the plant cell has a difference in lignin content as compared to the corresponding lignin content in tissue of a control plant that does not comprise the nucleic acid. A transgenic plant comprising such a plant cell also is provided.

The plant cell can be capable of producing one or more lignin monomers. The plant cell can be from a genus selected from the group consisting of *Acer, Aesculus, Afzelia, Agrostis, Alnus, Avena, Cannabis, Carya, Cinnamomum, Coffea, Eucalyptus, Festuca, Fraxinus, Hordeum, Juglans, Lolium, Medicago, Milium, Miscanthus, Panicum, Pinus, Poa, Populus, Prunus, Quercus, Saccharum, Simarouba, Sorghum, Trifolium, Triticum, Vitis*, and *Zea*. The plant cell can be from a species selected from *Miscanthus* hybrid (*Miscanthus×giganteus*), *Miscanthus sinensis, Miscanthus sacchariflorus, Panicum virgatum, Populus trichocarpa*.

The regulatory region can be involved in lignin or cellulose biosynthesis. The regulatory region can be selected from the group consisting of SEQ ID NOs:1909-1918. The regulatory region can be unassociated with the polypeptide. The regulatory region can be a promoter. The promoter can be a tissue-preferential promoter. The tissue can be vascular, stem, pith, xylem, phloem, fruit, seed, seed pod, root, tuber, inflorescence, or leaf tissue. The promoter can be a cell-type preferential promoter. The cell can be a sieve cell, a laticifer cell, a sclerenchyma cell, a xylem cell, or trichome cell. The promoter can be inducible.

In another aspect, forage comprising tissue from the transgenic plant is provided.

A method of expressing a sequence of interest is provided herein. The method comprises growing a plant cell comprising an exogenous nucleic acid comprising a regulatory region operably linked to a sequence of interest and an exogenous nucleic acid comprising a nucleic acid encoding a polypeptide, where the regulatory region and the polypeptide are associated, and where the plant cell expresses the sequence of interest. The polypeptide has 80% or greater sequence identity to SEQ ID NO:96, SEQ ID NOs:98-100, SEQ ID NO:102, SEQ ID NO:104, SEQ ID NO:106, SEQ ID NO:108, SEQ ID NOs:110-112, SEQ ID NOs:114-117, SEQ ID NOs:119-122, SEQ ID NO:124, SEQ ID NOs:126-128, SEQ ID NOs:130-132, SEQ ID NOs:134-137, SEQ ID NO:139, SEQ ID NO:141, SEQ ID NO:143, SEQ ID NOs: 145-147, SEQ ID NO:149, SEQ ID NOs:151-155, SEQ ID NO:157, SEQ ID NO:159, SEQ ID NO:161, SEQ ID NO:163, SEQ ID NOs:165-168, SEQ ID NO:170, SEQ ID NOs:172-176, SEQ ID NOs:178-194, SEQ ID NO:196, SEQ ID NOs:198-215, SEQ ID NO:217, SEQ ID NO:219, SEQ ID NOs:221-251, SEQ ID NO:253, SEQ ID NOs:255-256, SEQ ID NO:258, SEQ ID NO:260, SEQ ID NOs:262-265, SEQ ID NO:267, SEQ ID NOs:269-270, SEQ ID NOs:272-273, SEQ ID NOs:275-277, SEQ ID NOs:279-280, SEQ ID NO:282, SEQ ID NO:284, SEQ ID NOs:286-287, SEQ ID NOs:289-290, SEQ ID NO:292, SEQ ID NOs:294-298, SEQ ID NO:300, SEQ ID NO:302, SEQ ID NO:304, SEQ ID NO:306, SEQ ID NOs:308-313, SEQ ID NOs:315-316, SEQ ID NOs:318-319, SEQ ID NO:321, SEQ ID NO:323, SEQ ID NOs:325-326, SEQ ID NO:328, SEQ ID NO:330, SEQ ID NO:332, SEQ ID NOs:334-335, SEQ ID NO:337, SEQ ID NO:339-341, SEQ ID NO:343, SEQ ID NO:345, SEQ ID NO:347-351, SEQ ID NO:353, SEQ ID NO:355, SEQ ID NO:357-359, SEQ ID NOs:361-368, SEQ ID NO:370, SEQ ID NO:372, SEQ ID NOs:374-375, SEQ ID NO:377, SEQ ID NO:379, SEQ ID NOs:381-385, SEQ ID NOs:387-389, SEQ ID NOs:391-392, SEQ ID NOs:394-398, SEQ ID NO:400, SEQ ID NOs:402-403, SEQ ID NO:405, SEQ ID NO:407, SEQ ID NO:409, SEQ ID NO:411, SEQ ID NO:413, SEQ ID NO:415, SEQ ID NOs:417-430, SEQ ID NOs:432-434, SEQ ID NO:436, SEQ ID NO:438, SEQ ID NO:440, SEQ ID NOs:442-443, SEQ ID NOs:445-447, SEQ ID NO:449, SEQ ID NOs:451-452, SEQ ID NOs:454-457, SEQ ID NO:459, SEQ ID NOs:461-463, SEQ ID NOs:465-468, SEQ ID NOs:470-471, SEQ ID NO:473, SEQ ID NOs:475-476, SEQ ID NOs:478-481, SEQ ID NOs:483-485, SEQ ID NOs:487-488, SEQ ID NO:490, SEQ ID NO:492, SEQ ID NO:494, SEQ ID NOs:496-499, SEQ ID NOs:501-502, SEQ ID NOs:504-506, SEQ ID NO:508, SEQ ID NOs:510-514, SEQ ID NO:516, SEQ ID NO:518, SEQ ID NOs:520-522, SEQ ID NO:524, SEQ ID NOs:526-527, SEQ ID NOs:529-533, SEQ ID NO:535, SEQ ID NO:537, SEQ ID NO:539, SEQ ID NO:541, SEQ ID NO:543, SEQ ID NOs:545-546, SEQ ID NOs:548-551, SEQ ID NO:553, SEQ ID NOs:555-561, SEQ ID NOs:563-564, SEQ ID NOs:566-568, SEQ ID NO:570, SEQ ID NO:572, SEQ ID NOs:574-576, SEQ ID NOs:578-579, SEQ ID NO:581, SEQ ID NO:583, SEQ ID NOs:585-588, SEQ ID NOs:590-591, SEQ ID NOs:593-594, SEQ ID NOs:596-597, SEQ ID NO:599, SEQ ID NO:601, SEQ ID NOs:603-604, SEQ ID NO:606, SEQ ID NO:608, SEQ ID NO:610, SEQ ID NO:612, SEQ ID NOs:614-617, SEQ ID NO:619, SEQ ID NOs:621-636, SEQ ID NOs:638-648, SEQ ID NO:650, SEQ ID NOs:652-654, SEQ ID NOs:656-657, SEQ ID NO:659, SEQ ID NOs:661-663, SEQ ID NOs:665-669, SEQ ID NOs:671-673, SEQ ID NOs:675-676, SEQ ID NO:678, SEQ ID NO:680, SEQ ID NO:682, SEQ ID NO:684, SEQ ID NOs:686-687, SEQ ID NOs:689-693, SEQ ID NOs:695-696, SEQ ID NO:698, SEQ ID NOs:700-701, SEQ ID NO:703, SEQ ID NO:705, SEQ ID NO:707, SEQ ID NOs:709-711, SEQ ID NO:713, SEQ ID NOs:715-716, SEQ ID NO:718, SEQ ID NO:720, SEQ ID NO:722, SEQ ID NOs:724-728, SEQ ID NOs:730-735, SEQ ID NOs:737-740, SEQ ID NO:742, SEQ ID NOs:744-745, SEQ ID NOs:747-751, SEQ ID NO:753, SEQ ID NOs:755-758, SEQ ID NOs:760-763, SEQ ID NOs:765-777, SEQ ID NO:779, SEQ ID NOs:781-784, SEQ ID NOs:786-788, SEQ ID NOs:790-791, SEQ ID NOs:793-794, SEQ ID NO:796, SEQ ID NO:798, SEQ ID NO:800, SEQ ID NOs:802-806, SEQ ID NOs:808-809, SEQ ID NOs:811-812, SEQ ID NO:814, SEQ ID NOs:816-818, SEQ ID NO:820, SEQ ID NO:822, SEQ ID NOs:824-826, SEQ ID NO:828, SEQ ID NOs:830-831, SEQ ID NO:833, SEQ ID NOs:835-836, SEQ ID NOs:838-839, SEQ ID NO:841, SEQ ID NOs:843-847, SEQ ID NOs:849-850, SEQ ID NOs:852-853, SEQ ID NOs:855-857, SEQ ID NO:859, SEQ ID NOs:861-863, SEQ ID NOs:865-866, SEQ ID NOs:868-883, SEQ ID NOs:885-888, SEQ ID NO:890, SEQ ID NO:892, SEQ ID NO:894, SEQ ID NO:896, SEQ ID NO:898, SEQ ID NOs:900-902, SEQ ID NOs:904-905, SEQ ID NOs:907-910, SEQ ID NO:912, SEQ ID NOs:914-915, SEQ ID NO:917, SEQ ID NO:919, SEQ ID NOs:921-925, SEQ ID NO:927, SEQ ID NOs:929-932, SEQ ID NO:934, SEQ ID NO:936, SEQ ID NOs:938-941, SEQ ID NO:943 SEQ ID NOs:945-957, SEQ ID NOs:959-962, SEQ ID NO:964, SEQ ID NO:966, SEQ ID NOs:968-971, SEQ ID NO:973, SEQ ID NOs:975-978, SEQ ID NO:980, SEQ ID NOs:982-992, SEQ ID NOs:994-1005, SEQ ID NOs:1007-1009, SEQ ID NOs:1011-1014, SEQ ID NOs:1016-1026, SEQ ID NOs:1028-1029, SEQ ID NOs:1031-1033, SEQ ID NOs:1035-1048, SEQ ID NO:1050, SEQ ID NOs:1052-1053, SEQ ID NOs:1055-1056, SEQ ID NO:1058, SEQ ID NO:1060, SEQ ID NO:1062, SEQ ID NOs:1064-1066, SEQ ID NOs:1068-1069, SEQ ID NOs:1071-1076, SEQ ID NOs:1078-1079, SEQ ID NO:1081, SEQ ID NO:1083, SEQ ID NO:1085, SEQ ID NOs:1087-1089, SEQ ID NOs:1091-1092, SEQ ID NO:1094, SEQ ID NO:1096, SEQ ID NOs:1098-1102, SEQ ID NOs:1104-1107, SEQ ID NOs:1109-1115, SEQ ID NOs:1117-1120, SEQ ID NOs:1122-1123, SEQ ID NOs:1125-1127, SEQ ID NO:1129, SEQ ID NOs:1131-1132, SEQ ID NO:1134, SEQ ID NOs:1136-1137, SEQ ID NOs:1139-1141, SEQ ID NOs:1143-1147, SEQ ID NOs:1149-1154, SEQ ID NOs:1156-1157, SEQ ID NO:1159, SEQ ID NO:1161, SEQ ID NO:1163, SEQ ID NOs:1165-1169, SEQ ID NO:1171, SEQ ID NOs:1173-1174, SEQ ID NOs:1176-1181, SEQ ID NO:1183, SEQ ID NOs:1185-1207, SEQ ID NO:1209, SEQ ID NO:1211, SEQ ID NO:1213, SEQ ID NO:1215, SEQ ID NO:1217, SEQ ID NO:1219, SEQ ID NO:1221, SEQ ID NO:1223, SEQ ID NOs:1225-1235, SEQ ID NO:1237, SEQ ID NO:1239, SEQ ID NO:1241, SEQ ID NO:1243, SEQ ID NO:1245, SEQ ID NO:1247, SEQ ID NO:1249, SEQ ID NO:1251, SEQ ID NO:1253, SEQ ID NO:1255, SEQ ID NO:1257, SEQ ID NO:1259, SEQ ID NO:1261, SEQ ID NO:1263, SEQ ID NO:1265, SEQ ID NO:1267, SEQ ID NO:1269, SEQ ID NO:1271, SEQ ID NO:1273, SEQ ID NO:1275, SEQ ID NO:1277, SEQ ID NO:1279, SEQ ID NO:1281, SEQ ID NO:1283, SEQ ID NOs:1285-1290, SEQ ID NO:1292, SEQ ID NO:1294, SEQ ID NO:1296, SEQ ID NO:1298, SEQ ID NO:1300, SEQ ID NOs:1302-1309, SEQ ID NO:1311, SEQ ID NO:1313, SEQ ID NO:1315, SEQ ID NO:1317, SEQ ID NO:1319, SEQ ID NO:1321, SEQ ID NO:1323, SEQ ID NO:1325, SEQ ID NO:1327, SEQ ID NO:1329, SEQ ID NO:1331, SEQ ID NO:1333, SEQ ID NO:1335, SEQ ID NO:1337, SEQ ID NO:1339, SEQ ID NO:1341, SEQ ID NO:1343, SEQ ID NO:1345, SEQ ID NO:1347, SEQ ID NO:1349, SEQ ID NO:1351, SEQ ID NO:1353, SEQ ID NO:1355, SEQ ID NO:1357, SEQ ID NO:1359, SEQ ID NOs:1361-1367, SEQ ID NO:1369, SEQ ID NO:1371, SEQ ID NO:1373, SEQ ID NO:1375, SEQ ID NO:1377, SEQ ID NO:1379, SEQ ID NO:1381, SEQ ID NO:1383, SEQ ID NO:1385, SEQ ID NO:1387, SEQ ID NO:1389, SEQ ID NO:1391, SEQ ID NO:1393, SEQ ID NO:1395, SEQ ID NO:1397, SEQ ID NO:1399, SEQ ID NO:1401, SEQ ID NO:1403, SEQ ID NOs:1405-1410, SEQ ID NO:1412, SEQ ID NOs:1414-1415, SEQ ID NO:1417, SEQ ID NO:1419, SEQ ID NO:1421, SEQ ID NOs:1423-1429, SEQ ID NO:1431, SEQ ID NO:1433, SEQ ID NOs:1436-1442, SEQ ID NOs:1444-1463, SEQ ID NO:1465, SEQ ID NO:1467, SEQ ID NO:1469, SEQ ID NO:1471, SEQ ID NO:1473, SEQ ID NO:1475, SEQ ID NO:1477, SEQ ID NO:1479, SEQ ID NO:1481, SEQ ID NO:1483, SEQ ID NO:1485, SEQ ID NOs:1487-1491, SEQ ID NOs:1493-1500, SEQ ID NO:1502, SEQ ID NOs:1504-1516, SEQ ID NO:1518, SEQ ID NO:1520, SEQ ID NO:1522, SEQ ID NO:1524, SEQ ID NO:1526, SEQ ID NOs:1528-1534, SEQ ID NO:1536, SEQ ID NO:1538, SEQ ID NO:1540, SEQ ID NO:1542, SEQ ID NO:1544, SEQ ID NO:1546, SEQ ID NO:1548, SEQ ID NO:1550, SEQ ID NO:1552, SEQ ID NO:1554, SEQ ID NO:1556, SEQ ID NO:1558, SEQ ID NO:1560, SEQ ID NO:1562, SEQ ID NO:1564, SEQ ID NO:1566, SEQ ID NO:1568, SEQ ID NOs:1570-1571, SEQ ID NO:1573, SEQ ID NO:1575, SEQ ID NO:1577, SEQ ID NO:1579, SEQ ID NO:1581, SEQ ID NO:1583, SEQ ID NO:1585, SEQ ID NO:1587, SEQ ID NO:1589, SEQ ID NO:1591, SEQ ID NO:1593, SEQ ID NOs:1595-1608, SEQ ID NO:1610, SEQ ID NO:1612, SEQ ID NO:1614, SEQ ID NO:1616, SEQ ID NO:1618, SEQ ID NOs:1620-1622, SEQ ID NO:1624, SEQ ID NO:1626, SEQ ID NO:1628, SEQ ID NO:1630, SEQ ID NOs:1632-1635, SEQ ID NOs:1637-1651, SEQ ID NOs:1653-1655, SEQ ID NO:1657, SEQ ID NO:1659, SEQ ID NO:1661, SEQ ID NO:1663, SEQ ID NO:1665, SEQ ID NO:1667, SEQ ID NO:1669, SEQ ID NO:1671, SEQ ID NO:1673, SEQ ID NOs:1675-1679, SEQ ID NO:1681, SEQ ID NOs:1683-1690, SEQ ID NO:1692, SEQ ID NO:1694, SEQ ID NO:1696, SEQ ID NO:1698, SEQ ID NO:1700, SEQ ID NO:1702, SEQ ID NO:1704, SEQ ID NO:1706, SEQ ID NO:1708, SEQ ID NO:1710; SEQ ID NO:1712, SEQ ID NO:1714, SEQ ID NO:1716, SEQ ID NO:1718, SEQ ID NO:1720, SEQ ID NO:1722, SEQ ID NO:1724, SEQ ID NO:1726, SEQ ID NOs:1728-1731, SEQ ID NO:1733, SEQ ID NOs:1735-1747, SEQ ID NOs:1749-1750, SEQ ID NOs:1752-1765, SEQ ID NOs:1767-1775, SEQ ID NO:1777, SEQ ID NO:1779, SEQ ID NO:1781, SEQ ID NO:1783, SEQ ID NOs:1785-1804, SEQ ID NOs:1806-1820, SEQ ID NO:1822, SEQ ID NO:1824, SEQ ID NO:1826, SEQ ID NO:1828, SEQ ID NO:1830, SEQ ID NO:1832, SEQ ID NO:1834, SEQ ID NO:1836, SEQ ID NO:1838, SEQ ID NO:1840, SEQ ID NO:1842, SEQ ID NO:1844, SEQ ID NO:1846, SEQ ID NO:1848, SEQ ID NO:1850, SEQ ID NO:1852, SEQ ID NO:1854, SEQ ID NO:1856, SEQ ID NO:1858, SEQ ID NO:1860, SEQ ID NO:1862, SEQ ID NO:1864, SEQ ID NO:1866, SEQ ID NO:1868, SEQ ID NO:1870, SEQ ID NO:1872, SEQ ID NO:1874, SEQ ID NO:1876, SEQ ID NO:1878, SEQ ID NO:1880, SEQ ID NO:1882, SEQ ID NO:1884, SEQ ID NO:1886, SEQ ID NO:1888, SEQ ID NO:1890, SEQ ID NOs:1892-1895, SEQ ID NO:1897, SEQ ID NO:1899, SEQ ID NOs:1901-1902, SEQ ID NO:1904, SEQ ID NO:1906, SEQ ID NO:1908, SEQ ID NOs:1921-2059, SEQ ID NO:2061, SEQ ID NO:2063, SEQ ID NOs:2065-2083, SEQ ID NO:2085, SEQ ID NO:2087, SEQ ID NO:2089, SEQ ID NO:2091, SEQ ID NO:2093, SEQ ID NO:2095, SEQ ID NO:2097, SEQ ID NO:2099, SEQ ID NO:2101, SEQ ID NO:2103, SEQ ID NO:2105, SEQ ID NO:2107, SEQ ID NO:2109, SEQ ID NO:2111, SEQ ID NO:2113, SEQ ID NO:2115, SEQ ID NO:2117, SEQ ID NO:2119, SEQ ID NO:2121, SEQ ID NO:2123, SEQ ID NO:2125, SEQ ID NO:2127, SEQ ID NO:2129, SEQ ID NO:2131, SEQ ID NO:2133, SEQ ID NO:2135, SEQ ID NO:2137, SEQ ID NO:2139, SEQ ID NO:2141, SEQ ID NO:2143, SEQ ID NO:2145, SEQ ID NO:2147, SEQ ID NO:2149, SEQ ID NO:2151, SEQ ID NO:2153, SEQ ID NO:2155, SEQ ID NO:2157, SEQ ID NO:2159, SEQ ID NO:2161, SEQ ID NO:2162, SEQ ID NO:2164, SEQ ID NO:2166, SEQ ID NO:6168, SEQ ID NO:2170, SEQ ID NO:2172, SEQ ID NO:2174, SEQ ID NO:2176, SEQ ID NO:2178, SEQ ID NO:2180, SEQ ID NO:2182, SEQ ID NO:2184, SEQ ID NO:2186, SEQ ID NO:2188, SEQ ID NO:2190, SEQ ID NO:2192, SEQ ID NO:2194, SEQ ID NO:2196, SEQ ID NO:2198, SEQ ID NO:2200, SEQ ID NO:2202, SEQ ID NO:2204, SEQ ID NO:2206, SEQ ID NO:2208, SEQ ID NO:2210, SEQ ID NO:2212, SEQ ID NO:2214, SEQ ID NO:2216, SEQ ID NO:2218, SEQ ID NO:2220, SEQ ID NO:2222, SEQ ID NO:2224, SEQ ID NO:2226, SEQ ID NO:2228, SEQ ID NO:2230, SEQ ID NO:2232, SEQ ID NO:2234, SEQ ID NO:2236, SEQ ID NO:2238, SEQ ID NO:2240, SEQ ID NO:2242, SEQ ID NO:2244, SEQ ID NO:2246, SEQ ID NO:2248, SEQ ID NO:2250, SEQ ID NO:2252, SEQ ID NO:2254, SEQ ID NO:2256, SEQ ID NO:2258, SEQ ID NO:2260, SEQ ID NO:2262, SEQ ID NO:2264, SEQ ID NO:2266, SEQ ID NO:2268, SEQ ID NO:2270, SEQ ID NO:2272, SEQ ID NO:2274, SEQ ID NO:2276, SEQ ID NO:2278, SEQ ID NO:2280, SEQ ID NO:2282, SEQ ID NO:2284, SEQ ID NO:2286, SEQ ID NO:2288, SEQ ID NO:2290, SEQ ID NO:2292, SEQ ID NO:2294, SEQ ID NO:2296, SEQ ID NO:2298, SEQ ID NO:2300, SEQ ID NO:2302, SEQ ID NO:2304, SEQ ID NO:2306, SEQ ID NO:2308, SEQ ID NO:2310, SEQ ID NO:2312, SEQ ID NO:2314, SEQ ID NO:2316, SEQ ID NO:2318, SEQ ID NO:2320, SEQ ID NO:2322, SEQ ID NO:2324, SEQ ID NO:2326, SEQ ID NO:2328, SEQ ID NO:2330, SEQ ID NO:2332, SEQ ID NO:2334, SEQ ID NO:2336, SEQ ID NO:2338, SEQ ID NO:2340, SEQ ID NO:2342, SEQ ID NO:2344, SEQ ID NO:2346, and SEQ ID NO:2348. The plant cell is grown under conditions effective for expression of the regulatory protein.

In another aspect, the method comprises growing a plant cell comprising an exogenous nucleic acid encoding the sequence of interest operably linked to a regulatory region. The regulatory region comprises a nucleic acid having 80% or greater sequence identity to a regulatory region selected from the group consisting of SEQ ID NOs:1909-1918. The plant cell is grown under conditions effective for expression of the regulatory protein. The regulatory region and the polypeptide are associated and the plant cell expresses the sequence of interest.

The exogenous nucleic acid comprising the regulatory region operably linked to the sequence of interest and the exogenous nucleic acid comprising the nucleic acid encoding the polypeptide can be included in the same nucleic acid construct or separate nucleic acid constructs.

The sequence of interest can comprise a coding sequence for a polypeptide involved in lignin biosynthesis. The sequence of interest can be in antisense orientation. The sequence of interest can be transcribed into an interfering RNA.

In another aspect, a method of expressing a sequence of interest in a plant cell is provided. The method comprises growing a plant cell comprising an exogenous nucleic acid encoding a polypeptide sequence having 80% or greater sequence identity to a polypeptide sequence selected from the group consisting of SEQ ID NO:96, SEQ ID NOs:98-100, SEQ ID NO:102, SEQ ID NO:104, SEQ ID NO:106, SEQ ID NO:108, SEQ ID NOs:110-112, SEQ ID NOs:114-117, SEQ ID NOs:119-122, SEQ ID NO:124, SEQ ID NOs:126-128, SEQ ID NOs:130-132, SEQ ID NOs:134-137, SEQ ID NO:139, SEQ ID NO:141, SEQ ID NO:143, SEQ ID NOs:145-147, SEQ ID NO:149, SEQ ID NOs:151-155, SEQ ID NO:157, SEQ ID NO:159, SEQ ID NO:161, SEQ ID NO:163, SEQ ID NOs:165-168, SEQ ID NO:170, SEQ ID NOs:172-176, SEQ ID NOs:178-194, SEQ ID NO:196, SEQ ID NOs:198-215, SEQ ID NO:217, SEQ ID NO:219, SEQ ID NOs:221-251, SEQ ID NO:253, SEQ ID NOs:255-256, SEQ ID NO:258, SEQ ID NO:260, SEQ ID NOs:262-265, SEQ ID NO:267, SEQ ID NOs:269-270, SEQ ID NOs:272-273, SEQ ID NOs:275-277, SEQ ID NOs:279-280, SEQ ID NO:282, SEQ ID NO:284, SEQ ID NOs:286-287, SEQ ID NOs:289-290, SEQ ID NO:292, SEQ ID NOs:294-298, SEQ ID NO:300, SEQ ID NO:302, SEQ ID NO:304, SEQ ID NO:306, SEQ ID NOs:308-313, SEQ ID NOs:315-316, SEQ ID NOs:318-319, SEQ ID NO:321, SEQ ID NO:323, SEQ ID NOs:325-326, SEQ ID NO:328, SEQ ID NO:330, SEQ ID NO:332, SEQ ID NOs:334-335, SEQ ID NO:337, SEQ ID NO:339-341, SEQ ID NO:343, SEQ ID NO:345, SEQ ID NO:347-351, SEQ ID NO:353, SEQ ID NO:355, SEQ ID NO:357-359, SEQ ID NOs:361-368, SEQ ID NO:370, SEQ ID NO:372, SEQ ID NOs:374-375, SEQ ID NO:377, SEQ ID NO:379, SEQ ID NOs:381-385, SEQ ID NOs:387-389, SEQ ID NOs:391-392, SEQ ID NOs:394-398, SEQ ID NO:400, SEQ ID NOs:402-403, SEQ ID NO:405, SEQ ID NO:407, SEQ ID NO:409, SEQ ID NO:411, SEQ ID NO:413, SEQ ID NO:415, SEQ ID NOs:417-430, SEQ ID NOs:432-434, SEQ ID NO:436, SEQ ID NO:438, SEQ ID NO:440, SEQ ID NOs:442-443, SEQ ID NOs:445-447, SEQ ID NO:449, SEQ ID NOs:451-452, SEQ ID NOs:454-457, SEQ ID NO:459, SEQ ID NOs:461-463, SEQ ID NOs:465-468, SEQ ID NOs:470-471, SEQ ID NO:473, SEQ ID NOs:475-476, SEQ ID NOs:478-481, SEQ ID NOs:483-485, SEQ ID NOs:487-488, SEQ ID NO:490, SEQ ID NO:492, SEQ ID NO:494, SEQ ID NOs:496-499, SEQ ID NOs:501-502, SEQ ID NOs:504-506, SEQ ID NO:508, SEQ ID NOs:510-514, SEQ ID NO:516, SEQ ID NO:518, SEQ ID NOs:520-522, SEQ ID NO:524, SEQ ID NOs:526-527, SEQ ID NOs:529-533, SEQ ID NO:535, SEQ ID NO:537, SEQ ID NO:539, SEQ ID NO:541, SEQ ID NO:543, SEQ ID NOs:545-546, SEQ ID NOs:548-551, SEQ ID NO:553, SEQ ID NOs:555-561, SEQ ID NOs:563-564, SEQ ID NOs:566-568, SEQ ID NO:570, SEQ ID NO:572, SEQ ID NOs:574-576, SEQ ID NOs:578-579, SEQ ID NO:581, SEQ ID NO:583, SEQ ID NOs:585-588, SEQ ID NOs:590-591, SEQ ID NOs:593-594, SEQ ID NOs:596-597, SEQ ID NO:599, SEQ ID NO:601, SEQ ID NOs:603-604, SEQ ID NO:606, SEQ ID NO:608, SEQ ID NO:610, SEQ ID NO:612, SEQ ID NOs:614-617, SEQ ID NO:619, SEQ ID NOs:621-636, SEQ ID NOs:638-648, SEQ ID NO:650, SEQ ID NOs:652-654, SEQ ID NOs:656-657, SEQ ID NO:659, SEQ ID NOs:661-663, SEQ ID NOs:665-669, SEQ ID NOs:671-673, SEQ ID NOs:675-676, SEQ ID NO:678, SEQ ID NO:680, SEQ ID NO:682, SEQ ID NO:684, SEQ ID NOs:686-687, SEQ ID NOs:689-693, SEQ ID NOs:695-696, SEQ ID NO:698, SEQ ID NOs:700-701, SEQ ID NO:703, SEQ ID NO:705, SEQ ID NO:707, SEQ ID NOs:709-711, SEQ ID NO:713, SEQ ID NOs:715-716, SEQ ID NO:718, SEQ ID NO:720, SEQ ID NO:722, SEQ ID NOs:724-728, SEQ ID NOs:730-735, SEQ ID NOs:737-740, SEQ ID NO:742, SEQ ID NOs:744-745, SEQ ID NOs:747-751, SEQ ID NO:753, SEQ ID NOs:755-758, SEQ ID NOs:760-763, SEQ ID NOs:765-777, SEQ ID NO:779, SEQ ID NOs:781-784, SEQ ID NOs:786-788, SEQ ID NOs:790-791, SEQ ID NOs:793-794, SEQ ID NO:796, SEQ ID NO:798, SEQ ID NO:800, SEQ ID NOs:802-806, SEQ ID NOs:808-809, SEQ ID NOs:811-812, SEQ ID NO:814, SEQ ID NOs:816-818, SEQ ID NO:820, SEQ ID NO:822, SEQ ID NOs:824-826, SEQ ID NO:828, SEQ ID NOs:830-831, SEQ ID NO:833, SEQ ID NOs:835-836, SEQ ID NOs:838-839, SEQ ID NO:841, SEQ ID NOs:843-847, SEQ ID NOs:849-850, SEQ ID NOs:852-853, SEQ ID NOs:855-857, SEQ ID NO:859, SEQ ID NOs:861-863, SEQ ID NOs:865-866, SEQ ID NOs:868-883, SEQ ID NOs:885-888, SEQ ID NO:890, SEQ ID NO:892, SEQ ID NO:894, SEQ ID NO:896, SEQ ID NO:898, SEQ ID NOs:900-902, SEQ ID NOs:904-905, SEQ ID NOs:907-910, SEQ ID NO:912, SEQ ID NOs:914-915, SEQ ID NO:917, SEQ ID NO:919, SEQ ID NOs:921-925, SEQ ID NO:927, SEQ ID NOs:929-932, SEQ ID NO:934, SEQ ID NO:936, SEQ ID NOs:938-941, SEQ ID NO:943 SEQ ID NOs:945-957, SEQ ID NOs:959-962, SEQ ID NO:964, SEQ ID NO:966, SEQ ID NOs:968-971, SEQ ID NO:973, SEQ ID NOs:975-978, SEQ ID NO:980, SEQ ID NOs:982-992, SEQ ID NOs:994-1005, SEQ ID NOs:1007-1009, SEQ ID NOs:1011-1014, SEQ ID NOs:1016-1026, SEQ ID NOs:1028-1029, SEQ ID NOs:1031-1033, SEQ ID NOs:1035-1048, SEQ ID NO:1050, SEQ ID NOs:1052-1053, SEQ ID NOs:1055-1056, SEQ ID NO:1058, SEQ ID NO:1060, SEQ ID NO:1062, SEQ ID NOs:1064-1066, SEQ ID NOs:1068-1069, SEQ ID NOs:1071-1076, SEQ ID NOs:1078-1079, SEQ ID NO:1081, SEQ ID NO:1083, SEQ ID NO:1085, SEQ ID NOs:1087-1089, SEQ ID NOs:1091-1092, SEQ ID NO:1094, SEQ ID NO:1096, SEQ ID NOs:1098-1102, SEQ ID NOs:1104-1107, SEQ ID NOs:1109-1115, SEQ ID NOs:1117-1120, SEQ ID NOs:1122-1123, SEQ ID NOs:1125-1127, SEQ ID NO:1129, SEQ ID NOs:1131-1132, SEQ ID NO:1134, SEQ ID NOs:1136-1137, SEQ ID NOs:1139-1141, SEQ ID NOs:1143-1147, SEQ ID NOs:1149-1154, SEQ ID NOs:1156-1157, SEQ ID NO:1159, SEQ ID NO:1161, SEQ ID NO:1163, SEQ ID NOs:1165-1169, SEQ ID NO:1171, SEQ ID NOs:1173-1174, SEQ ID NOs:1176-1181, SEQ ID NO:1183, SEQ ID NOs:1185-1207, SEQ ID NO:1209, SEQ ID NO:1211, SEQ ID NO:1213, SEQ ID NO:1215, SEQ ID NO:1217, SEQ ID NO:1219, SEQ ID NO:1221, SEQ ID NO:1223, SEQ ID NOs:1225-1235, SEQ ID NO:1237, SEQ ID NO:1239, SEQ ID NO:1241, SEQ ID NO:1243, SEQ ID NO:1245, SEQ ID NO:1247, SEQ ID NO:1249, SEQ ID NO:1251, SEQ ID NO:1253, SEQ ID NO:1255, SEQ ID NO:1257, SEQ ID NO:1259, SEQ ID NO:1261, SEQ ID NO:1263, SEQ ID NO:1265, SEQ ID NO:1267, SEQ ID NO:1269, SEQ ID NO:1271, SEQ ID NO:1273, SEQ ID NO:1275, SEQ ID NO:1277, SEQ ID NO:1279, SEQ ID NO:1281, SEQ ID NO:1283, SEQ ID NOs:1285-1290, SEQ ID NO:1292, SEQ ID NO:1294, SEQ ID NO:1296, SEQ ID NO:1298, SEQ ID NO:1300, SEQ ID NOs:1302-1309, SEQ ID NO:1311, SEQ ID NO:1313, SEQ ID NO:1315, SEQ ID NO:1317, SEQ ID NO:1319, SEQ ID NO:1321, SEQ ID NO:1323, SEQ ID NO:1325, SEQ ID NO:1327, SEQ ID NO:1329, SEQ ID NO:1331, SEQ ID NO:1333, SEQ ID NO:1335, SEQ ID NO:1337, SEQ ID NO:1339, SEQ ID NO:1341, SEQ ID NO:1343, SEQ ID NO:1345, SEQ ID NO:1347, SEQ ID NO:1349, SEQ ID NO:1351, SEQ ID NO:1353, SEQ ID NO:1355, SEQ ID NO:1357, SEQ ID NO:1359, SEQ ID NOs:1361-1367, SEQ ID NO:1369, SEQ ID NO:1371, SEQ ID NO:1373, SEQ ID NO:1375, SEQ ID NO:1377, SEQ ID NO:1379, SEQ ID NO:1381, SEQ ID NO:1383, SEQ ID NO:1385, SEQ ID NO:1387, SEQ ID NO:1389, SEQ ID NO:1391, SEQ ID NO:1393, SEQ ID NO:1395, SEQ ID NO:1397, SEQ ID NO:1399, SEQ ID NO:1401, SEQ ID NO:1403, SEQ ID NOs:1405-1410, SEQ ID NO:1412, SEQ ID NOs:1414-1415, SEQ ID NO:1417, SEQ ID NO:1419, SEQ ID NO:1421, SEQ ID NOs:1423-1429, SEQ ID NO:1431, SEQ ID NO:1433, SEQ ID NOs:1436-1442, SEQ ID NOs:1444-1463, SEQ ID NO:1465, SEQ ID NO:1467, SEQ ID NO:1469, SEQ ID NO:1471, SEQ ID NO:1473, SEQ ID NO:1475, SEQ ID NO:1477, SEQ ID NO:1479, SEQ ID NO:1481, SEQ ID NO:1483, SEQ ID NO:1485, SEQ ID NOs:1487-1491, SEQ ID NOs:1493-1500, SEQ ID NO:1502, SEQ ID NOs:1504-1516, SEQ ID NO:1518, SEQ ID NO:1520, SEQ ID NO:1522, SEQ ID NO:1524, SEQ ID NO:1526, SEQ ID NOs:1528-1534, SEQ ID NO:1536, SEQ ID NO:1538, SEQ ID NO:1540, SEQ ID NO:1542, SEQ ID NO:1544, SEQ ID NO:1546, SEQ ID NO:1548, SEQ ID NO:1550, SEQ ID NO:1552, SEQ ID NO:1554, SEQ ID NO:1556, SEQ ID NO:1558, SEQ ID NO:1560, SEQ ID NO:1562, SEQ ID NO:1564, SEQ ID NO:1566, SEQ ID NO:1568, SEQ ID NOs:1570-1571, SEQ ID NO:1573, SEQ ID NO:1575, SEQ ID NO:1577, SEQ ID NO:1579, SEQ ID NO:1581, SEQ ID NO:1583, SEQ ID NO:1585, SEQ ID NO:1587, SEQ ID NO:1589, SEQ ID NO:1591, SEQ ID NO:1593, SEQ ID NOs:1595-1608, SEQ ID NO:1610, SEQ ID NO:1612, SEQ ID NO:1614, SEQ ID NO:1616, SEQ ID NO:1618, SEQ ID NOs:1620-1622, SEQ ID NO:1624, SEQ ID NO:1626, SEQ ID NO:1628, SEQ ID NO:1630, SEQ ID NOs:1632-1635, SEQ ID NOs:1637-1651, SEQ ID NOs:1653-1655, SEQ ID NO:1657, SEQ ID NO:1659, SEQ ID NO:1661, SEQ ID NO:1663, SEQ ID NO:1665, SEQ ID NO:1667, SEQ ID NO:1669, SEQ ID NO:1671, SEQ ID NO:1673, SEQ ID NOs:1675-1679, SEQ ID NO:1681, SEQ ID NOs:1683-1690, SEQ ID NO:1692, SEQ ID NO:1694, SEQ ID NO:1696, SEQ ID NO:1698, SEQ ID NO:1700, SEQ ID NO:1702, SEQ ID NO:1704, SEQ ID NO:1706, SEQ ID NO:1708, SEQ ID NO:1710; SEQ ID NO:1712, SEQ ID NO:1714, SEQ ID NO:1716, SEQ ID NO:1718, SEQ ID NO:1720, SEQ ID NO:1722, SEQ ID NO:1724, SEQ ID NO:1726, SEQ ID NOs:1728-1731, SEQ ID NO:1733, SEQ ID NOs:1735-1747, SEQ ID NOs:1749-1750, SEQ ID NOs:1752-1765, SEQ ID NOs:1767-1775, SEQ ID NO:1777, SEQ ID NO:1779, SEQ ID NO:1781, SEQ ID NO:1783, SEQ ID NOs:1785-1804, SEQ ID NOs:1806-1820, SEQ ID NO:1822, SEQ ID NO:1824, SEQ ID NO:1826, SEQ ID NO:1828, SEQ ID NO:1830, SEQ ID NO:1832, SEQ ID NO:1834, SEQ ID NO:1836, SEQ ID NO:1838, SEQ ID NO:1840, SEQ ID NO:1842, SEQ ID NO:1844, SEQ ID NO:1846, SEQ ID NO:1848, SEQ ID NO:1850, SEQ ID NO:1852, SEQ ID NO:1854, SEQ ID NO:1856, SEQ ID NO:1858, SEQ ID NO:1860, SEQ ID NO:1862, SEQ ID NO:1864, SEQ ID NO:1866, SEQ ID NO:1868, SEQ ID NO:1870, SEQ ID NO:1872, SEQ ID NO:1874, SEQ ID NO:1876, SEQ ID NO:1878, SEQ ID NO:1880, SEQ ID NO:1882, SEQ ID NO:1884, SEQ ID NO:1886, SEQ ID NO:1888, SEQ ID NO:1890, SEQ ID NOs:1892-1895, SEQ ID NO:1897, SEQ ID NO:1899, SEQ ID NOs:1901-1902, SEQ ID NO:1904, SEQ ID NO:1906, SEQ ID NO:1908, SEQ ID NOs:1921-2059, SEQ ID NO:2061, SEQ ID NO:2063, SEQ ID NOs:2065-2083, SEQ ID NO:2085, SEQ ID NO:2087, SEQ ID NO:2089, SEQ ID NO:2091, SEQ ID NO:2093, SEQ ID NO:2095, SEQ ID NO:2097, SEQ ID NO:2099, SEQ ID NO:2101, SEQ ID NO:2103, SEQ ID NO:2105, SEQ ID NO:2107, SEQ ID NO:2109, SEQ ID NO:2111, SEQ ID NO:2113, SEQ ID NO:2115, SEQ ID NO:2117, SEQ ID NO:2119, SEQ ID NO:2121, SEQ ID NO:2123, SEQ ID NO:2125, SEQ ID NO:2127, SEQ ID NO:2129, SEQ ID NO:2131, SEQ ID NO:2133, SEQ ID NO:2135, SEQ ID NO:2137, SEQ ID NO:2139, SEQ ID NO:2141, SEQ ID NO:2143, SEQ ID NO:2145, SEQ ID NO:2147, SEQ ID NO:2149, SEQ ID NO:2151, SEQ ID NO:2153, SEQ ID NO:2155, SEQ ID NO:2157, SEQ ID NO:2159, SEQ ID NO:2161, SEQ ID NO:2162, SEQ ID NO:2164, SEQ ID NO:2166, SEQ ID NO:6168, SEQ ID NO:2170, SEQ ID NO:2172, SEQ ID NO:2174, SEQ ID NO:2176, SEQ ID NO:2178, SEQ ID NO:2180, SEQ ID NO:2182, SEQ ID NO:2184, SEQ ID NO:2186, SEQ ID NO:2188, SEQ ID NO:2190, SEQ ID NO:2192, SEQ ID NO:2194, SEQ ID NO:2196, SEQ ID NO:2198, SEQ ID NO:2200, SEQ ID NO:2202, SEQ ID NO:2204, SEQ ID NO:2206, SEQ ID NO:2208, SEQ ID NO:2210, SEQ ID NO:2212, SEQ ID NO:2214, SEQ ID NO:2216, SEQ ID NO:2218, SEQ ID NO:2220, SEQ ID NO:2222, SEQ ID NO:2224, SEQ ID NO:2226, SEQ ID NO:2228, SEQ ID NO:2230, SEQ ID NO:2232, SEQ ID NO:2234, SEQ ID NO:2236, SEQ ID NO:2238, SEQ ID NO:2240, SEQ ID NO:2242, SEQ ID NO:2244, SEQ ID NO:2246, SEQ ID NO:2248, SEQ ID NO:2250, SEQ ID NO:2252, SEQ ID NO:2254, SEQ ID NO:2256, SEQ ID NO:2258, SEQ ID NO:2260, SEQ ID NO:2262, SEQ ID NO:2264, SEQ ID NO:2266, SEQ ID NO:2268, SEQ ID NO:2270, SEQ ID NO:2272, SEQ ID NO:2274, SEQ ID NO:2276, SEQ ID NO:2278, SEQ ID NO:2280, SEQ ID NO:2282, SEQ ID NO:2284, SEQ ID NO:2286, SEQ ID NO:2288, SEQ ID NO:2290, SEQ ID NO:2292, SEQ ID NO:2294, SEQ ID NO:2296, SEQ ID NO:2298, SEQ ID NO:2300, SEQ ID NO:2302, SEQ ID NO:2304, SEQ ID NO:2306, SEQ ID NO:2308, SEQ ID NO:2310, SEQ ID NO:2312, SEQ ID NO:2314, SEQ ID NO:2316, SEQ ID NO:2318, SEQ ID NO:2320, SEQ ID NO:2322, SEQ ID NO:2324, SEQ ID NO:2326, SEQ ID NO:2328, SEQ ID NO:2330, SEQ ID NO:2332, SEQ ID NO:2334, SEQ ID NO:2336, SEQ ID NO:2338, SEQ ID NO:2340, SEQ ID NO:2342, SEQ ID NO:2344, SEQ ID NO:2346, and SEQ ID NO:2348. The plant cell has an endogenous gene involved in lignin biosynthesis comprising a regulatory region and the sequence of interest. The endogenous regulatory region and the polypeptide are associated. The plant cell is grown under conditions effective for expression of the polypeptide and expresses the sequence of interest.

The sequence of interest can comprise a coding sequence for a polypeptide involved in lignin biosynthesis. The endogenous gene can comprise a coding sequence for a polypeptide involved in lignin biosynthesis. The exogenous nucleic acid encoding the polypeptide can be operably linked to a regulatory region capable of modulating expression of the polypeptide in the cell. The regulatory region can be tissue-preferential, cell-type preferential, organ-preferential, or inducible.

In another aspect, a plant is provided. The plant comprises any of the plant cells described above. Progeny of the plant also are provided, where the progeny have a difference in lignin content as compared to the corresponding lignin content in tissue of a control plant that does not comprise the nucleic acid.

Methods of modulating the level of lignin in a plant are provided herein. In one aspect, a method comprises introducing into a plant cell an exogenous nucleic acid, said exogenous nucleic acid comprising a regulatory region operably linked to a nucleotide sequence encoding a polypeptide, wherein the HMM bit score of the amino acid sequence of said polypeptide is greater than about 20, said HMM based on the amino acid sequences depicted in one of FIGS. 1 to 51 or 53 to 131, and wherein a tissue of a plant produced from said plant cell has a difference in the lignin content as compared to the corresponding lignin content of a control plant that does not comprise said exogenous nucleic acid.

In another aspect, a method of modulating the lignin content in a plant is provided. The method comprises introducing into a plant cell an exogenous nucleic acid comprising a regulatory region operably linked to a nucleic acid encoding a lignin-modulating polypeptide comprising a polypeptide sequence having 80% or greater sequence identity to a polypeptide sequence selected from the group consisting of SEQ ID NO:96, SEQ ID NOs:98-100, SEQ ID NO:102, SEQ ID NO:104, SEQ ID NO:106, SEQ ID NO:108, SEQ ID NOs:110-112, SEQ ID NOs:114-117, SEQ ID NOs:119-122, SEQ ID NO:124, SEQ ID NOs:126-128, SEQ ID NOs:130-132, SEQ ID NOs:134-137, SEQ ID NO:139, SEQ ID NO:141, SEQ ID NO:143, SEQ ID NOs:145-147, SEQ ID NO:149, SEQ ID NOs:151-155, SEQ ID NO:157, SEQ ID NO:159, SEQ ID NO:161, SEQ ID NO:163, SEQ ID NOs:165-168, SEQ ID NO:170, SEQ ID NOs:172-176, SEQ ID NOs:178-194, SEQ ID NO:196, SEQ ID NOs:198-215, SEQ ID NO:217, SEQ ID NO:219, SEQ ID NOs:221-251, SEQ ID NO:253, SEQ ID NOs:255-256, SEQ ID NO:258, SEQ ID NO:260, SEQ ID NOs:262-265, SEQ ID NO:267, SEQ ID NOs:269-270, SEQ ID NOs:272-273, SEQ ID NOs:275-277, SEQ ID NOs:279-280, SEQ ID NO:282, SEQ ID NO:284, SEQ ID NOs:286-287, SEQ ID NOs:289-290, SEQ ID NO:292, SEQ ID NOs:294-298, SEQ ID NO:300, SEQ ID NO:302, SEQ ID NO:304, SEQ ID NO:306, SEQ ID NOs:308-313, SEQ ID NOs:315-316, SEQ ID NOs:318-319, SEQ ID NO:321, SEQ ID NO:323, SEQ ID NOs:325-326, SEQ ID NO:328, SEQ ID NO:330, SEQ ID NO:332, SEQ ID NOs:334-335, SEQ ID NO:337, SEQ ID NO:339-341, SEQ ID NO:343, SEQ ID NO:345, SEQ ID NO:347-351, SEQ ID NO:353, SEQ ID NO:355, SEQ ID NO:357-359, SEQ ID NOs:361-368, SEQ ID NO:370, SEQ ID NO:372, SEQ ID NOs:374-375, SEQ ID NO:377, SEQ ID NO:379, SEQ ID NOs:381-385, SEQ ID NOs:387-389, SEQ ID NOs:391-392, SEQ ID NOs:394-398, SEQ ID NO:400, SEQ ID NOs:402-403, SEQ ID NO:405, SEQ ID NO:407, SEQ ID NO:409, SEQ ID NO:411, SEQ ID NO:413, SEQ ID NO:415, SEQ ID NOs:417-430, SEQ ID NOs:432-434, SEQ ID NO:436, SEQ ID NO:438, SEQ ID NO:440, SEQ ID NOs:442-443, SEQ ID NOs:445-447, SEQ ID NO:449, SEQ ID NOs:451-452, SEQ ID NOs:454-457, SEQ ID NO:459, SEQ ID NOs:461-463, SEQ ID NOs:465-468, SEQ ID NOs:470-471, SEQ ID NO:473, SEQ ID NOs:475-476, SEQ ID NOs:478-481, SEQ ID NOs:483-485, SEQ ID NOs:487-488, SEQ ID NO:490, SEQ ID NO:492, SEQ ID NO:494, SEQ ID NOs:496-499, SEQ ID NOs:501-502, SEQ ID NOs:504-506, SEQ ID NO:508, SEQ ID NOs:510-514, SEQ ID NO:516, SEQ ID NO:518, SEQ ID NOs:520-522, SEQ ID NO:524, SEQ ID NOs:526-527, SEQ ID NOs:529-533, SEQ ID NO:535, SEQ ID NO:537, SEQ ID NO:539, SEQ ID NO:541, SEQ ID NO:543, SEQ ID NOs:545-546, SEQ ID NOs:548-551, SEQ ID NO:553, SEQ ID NOs:555-561, SEQ ID NOs:563-564, SEQ ID NOs:566-568, SEQ ID NO:570, SEQ ID NO:572, SEQ ID NOs:574-576, SEQ ID NOs:578-579, SEQ ID NO:581, SEQ ID NO:583, SEQ ID NOs:585-588, SEQ ID NOs:590-591, SEQ ID NOs:593-594, SEQ ID NOs:596-597, SEQ ID NO:599, SEQ ID NO:601, SEQ ID NOs:603-604, SEQ ID NO:606, SEQ ID NO:608, SEQ ID NO:610, SEQ ID NO:612, SEQ ID NOs:614-617, SEQ ID NO:619, SEQ ID NOs:621-636, SEQ ID NOs:638-648, SEQ ID NO:650, SEQ ID NOs:652-654, SEQ ID NOs:656-657, SEQ ID NO:659, SEQ ID NOs:661-663, SEQ ID NOs:665-669, SEQ ID NOs:671-673, SEQ ID NOs:675-676, SEQ ID NO:678, SEQ ID NO:680, SEQ ID NO:682, SEQ ID NO:684, SEQ ID NOs:686-687, SEQ ID NOs:689-693, SEQ ID NOs:695-696, SEQ ID NO:698, SEQ ID NOs:700-701, SEQ ID NO:703, SEQ ID NO:705, SEQ ID NO:707, SEQ ID NOs:709-711, SEQ ID NO:713, SEQ ID NOs:715-716, SEQ ID NO:718, SEQ ID NO:720, SEQ ID NO:722, SEQ ID NOs:724-728, SEQ ID NOs:730-735, SEQ ID NOs:737-740, SEQ ID NO:742, SEQ ID NOs:744-745, SEQ ID NOs:747-751, SEQ ID NO:753, SEQ ID NOs:755-758, SEQ ID NOs:760-763, SEQ ID NOs:765-777, SEQ ID NO:779, SEQ ID NOs:781-784, SEQ ID NOs:786-788, SEQ ID NOs:790-791, SEQ ID NOs:793-794, SEQ ID NO:796, SEQ ID NO:798, SEQ ID NO:800, SEQ ID NOs:802-806, SEQ ID NOs:808-809, SEQ ID NOs:811-812, SEQ ID NO:814, SEQ ID NOs:816-818, SEQ ID NO:820, SEQ ID NO:822, SEQ ID NOs:824-826, SEQ ID NO:828, SEQ ID NOs:830-831, SEQ ID NO:833, SEQ ID NOs:835-836, SEQ ID NOs:838-839, SEQ ID NO:841, SEQ ID NOs:843-847, SEQ ID NOs:849-850, SEQ ID NOs:852-853, SEQ ID NOs:855-857, SEQ ID NO:859, SEQ ID NOs:861-863, SEQ ID NOs:865-866, SEQ ID NOs:868-883, SEQ ID NOs:885-888, SEQ ID NO:890, SEQ ID NO:892, SEQ ID NO:894, SEQ ID NO:896, SEQ ID NO:898, SEQ ID NOs:900-902, SEQ ID NOs:904-905, SEQ ID NOs:907-910, SEQ ID NO:912, SEQ ID NOs:914-915, SEQ ID NO:917, SEQ ID NO:919, SEQ ID NOs:921-925, SEQ ID NO:927, SEQ ID NOs:929-932, SEQ ID NO:934, SEQ ID NO:936, SEQ ID NOs:938-941, SEQ ID NO:943 SEQ ID NOs:945-957, SEQ ID NOs:959-962, SEQ ID NO:964, SEQ ID NO:966, SEQ ID NOs:968-971, SEQ ID NO:973, SEQ ID NOs:975-978, SEQ ID NO:980, SEQ ID NOs:982-992, SEQ ID NOs:994-1005, SEQ ID NOs:1007-1009, SEQ ID NOs:1011-1014, SEQ ID NOs:1016-1026, SEQ ID NOs:1028-1029, SEQ ID NOs:1031-1033, SEQ ID NOs:1035-1048, SEQ ID NO:1050, SEQ ID NOs:1052-1053, SEQ ID NOs:1055-1056, SEQ ID NO:1058, SEQ ID NO:1060, SEQ ID NO:1062, SEQ ID NOs:1064-1066, SEQ ID NOs:1068-1069, SEQ ID NOs:1071-1076, SEQ ID NOs:1078-1079, SEQ ID NO:1081, SEQ ID NO:1083, SEQ ID NO:1085, SEQ ID NOs:1087-1089, SEQ ID NOs:1091-1092, SEQ ID NO:1094, SEQ ID NO:1096, SEQ ID NOs:1098-1102, SEQ ID NOs:1104-1107, SEQ ID NOs:1109-1115, SEQ ID NOs:1117-1120, SEQ ID NOs:1122-1123, SEQ ID NOs:1125-1127, SEQ ID NO:1129, SEQ ID NOs:1131-1132, SEQ ID NO:1134, SEQ ID NOs:1136-1137, SEQ ID NOs:1139-1141, SEQ ID NOs:1143-1147, SEQ ID NOs:1149-1154, SEQ ID NOs:1156-1157, SEQ ID NO:1159, SEQ ID NO:1161, SEQ ID NO:1163, SEQ ID NOs:1165-1169, SEQ ID NO:1171, SEQ ID NOs:1173-1174, SEQ ID NOs:1176-1181, SEQ ID NO:1183, SEQ ID NOs:1185-1207, SEQ ID NO:1209, SEQ ID NO:1211, SEQ ID NO:1213, SEQ ID NO:1215, SEQ ID NO:1217, SEQ ID NO:1219, SEQ ID NO:1221, SEQ ID NO:1223, SEQ ID NOs:1225-1235, SEQ ID NO:1237, SEQ ID NO:1239, SEQ ID NO:1241, SEQ ID NO:1243, SEQ ID NO:1245, SEQ ID NO:1247, SEQ ID NO:1249, SEQ ID NO:1251, SEQ ID NO:1253, SEQ ID NO:1255, SEQ ID NO:1257, SEQ ID NO:1259, SEQ ID NO:1261, SEQ ID NO:1263, SEQ ID NO:1265, SEQ ID NO:1267, SEQ ID NO:1269, SEQ ID NO:1271, SEQ ID NO:1273, SEQ ID NO:1275, SEQ ID NO:1277, SEQ ID NO:1279, SEQ ID NO:1281, SEQ ID NO:1283, SEQ ID NOs:1285-1290, SEQ ID NO:1292, SEQ ID NO:1294, SEQ ID NO:1296, SEQ ID NO:1298, SEQ ID NO:1300, SEQ ID NOs:1302-1309, SEQ ID NO:1311, SEQ ID NO:1313, SEQ ID NO:1315, SEQ ID NO:1317, SEQ ID NO:1319, SEQ ID NO:1321, SEQ ID NO:1323, SEQ ID NO:1325, SEQ ID NO:1327, SEQ ID NO:1329, SEQ ID NO:1331, SEQ ID NO:1333, SEQ ID NO:1335, SEQ ID NO:1337, SEQ ID NO:1339, SEQ ID NO:1341, SEQ ID NO:1343, SEQ ID NO:1345, SEQ ID NO:1347, SEQ ID NO:1349, SEQ ID NO:1351, SEQ ID NO:1353, SEQ ID NO:1355, SEQ ID NO:1357, SEQ ID NO:1359, SEQ ID NOs:1361-1367, SEQ ID NO:1369, SEQ ID NO:1371, SEQ ID NO:1373, SEQ ID NO:1375, SEQ ID NO:1377, SEQ ID NO:1379, SEQ ID NO:1381, SEQ ID NO:1383, SEQ ID NO:1385, SEQ ID NO:1387, SEQ ID NO:1389, SEQ ID NO:1391, SEQ ID NO:1393, SEQ ID NO:1395, SEQ ID NO:1397, SEQ ID NO:1399, SEQ ID NO:1401, SEQ ID NO:1403, SEQ ID NOs:1405-1410, SEQ ID NO:1412, SEQ ID NOs:1414-1415, SEQ ID NO:1417, SEQ ID NO:1419, SEQ ID NO:1421, SEQ ID NOs:1423-1429, SEQ ID NO:1431, SEQ ID NO:1433, SEQ ID NOs: 1436-1442, SEQ ID NOs:1444-1463, SEQ ID NO:1465, SEQ ID NO:1467, SEQ ID NO:1469, SEQ ID NO:1471, SEQ ID NO:1473, SEQ ID NO:1475, SEQ ID NO:1477, SEQ ID NO:1479, SEQ ID NO:1481, SEQ ID NO:1483, SEQ ID NO:1485, SEQ ID NOs:1487-1491, SEQ ID NOs:1493-1500, SEQ ID NO:1502, SEQ ID NOs:1504-1516, SEQ ID NO:1518, SEQ ID NO:1520, SEQ ID NO:1522, SEQ ID NO:1524, SEQ ID NO:1526, SEQ ID NOs:1528-1534, SEQ ID NO:1536, SEQ ID NO:1538, SEQ ID NO:1540, SEQ ID NO:1542, SEQ ID NO:1544, SEQ ID NO:1546, SEQ ID NO:1548, SEQ ID NO:1550, SEQ ID NO:1552, SEQ ID NO:1554, SEQ ID NO:1556, SEQ ID NO:1558, SEQ ID NO:1560, SEQ ID NO:1562, SEQ ID NO:1564, SEQ ID NO:1566, SEQ ID NO:1568, SEQ ID NOs:1570-1571, SEQ ID NO:1573, SEQ ID NO:1575, SEQ ID NO:1577, SEQ ID NO:1579, SEQ ID NO:1581, SEQ ID NO:1583, SEQ ID NO:1585, SEQ ID NO:1587, SEQ ID NO:1589, SEQ ID NO:1591, SEQ ID NO:1593, SEQ ID NOs:1595-1608, SEQ ID NO:1610, SEQ ID NO:1612, SEQ ID NO:1614, SEQ ID NO:1616, SEQ ID NO:1618, SEQ ID NOs:1620-1622, SEQ ID NO:1624, SEQ ID NO:1626, SEQ ID NO:1628, SEQ ID NO:1630, SEQ ID NOs:1632-1635, SEQ ID NOs:1637-1651, SEQ ID NOs:1653-1655, SEQ ID NO:1657, SEQ ID NO:1659, SEQ ID NO:1661, SEQ ID NO:1663, SEQ ID NO:1665, SEQ ID NO:1667, SEQ ID NO:1669, SEQ ID NO:1671, SEQ ID NO:1673, SEQ ID NOs:1675-1679, SEQ ID NO:1681, SEQ ID NOs:1683-1690, SEQ ID NO:1692, SEQ ID NO:1694, SEQ ID NO:1696, SEQ ID NO:1698, SEQ ID NO:1700, SEQ ID NO:1702, SEQ ID NO:1704, SEQ ID NO:1706, SEQ ID NO:1708, SEQ ID NO:1710; SEQ ID NO:1712, SEQ ID NO:1714, SEQ ID NO:1716, SEQ ID NO:1718, SEQ ID NO:1720, SEQ ID NO:1722, SEQ ID NO:1724, SEQ ID NO:1726, SEQ ID NOs:1728-1731, SEQ ID NO:1733, SEQ ID NOs:1735-1747, SEQ ID NOs:1749-1750, SEQ ID NOs:1752-1765, SEQ ID NOs:1767-1775, SEQ ID NO:1777, SEQ ID NO:1779, SEQ ID NO:1781, SEQ ID NO:1783, SEQ ID NOs:1785-1804, SEQ ID NOs:1806-1820, SEQ ID NO:1822, SEQ ID NO:1824, SEQ ID NO:1826, SEQ ID NO:1828, SEQ ID NO:1830, SEQ ID NO:1832, SEQ ID NO:1834, SEQ ID NO:1836, SEQ ID NO:1838, SEQ ID NO:1840, SEQ ID NO:1842, SEQ ID NO:1844, SEQ ID NO:1846, SEQ ID NO:1848, SEQ ID NO:1850, SEQ ID NO:1852, SEQ ID NO:1854, SEQ ID NO:1856, SEQ ID NO:1858, SEQ ID NO:1860, SEQ ID NO:1862, SEQ ID NO:1864, SEQ ID NO:1866, SEQ ID NO:1868, SEQ ID NO:1870, SEQ ID NO:1872, SEQ ID NO:1874, SEQ ID NO:1876, SEQ ID NO:1878, SEQ ID NO:1880, SEQ ID NO:1882, SEQ ID NO:1884, SEQ ID NO:1886, SEQ ID NO:1888, SEQ ID NO:1890, SEQ ID NOs:1892-1895, SEQ ID NO:1897, SEQ ID NO:1899, SEQ ID NOs:1901-1902, SEQ ID NO:1904, SEQ ID NO:1906, SEQ ID NO:1908, SEQ ID NOs:1921-2059, SEQ ID NO:2061, SEQ ID NO:2063, SEQ ID NOs:2065-2083, SEQ ID NO:2085, SEQ ID NO:2087, SEQ ID NO:2089, SEQ ID NO:2091, SEQ ID NO:2093, SEQ ID NO:2095, SEQ ID NO:2097, SEQ ID NO:2099, SEQ ID NO:2101, SEQ ID NO:2103, SEQ ID NO:2105, SEQ ID NO:2107, SEQ ID NO:2109, SEQ ID NO:2111, SEQ ID NO:2113, SEQ ID NO:2115, SEQ ID NO:2117, SEQ ID NO:2119, SEQ ID NO:2121, SEQ ID NO:2123, SEQ ID NO:2125, SEQ ID NO:2127, SEQ ID NO:2129, SEQ ID NO:2131, SEQ ID NO:2133, SEQ ID NO:2135, SEQ ID NO:2137, SEQ ID NO:2139, SEQ ID NO:2141, SEQ ID NO:2143, SEQ ID NO:2145, SEQ ID NO:2147, SEQ ID NO:2149, SEQ ID NO:2151, SEQ ID NO:2153, SEQ ID NO:2155, SEQ ID NO:2157, SEQ ID NO:2159, SEQ ID NO:2161, SEQ ID NO:2162, SEQ ID NO:2164, SEQ ID NO:2166, SEQ ID NO:6168, SEQ ID NO:2170, SEQ ID NO:2172, SEQ ID NO:2174, SEQ ID NO:2176, SEQ ID NO:2178, SEQ ID NO:2180, SEQ ID NO:2182, SEQ ID NO:2184, SEQ ID NO:2186, SEQ ID NO:2188, SEQ ID NO:2190, SEQ ID NO:2192, SEQ ID NO:2194, SEQ ID NO:2196, SEQ ID NO:2198, SEQ ID NO:2200, SEQ ID NO:2202, SEQ ID NO:2204, SEQ ID NO:2206, SEQ ID NO:2208, SEQ ID NO:2210, SEQ ID NO:2212, SEQ ID NO:2214, SEQ ID NO:2216, SEQ ID NO:2218, SEQ ID NO:2220, SEQ ID NO:2222, SEQ ID NO:2224, SEQ ID NO:2226, SEQ ID NO:2228, SEQ ID NO:2230, SEQ ID NO:2232, SEQ ID NO:2234, SEQ ID NO:2236, SEQ ID NO:2238, SEQ ID NO:2240, SEQ ID NO:2242, SEQ ID NO:2244, SEQ ID NO:2246, SEQ ID NO:2248, SEQ ID NO:2250, SEQ ID NO:2252, SEQ ID NO:2254, SEQ ID NO:2256, SEQ ID NO:2258, SEQ ID NO:2260, SEQ ID NO:2262, SEQ ID NO:2264, SEQ ID NO:2266, SEQ ID NO:2268, SEQ ID NO:2270, SEQ ID NO:2272, SEQ ID NO:2274, SEQ ID NO:2276, SEQ ID NO:2278, SEQ ID NO:2280, SEQ ID NO:2282, SEQ ID NO:2284, SEQ ID NO:2286, SEQ ID NO:2288, SEQ ID NO:2290, SEQ ID NO:2292, SEQ ID NO:2294, SEQ ID NO:2296, SEQ ID NO:2298, SEQ ID NO:2300, SEQ ID NO:2302, SEQ ID NO:2304, SEQ ID NO:2306, SEQ ID NO:2308, SEQ ID NO:2310, SEQ ID NO:2312, SEQ ID NO:2314, SEQ ID NO:2316, SEQ ID NO:2318, SEQ ID NO:2320, SEQ ID NO:2322, SEQ ID NO:2324, SEQ ID NO:2326, SEQ ID NO:2328, SEQ ID NO:2330, SEQ ID NO:2332, SEQ ID NO:2334, SEQ ID NO:2336, SEQ ID NO:2338, SEQ ID NO:2340, SEQ ID NO:2342, SEQ ID NO:2344, SEQ ID NO:2346, and SEQ ID NO:2348; where a tissue of a plant produced from the plant cell has a difference in lignin content as compared to the corresponding lignin content in tissue of a control plant that does not comprise the nucleic acid.

In another aspect, a method of modulating the lignin content in a plant is provided. The method comprises introducing into a plant cell an exogenous nucleic acid comprising a regulatory region operably linked to a polynucleotide whose transcription product is at least 30 nucleotides in length and is complementary to a nucleic acid encoding a lignin-modulating polypeptide, the lignin-modulating polypeptide selected from the group consisting of a polypeptide having 80% or greater sequence identity to SEQ ID NO:96, SEQ ID NOs:98-100, SEQ ID NO:102, SEQ ID NO:104, SEQ ID NO:106, SEQ ID NO:108, SEQ ID NOs:110-112, SEQ ID NOs:114-117, SEQ ID NOs:119-122, SEQ ID NO:124, SEQ ID NOs:126-128, SEQ ID NOs:130-132, SEQ ID NOs:134-137, SEQ ID NO:139, SEQ ID NO:141, SEQ ID NO:143, SEQ ID NOs:145-147, SEQ ID NO:149, SEQ ID NOs:151-155, SEQ ID NO:157, SEQ ID NO:159, SEQ ID NO:161, SEQ ID NO:163, SEQ ID NOs:165-168, SEQ ID NO:170, SEQ ID NOs:172-176, SEQ ID NOs:178-194, SEQ ID NO:196, SEQ ID NOs:198-215, SEQ ID NO:217, SEQ ID NO:219, SEQ ID NOs:221-251, SEQ ID NO:253, SEQ ID NOs:255-256, SEQ ID NO:258, SEQ ID NO:260, SEQ ID NOs:262-265, SEQ ID NO:267, SEQ ID NOs:269-270, SEQ ID NOs:272-273, SEQ ID NOs:275-277, SEQ ID NOs:279-280, SEQ ID NO:282, SEQ ID NO:284, SEQ ID NOs:286-287, SEQ ID NOs:289-290, SEQ ID NO:292, SEQ ID NOs:294-298, SEQ ID NO:300, SEQ ID NO:302, SEQ ID NO:304, SEQ ID NO:306, SEQ ID NOs:308-313, SEQ ID NOs:315-316, SEQ ID NOs:318-319, SEQ ID NO:321, SEQ ID NO:323, SEQ ID NOs:325-326, SEQ ID NO:328, SEQ ID NO:330, SEQ ID NO:332, SEQ ID NOs:334-335, SEQ ID NO:337, SEQ ID NO:339-341, SEQ ID NO:343, SEQ ID NO:345, SEQ ID NO:347-351, SEQ ID NO:353, SEQ ID NO:355, SEQ ID NO:357-359, SEQ ID NOs:361-368, SEQ ID NO:370, SEQ ID NO:372, SEQ ID NOs:374-375, SEQ ID NO:377, SEQ ID NO:379, SEQ ID NOs:381-385, SEQ ID NOs:387-389, SEQ ID NOs:391-392, SEQ ID NOs:394-398, SEQ ID NO:400, SEQ ID NOs:402-403, SEQ ID NO:405, SEQ ID NO:407, SEQ ID NO:409, SEQ ID NO:411, SEQ ID NO:413, SEQ ID NO:415, SEQ ID NOs:417-430, SEQ ID NOs:432-434, SEQ ID NO:436, SEQ ID NO:438, SEQ ID NO:440, SEQ ID NOs:442-443, SEQ ID NOs:445-447, SEQ ID NO:449, SEQ ID NOs:451-452, SEQ ID NOs:454-457, SEQ ID NO:459, SEQ ID NOs:461-463, SEQ ID NOs:465-468, SEQ ID NOs:470-471, SEQ ID NO:473, SEQ ID NOs:475-476, SEQ ID NOs:478-481, SEQ ID NOs:483-485, SEQ ID NOs:487-488, SEQ ID NO:490, SEQ ID NO:492, SEQ ID NO:494, SEQ ID NOs:496-499, SEQ ID NOs:501-502, SEQ ID NOs:504-506, SEQ ID NO:508, SEQ ID NOs:510-514, SEQ ID NO:516, SEQ ID NO:518, SEQ ID NOs:520-522, SEQ ID NO:524, SEQ ID NOs:526-527, SEQ ID NOs:529-533, SEQ ID NO:535, SEQ ID NO:537, SEQ ID NO:539, SEQ ID NO:541, SEQ ID NO:543, SEQ ID NOs:545-546, SEQ ID NOs:548-551, SEQ ID NO:553, SEQ ID NOs:555-561, SEQ ID NOs:563-564, SEQ ID NOs:566-568, SEQ ID NO:570, SEQ ID NO:572, SEQ ID NOs:574-576, SEQ ID NOs:578-579, SEQ ID NO:581, SEQ ID NO:583, SEQ ID NOs:585-588, SEQ ID NOs:590-591, SEQ ID NOs:593-594, SEQ ID NOs:596-597, SEQ ID NO:599, SEQ ID NO:601, SEQ ID NOs:603-604, SEQ ID NO:606, SEQ ID NO:608, SEQ ID NO:610, SEQ ID NO:612, SEQ ID NOs:614-617, SEQ ID NO:619, SEQ ID NOs:621-636, SEQ ID NOs:638-648, SEQ ID NO:650, SEQ ID NOs:652-654, SEQ ID NOs:656-657, SEQ ID NO:659, SEQ ID NOs:661-663, SEQ ID NOs:665-669, SEQ ID NOs:671-673, SEQ ID NOs:675-676, SEQ ID NO:678, SEQ ID NO:680, SEQ ID NO:682, SEQ ID NO:684, SEQ ID NOs:686-687, SEQ ID NOs:689-693, SEQ ID NOs:695-696, SEQ ID NO:698, SEQ ID NOs:700-701, SEQ ID NO:703, SEQ ID NO:705, SEQ ID NO:707, SEQ ID NOs:709-711, SEQ ID NO:713, SEQ ID NOs:715-716, SEQ ID NO:718, SEQ ID NO:720, SEQ ID NO:722, SEQ ID NOs:724-728, SEQ ID NOs:730-735, SEQ ID NOs:737-740, SEQ ID NO:742, SEQ ID NOs:744-745, SEQ ID NOs:747-751, SEQ ID NO:753, SEQ ID NOs:755-758, SEQ ID NOs:760-763, SEQ ID NOs:765-777, SEQ ID NO:779, SEQ ID NOs:781-784, SEQ ID NOs:786-788, SEQ ID NOs:790-791, SEQ ID NOs:793-794, SEQ ID NO:796, SEQ ID NO:798, SEQ ID NO:800, SEQ ID NOs:802-806, SEQ ID NOs:808-809, SEQ ID NOs:811-812, SEQ ID NO:814, SEQ ID NOs:816-818, SEQ ID NO:820, SEQ ID NO:822, SEQ ID NOs:824-826, SEQ ID NO:828, SEQ ID NOs:830-831, SEQ ID NO:833, SEQ ID NOs:835-836, SEQ ID NOs:838-839, SEQ ID NO:841, SEQ ID NOs:843-847, SEQ ID NOs:849-850, SEQ ID NOs:852-853, SEQ ID NOs:855-857, SEQ ID NO:859, SEQ ID NOs:861-863, SEQ ID NOs:865-866, SEQ ID NOs:868-883, SEQ ID NOs:885-888, SEQ ID NO:890, SEQ ID NO:892, SEQ ID NO:894, SEQ ID NO:896, SEQ ID NO:898, SEQ ID NOs:900-902, SEQ ID NOs:904-905, SEQ ID NOs:907-910, SEQ ID NO:912, SEQ ID NOs:914-915, SEQ ID NO:917, SEQ ID NO:919, SEQ ID NOs:921-925, SEQ ID NO:927, SEQ ID NOs:929-932, SEQ ID NO:934, SEQ ID NO:936, SEQ ID NOs:938-941, SEQ ID NO:943 SEQ ID NOs:945-957, SEQ ID NOs:959-962, SEQ ID NO:964, SEQ ID NO:966, SEQ ID NOs:968-971, SEQ ID NO:973, SEQ ID NOs:975-978, SEQ ID NO:980, SEQ ID NOs:982-992, SEQ ID NOs:994-1005, SEQ ID NOs:1007-1009, SEQ ID NOs:1011-1014, SEQ ID NOs:1016-1026, SEQ ID NOs:1028-1029, SEQ ID NOs:1031-1033, SEQ ID NOs:1035-1048, SEQ ID NO:1050, SEQ ID NOs:1052-1053, SEQ ID NOs:1055-1056, SEQ ID NO:1058, SEQ ID NO:1060, SEQ ID NO:1062, SEQ ID NOs:1064-1066, SEQ ID NOs:1068-1069, SEQ ID NOs:1071-1076, SEQ ID NOs:1078-1079, SEQ ID NO:1081, SEQ ID NO:1083, SEQ ID NO:1085, SEQ ID NOs:1087-1089, SEQ ID NOs:1091-1092, SEQ ID NO:1094, SEQ ID NO:1096, SEQ ID NOs:1098-1102, SEQ ID NOs:1104-1107, SEQ ID NOs:1109-1115, SEQ ID NOs:1117-1120, SEQ ID NOs:1122-1123, SEQ ID NOs:1125-1127, SEQ ID NO:1129, SEQ ID NOs:1131-1132, SEQ ID NO:1134, SEQ ID NOs:1136-1137, SEQ ID NOs:1139-1141, SEQ ID NOs:1143-1147, SEQ ID NOs:1149-1154, SEQ ID NOs:1156-1157, SEQ ID NO:1159, SEQ ID NO:1161, SEQ ID NO:1163, SEQ ID NOs:1165-1169, SEQ ID NO:1171, SEQ ID NOs:1173-1174, SEQ ID NOs:1176-1181, SEQ ID NO:1183, SEQ ID NOs:1185-1207, SEQ ID NO:1209, SEQ ID NO:1211, SEQ ID NO:1213, SEQ ID NO:1215, SEQ ID NO:1217, SEQ ID NO:1219, SEQ ID NO:1221, SEQ ID NO:1223, SEQ ID NOs:1225-1235, SEQ ID NO:1237, SEQ ID NO:1239, SEQ ID NO:1241, SEQ ID NO:1243, SEQ ID NO:1245, SEQ ID NO:1247, SEQ ID NO:1249, SEQ ID NO:1251, SEQ ID NO:1253, SEQ ID NO:1255, SEQ ID NO:1257, SEQ ID NO:1259, SEQ ID NO:1261, SEQ ID NO:1263, SEQ ID NO:1265, SEQ ID NO:1267, SEQ ID NO:1269, SEQ ID NO:1271, SEQ ID NO:1273, SEQ ID NO:1275, SEQ ID NO:1277, SEQ ID NO:1279, SEQ ID NO:1281, SEQ ID NO:1283, SEQ ID NOs:1285-1290, SEQ ID NO:1292, SEQ ID NO:1294, SEQ ID NO:1296, SEQ ID NO:1298, SEQ ID NO:1300, SEQ ID NOs:1302-1309, SEQ ID NO:1311, SEQ ID NO:1313, SEQ ID NO:1315, SEQ ID NO:1317, SEQ ID NO:1319, SEQ ID NO:1321, SEQ ID NO:1323, SEQ ID NO:1325, SEQ ID NO:1327, SEQ ID NO:1329, SEQ ID NO:1331, SEQ ID NO:1333, SEQ ID NO:1335, SEQ ID NO:1337, SEQ ID NO:1339, SEQ ID NO:1341, SEQ ID NO:1343, SEQ ID NO:1345, SEQ ID NO:1347, SEQ ID NO:1349, SEQ ID NO:1351, SEQ ID NO:1353, SEQ ID NO:1355, SEQ ID NO:1357, SEQ ID NO:1359, SEQ ID NOs:1361-1367, SEQ ID NO:1369, SEQ ID NO:1371, SEQ ID NO:1373, SEQ ID NO:1375, SEQ ID NO:1377, SEQ ID NO:1379, SEQ ID NO:1381, SEQ ID NO:1383, SEQ ID NO:1385, SEQ ID NO:1387, SEQ ID NO:1389, SEQ ID NO:1391, SEQ ID NO:1393, SEQ ID NO:1395, SEQ ID NO:1397, SEQ ID NO:1399, SEQ ID NO:1401, SEQ ID NO:1403, SEQ ID NOs:1405-1410, SEQ ID NO:1412, SEQ ID NOs:1414-1415, SEQ ID NO:1417, SEQ ID NO:1419, SEQ ID NO:1421, SEQ ID NOs:1423-1429, SEQ ID NO:1431, SEQ ID NO:1433, SEQ ID NOs:1436-1442, SEQ ID NOs:1444-1463, SEQ ID NO:1465, SEQ ID NO:1467, SEQ ID NO:1469, SEQ ID NO:1471, SEQ ID NO:1473, SEQ ID NO:1475, SEQ ID NO:1477, SEQ ID NO:1479, SEQ ID NO:1481, SEQ ID NO:1483, SEQ ID NO:1485, SEQ ID NOs:1487-1491, SEQ ID NOs:1493-1500, SEQ ID NO:1502, SEQ ID NOs:1504-1516, SEQ ID NO:1518, SEQ ID NO:1520, SEQ ID NO:1522, SEQ ID NO:1524, SEQ ID NO:1526, SEQ ID NOs:1528-1534, SEQ ID NO:1536, SEQ ID NO:1538, SEQ ID NO:1540, SEQ ID NO:1542, SEQ ID NO:1544, SEQ ID NO:1546, SEQ ID NO:1548, SEQ ID NO:1550, SEQ ID NO:1552, SEQ ID NO:1554, SEQ ID NO:1556, SEQ ID NO:1558, SEQ ID NO:1560, SEQ ID NO:1562, SEQ ID NO:1564, SEQ ID NO:1566, SEQ ID NO:1568, SEQ ID NOs:1570-1571, SEQ ID NO:1573, SEQ ID NO:1575, SEQ ID NO:1577, SEQ ID NO:1579, SEQ ID NO:1581, SEQ ID NO:1583, SEQ ID NO:1585, SEQ ID NO:1587, SEQ ID NO:1589, SEQ ID NO:1591, SEQ ID NO:1593, SEQ ID NOs:1595-1608, SEQ ID NO:1610, SEQ ID NO:1612, SEQ ID NO:1614, SEQ ID NO:1616, SEQ ID NO:1618, SEQ ID NOs:1620-1622, SEQ ID NO:1624, SEQ ID NO:1626, SEQ ID NO:1628, SEQ ID NO:1630, SEQ ID NOs:1632-1635, SEQ ID NOs:1637-1651, SEQ ID NOs:1653-1655, SEQ ID NO:1657, SEQ ID NO:1659, SEQ ID NO:1661, SEQ ID NO:1663, SEQ ID NO:1665, SEQ ID NO:1667, SEQ ID NO:1669, SEQ ID NO:1671, SEQ ID NO:1673, SEQ ID NOs:1675-1679, SEQ ID NO:1681, SEQ ID NOs:1683-1690, SEQ ID NO:1692, SEQ ID NO:1694, SEQ ID NO:1696, SEQ ID NO:1698, SEQ ID NO:1700, SEQ ID NO:1702, SEQ ID NO:1704, SEQ ID NO:1706, SEQ ID NO:1708, SEQ ID NO:1710; SEQ ID NO:1712, SEQ ID NO:1714, SEQ ID NO:1716, SEQ ID NO:1718, SEQ ID NO:1720, SEQ ID NO:1722, SEQ ID NO:1724, SEQ ID NO:1726, SEQ ID NOs:1728-1731, SEQ ID NO:1733, SEQ ID NOs:1735-1747, SEQ ID NOs:1749-1750, SEQ ID NOs:1752-1765, SEQ ID NOs:1767-1775, SEQ ID NO:1777, SEQ ID NO:1779, SEQ ID NO:1781, SEQ ID NO:1783, SEQ ID NOs:1785-1804, SEQ ID NOs:1806-1820, SEQ ID NO:1822, SEQ ID NO:1824, SEQ ID NO:1826, SEQ ID NO:1828, SEQ ID NO:1830, SEQ ID NO:1832, SEQ ID NO:1834, SEQ ID NO:1836, SEQ ID NO:1838, SEQ ID NO:1840, SEQ ID NO:1842, SEQ ID NO:1844, SEQ ID NO:1846, SEQ ID NO:1848, SEQ ID NO:1850, SEQ ID NO:1852, SEQ ID NO:1854, SEQ ID NO:1856, SEQ ID NO:1858, SEQ ID NO:1860, SEQ ID NO:1862, SEQ ID NO:1864, SEQ ID NO:1866, SEQ ID NO:1868, SEQ ID NO:1870, SEQ ID NO:1872, SEQ ID NO:1874, SEQ ID NO:1876, SEQ ID NO:1878, SEQ ID NO:1880, SEQ ID NO:1882, SEQ ID NO:1884, SEQ ID NO:1886, SEQ ID NO:1888, SEQ ID NO:1890, SEQ ID NOs:1892-1895, SEQ ID NO:1897, SEQ ID NO:1899, SEQ ID NOs:1901-1902, SEQ ID NO:1904, SEQ ID NO:1906, SEQ ID NO:1908, SEQ ID NOs:1921-2059, SEQ ID NO:2061, SEQ ID NO:2063, SEQ ID NOs:2065-2083, SEQ ID NO:2085, SEQ ID NO:2087, SEQ ID NO:2089, SEQ ID NO:2091, SEQ ID NO:2093, SEQ ID NO:2095, SEQ ID NO:2097, SEQ ID NO:2099, SEQ ID NO:2101, SEQ ID NO:2103, SEQ ID NO:2105, SEQ ID NO:2107, SEQ ID NO:2109, SEQ ID NO:2111, SEQ ID NO:2113, SEQ ID NO:2115, SEQ ID NO:2117, SEQ ID NO:2119, SEQ ID NO:2121, SEQ ID NO:2123, SEQ ID NO:2125, SEQ ID NO:2127, SEQ ID NO:2129, SEQ ID NO:2131, SEQ ID NO:2133, SEQ ID NO:2135, SEQ ID NO:2137, SEQ ID NO:2139, SEQ ID NO:2141, SEQ ID NO:2143, SEQ ID NO:2145, SEQ ID NO:2147, SEQ ID NO:2149, SEQ ID NO:2151, SEQ ID NO:2153, SEQ ID NO:2155, SEQ ID NO:2157, SEQ ID NO:2159, SEQ ID NO:2161, SEQ ID NO:2162, SEQ ID NO:2164, SEQ ID NO:2166, SEQ ID NO:6168, SEQ ID NO:2170, SEQ ID NO:2172, SEQ ID NO:2174, SEQ ID NO:2176, SEQ ID NO:2178, SEQ ID NO:2180, SEQ ID NO:2182, SEQ ID NO:2184, SEQ ID NO:2186, SEQ ID NO:2188, SEQ ID NO:2190, SEQ ID NO:2192, SEQ ID NO:2194, SEQ ID NO:2196, SEQ ID NO:2198, SEQ ID NO:2200, SEQ ID NO:2202, SEQ ID NO:2204, SEQ ID NO:2206, SEQ ID NO:2208, SEQ ID NO:2210, SEQ ID NO:2212, SEQ ID NO:2214, SEQ ID NO:2216, SEQ ID NO:2218, SEQ ID NO:2220, SEQ ID NO:2222, SEQ ID NO:2224, SEQ ID NO:2226, SEQ ID NO:2228, SEQ ID NO:2230, SEQ ID NO:2232, SEQ ID NO:2234, SEQ ID NO:2236, SEQ ID NO:2238, SEQ ID NO:2240, SEQ ID NO:2242, SEQ ID NO:2244, SEQ ID NO:2246, SEQ ID NO:2248, SEQ ID NO:2250, SEQ ID NO:2252, SEQ ID NO:2254, SEQ ID NO:2256, SEQ ID NO:2258, SEQ ID NO:2260, SEQ ID NO:2262, SEQ ID NO:2264, SEQ ID NO:2266, SEQ ID NO:2268, SEQ ID NO:2270, SEQ ID NO:2272, SEQ ID NO:2274, SEQ ID NO:2276, SEQ ID NO:2278, SEQ ID NO:2280, SEQ ID NO:2282, SEQ ID NO:2284, SEQ ID NO:2286, SEQ ID NO:2288, SEQ ID NO:2290, SEQ ID NO:2292, SEQ ID NO:2294, SEQ ID NO:2296, SEQ ID NO:2298, SEQ ID NO:2300, SEQ ID NO:2302, SEQ ID NO:2304, SEQ ID NO:2306, SEQ ID NO:2308, SEQ ID NO:2310, SEQ ID NO:2312, SEQ ID NO:2314, SEQ ID NO:2316, SEQ ID NO:2318, SEQ ID NO:2320, SEQ ID NO:2322, SEQ ID NO:2324, SEQ ID NO:2326, SEQ ID NO:2328, SEQ ID NO:2330, SEQ ID NO:2332, SEQ ID NO:2334, SEQ ID NO:2336, SEQ ID NO:2338, SEQ ID NO:2340, SEQ ID NO:2342, SEQ ID NO:2344, SEQ ID NO:2346, and SEQ ID NO:2348; where a tissue of a plant produced from the plant cell has a difference in lignin content as compared to the corresponding lignin content in tissue of a control plant that does not comprise the nucleic acid.

In another aspect, a plant cell is provided. The plant cell comprises an exogenous nucleic acid comprising a regulatory region operably linked to a polynucleotide that is transcribed into an interfering RNA effective for inhibiting expression of a lignin-modulating polypeptide selected from the group consisting of a polypeptide having 80% or greater sequence identity to SEQ ID NO:96, SEQ ID NOs:98-100, SEQ ID NO:102, SEQ ID NO:104, SEQ ID NO:106, SEQ ID NO:108, SEQ ID NOs:110-112, SEQ ID NOs:114-117, SEQ ID NOs:119-122, SEQ ID NO:124, SEQ ID NOs:126-128, SEQ ID NOs:130-132, SEQ ID NOs:134-137, SEQ ID NO:139, SEQ ID NO:141, SEQ ID NO:143, SEQ ID NOs:145-147, SEQ ID NO:149, SEQ ID NOs:151-155, SEQ ID NO:157, SEQ ID NO:159, SEQ ID NO:161, SEQ ID NO:163, SEQ ID NOs:165-168, SEQ ID NO:170, SEQ ID NOs:172-176, SEQ ID NOs:178-194, SEQ ID NO:196, SEQ ID NOs:198-215, SEQ ID NO:217, SEQ ID NO:219, SEQ ID NOs:221-251, SEQ ID NO:253, SEQ ID NOs:255-256, SEQ ID NO:258, SEQ ID NO:260, SEQ ID NOs:262-265, SEQ ID NO:267, SEQ ID NOs:269-270, SEQ ID NOs:272-273, SEQ ID NOs:275-277, SEQ ID NOs:279-280, SEQ ID NO:282, SEQ ID NO:284, SEQ ID NOs:286-287, SEQ ID NOs:289-290, SEQ ID NO:292, SEQ ID NOs:294-298, SEQ ID NO:300, SEQ ID NO:302, SEQ ID NO:304, SEQ ID NO:306, SEQ ID NOs:308-313, SEQ ID NOs:315-316, SEQ ID NOs:318-319, SEQ ID NO:321, SEQ ID NO:323, SEQ ID NOs:325-326, SEQ ID NO:328, SEQ ID NO:330, SEQ ID NO:332, SEQ ID NOs:334-335, SEQ ID NO:337, SEQ ID NOs:339-341, SEQ ID NO:343, SEQ ID NO:345, SEQ ID NOs:347-351, SEQ ID NO:353, SEQ ID NO:355, SEQ ID NOs:357-359, SEQ ID NOs:361-368, SEQ ID NO:370, SEQ ID NO:372, SEQ ID NOs:374-375, SEQ ID NO:377, SEQ ID NO:379, SEQ ID NOs:381-385, SEQ ID NOs:387-389, SEQ ID NOs:391-392, SEQ ID NOs:394-398, SEQ ID NO:400, SEQ ID NOs:402-403, SEQ ID NO:405, SEQ ID NO:407, SEQ ID NO:409, SEQ ID NO:411, SEQ ID NO:413, SEQ ID NO:415, SEQ ID NOs:417-430, SEQ ID NOs:432-434, SEQ ID NO:436, SEQ ID NO:438, SEQ ID NO:440, SEQ ID NOs:442-443, SEQ ID NOs:445-447, SEQ ID NO:449, SEQ ID NOs:451-452, SEQ ID NOs:454-457, SEQ ID NO:459, SEQ ID NOs:461-463, SEQ ID NOs:465-468, SEQ ID NOs:470-471, SEQ ID NO:473, SEQ ID NOs:475-476, SEQ ID NOs:478-481, SEQ ID NOs:483-485, SEQ ID NOs:487-488, SEQ ID NO:490, SEQ ID NO:492, SEQ ID NO:494, SEQ ID NOs:496-499, SEQ ID NOs:501-502, SEQ ID NOs:504-506, SEQ ID NO:508, SEQ ID NOs:510-514, SEQ ID NO:516, SEQ ID NO:518, SEQ ID NOs:520-522, SEQ ID NO:524, SEQ ID NOs:526-527, SEQ ID NOs:529-533, SEQ ID NO:535, SEQ ID NO:537, SEQ ID NO:539, SEQ ID NO:541, SEQ ID NO:543, SEQ ID NOs:545-546, SEQ ID NOs:548-551, SEQ ID NO:553, SEQ ID NOs:555-561, SEQ ID NOs:563-564, SEQ ID NOs:566-568, SEQ ID NO:570, SEQ ID NO:572, SEQ ID NOs:574-576, SEQ ID NOs:578-579, SEQ ID NO:581, SEQ ID NO:583, SEQ ID NOs:585-588, SEQ ID NOs:590-591, SEQ ID NOs:593-594, SEQ ID NOs:596-597, SEQ ID NO:599, SEQ ID NO:601, SEQ ID NOs:603-604, SEQ ID NO:606, SEQ ID NO:608, SEQ ID NO:610, SEQ ID NO:612, SEQ ID NOs:614-617, SEQ ID NO:619, SEQ ID NOs:621-636, SEQ ID NOs:638-648, SEQ ID NO:650, SEQ ID NOs:652-654, SEQ ID NOs:656-657, SEQ ID NO:659, SEQ ID NOs:661-663, SEQ ID NOs:665-669, SEQ ID NOs:671-673, SEQ ID NOs:675-676, SEQ ID NO:678, SEQ ID NO:680, SEQ ID NO:682, SEQ ID NO:684, SEQ ID NOs:686-687, SEQ ID NOs:689-693, SEQ ID NOs:695-696, SEQ ID NO:698, SEQ ID NOs:700-701, SEQ ID NO:703, SEQ ID NO:705, SEQ ID NO:707, SEQ ID NOs:709-711, SEQ ID NO:713, SEQ ID NOs:715-716, SEQ ID NO:718, SEQ ID NO:720, SEQ ID NO:722, SEQ ID NOs:724-728, SEQ ID NOs:730-735, SEQ ID NOs:737-740, SEQ ID NO:742, SEQ ID NOs:744-745, SEQ ID NOs:747-751, SEQ ID NO:753, SEQ ID NOs:755-758, SEQ ID NOs:760-763, SEQ ID NOs:765-777, SEQ ID NO:779, SEQ ID NOs:781-784, SEQ ID NOs:786-788, SEQ ID NOs:790-791, SEQ ID NOs:793-794, SEQ ID NO:796, SEQ ID NO:798, SEQ ID NO:800, SEQ ID NOs:802-806, SEQ ID NOs:808-809, SEQ ID NOs:811-812, SEQ ID NO:814, SEQ ID NOs:816-818, SEQ ID NO:820, SEQ ID NO:822, SEQ ID NOs:824-826, SEQ ID NO:828, SEQ ID NOs:830-831, SEQ ID NO:833, SEQ ID NOs:835-836, SEQ ID NOs:838-839, SEQ ID NO:841, SEQ ID NOs:843-847, SEQ ID NOs:849-850, SEQ ID NOs:852-853, SEQ ID NOs:855-857, SEQ ID NO:859, SEQ ID NOs:861-863, SEQ ID NOs:865-866, SEQ ID NOs:868-883, SEQ ID NOs:885-888, SEQ ID NO:890, SEQ ID NO:892, SEQ ID NO:894, SEQ ID NO:896, SEQ ID NO:898, SEQ ID NOs:900-902, SEQ ID NOs:904-905, SEQ ID NOs:907-910, SEQ ID NO:912, SEQ ID NOs:914-915, SEQ ID NO:917, SEQ ID NO:919, SEQ ID NOs:921-925, SEQ ID NO:927, SEQ ID NOs:929-932, SEQ ID NO:934, SEQ ID NO:936, SEQ ID NOs:938-941, SEQ ID NO:943 SEQ ID NOs:945-957, SEQ ID NOs:959-962, SEQ ID NO:964, SEQ ID NO:966, SEQ ID NOs:968-971, SEQ ID NO:973, SEQ ID NOs:975-978, SEQ ID NO:980, SEQ ID NOs:982-992, SEQ ID NOs:994-1005, SEQ ID NOs:1007-1009, SEQ ID NOs:1011-1014, SEQ ID NOs:1016-1026, SEQ ID NOs:1028-1029, SEQ ID NOs:1031-1033, SEQ ID NOs:1035-1048, SEQ ID NO:1050, SEQ ID NOs:1052-1053, SEQ ID NOs:1055-1056, SEQ ID NO:1058, SEQ ID NO:1060, SEQ ID NO:1062, SEQ ID NOs:1064-1066, SEQ ID NOs:1068-1069, SEQ ID NOs:1071-1076, SEQ ID NOs:1078-1079, SEQ ID NO:1081, SEQ ID NO:1083, SEQ ID NO:1085, SEQ ID NOs:1087-1089, SEQ ID NOs:1091-1092, SEQ ID NO:1094, SEQ ID NO:1096, SEQ ID NOs:1098-1102, SEQ ID NOs:1104-1107, SEQ ID NOs:1109-1115, SEQ ID NOs:1117-1120, SEQ ID NOs:1122-1123, SEQ ID NOs:1125-1127, SEQ ID NO:1129, SEQ ID NOs:1131-1132, SEQ ID NO:1134, SEQ ID NOs:1136-1137, SEQ ID NOs:1139-1141, SEQ ID NOs:1143-1147, SEQ ID NOs:1149-1154, SEQ ID NOs:1156-1157, SEQ ID NO:1159, SEQ ID NO:1161, SEQ ID NO:1163, SEQ ID NOs:1165-1169, SEQ ID NO:1171, SEQ ID NOs:1173-1174, SEQ ID NOs:1176-1181, SEQ ID NO:1183, SEQ ID NOs:1185-1207, SEQ ID NO:1209, SEQ ID NO:1211, SEQ ID NO:1213, SEQ ID NO:1215, SEQ ID NO:1217, SEQ ID NO:1219, SEQ ID NO:1221, SEQ ID NO:1223, SEQ ID NOs:1225-1235, SEQ ID NO:1237, SEQ ID NO:1239, SEQ ID NO:1241, SEQ ID NO:1243, SEQ ID NO:1245, SEQ ID NO:1247, SEQ ID NO:1249, SEQ ID NO:1251, SEQ ID NO:1253, SEQ ID NO:1255, SEQ ID NO:1257, SEQ ID NO:1259, SEQ ID NO:1261, SEQ ID NO:1263, SEQ ID NO:1265, SEQ ID NO:1267, SEQ ID NO:1269, SEQ ID NO:1271, SEQ ID NO:1273, SEQ ID NO:1275, SEQ ID NO:1277, SEQ ID NO:1279, SEQ ID NO:1281, SEQ ID NO:1283, SEQ ID NOs:1285-1290, SEQ ID NO:1292, SEQ ID NO:1294, SEQ ID NO:1296, SEQ ID NO:1298, SEQ ID NO:1300, SEQ ID NOs:1302-1309, SEQ ID NO:1311, SEQ ID NO:1313, SEQ ID NO:1315, SEQ ID NO:1317, SEQ ID NO:1319, SEQ ID NO:1321, SEQ ID NO:1323, SEQ ID NO:1325, SEQ ID NO:1327, SEQ ID NO:1329, SEQ ID NO:1331, SEQ ID NO:1333, SEQ ID NO:1335, SEQ ID NO:1337, SEQ ID NO:1339, SEQ ID NO:1341, SEQ ID NO:1343, SEQ ID NO:1345, SEQ ID NO:1347, SEQ ID NO:1349, SEQ ID NO:1351, SEQ ID NO:1353, SEQ ID NO:1355, SEQ ID NO:1357, SEQ ID NO:1359, SEQ ID NOs:1361-1367, SEQ ID NO:1369, SEQ ID NO:1371, SEQ ID NO:1373, SEQ ID NO:1375, SEQ ID NO:1377, SEQ ID NO:1379, SEQ ID NO:1381, SEQ ID NO:1383, SEQ ID NO:1385, SEQ ID NO:1387, SEQ ID NO:1389, SEQ ID NO:1391, SEQ ID NO:1393, SEQ ID NO:1395, SEQ ID NO:1397, SEQ ID NO:1399, SEQ ID NO:1401, SEQ ID NO:1403, SEQ ID NOs:1405-1410, SEQ ID NO:1412, SEQ ID NOs:1414-1415, SEQ ID NO:1417, SEQ ID NO:1419, SEQ ID NO:1421, SEQ ID NOs:1423-1429, SEQ ID NO:1431, SEQ ID NO:1433, SEQ ID NOs:1436-1442, SEQ ID NOs:1444-1463, SEQ ID NO:1465, SEQ ID NO:1467, SEQ ID NO:1469, SEQ ID NO:1471, SEQ ID NO:1473, SEQ ID NO:1475, SEQ ID NO:1477, SEQ ID NO:1479, SEQ ID NO:1481, SEQ ID NO:1483, SEQ ID NO:1485, SEQ ID NOs:1487-1491, SEQ ID NOs:1493-1500, SEQ ID NO:1502, SEQ ID NOs:1504-1516, SEQ ID NO:1518, SEQ ID NO:1520, SEQ ID NO:1522, SEQ ID NO:1524, SEQ ID NO:1526, SEQ ID NOs:1528-1534, SEQ ID NO:1536, SEQ ID NO:1538, SEQ ID NO:1540, SEQ ID NO:1542, SEQ ID NO:1544, SEQ ID NO:1546, SEQ ID NO:1548, SEQ ID NO:1550, SEQ ID NO:1552, SEQ ID NO:1554, SEQ ID NO:1556, SEQ ID NO:1558, SEQ ID NO:1560, SEQ ID NO:1562, SEQ ID NO:1564, SEQ ID NO:1566, SEQ ID NO:1568, SEQ ID NOs:1570-1571, SEQ ID NO:1573, SEQ ID NO:1575, SEQ ID NO:1577, SEQ ID NO:1579, SEQ ID NO:1581, SEQ ID NO:1583, SEQ ID NO:1585, SEQ ID NO:1587, SEQ ID NO:1589, SEQ ID NO:1591, SEQ ID NO:1593, SEQ ID NOs:1595-1608, SEQ ID NO:1610, SEQ ID NO:1612, SEQ ID NO:1614, SEQ ID NO:1616, SEQ ID NO:1618, SEQ ID NOs:1620-1622, SEQ ID NO:1624, SEQ ID NO:1626, SEQ ID NO:1628, SEQ ID NO:1630, SEQ ID NOs:1632-1635, SEQ ID NOs:1637-1651, SEQ ID NOs:1653-1655, SEQ ID NO:1657, SEQ ID NO:1659, SEQ ID NO:1661, SEQ ID NO:1663, SEQ ID NO:1665, SEQ ID NO:1667, SEQ ID NO:1669, SEQ ID NO:1671, SEQ ID NO:1673, SEQ ID NOs:1675-1679, SEQ ID NO:1681, SEQ ID NOs:1683-1690, SEQ ID NO:1692, SEQ ID NO:1694, SEQ ID NO:1696, SEQ ID NO:1698, SEQ ID NO:1700, SEQ ID NO:1702, SEQ ID NO:1704, SEQ ID NO:1706, SEQ ID NO:1708, SEQ ID NO:1710; SEQ ID NO:1712, SEQ ID NO:1714, SEQ ID NO:1716, SEQ ID NO:1718, SEQ ID NO:1720, SEQ ID NO:1722, SEQ ID NO:1724, SEQ ID NO:1726, SEQ ID NOs:1728-1731, SEQ ID NO:1733, SEQ ID NOs:1735-1747, SEQ ID NOs:1749-1750, SEQ ID NOs:1752-1765, SEQ ID NOs:1767-1775, SEQ ID NO:1777, SEQ ID NO:1779, SEQ ID NO:1781, SEQ ID NO:1783, SEQ ID NOs:1785-1804, SEQ ID NOs:1806-1820, SEQ ID NO:1822, SEQ ID NO:1824, SEQ ID NO:1826, SEQ ID NO:1828, SEQ ID NO:1830, SEQ ID NO:1832, SEQ ID NO:1834, SEQ ID NO:1836, SEQ ID NO:1838, SEQ ID NO:1840, SEQ ID NO:1842, SEQ ID NO:1844, SEQ ID NO:1846, SEQ ID NO:1848, SEQ ID NO:1850, SEQ ID NO:1852, SEQ ID NO:1854, SEQ ID NO:1856, SEQ ID NO:1858, SEQ ID NO:1860, SEQ ID NO:1862, SEQ ID NO:1864, SEQ ID NO:1866, SEQ ID NO:1868, SEQ ID NO:1870, SEQ ID NO:1872, SEQ ID NO:1874, SEQ ID NO:1876, SEQ ID NO:1878, SEQ ID NO:1880, SEQ ID NO:1882, SEQ ID NO:1884, SEQ ID NO:1886, SEQ ID NO:1888, SEQ ID NO:1890, SEQ ID NOs:1892-1895, SEQ ID NO:1897, SEQ ID NO:1899, SEQ ID NOs:1901-1902, SEQ ID NO:1904, SEQ ID NO:1906, SEQ ID NO:1908, SEQ ID NOs:1921-2059, SEQ ID NO:2061, SEQ ID NO:2063, SEQ ID NOs:2065-2083, SEQ ID NO:2085, SEQ ID NO:2087, SEQ ID NO:2089, SEQ ID NO:2091, SEQ ID NO:2093, SEQ ID NO:2095, SEQ ID NO:2097, SEQ ID NO:2099, SEQ ID NO:2101, SEQ ID NO:2103, SEQ ID NO:2105, SEQ ID NO:2107, SEQ ID NO:2109, SEQ ID NO:2111, SEQ ID NO:2113, SEQ ID NO:2115, SEQ ID NO:2117, SEQ ID NO:2119, SEQ ID NO:2121, SEQ ID NO:2123, SEQ ID NO:2125, SEQ ID NO:2127, SEQ ID NO:2129, SEQ ID NO:2131, SEQ ID NO:2133, SEQ ID NO:2135, SEQ ID NO:2137, SEQ ID NO:2139, SEQ ID NO:2141, SEQ ID NO:2143, SEQ ID NO:2145, SEQ ID NO:2147, SEQ ID NO:2149, SEQ ID NO:2151, SEQ ID NO:2153, SEQ ID NO:2155, SEQ ID NO:2157, SEQ ID NO:2159, SEQ ID NO:2161, SEQ ID NO:2162, SEQ ID NO:2164, SEQ ID NO:2166, SEQ ID NO:6168, SEQ ID NO:2170, SEQ ID NO:2172, SEQ ID NO:2174, SEQ ID NO:2176, SEQ ID NO:2178, SEQ ID NO:2180, SEQ ID NO:2182, SEQ ID NO:2184, SEQ ID NO:2186, SEQ ID NO:2188, SEQ ID NO:2190, SEQ ID NO:2192, SEQ ID NO:2194, SEQ ID NO:2196, SEQ ID NO:2198, SEQ ID NO:2200, SEQ ID NO:2202, SEQ ID NO:2204, SEQ ID NO:2206, SEQ ID NO:2208, SEQ ID NO:2210, SEQ ID NO:2212, SEQ ID NO:2214, SEQ ID NO:2216, SEQ ID NO:2218, SEQ ID NO:2220, SEQ ID NO:2222, SEQ ID NO:2224, SEQ ID NO:2226, SEQ ID NO:2228, SEQ ID NO:2230, SEQ ID NO:2232, SEQ ID NO:2234, SEQ ID NO:2236, SEQ ID NO:2238, SEQ ID NO:2240, SEQ ID NO:2242, SEQ ID NO:2244, SEQ ID NO:2246, SEQ ID NO:2248, SEQ ID NO:2250, SEQ ID NO:2252, SEQ ID NO:2254, SEQ ID NO:2256, SEQ ID NO:2258, SEQ ID NO:2260, SEQ ID NO:2262, SEQ ID NO:2264, SEQ ID NO:2266, SEQ ID NO:2268, SEQ ID NO:2270, SEQ ID NO:2272, SEQ ID NO:2274, SEQ ID NO:2276, SEQ ID NO:2278, SEQ ID NO:2280, SEQ ID NO:2282, SEQ ID NO:2284, SEQ ID NO:2286, SEQ ID NO:2288, SEQ ID NO:2290, SEQ ID NO:2292, SEQ ID NO:2294, SEQ ID NO:2296, SEQ ID NO:2298, SEQ ID NO:2300, SEQ ID NO:2302, SEQ ID NO:2304, SEQ ID NO:2306, SEQ ID NO:2308, SEQ ID NO:2310, SEQ ID NO:2312, SEQ ID NO:2314, SEQ ID NO:2316, SEQ ID NO:2318, SEQ ID NO:2320, SEQ ID NO:2322, SEQ ID NO:2324, SEQ ID NO:2326, SEQ ID NO:2328, SEQ ID NO:2330, SEQ ID NO:2332, SEQ ID NO:2334, SEQ ID NO:2336, SEQ ID NO:2338, SEQ ID NO:2340, SEQ ID NO:2342, SEQ ID NO:2344, SEQ ID NO:2346, and SEQ ID NO:2348; where a tissue of a plant produced from the plant cell has a difference in lignin content as compared to the corresponding lignin content in tissue of a control plant that does not comprise the nucleic acid.

The exogenous nucleic acid can further comprise a 3' UTR operably linked to the polynucleotide. The polynucleotide can be transcribed into an interfering RNA comprising a stem-loop structure. The stem-loop structure can comprise an inverted repeat of the 3' UTR. The difference can be a decreased lignin content.

In another aspect, an isolated nucleic acid molecule is provided. The isolated nucleic acid molecule comprises a nucleotide sequence having 95% or greater sequence identity to the nucleotide sequence set forth in SEQ ID NO:97, SEQ ID NO:101, SEQ ID NO:107, SEQ ID NO:109, SEQ ID NO:113, SEQ ID NO:123, SEQ ID NO:125, SEQ ID NO:129, SEQ ID NO:138, SEQ ID NO:140, SEQ ID NO:142, SEQ ID NO:144, SEQ ID NO:150, SEQ ID NO:195, SEQ ID NO:197, SEQ ID NO:216, SEQ ID NO:218, SEQ ID NO:252, SEQ ID NO:254, SEQ ID NO:257, SEQ ID NO:259, SEQ ID NO:261, SEQ ID NO:266, SEQ ID NO:268, SEQ ID NO:271, SEQ ID NO:274, SEQ ID NO:278, SEQ ID NO:281, SEQ ID NO:283, SEQ ID NO:285, SEQ ID NO:288, SEQ ID NO:291, SEQ ID NO:293, SEQ ID NO:299, SEQ ID NO:301, SEQ ID NO:303, SEQ ID NO:305, SEQ ID NO:307, SEQ ID NO:314, SEQ ID NO:317, SEQ ID NO:320, SEQ ID NO:322, SEQ ID NO:324, SEQ ID NO:327, 329, SEQ ID NO:331, SEQ ID NO:333, SEQ ID NO:342, SEQ ID NO:344, SEQ ID NO:346, SEQ ID NO:352, SEQ ID NO:376, SEQ ID NO:386, SEQ ID NO:390, SEQ ID NO:393, SEQ ID NO:399, SEQ ID NO:401, SEQ ID NO:439, SEQ ID NO:441, SEQ ID NO:448, SEQ ID NO:450, SEQ ID NO:453, SEQ ID NO:458, SEQ ID NO:469, SEQ ID NO:472, SEQ ID NO:474, SEQ ID NO:477, SEQ ID NO:482, SEQ ID NO:486, SEQ ID NO:491, SEQ ID NO:493, SEQ ID NO:495, SEQ ID NO:500, SEQ ID NO:507, SEQ ID NO:509, SEQ ID NO:515, SEQ ID NO:534, SEQ ID NO:536, SEQ ID NO:538, SEQ ID NO:540, SEQ ID NO:542, SEQ ID NO:544, SEQ ID NO:552, SEQ ID NO:562, SEQ ID NO:569, SEQ ID NO:571, SEQ ID NO:573, SEQ ID NO:577, SEQ ID NO:580, SEQ ID NO:592, SEQ ID NO:595, SEQ ID NO:602, SEQ ID NO:618, SEQ ID NO:620, SEQ ID NO:649, SEQ ID NO:655, SEQ ID NO:658, SEQ ID NO:664, SEQ ID NO:674, SEQ ID NO:681, SEQ ID NO:683, SEQ ID NO:699, SEQ ID NO:704, SEQ ID NO:708, SEQ ID NO:712, SEQ ID NO:714, SEQ ID NO:717, SEQ ID NO:719, SEQ ID NO:721, SEQ ID NO:723, SEQ ID NO:746, SEQ ID NO:752, SEQ ID NO:754, SEQ ID NO:764, SEQ ID NO:785, SEQ ID NO:789, SEQ ID NO:795, SEQ ID NO:797, SEQ ID NO:799, SEQ ID NO:801, SEQ ID NO:810, SEQ ID NO:819, SEQ ID NO:821, SEQ ID NO:823, SEQ ID NO:827, SEQ ID NO:829, SEQ ID NO:840, SEQ ID NO:842, SEQ ID NO:848, SEQ ID NO:854, SEQ ID NO:858, SEQ ID NO:860, SEQ ID NO:867, SEQ ID NO:889, SEQ ID NO:891, SEQ ID NO:893, SEQ ID NO:895, SEQ ID NO:903, SEQ ID NO:906, SEQ ID NO:911, SEQ ID NO:916, SEQ ID NO:918, SEQ ID NO:920, SEQ ID NO:926, SEQ ID NO:928, SEQ ID NO:942, SEQ ID NO:944, SEQ ID NO:958, SEQ ID NO:965, SEQ ID NO:967, SEQ ID NO:972, SEQ ID NO:974, SEQ ID NO:981, SEQ ID NO:1006, SEQ ID NO:1010, SEQ ID NO:1015, SEQ ID NO:1027, SEQ ID NO:1030, SEQ ID NO:1034, SEQ ID NO:1054, SEQ ID NO:1067, SEQ ID NO:1070, SEQ ID NO:1077, SEQ ID NO:1084, SEQ ID NO:1086, SEQ ID NO:1090, SEQ ID NO:1093, SEQ ID NO:1097, SEQ ID NO:1108, SEQ ID NO:1116, SEQ ID NO:1121, SEQ ID NO:1124, SEQ ID NO:1138, SEQ ID NO:1142, SEQ ID NO:1148, SEQ ID NO:1155, SEQ ID NO:1158, SEQ ID NO:1160, SEQ ID NO:1170, SEQ ID NO:1172, SEQ ID NO:1175, SEQ ID NO:1208, SEQ ID NO:1212, SEQ ID NO:1214, SEQ ID NO:1216, SEQ ID NO:1218, SEQ ID NO:1220, SEQ ID NO:1222, SEQ ID NO:1224, SEQ ID NO:1236, SEQ ID NO:1240, SEQ ID NO:1242, SEQ ID NO:1244, SEQ ID NO:1246, SEQ ID NO:1250, SEQ ID NO:1252, SEQ ID NO:1254, SEQ ID NO:1256, SEQ ID NO:1260, SEQ ID NO:1262, SEQ ID NO:1264, SEQ ID NO:1268, SEQ ID NO:1270, SEQ ID NO:1272, SEQ ID NO:1274, SEQ ID NO:1276, SEQ ID NO:1278, SEQ ID NO:1280, SEQ ID NO:1282, SEQ ID NO:1291, SEQ ID NO:1295, SEQ ID NO:1297, SEQ ID NO:1299, SEQ ID NO:1310, SEQ ID NO:1312, SEQ ID NO:1316, SEQ ID NO:1318, SEQ ID NO:1320, SEQ ID NO:1324, SEQ ID NO:1326, SEQ ID NO:1328, SEQ ID NO:1330, SEQ ID NO:1334, SEQ ID NO:1336, SEQ ID NO:1338, SEQ ID NO:1340, SEQ ID NO:1342, SEQ ID NO:1346, SEQ ID NO:1348, SEQ ID NO:1350, SEQ ID NO:1352, SEQ ID NO:1354, SEQ ID NO:1356, SEQ ID NO:1358, SEQ ID NO:1368, SEQ ID NO:1372, SEQ ID NO:1374, SEQ ID NO:1378, SEQ ID NO:1380, SEQ ID NO:1384, SEQ ID NO:1386, SEQ ID NO:1388, SEQ ID NO:1390, SEQ ID NO:1396, SEQ ID NO:1398, SEQ ID NO:1400, SEQ ID NO:1402, SEQ ID NO:1411, SEQ ID NO:1416, SEQ ID NO:1418, SEQ ID NO:1430, SEQ ID NO:1432, SEQ ID NO:1466, SEQ ID NO:1470, SEQ ID NO:1476, SEQ ID NO:1478, SEQ ID NO:1482, SEQ ID NO:1484, SEQ ID NO:1486, SEQ ID NO:1501, SEQ ID NO:1519, SEQ ID NO:1521, SEQ ID NO:1523, SEQ ID NO:1527, SEQ ID NO:1535, SEQ ID NO:1537, SEQ ID NO:1541, SEQ ID NO:1543, SEQ ID NO:1545, SEQ ID NO:1547, SEQ ID NO:1549, SEQ ID NO:1553, SEQ ID NO:1555, SEQ ID NO:1557, SEQ ID NO:1559, SEQ ID NO:1561, SEQ ID NO:1565, SEQ ID NO:1567, SEQ ID NO:1574, SEQ ID NO:1576, SEQ ID NO:1578, SEQ ID NO:1582, SEQ ID NO:1586, SEQ ID NO:1588, SEQ ID NO:1590, SEQ ID NO:1592, SEQ ID NO:1611, SEQ ID NO:1613, SEQ ID NO:1615, SEQ ID NO:1617, SEQ ID NO:1623, SEQ ID NO:1625, SEQ ID NO:1629, SEQ ID NO:1631, SEQ ID NO:1656, SEQ ID NO:1658, SEQ ID NO:1662, SEQ ID NO:1664, SEQ ID NO:1666, SEQ ID NO:1668, SEQ ID NO:1670, SEQ ID NO:1672, SEQ ID NO:1682, SEQ ID NO:1693, SEQ ID NO:1695, SEQ ID NO:1699, SEQ ID NO:1701, SEQ ID NO:1703, SEQ ID NO:1705, SEQ ID NO:1707, SEQ ID NO:1709, SEQ ID NO:1711, SEQ ID NO:1713, SEQ ID NO:1715, SEQ ID NO:1717, SEQ ID NO:1719, SEQ ID NO:1723, SEQ ID NO:1725, SEQ ID NO:1732, SEQ ID NO:1748, SEQ ID NO:1776, SEQ ID NO:1780, SEQ ID NO:1782, SEQ ID NO:1833, SEQ ID NO:1855, SEQ ID NO:1891, SEQ ID NO:1898, SEQ ID NO:1900, SEQ ID NO:1907, SEQ ID NO:2060, SEQ ID NO:2062, SEQ ID NO:2064, SEQ ID NO:2088, SEQ ID NO:2090, SEQ ID NO:2092, SEQ ID NO:2094, SEQ ID NO:2096, SEQ ID NO:2098, SEQ ID NO:2100, SEQ ID NO:2102, SEQ ID NO:2104, SEQ ID NO:2106, SEQ ID NO:2108, SEQ ID NO:2110, SEQ ID NO:2112, SEQ ID NO:2114, SEQ ID NO:2116, SEQ ID NO:2118, SEQ ID NO:2120, SEQ ID NO:2122, SEQ ID NO:2124, SEQ ID NO:2126, SEQ ID NO:2128, SEQ ID NO:2130, SEQ ID NO:2132, SEQ ID NO:2134, SEQ ID NO:2136, SEQ ID NO:2138, SEQ ID NO:2140, SEQ ID NO:2142, SEQ ID NO:2144, SEQ ID NO:2146, SEQ ID NO:2148, SEQ ID NO:2150, SEQ ID NO:2152, SEQ ID NO:2154, SEQ ID NO:2156, SEQ ID NO:2158, SEQ ID NO:2160, SEQ ID NO:2161, SEQ ID NO:2163, SEQ ID NO:2165, SEQ ID NO:6167, SEQ ID NO:2169, SEQ ID NO:2171, SEQ ID NO:2173, SEQ ID NO:2175, SEQ ID NO:2177, SEQ ID NO:2179, SEQ ID NO:2181, SEQ ID NO:2183, SEQ ID NO:2185, SEQ ID NO:2187, SEQ ID NO:2189, SEQ ID NO:2191, SEQ ID NO:2193, SEQ ID NO:2195, SEQ ID NO:2197, SEQ ID NO:2199, SEQ ID NO:2201, SEQ ID NO:2203, SEQ ID NO:2205, SEQ ID NO:2207, SEQ ID NO:2209, SEQ ID NO:2211, SEQ ID NO:2213, SEQ ID NO:2215, SEQ ID NO:2217, SEQ ID NO:2219, SEQ ID NO:2221, SEQ ID NO:2223, SEQ ID NO:2225, SEQ ID NO:2227, SEQ ID NO:2229, SEQ ID NO:2231, SEQ ID NO:2233, SEQ ID NO:2235, SEQ ID NO:2237, SEQ ID NO:2239, SEQ ID NO:2241, SEQ ID NO:2243, SEQ ID NO:2245, SEQ ID NO:2247, SEQ ID NO:2249, SEQ ID NO:2251, SEQ ID NO:2253, SEQ ID NO:2255, SEQ ID NO:2257, SEQ ID NO:2259, SEQ ID NO:2261, SEQ ID NO:2263, SEQ ID NO:2265, SEQ ID NO:2267, SEQ ID NO:2269, SEQ ID NO:2271, SEQ ID NO:2273, SEQ ID NO:2275, SEQ ID NO:2277, SEQ ID NO:2279, SEQ ID NO:2281, SEQ ID NO:2283, SEQ ID NO:2285, SEQ ID NO:2287, SEQ ID NO:2289, SEQ ID NO:2291, SEQ ID NO:2293, SEQ ID NO:2295, SEQ ID NO:2297, SEQ ID NO:2299, SEQ ID NO:2301, SEQ ID NO:2303, SEQ ID NO:2305, SEQ ID NO:2307, SEQ ID NO:2309, SEQ ID NO:2311, SEQ ID NO:2313, SEQ ID NO:2315, SEQ ID NO:2317, SEQ ID NO:2319, SEQ ID NO:2321, SEQ ID NO:2323, SEQ ID NO:2325, SEQ ID NO:2327, SEQ ID NO:2329, SEQ ID NO:2331, SEQ ID NO:2333, SEQ ID NO:2335, SEQ ID NO:2337, SEQ ID NO:2339, SEQ ID NO:2341, SEQ ID NO:2343, SEQ ID NO:2345, SEQ ID NO:2347, or SEQ ID NO:2690.

In another aspect, an isolated nucleic acid is provided. The isolated nucleic acid comprises a nucleotide sequence encoding a polypeptide having 80% or greater sequence identity to the amino acid sequence set forth in SEQ ID NO:98, SEQ ID NO:102, SEQ ID NO:108, SEQ ID NO:10, SEQ ID NO:114, SEQ ID NO:124, SEQ ID NO:126, SEQ ID NO:130, SEQ ID NO:139, SEQ ID NO:141, SEQ ID NO:143, SEQ ID NO:145, SEQ ID NO:151, SEQ ID NO:196, SEQ ID NO:198, SEQ ID NO:217, SEQ ID NO:219, SEQ ID NO:253, SEQ ID NO:255, SEQ ID NO:258, SEQ ID NO:260, SEQ ID NO:262, SEQ ID NO:267, SEQ ID NO:269, SEQ ID NO:272, SEQ ID NO:275, SEQ ID NO:279, SEQ ID NO:282, SEQ ID NO:284, SEQ ID NO:286, SEQ ID NO:289, SEQ ID NO:292, SEQ ID NO:294, SEQ ID NO:300, SEQ ID NO:302, SEQ ID NO:304, SEQ ID NO:306, SEQ ID NO:308, SEQ ID NO:315, SEQ ID NO:318, SEQ ID NO:321, SEQ ID NO:323, SEQ ID NO:325, SEQ ID NO:328, SEQ ID NO:330, SEQ ID NO:332, SEQ ID NO:334, SEQ ID NO:343, SEQ ID NO:345, SEQ ID NO:347, SEQ ID NO:353, SEQ ID NO:377, SEQ ID NO:387, SEQ ID NO:391, SEQ ID NO:394, SEQ ID NO:400, SEQ ID NO:402, SEQ ID NO:440, SEQ ID NO:442, SEQ ID NO:449, SEQ ID NO:451, SEQ ID NO:454, SEQ ID NO:459, SEQ ID NO:470, SEQ ID NO:473, SEQ ID NO:475, SEQ ID NO:478, SEQ ID NO:483, SEQ ID NO:487, SEQ ID NO:492, SEQ ID NO:494, SEQ ID NO:496, SEQ ID NO:501, SEQ ID NO:508, SEQ ID NO:510, SEQ ID NO:516, SEQ ID NO:535, SEQ ID NO:537, SEQ ID NO:539, SEQ ID NO:541, SEQ ID NO:543, SEQ ID NO:545, SEQ ID NO:553, SEQ ID NO:563, SEQ ID NO:570, SEQ ID NO:572, SEQ ID NO:574, SEQ ID NO:578, SEQ ID NO:581, SEQ ID NO:593, SEQ ID NO:596, SEQ ID NO:603, SEQ ID NO:619, SEQ ID NO:621, SEQ ID NO:650, SEQ ID NO:656, SEQ ID NO:659, SEQ ID NO:665, SEQ ID NO:675, SEQ ID NO:682, SEQ ID NO:684, SEQ ID NO:700, SEQ ID NO:705, SEQ ID NO:709, SEQ ID NO:713, SEQ ID NO:715, SEQ ID NO:718, SEQ ID NO:720, SEQ ID NO:722, SEQ ID NO:724, SEQ ID NO:747, SEQ ID NO:753, SEQ ID NO:755, SEQ ID NO:765, SEQ ID NO:786, SEQ ID NO:780, SEQ ID NO:796, SEQ ID NO:798, SEQ ID NO:800, SEQ ID NO:802, SEQ ID NO:811, SEQ ID NO:820, SEQ ID NO:822, SEQ ID NO:824, SEQ ID NO:828, SEQ ID NO:830, SEQ ID NO:841, SEQ ID NO:843, SEQ ID NO:849, SEQ ID NO:855, SEQ ID NO:859, SEQ ID NO:861, SEQ ID NO:868, SEQ ID NO:890, SEQ ID NO:892, SEQ ID NO:894, SEQ ID NO:896, SEQ ID NO:904, SEQ ID NO:907, SEQ ID NO:912, SEQ ID NO:917, SEQ ID NO:919, SEQ ID NO:921, SEQ ID NO:927, SEQ ID NO:929, SEQ ID NO:943, SEQ ID NO:945, SEQ ID NO:959, SEQ ID NO:966, SEQ ID NO:968, SEQ ID NO:973, SEQ ID NO:975, SEQ ID NO:982, SEQ ID NO:1007, SEQ ID NO:1011, SEQ ID NO:1016, SEQ ID NO:1028, SEQ ID NO:1031, SEQ ID NO:1035, SEQ ID NO:1055, SEQ ID NO:1068, SEQ ID NO:1071, SEQ ID NO:1078, SEQ ID NO:1085, SEQ ID NO:1087, SEQ ID NO:1091, SEQ ID NO:1094, SEQ ID NO:1098, SEQ ID NO:1109, SEQ ID NO:1117, SEQ ID NO:1122, SEQ ID NO:1125, SEQ ID NO:1139, SEQ ID NO:1143, SEQ ID NO:1149, SEQ ID NO:1156, SEQ ID NO:1159, SEQ ID NO:1161, SEQ ID NO:1171, SEQ ID NO:1173, SEQ ID NO:1176, SEQ ID NO:1209, SEQ ID NO:1213, SEQ ID NO:1215, SEQ ID NO:1217, SEQ ID NO:1219, SEQ ID NO:1221, SEQ ID NO:1223, SEQ ID NO:1225, SEQ ID NO:1237, SEQ ID NO:1241, SEQ ID NO:1243, SEQ ID NO:1245, SEQ ID NO:1247, SEQ ID NO:1251, SEQ ID NO:1253, SEQ ID NO:1255, SEQ ID NO:1257, SEQ ID NO:1261, SEQ ID NO:1263, SEQ ID NO:1265, SEQ ID NO:1269, SEQ ID NO:1271, SEQ ID NO:1273, SEQ ID NO:1275, SEQ ID NO:1277, SEQ ID NO:1279, SEQ ID NO:1281, SEQ ID NO:1283, SEQ ID NO:1292, SEQ ID NO:1296, SEQ ID NO:1298, SEQ ID NO:1300, SEQ ID NO:1311, SEQ ID NO:1313, SEQ ID NO:1317, SEQ ID NO:1319, SEQ ID NO:1321, SEQ ID NO:1325, SEQ ID NO:1327, SEQ ID NO:1329, SEQ ID NO:1331, SEQ ID NO:1335, SEQ ID NO:1337, SEQ ID NO:1339, SEQ ID NO:1341, SEQ ID NO:1343, SEQ ID NO:1347, SEQ ID NO:1349, SEQ ID NO:1351, SEQ ID NO:1353, SEQ ID NO:1355, SEQ ID NO:1357, SEQ ID NO:1359, SEQ ID NO:1369, SEQ ID NO:1373, SEQ ID NO:1375, SEQ ID NO:1379, SEQ ID NO:1381, SEQ ID NO:1385, SEQ ID NO:1387, SEQ ID NO:1389, SEQ ID NO:1391, SEQ ID NO:1397, SEQ ID NO:1399, SEQ ID NO:1401, SEQ ID NO:1403, SEQ ID NO:1412, SEQ ID NO:1417, SEQ ID NO:1419, SEQ ID NO:1431, SEQ ID NO:1433, SEQ ID NO:1467, SEQ ID NO:1471, SEQ ID NO:1477, SEQ ID NO:1479, SEQ ID NO:1483, SEQ ID NO:1485, SEQ ID NO:1487, SEQ ID NO:1502, SEQ ID NO:1520, SEQ ID NO:1522, SEQ ID NO:1524, SEQ ID NO:1528, SEQ ID NO:1536, SEQ ID NO:1538, SEQ ID NO:1542, SEQ ID NO:1544, SEQ ID NO:1546, SEQ ID NO:1548, SEQ ID NO:1550, SEQ ID NO:1554, SEQ ID NO:1556, SEQ ID NO:1558, SEQ ID NO:1560, SEQ ID NO:1562, SEQ ID NO:1566, SEQ ID NO:1568, SEQ ID NO:1575, SEQ ID NO:1577, SEQ ID NO:1579, SEQ ID NO:1583, SEQ ID NO:1587, SEQ ID NO:1589, SEQ ID NO:1591, SEQ ID NO:1593, SEQ ID NO:1612, SEQ ID NO:1614, SEQ ID NO:1616, SEQ ID NO:1618, SEQ ID NO:1624, SEQ ID NO:1626, SEQ ID NO:1630, SEQ ID NO:1632, SEQ ID NO:1657, SEQ ID NO:1659, SEQ ID NO:1663, SEQ ID NO:1665, SEQ ID NO:1667, SEQ ID NO:1669, SEQ ID NO:1671, SEQ ID NO:1673, SEQ ID NO:1683, SEQ ID NO:1694, SEQ ID NO:1696, SEQ ID NO:1700, SEQ ID NO:1702, SEQ ID NO:1704, SEQ ID NO:1706, SEQ ID NO:1708, SEQ ID NO:1710, SEQ ID NO:1712, SEQ ID NO:1714, SEQ ID NO:1716, SEQ ID NO:1718, SEQ ID NO:1720, SEQ ID NO:1724, SEQ ID NO:1726, SEQ ID NO:1733, SEQ ID NO:1749, SEQ ID NO:1777, SEQ ID NO:1781, SEQ ID NO:1783, SEQ ID NO:1834, SEQ ID NO:1856, SEQ ID NO:1892, SEQ ID NO:1899, SEQ ID NO:1901, SEQ ID NO:1908, SEQ ID NO:2061, SEQ ID NO:2063, SEQ ID NO:2065, SEQ ID NO:2089, SEQ ID NO:2091, SEQ ID NO:2093, SEQ ID NO:2095, SEQ ID NO:2097, SEQ ID NO:2099, SEQ ID NO:2101, SEQ ID NO:2103, SEQ ID NO:2105, SEQ ID NO:2107, SEQ ID NO:2109, SEQ ID NO:2111, SEQ ID NO:2113, SEQ ID NO:2115, SEQ ID NO:2117, SEQ ID NO:2119, SEQ ID NO:2121, SEQ ID NO:2123, SEQ ID NO:2125, SEQ ID NO:2127, SEQ ID NO:2129, SEQ ID NO:2131, SEQ ID NO:2133, SEQ ID NO:2135, SEQ ID NO:2137, SEQ ID NO:2139, SEQ ID NO:2141, SEQ ID NO:2143, SEQ ID NO:2145, SEQ ID NO:2147, SEQ ID NO:2149, SEQ ID NO:2151, SEQ ID NO:2153, SEQ ID NO:2155, SEQ ID NO:2157, SEQ ID NO:2159, SEQ ID NO:2161, SEQ ID NO:2162, SEQ ID NO:2164, SEQ ID NO:2166, SEQ ID NO:6168, SEQ ID NO:2170, SEQ ID NO:2172, SEQ ID NO:2174, SEQ ID NO:2176, SEQ ID NO:2178, SEQ ID NO:2180, SEQ ID NO:2182, SEQ ID NO:2184, SEQ ID NO:2186, SEQ ID NO:2188, SEQ ID NO:2190, SEQ ID NO:2192, SEQ ID NO:2194, SEQ ID NO:2196, SEQ ID NO:2198, SEQ ID NO:2200, SEQ ID NO:2202, SEQ ID NO:2204, SEQ ID NO:2206, SEQ ID NO:2208, SEQ ID NO:2210, SEQ ID NO:2212, SEQ ID NO:2214, SEQ ID NO:2216, SEQ ID NO:2218, SEQ ID NO:2220, SEQ ID NO:2222, SEQ ID NO:2224, SEQ ID NO:2226, SEQ ID NO:2228, SEQ ID NO:2230, SEQ ID NO:2232, SEQ ID NO:2234, SEQ ID NO:2236, SEQ ID NO:2238, SEQ ID NO:2240, SEQ ID NO:2242, SEQ ID NO:2244, SEQ ID NO:2246, SEQ ID NO:2248, SEQ ID NO:2250, SEQ ID NO:2252, SEQ ID NO:2254, SEQ ID NO:2256, SEQ ID NO:2258, SEQ ID NO:2260, SEQ ID NO:2262, SEQ ID NO:2264, SEQ ID NO:2266, SEQ ID NO:2268, SEQ ID NO:2270, SEQ ID NO:2272, SEQ ID NO:2274, SEQ ID NO:2276, SEQ ID NO:2278, SEQ ID NO:2280, SEQ ID NO:2282, SEQ ID NO:2284, SEQ ID NO:2286, SEQ ID NO:2288, SEQ ID NO:2290, SEQ ID NO:2292, SEQ ID NO:2294, SEQ ID NO:2296, SEQ ID NO:2298, SEQ ID NO:2300, SEQ ID NO:2302, SEQ ID NO:2304, SEQ ID NO:2306, SEQ ID NO:2308, SEQ ID NO:2310, SEQ ID NO:2312, SEQ ID NO:2314, SEQ ID NO:2316, SEQ ID NO:2318, SEQ ID NO:2320, SEQ ID NO:2322, SEQ ID NO:2324, SEQ ID NO:2326, SEQ ID NO:2328, SEQ ID NO:2330, SEQ ID NO:2332, SEQ ID NO:2334, SEQ ID NO:2336, SEQ ID NO:2338, SEQ ID NO:2340, SEQ ID NO:2342, SEQ ID NO:2344, SEQ ID NO:2346, SEQ ID NO:2348, or SEQ ID NO:1747.

In another aspect, an isolated nucleic acid is provided. The isolated nucleic acid comprises a nucleotide sequence having 95% or greater sequence identity to the nucleic acid sequence set forth in SEQ ID NO:97, SEQ ID NO:101, SEQ ID NO:107, SEQ ID NO:109, SEQ ID NO:113, SEQ ID NO:123, SEQ ID NO:125, SEQ ID NO:129, SEQ ID NO:138, SEQ ID NO:140, SEQ ID NO:142, SEQ ID NO:144, SEQ ID NO:150, SEQ ID NO:195, SEQ ID NO:197, SEQ ID NO:216, SEQ ID NO:218, SEQ ID NO:252, SEQ ID NO:254, SEQ ID NO:257, SEQ ID NO:259, SEQ ID NO:261, SEQ ID NO:266, SEQ ID NO:268, SEQ ID NO:271, SEQ ID NO:274, SEQ ID NO:278, SEQ ID NO:281, SEQ ID NO:283, SEQ ID NO:285, SEQ ID NO:288, SEQ ID NO:291, SEQ ID NO:293, SEQ ID NO:299, SEQ ID NO:301, SEQ ID NO:303, SEQ ID NO:305, SEQ ID NO:307, SEQ ID NO:314, SEQ ID NO:317, SEQ ID NO:320, SEQ ID NO:322, SEQ ID NO:324, SEQ ID NO:327, 329, SEQ ID NO:331, SEQ ID NO:333, SEQ ID NO:342, SEQ ID NO:344, SEQ ID NO:346, SEQ ID NO:352, SEQ ID NO:376, SEQ ID NO:386, SEQ ID NO:390, SEQ ID NO:393, SEQ ID NO:399, SEQ ID NO:401, SEQ ID
NO:439, SEQ ID NO:441, SEQ ID NO:448, SEQ ID
NO:450, SEQ ID NO:453, SEQ ID NO:458, SEQ ID
NO:469, SEQ ID NO:472, SEQ ID NO:474, SEQ ID
NO:477, SEQ ID NO:482, SEQ ID NO:486, SEQ ID
NO:491, SEQ ID NO:493, SEQ ID NO:495, SEQ ID
NO:500, SEQ ID NO:507, SEQ ID NO:509, SEQ ID
NO:515, SEQ ID NO:534, SEQ ID NO:536, SEQ ID
NO:538, SEQ ID NO:540, SEQ ID NO:542, SEQ ID
NO:544, SEQ ID NO:552, SEQ ID NO:562, SEQ ID
NO:569, SEQ ID NO:571, SEQ ID NO:573, SEQ ID
NO:577, SEQ ID NO:580, SEQ ID NO:592, SEQ ID
NO:595, SEQ ID NO:602, SEQ ID NO:618, SEQ ID
NO:620, SEQ ID NO:649, SEQ ID NO:655, SEQ ID
NO:658, SEQ ID NO:664, SEQ ID NO:674, SEQ ID
NO:681, SEQ ID NO:683, SEQ ID NO:699, SEQ ID
NO:704, SEQ ID NO:708, SEQ ID NO:712, SEQ ID
NO:714, SEQ ID NO:717, SEQ ID NO:719, SEQ ID
NO:721, SEQ ID NO:723, SEQ ID NO:746, SEQ ID
NO:752, SEQ ID NO:754, SEQ ID NO:764, SEQ ID
NO:785, SEQ ID NO:789, SEQ ID NO:795, SEQ ID
NO:797, SEQ ID NO:799, SEQ ID NO:801, SEQ ID
NO:810, SEQ ID NO:819, SEQ ID NO:821, SEQ ID
NO:823, SEQ ID NO:827, SEQ ID NO:829, SEQ ID
NO:840, SEQ ID NO:842, SEQ ID NO:848, SEQ ID
NO:854, SEQ ID NO:858, SEQ ID NO:860, SEQ ID
NO:867, SEQ ID NO:889, SEQ ID NO:891, SEQ ID
NO:893, SEQ ID NO:895, SEQ ID NO:903, SEQ ID
NO:906, SEQ ID NO:911, SEQ ID NO:916, SEQ ID
NO:918, SEQ ID NO:920, SEQ ID NO:926, SEQ ID
NO:928, SEQ ID NO:942, SEQ ID NO:944, SEQ ID
NO:958, SEQ ID NO:965, SEQ ID NO:967, SEQ ID
NO:972, SEQ ID NO:974, SEQ ID NO:981, SEQ ID
NO:1006, SEQ ID NO:1010, SEQ ID NO:1015, SEQ ID
NO:1027, SEQ ID NO:1030, SEQ ID NO:1034, SEQ ID
NO:1054, SEQ ID NO:1067, SEQ ID NO:1070, SEQ ID
NO:1077, SEQ ID NO:1084, SEQ ID NO:1086, SEQ ID
NO:1090, SEQ ID NO:1093, SEQ ID NO:1097, SEQ ID
NO:1108, SEQ ID NO:1116, SEQ ID NO:1121, SEQ ID
NO:1124, SEQ ID NO:1138, SEQ ID NO:1142, SEQ ID
NO:1148, SEQ ID NO:1155, SEQ ID NO:1158, SEQ ID
NO:1160, SEQ ID NO:1170, SEQ ID NO:1172, SEQ ID
NO:1175, SEQ ID NO:1208, SEQ ID NO:1212, SEQ ID
NO:1214, SEQ ID NO:1216, SEQ ID NO:1218, SEQ ID
NO:1220, SEQ ID NO:1222, SEQ ID NO:1224, SEQ ID
NO:1236, SEQ ID NO:1240, SEQ ID NO:1242, SEQ ID
NO:1244, SEQ ID NO:1246, SEQ ID NO:1250, SEQ ID
NO:1252, SEQ ID NO:1254, SEQ ID NO:1256, SEQ ID
NO:1260, SEQ ID NO:1262, SEQ ID NO:1264, SEQ ID
NO:1268, SEQ ID NO:1270, SEQ ID NO:1272, SEQ ID
NO:1274, SEQ ID NO:1276, SEQ ID NO:1278, SEQ ID
NO:1280, SEQ ID NO:1282, SEQ ID NO:1291, SEQ ID
NO:1295, SEQ ID NO:1297, SEQ ID NO:1299, SEQ ID
NO:1310, SEQ ID NO:1312, SEQ ID NO:1316, SEQ ID
NO:1318, SEQ ID NO:1320, SEQ ID NO:1324, SEQ ID
NO:1326, SEQ ID NO:1328, SEQ ID NO:1330, SEQ ID
NO:1334, SEQ ID NO:1336, SEQ ID NO:1338, SEQ ID
NO:1340, SEQ ID NO:1342, SEQ ID NO:1346, SEQ ID
NO:1348, SEQ ID NO:1350, SEQ ID NO:1352, SEQ ID
NO:1354, SEQ ID NO:1356, SEQ ID NO:1358, SEQ ID
NO:1368, SEQ ID NO:1372, SEQ ID NO:1374, SEQ ID
NO:1378, SEQ ID NO:1380, SEQ ID NO:1384, SEQ ID
NO:1386, SEQ ID NO:1388, SEQ ID NO:1390, SEQ ID
NO:1396, SEQ ID NO:1398, SEQ ID NO:1400, SEQ ID
NO:1402, SEQ ID NO:1411, SEQ ID NO:1416, SEQ ID
NO:1418, SEQ ID NO:1430, SEQ ID NO:1432, SEQ ID
NO:1466, SEQ ID NO:1470, SEQ ID NO:1476, SEQ ID
NO:1478, SEQ ID NO:1482, SEQ ID NO:1484, SEQ ID
NO:1486, SEQ ID NO:1501, SEQ ID NO:1519, SEQ ID
NO:1521, SEQ ID NO:1523, SEQ ID NO:1527, SEQ ID
NO:1535, SEQ ID NO:1537, SEQ ID NO:1541, SEQ ID
NO:1543, SEQ ID NO:1545, SEQ ID NO:1547, SEQ ID
NO:1549, SEQ ID NO:1553, SEQ ID NO:1555, SEQ ID
NO:1557, SEQ ID NO:1559, SEQ ID NO:1561, SEQ ID
NO:1565, SEQ ID NO:1567, SEQ ID NO:1574, SEQ ID
NO:1576, SEQ ID NO:1578, SEQ ID NO:1582, SEQ ID
NO:1586, SEQ ID NO:1588, SEQ ID NO:1590, SEQ ID
NO:1592, SEQ ID NO:1611, SEQ ID NO:1613, SEQ ID
NO:1615, SEQ ID NO:1617, SEQ ID NO:1623, SEQ ID
NO:1625, SEQ ID NO:1629, SEQ ID NO:1631, SEQ ID
NO:1656, SEQ ID NO:1658, SEQ ID NO:1662, SEQ ID
NO:1664, SEQ ID NO:1666, SEQ ID NO:1668, SEQ ID
NO:1670, SEQ ID NO:1672, SEQ ID NO:1682, SEQ ID
NO:1693, SEQ ID NO:1695, SEQ ID NO:1699, SEQ ID
NO:1701, SEQ ID NO:1703, SEQ ID NO:1705, SEQ ID
NO:1707, SEQ ID NO:1709, SEQ ID NO:1711, SEQ ID
NO:1713, SEQ ID NO:1715, SEQ ID NO:1717, SEQ ID
NO:1719, SEQ ID NO:1723, SEQ ID NO:1725, SEQ ID
NO:1732, SEQ ID NO:1748, SEQ ID NO:1776, SEQ ID
NO:1780, SEQ ID NO:1782, SEQ ID NO:1833, SEQ ID
NO:1855, SEQ ID NO:1891, SEQ ID NO:1898, SEQ ID
NO:1900, SEQ ID NO:1907, SEQ ID NO:2060, SEQ ID
NO:2062, SEQ ID NO:2064, SEQ ID NO:2088, SEQ ID
NO:2090, SEQ ID NO:2092, SEQ ID NO:2094, SEQ ID
NO:2096, SEQ ID NO:2098, SEQ ID NO:2100, SEQ ID
NO:2102, SEQ ID NO:2104, SEQ ID NO:2106, SEQ ID
NO:2108, SEQ ID NO:2110, SEQ ID NO:2112, SEQ ID
NO:2114, SEQ ID NO:2116, SEQ ID NO:2118, SEQ ID
NO:2120, SEQ ID NO:2122, SEQ ID NO:2124, SEQ ID
NO:2126, SEQ ID NO:2128, SEQ ID NO:2130, SEQ ID
NO:2132, SEQ ID NO:2134, SEQ ID NO:2136, SEQ ID
NO:2138, SEQ ID NO:2140, SEQ ID NO:2142, SEQ ID
NO:2144, SEQ ID NO:2146, SEQ ID NO:2148, SEQ ID
NO:2150, SEQ ID NO:2152, SEQ ID NO:2154, SEQ ID
NO:2156, SEQ ID NO:2158, SEQ ID NO:2160, SEQ ID
NO:2161, SEQ ID NO:2163, SEQ ID NO:2165, SEQ ID
NO:6167, SEQ ID NO:2169, SEQ ID NO:2171, SEQ ID
NO:2173, SEQ ID NO:2175, SEQ ID NO:2177, SEQ ID
NO:2179, SEQ ID NO:2181, SEQ ID NO:2183, SEQ ID
NO:2185, SEQ ID NO:2187, SEQ ID NO:2189, SEQ ID
NO:2191, SEQ ID NO:2193, SEQ ID NO:2195, SEQ ID
NO:2197, SEQ ID NO:2199, SEQ ID NO:2201, SEQ ID
NO:2203, SEQ ID NO:2205, SEQ ID NO:2207, SEQ ID
NO:2209, SEQ ID NO:2211, SEQ ID NO:2213, SEQ ID
NO:2215, SEQ ID NO:2217, SEQ ID NO:2219, SEQ ID
NO:2221, SEQ ID NO:2223, SEQ ID NO:2225, SEQ ID
NO:2227, SEQ ID NO:2229, SEQ ID NO:2231, SEQ ID
NO:2233, SEQ ID NO:2235, SEQ ID NO:2237, SEQ ID
NO:2239, SEQ ID NO:2241, SEQ ID NO:2243, SEQ ID
NO:2245, SEQ ID NO:2247, SEQ ID NO:2249, SEQ ID
NO:2251, SEQ ID NO:2253, SEQ ID NO:2255, SEQ ID
NO:2257, SEQ ID NO:2259, SEQ ID NO:2261, SEQ ID
NO:2263, SEQ ID NO:2265, SEQ ID NO:2267, SEQ ID
NO:2269, SEQ ID NO:2271, SEQ ID NO:2273, SEQ ID
NO:2275, SEQ ID NO:2277, SEQ ID NO:2279, SEQ ID
NO:2281, SEQ ID NO:2283, SEQ ID NO:2285, SEQ ID
NO:2287, SEQ ID NO:2289, SEQ ID NO:2291, SEQ ID
NO:2293, SEQ ID NO:2295, SEQ ID NO:2297, SEQ ID
NO:2299, SEQ ID NO:2301, SEQ ID NO:2303, SEQ ID
NO:2305, SEQ ID NO:2307, SEQ ID NO:2309, SEQ ID
NO:2311, SEQ ID NO:2313, SEQ ID NO:2315, SEQ ID
NO:2317, SEQ ID NO:2319, SEQ ID NO:2321, SEQ ID
NO:2323, SEQ ID NO:2325, SEQ ID NO:2327, SEQ ID
NO:2329, SEQ ID NO:2331, SEQ ID NO:2333, SEQ ID NO:2335, SEQ ID NO:2337, SEQ ID NO:2339, SEQ ID NO:2341, SEQ ID NO:2343, SEQ ID NO:2345, SEQ ID NO:2347, or SEQ ID NO:2690.

In another aspect, a method of modulating the lignin content in a plant is provided. The method comprises introducing into a plant cell an exogenous nucleic acid comprising a regulatory region operably linked to a nucleic acid having 95% or greater sequence identity to a nucleic acid sequence selected from the group consisting of SEQ ID NO:95, SEQ ID NO:97, SEQ ID NO:101, SEQ ID NO:103, SEQ ID NO:105, SEQ ID NO:107, SEQ ID NO:109, SEQ ID NO:113, SEQ ID NO:118, SEQ ID NO:123, SEQ ID NO:125, SEQ ID NO:129, SEQ ID NO:133, SEQ ID NO:138, SEQ ID NO:140, SEQ ID NO:142, SEQ ID NO:144, SEQ ID NO:148, SEQ ID NO:150, SEQ ID NO:156, SEQ ID NO:158, SEQ ID NO:160, SEQ ID NO:162, SEQ ID NO:164, SEQ ID NO:169, SEQ ID NO:171, SEQ ID NO:177, SEQ ID NO:195, SEQ ID NO:197, SEQ ID NO:216, SEQ ID NO:218, SEQ ID NO:220, SEQ ID NO:252, SEQ ID NO:254, SEQ ID NO:257, SEQ ID NO:259, SEQ ID NO:261, SEQ ID NO:266, SEQ ID NO:268, SEQ ID NO:271, SEQ ID NO:274, SEQ ID NO:278, SEQ ID NO:281, SEQ ID NO:283, SEQ ID NO:285, SEQ ID NO:288, SEQ ID NO:291, SEQ ID NO:293, SEQ ID NO:299, SEQ ID NO:301, SEQ ID NO:303, SEQ ID NO:305, SEQ ID NO:307, SEQ ID NO:314, SEQ ID NO:317, SEQ ID NO:320, SEQ ID NO:322, SEQ ID NO:324, SEQ ID NO:327, SEQ ID NO:329, SEQ ID NO:331, SEQ ID NO:333, SEQ ID NO:336, SEQ ID NO:338, SEQ ID NO:342, SEQ ID NO:344, SEQ ID NO:346, SEQ ID NO:352, SEQ ID NO:354, SEQ ID NO:356, SEQ ID NO:360, SEQ ID NO:369, SEQ ID NO:371, SEQ ID NO:373, SEQ ID NO:376, SEQ ID NO:378, SEQ ID NO:380, SEQ ID NO:386, SEQ ID NO:390, SEQ ID NO:393, SEQ ID NO:399, SEQ ID NO:401, SEQ ID NO:404, SEQ ID NO:406, SEQ ID NO:408, SEQ ID NO:410, SEQ ID NO:412, SEQ ID NO:414, SEQ ID NO:416, SEQ ID NO:431, SEQ ID NO:435, SEQ ID NO:437, SEQ ID NO:439, SEQ ID NO:441, SEQ ID NO:444, SEQ ID NO:448, SEQ ID NO:450, SEQ ID NO:453, SEQ ID NO:458, SEQ ID NO:460, SEQ ID NO:464, SEQ ID NO:469, SEQ ID NO:472, SEQ ID NO:474, SEQ ID NO:477, SEQ ID NO:482, SEQ ID NO:486, SEQ ID NO:489, SEQ ID NO:491, SEQ ID NO:493, SEQ ID NO:495, SEQ ID NO:500, SEQ ID NO:503, SEQ ID NO:507, SEQ ID NO:509, SEQ ID NO:515, SEQ ID NO:517, SEQ ID NO:519, SEQ ID NO:523, SEQ ID NO:525, SEQ ID NO:528, SEQ ID NO:534, SEQ ID NO:536, SEQ ID NO:538, SEQ ID NO:540, SEQ ID NO:542, SEQ ID NO:544, SEQ ID NO:547, SEQ ID NO:552, SEQ ID NO:554, SEQ ID NO:562, SEQ ID NO:565, SEQ ID NO:569, SEQ ID NO:571, SEQ ID NO:573, SEQ ID NO:577, SEQ ID NO:580, SEQ ID NO:582, SEQ ID NO:584, SEQ ID NO:589, SEQ ID NO:592, SEQ ID NO:595, SEQ ID NO:598, SEQ ID NO:600, SEQ ID NO:602, SEQ ID NO:605, SEQ ID NO:607, SEQ ID NO:609, SEQ ID NO:611, SEQ ID NO:613, SEQ ID NO:618, SEQ ID NO:620, SEQ ID NO:637, SEQ ID NO:649, SEQ ID NO:651, SEQ ID NO:655, SEQ ID NO:658, SEQ ID NO:660, SEQ ID NO:664, SEQ ID NO:670, SEQ ID NO:674, SEQ ID NO:677, SEQ ID NO:679, SEQ ID NO:681, SEQ ID NO:683, SEQ ID NO:685, SEQ ID NO:688, SEQ ID NO:694, SEQ ID NO:697, SEQ ID NO:699, SEQ ID NO:702, SEQ ID NO:704, SEQ ID NO:706, SEQ ID NO:708, SEQ ID NO:712, SEQ ID NO:714, SEQ ID NO:717, SEQ ID NO:719, SEQ ID NO:721, SEQ ID NO:723, SEQ ID NO:729, SEQ ID NO:736, SEQ ID NO:741, SEQ ID NO:743, SEQ ID NO:746, SEQ ID NO:752, SEQ ID NO:754, SEQ ID NO:759, SEQ ID NO:764, SEQ ID NO:778, SEQ ID NO:780, SEQ ID NO:785, SEQ ID NO:789, SEQ ID NO:792, SEQ ID NO:795, SEQ ID NO:797, SEQ ID NO:799, SEQ ID NO:801, SEQ ID NO:807, SEQ ID NO:810, SEQ ID NO:813, SEQ ID NO:815, SEQ ID NO:819, SEQ ID NO:821, SEQ ID NO:823, SEQ ID NO:827, SEQ ID NO:829, SEQ ID NO:832, SEQ ID NO:834, SEQ ID NO:837, SEQ ID NO:840, SEQ ID NO:842, SEQ ID NO:848, SEQ ID NO:851, SEQ ID NO:854, SEQ ID NO:858, SEQ ID NO:860, SEQ ID NO:864, SEQ ID NO:867, SEQ ID NO:884, SEQ ID NO:889, SEQ ID NO:891, SEQ ID NO:893, SEQ ID NO:895, SEQ ID NO:897, SEQ ID NO:899, SEQ ID NO:903, SEQ ID NO:906, SEQ ID NO:911, SEQ ID NO:913, SEQ ID NO:916, SEQ ID NO:918, SEQ ID NO:920, SEQ ID NO:926, SEQ ID NO:928, SEQ ID NO:933, SEQ ID NO:935, SEQ ID NO:937, SEQ ID NO:942, SEQ ID NO:944, SEQ ID NO:958, SEQ ID NO:963, SEQ ID NO:965, SEQ ID NO:967, SEQ ID NO:972, SEQ ID NO:974, SEQ ID NO:979, SEQ ID NO:981, SEQ ID NO:993, SEQ ID NO:1006, SEQ ID NO:1010, SEQ ID NO:1015, SEQ ID NO:1027, SEQ ID NO:1030, SEQ ID NO:1034, SEQ ID NO:1049, SEQ ID NO:1051, SEQ ID NO:1054, SEQ ID NO:1057, SEQ ID NO:1059, SEQ ID NO:1061, SEQ ID NO:1063, SEQ ID NO:1067, SEQ ID NO:1070, SEQ ID NO:1077, SEQ ID NO:1080, SEQ ID NO:1082, SEQ ID NO:1084, SEQ ID NO:1086, SEQ ID NO:1090, SEQ ID NO:1093, SEQ ID NO:1095, SEQ ID NO:1097, SEQ ID NO:1103, SEQ ID NO:1108, SEQ ID NO:1116, SEQ ID NO:1121, SEQ ID NO:1124, SEQ ID NO:1128, SEQ ID NO:1130, SEQ ID NO:1133, SEQ ID NO:1135, SEQ ID NO:1138, SEQ ID NO:1142, SEQ ID NO:1148, SEQ ID NO:1155, SEQ ID NO:1158, SEQ ID NO:1160, SEQ ID NO:1162, SEQ ID NO:1164, SEQ ID NO:1170, SEQ ID NO:1172, SEQ ID NO:1175, SEQ ID NO:1182, SEQ ID NO:1184, SEQ ID NO:1208, SEQ ID NO:1210, SEQ ID NO:1212, SEQ ID NO:1214, SEQ ID NO:1216, SEQ ID NO:1218, SEQ ID NO:1220, SEQ ID NO:1222, SEQ ID NO:1224, SEQ ID NO:1236, SEQ ID NO:1238, SEQ ID NO:1240, SEQ ID NO:1242, SEQ ID NO:1244, SEQ ID NO:1246, SEQ ID NO:1248, SEQ ID NO:1250, SEQ ID NO:1252, SEQ ID NO:1254, SEQ ID NO:1256, SEQ ID NO:1258, SEQ ID NO:1260, SEQ ID NO:1262, SEQ ID NO:1264, SEQ ID NO:1266, SEQ ID NO:1268, SEQ ID NO:1270, SEQ ID NO:1272, SEQ ID NO:1274, SEQ ID NO:1276, SEQ ID NO:1278, SEQ ID NO:1280, SEQ ID NO:1282, SEQ ID NO:1284, SEQ ID NO:1291, SEQ ID NO:1293, SEQ ID NO:1295, SEQ ID NO:1297, SEQ ID NO:1299, SEQ ID NO:1301, SEQ ID NO:1310, SEQ ID NO:1312, SEQ ID NO:1314, SEQ ID NO:1316, SEQ ID NO:1318, SEQ ID NO:1320, SEQ ID NO:1322, SEQ ID NO:1324, SEQ ID NO:1326, SEQ ID NO:1328, SEQ ID NO:1330, SEQ ID NO:1332, SEQ ID NO:1334, SEQ ID NO:1336, SEQ ID NO:1338, SEQ ID NO:1340, SEQ ID NO:1342, SEQ ID NO:1344, SEQ ID NO:1346, SEQ ID NO:1348, SEQ ID NO:1350, SEQ ID NO:1352, SEQ ID NO:1354, SEQ ID NO:1356, SEQ ID NO:1358, SEQ ID NO:1360, SEQ ID NO:1368, SEQ ID NO:1370, SEQ ID NO:1372, SEQ ID NO:1374, SEQ ID NO:1376, SEQ ID NO:1378, SEQ ID NO:1380, SEQ ID NO:1382, SEQ ID NO:1384, SEQ ID NO:1386, SEQ ID NO:1388, SEQ ID NO:1390, SEQ ID NO:1392, SEQ ID NO:1394, SEQ ID NO:1396, SEQ ID NO:1398, SEQ ID NO:1400, SEQ ID NO:1402, SEQ ID NO:1404, SEQ ID
NO:1411, SEQ ID NO:1413, SEQ ID NO:1416, SEQ ID
NO:1418, SEQ ID NO:1420, SEQ ID NO:1422, SEQ ID
NO:1430, SEQ ID NO:1432, SEQ ID NO:1434, SEQ ID
NO:1435, SEQ ID NO:1443, SEQ ID NO:1464, SEQ ID
NO:1466, SEQ ID NO:1468, SEQ ID NO:1470, SEQ ID
NO:1472, SEQ ID NO:1474, SEQ ID NO:1476, SEQ ID
NO:1478, SEQ ID NO:1480, SEQ ID NO:1482, SEQ ID
NO:1484, SEQ ID NO:1486, SEQ ID NO:1492, SEQ ID
NO:1501, SEQ ID NO:1503, SEQ ID NO:1517, SEQ ID
NO:1519, SEQ ID NO:1521, SEQ ID NO:1523, SEQ ID
NO:1525, SEQ ID NO:1527, SEQ ID NO:1535, SEQ ID
NO:1537, SEQ ID NO:1539, SEQ ID NO:1541, SEQ ID
NO:1543, SEQ ID NO:1545, SEQ ID NO:1547, SEQ ID
NO:1549, SEQ ID NO:1551, SEQ ID NO:1553, SEQ ID
NO:1555, SEQ ID NO:1557, SEQ ID NO:1559, SEQ ID
NO:1561, SEQ ID NO:1563, SEQ ID NO:1565, SEQ ID
NO:1567, SEQ ID NO:1569, SEQ ID NO:1572, SEQ ID
NO:1574, SEQ ID NO:1576, SEQ ID NO:1578, SEQ ID
NO:1580, SEQ ID NO:1582, SEQ ID NO:1584, SEQ ID
NO:1586, SEQ ID NO:1588, SEQ ID NO:1590, SEQ ID
NO:1592, SEQ ID NO:1594, SEQ ID NO:1609, SEQ ID
NO:1611, SEQ ID NO:1613, SEQ ID NO:1615, SEQ ID
NO:1617, SEQ ID NO:1619, SEQ ID NO:1623, SEQ ID
NO:1625, SEQ ID NO:1627, SEQ ID NO:1629, SEQ ID
NO:1631, SEQ ID NO:1636, SEQ ID NO:1652, SEQ ID
NO:1656, SEQ ID NO:1658, SEQ ID NO:1660, SEQ ID
NO:1662, SEQ ID NO:1664, SEQ ID NO:1666, SEQ ID
NO:1668, SEQ ID NO:1670, SEQ ID NO:1672, SEQ ID
NO:1674, SEQ ID NO:1680, SEQ ID NO:1682, SEQ ID
NO:1691, SEQ ID NO:1693, SEQ ID NO:1695, SEQ ID
NO:1697, SEQ ID NO:1699, SEQ ID NO:1701, SEQ ID
NO:1703, SEQ ID NO:1705, SEQ ID NO:1707, SEQ ID
NO:1709, SEQ ID NO:1711, SEQ ID NO:1713, SEQ ID
NO:1715, SEQ ID NO:1717, SEQ ID NO:1719, SEQ ID
NO:1721, SEQ ID NO:1723, SEQ ID NO:1725, SEQ ID
NO:1727, SEQ ID NO:1732, SEQ ID NO:1734, SEQ ID
NO:1748, SEQ ID NO:1751, SEQ ID NO:1766, SEQ ID
NO:1776, SEQ ID NO:1778, SEQ ID NO:1780, SEQ ID
NO:1782, SEQ ID NO:1784, SEQ ID NO:1805, SEQ ID
NO:1821, SEQ ID NO:1823, SEQ ID NO:1825, SEQ ID
NO:1827, SEQ ID NO:1829, SEQ ID NO:1831, SEQ ID
NO:1833, SEQ ID NO:1835, SEQ ID NO:1837, SEQ ID
NO:1839, SEQ ID NO:1841, SEQ ID NO:1843, SEQ ID
NO:1845, SEQ ID NO:1847, SEQ ID NO:1849, SEQ ID
NO:1851, SEQ ID NO:1853, SEQ ID NO:1855, SEQ ID
NO:1857, SEQ ID NO:1859, SEQ ID NO:1861, SEQ ID
NO:1863, SEQ ID NO:1865, SEQ ID NO:1867, SEQ ID
NO:1869, SEQ ID NO:1871, SEQ ID NO:1873, SEQ ID
NO:1875, SEQ ID NO:1877, SEQ ID NO:1879, SEQ ID
NO:1881, SEQ ID NO:1883, SEQ ID NO:1885, SEQ ID
NO:1887, SEQ ID NO:1889, SEQ ID NO:1891, SEQ ID
NO:1896, SEQ ID NO:1898, SEQ ID NO:1900, SEQ ID
NO:1903, SEQ ID NO:1905, SEQ ID NO:1907, SEQ ID
NO:1919, SEQ ID NO:1920, SEQ ID NO:2060, SEQ ID
NO:2062, SEQ ID NO:2064, SEQ ID NO:2084, SEQ ID
NO:2088, SEQ ID NO:2090, SEQ ID NO:2092, SEQ ID
NO:2094, SEQ ID NO:2096, SEQ ID NO:2098, SEQ ID
NO:2100, SEQ ID NO:2102, SEQ ID NO:2104, SEQ ID
NO:2106, SEQ ID NO:2108, SEQ ID NO:2110, SEQ ID
NO:2112, SEQ ID NO:2114, SEQ ID NO:2116, SEQ ID
NO:2118, SEQ ID NO:2120, SEQ ID NO:2122, SEQ ID
NO:2124, SEQ ID NO:2126, SEQ ID NO:2128, SEQ ID
NO:2130, SEQ ID NO:2132, SEQ ID NO:2134, SEQ ID
NO:2136, SEQ ID NO:2138, SEQ ID NO:2140, SEQ ID
NO:2142, SEQ ID NO:2144, SEQ ID NO:2146, SEQ ID
NO:2148, SEQ ID NO:2150, SEQ ID NO:2152, SEQ ID
NO:2154, SEQ ID NO:2156, SEQ ID NO:2158, SEQ ID
NO:2160, SEQ ID NO:2161, SEQ ID NO:2163, SEQ ID
NO:2165, SEQ ID NO:6167, SEQ ID NO:2169, SEQ ID
NO:2171, SEQ ID NO:2173, SEQ ID NO:2175, SEQ ID
NO:2177, SEQ ID NO:2179, SEQ ID NO:2181, SEQ ID
NO:2183, SEQ ID NO:2185, SEQ ID NO:2187, SEQ ID
NO:2189, SEQ ID NO:2191, SEQ ID NO:2193, SEQ ID
NO:2195, SEQ ID NO:2197, SEQ ID NO:2199, SEQ ID
NO:2201, SEQ ID NO:2203, SEQ ID NO:2205, SEQ ID
NO:2207, SEQ ID NO:2209, SEQ ID NO:2211, SEQ ID
NO:2213, SEQ ID NO:2215, SEQ ID NO:2217, SEQ ID
NO:2219, SEQ ID NO:2221, SEQ ID NO:2223, SEQ ID
NO:2225, SEQ ID NO:2227, SEQ ID NO:2229, SEQ ID
NO:2231, SEQ ID NO:2233, SEQ ID NO:2235, SEQ ID
NO:2237, SEQ ID NO:2239, SEQ ID NO:2241, SEQ ID
NO:2243, SEQ ID NO:2245, SEQ ID NO:2247, SEQ ID
NO:2249, SEQ ID NO:2251, SEQ ID NO:2253, SEQ ID
NO:2255, SEQ ID NO:2257, SEQ ID NO:2259, SEQ ID
NO:2261, SEQ ID NO:2263, SEQ ID NO:2265, SEQ ID
NO:2267, SEQ ID NO:2269, SEQ ID NO:2271, SEQ ID
NO:2273, SEQ ID NO:2275, SEQ ID NO:2277, SEQ ID
NO:2279, SEQ ID NO:2281, SEQ ID NO:2283, SEQ ID
NO:2285, SEQ ID NO:2287, SEQ ID NO:2289, SEQ ID
NO:2291, SEQ ID NO:2293, SEQ ID NO:2295, SEQ ID
NO:2297, SEQ ID NO:2299, SEQ ID NO:2301, SEQ ID
NO:2303, SEQ ID NO:2305, SEQ ID NO:2307, SEQ ID
NO:2309, SEQ ID NO:2311, SEQ ID NO:2313, SEQ ID
NO:2315, SEQ ID NO:2317, SEQ ID NO:2319, SEQ ID
NO:2321, SEQ ID NO:2323, SEQ ID NO:2325, SEQ ID
NO:2327, SEQ ID NO:2329, SEQ ID NO:2331, SEQ ID
NO:2333, SEQ ID NO:2335, SEQ ID NO:2337, SEQ ID
NO:2339, SEQ ID NO:2341, SEQ ID NO:2343, SEQ ID
NO:2345, SEQ ID NO:2347, and SEQ ID NO:2349-2690; where a tissue of a plant produced from the plant cell has a difference in lignin content as compared to the corresponding lignin content in tissue of a control plant that does not comprise the nucleic acid.

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims.

DESCRIPTION OF THE DRAWINGS

FIG. 1 is an alignment of the amino acid sequence of Annot ID 541887 (SEQ ID NO:96) with homologous and/or orthologous amino acid sequences CeresAnnot:1448288 (SEQ ID NO:98), CeresClone:644583 (SEQ ID NO:99), gi|50926522 (SEQ ID NO:100), and CeresClone:1791381 (SEQ ID NO:102). In all the alignment figures shown herein, a dash in an aligned sequence represents a gap, i.e., a lack of an amino acid at that position. Identical amino acids or conserved amino acid substitutions among aligned sequences are identified by boxes. FIG. 1 and the other alignment figures provided herein were generated using the program MUSCLE version 3.52.

FIG. 2 is an alignment of the amino acid sequence of Annot ID 548715 (SEQ ID NO:106) with homologous and/or orthologous amino acid sequences CeresAnnot:1447956 (SEQ ID NO:108), CeresClone:1923054 (SEQ ID NO:110), CeresClone:1051305 (SEQ ID NO:111), gi|50923813 (SEQ ID NO:112), CeresClone:1746793 (SEQ ID NO:114), CeresClone:843382 (SEQ ID NO:115), and CeresClone:1540519 (SEQ ID NO:116).

FIG. 3 is an alignment of the amino acid sequence of Annot ID 549656 (SEQ ID NO:119) with homologous and/or orthologous amino acid sequences CeresClone:463643 (SEQ ID NO:122), CeresAnnot:1442640 (SEQ ID NO:124), CeresClone:704938 (SEQ ID NO:127), CeresClone:281395 (SEQ ID NO:128), CeresClone:1784166 (SEQ ID NO:130), and gi|56785216 (SEQ ID NO:131).

FIG. 4 is an alignment of the amino acid sequence of Annot ID 550729 (SEQ ID NO:134) with homologous and/or orthologous amino acid sequences gi|20340241 (SEQ ID NO:136), CeresClone:473509 (SEQ ID NO:137), CeresAnnot:1525600 (SEQ ID NO:139), CeresClone:1922929 (SEQ ID NO:141), gi|76446335 (SEQ ID NO:146), and gi|37901055 (SEQ ID NO:147).

FIG. 5 is an alignment of the amino acid sequence of Annot ID 554970 (SEQ ID NO:149) with homologous and/or orthologous amino acid sequences CeresAnnot:1528227 (SEQ ID NO:151), gi|34908948 (SEQ ID NO:152), and CeresClone:1158508 (SEQ ID NO:154).

FIG. 6 is an alignment of the amino acid sequence of Annot ID 840236 (SEQ ID NO:165) with homologous and/or orthologous amino acid sequence gi|21105736 (SEQ ID NO:168).

FIG. 7 is an alignment of the amino acid sequence of CeresClone:1001761 (SEQ ID NO:172) with homologous and/or orthologous amino acid sequences CeresClone:955105 (SEQ ID NO:174) and CeresClone:1620054 (SEQ ID NO:175).

FIG. 9 is an alignment of the amino acid sequence of CeresClone:1011900 (SEQ ID NO:221) with homologous and/or orthologous amino acid sequences CeresClone:1083222 (SEQ ID NO:222), CeresClone:1075035 (SEQ ID NO:223), CeresClone:1444599 (SEQ ID NO:225), gi|1346181 (SEQ ID NO:227), CeresClone:1053672 (SEQ ID NO:231), gi|469070 (SEQ ID NO:232), gi|2226370 (SEQ ID NO:234), gi|2267569 (SEQ ID NO:235), gi|18347 (SEQ ID NO:244), gi|34851124 (SEQ ID NO:246), gi|7024451 (SEQ ID NO:247), gi|6273331 (SEQ ID NO:248), gi|20152613 (SEQ ID NO:249), gi|92874469 (SEQ ID NO:250), CeresAnnot:1450324 (SEQ ID NO:253), gi|1229138 (SEQ ID NO:256), CeresClone:1834392 (SEQ ID NO:258), gi|108863012 (SEQ ID NO:263), gi|6911144 (SEQ ID NO:270), CeresClone:1773631 (SEQ ID NO:275), gi|1934994 (SEQ ID NO:290), gi|2674201 (SEQ ID NO:296), gi|799015 (SEQ ID NO:297), gi|4704605 (SEQ ID NO:311), gi|10799202 (SEQ ID NO:313), gi|90265701 (SEQ ID NO:316), gi|90704785 (SEQ ID NO:319), gi|21625 (SEQ ID NO:326), and gi|21388658 (SEQ ID NO:335).

FIG. 10 is an alignment of the amino acid sequence of CeresClone:105162 (SEQ ID NO:339) with homologous and/or orthologous amino acid sequences CeresClone:1853694 (SEQ ID NO:343), CeresAnnot:1494468 (SEQ ID NO:345), gi|38036140 (SEQ ID NO:348), CeresClone:1649800 (SEQ ID NO:349), CeresClone:984060 (SEQ ID NO:350), gi|31872116 (SEQ ID NO:351), and CeresClone:1816624 (SEQ ID NO:353).

FIG. 11 is an alignment of the amino acid sequence of CeresClone:110428 (SEQ ID NO:357) with homologous and/or orthologous amino acid sequence CeresClone:1444428 (SEQ ID NO:359).

FIG. 12 is an alignment of the amino acid sequence of CeresClone:112098 (SEQ ID NO:361) with homologous and/or orthologous amino acid sequences CeresClone:1376604 (SEQ ID NO:367) and CeresClone:463184 (SEQ ID NO:368).

FIG. 13 is an alignment of the amino acid sequence of CeresClone:113639 (SEQ ID NO:374) with homologous and/or orthologous amino acid sequences CeresClone:562894 (SEQ ID NO:375) and CeresAnnot:1503065 (SEQ ID NO:377).

FIG. 15 is an alignment of the amino acid sequence of CeresClone:12256 (SEQ ID NO:417) with homologous and/or orthologous amino acid sequences CeresClone:976830 (SEQ ID NO:418), gi|87240462 (SEQ ID NO:421), gi|77556133 (SEQ ID NO:422), CeresClone:305612 (SEQ ID NO:423), CeresClone:686862 (SEQ ID NO:424), and CeresClone:1113246 (SEQ ID NO:425).

FIG. 16 is an alignment of the amino acid sequence of CeresClone:123804 (SEQ ID NO:432) with homologous and/or orthologous amino acid sequence CeresClone:670908 (SEQ ID NO:433).

FIG. 17 is an alignment of the amino acid sequence of CeresClone:125917 (SEQ ID NO:438) with homologous and/or orthologous amino acid sequences CeresAnnot:1456569 (SEQ ID NO:440), CeresAnnot:1450998 (SEQ ID NO:442), and gi|92873189 (SEQ ID NO:443).

FIG. 18 is an alignment of the amino acid sequence of Ceres Clone 14203 (SEQ ID NO:445) with homologous and/or orthologous amino acid sequences CeresClone:1021029 (SEQ ID NO:446), CeresClone:974951 (SEQ ID NO:447), 1460527 (SEQ ID NO:449), CeresClone:1853189 (SEQ ID NO:451), gi|92896423 (SEQ ID NO:452), CeresClone:1853430 (SEQ ID NO:454), CeresClone:1734621 (SEQ ID NO:455), gi|50909195 (SEQ ID NO:456), gi|66271037 (SEQ ID NO:457), and 1450673 (SEQ ID NO:459).

FIG. 19 is an alignment of the amino acid sequence of CeresClone:1480 (SEQ ID NO:461) with homologous and/or orthologous amino acid sequences CeresClone:1067639 (SEQ ID NO:462) and CeresClone:1068473 (SEQ ID NO:463).

FIG. 20 is an alignment of the amino acid sequence of CeresClone:1492 (SEQ ID NO:465) with homologous and/or orthologous amino acid sequences gi|89257443 (SEQ ID NO:466), CeresClone:1128644 (SEQ ID NO:467), gi|4586580 (SEQ ID NO:468), CeresClone:1835140 (SEQ ID NO:470), gi|50911379 (SEQ ID NO:471), 1538756 (SEQ ID NO:473), CeresClone:1840642 (SEQ ID NO:475), gi|311907 (SEQ ID NO:476), CeresClone:1932400 (SEQ ID NO:478), gi|1053067 (SEQ ID NO:479), CeresClone:727613 (SEQ ID NO:480), gi|34914060 (SEQ ID NO:481), CeresClone:1834939 (SEQ ID NO:483), gi|2500073 (SEQ ID NO:484), gi|5902803 (SEQ ID NO:485), CeresClone:1785552 (SEQ ID NO:487), and gi|401686 (SEQ ID NO:488).

FIG. 21 is an alignment of the amino acid sequence of Ceres Clone 156298 (SEQ ID NO:490) with homologous and/or orthologous amino acid sequences CeresAnnot:1512948 (SEQ ID NO:492), CeresClone:659211 (SEQ ID NO:497), gi|92877546 (SEQ ID NO:498), CeresClone:1831324 (SEQ ID NO:501), and CeresClone:398632 (SEQ ID NO:502). The consensus sequence determined by the alignment is set forth FIG. 22 is an alignment of the amino acid sequence of Ceres Clone 156373 (SEQ ID NO:504) with homologous and/or orthologous amino acid sequences CeresClone:1393778 (SEQ ID NO:505), CeresAnnot:1518013 (SEQ ID NO:508), CeresClone:477995 (SEQ ID NO:511), gi|45387429 (SEQ ID NO:513), gi|34900462 (SEQ ID NO:514), and CeresClone:1826835 (SEQ ID NO:516).

FIG. 23 is an alignment of the amino acid sequence of Ceres Clone 158240 (SEQ ID NO:520) with homologous and/or orthologous amino acid sequences gi|37538128 (SEQ ID NO:521) and gi|84453218 (SEQ ID NO:522).

FIG. 24 is an alignment of the amino acid sequence of Ceres Clone 16284 (SEQ ID NO:526) with homologous and/or orthologous amino acid sequence CeresClone:976709 (SEQ ID NO:527).

FIG. 26 is an alignment of the amino acid sequence of Ceres Clone 1845 (SEQ ID NO:548) with homologous and/or orthologous amino acid sequences CeresClone:890211 (SEQ ID NO:549), CeresClone:556120 (SEQ ID NO:550), and CeresAnnot:1483577 (SEQ ID NO:553).

FIG. 27 is an alignment of the amino acid sequence of Ceres Clone 205648 (SEQ ID NO:555) with homologous and/or orthologous amino acid sequences gi|102139801 (SEQ ID NO:556), gi|15148912 (SEQ ID NO:557), CeresClone:577178 (SEQ ID NO:558), CeresClone:644344 (SEQ ID NO:559), gi|52076897 (SEQ ID NO:560), CeresClone:1674566 (SEQ ID NO:561), CeresAnnot:1456842 (SEQ ID NO:563), and gi|34558777 (SEQ ID NO:564).

FIG. 28 is an alignment of the amino acid sequence of Ceres Clone 21406 (SEQ ID NO:566) with homologous and/or orthologous amino acid sequences gi|24030386 (SEQ ID NO:567), gi|6850309 (SEQ ID NO:568), CeresAnnot:1498288 (SEQ ID NO:572), and CeresAnnot:1471938 (SEQ ID NO:574).

FIG. 29 is an alignment of the amino acid sequence of Ceres Clone 224919 (SEQ ID NO:585) with homologous and/or orthologous amino acid sequences gi|50933495 (SEQ ID NO:586) and CeresClone:1556085 (SEQ ID NO:587).

FIG. 30 is an alignment of the amino acid sequence of Ceres Clone 22671 (SEQ ID NO:590) with homologous and/or orthologous amino acid sequences CeresClone:1079601 (SEQ ID NO:591), 1483277 (SEQ ID NO:593), CeresClone:690625 (SEQ ID NO:594), 1467420 (SEQ ID NO:596), and gi|15042132 (SEQ ID NO:597).

FIG. 31 is an alignment of the amino acid sequence of Ceres Clone 240112 (SEQ ID NO:601) with homologous and/or orthologous amino acid sequences CeresClone:1791988 (SEQ ID NO:603) and gi|50918981 (SEQ ID NO:604).

FIG. 33 is an alignment of the amino acid sequence of Ceres Clone 285598 (SEQ ID NO:638) with homologous and/or orthologous amino acid sequences CeresClone:236111 (SEQ ID NO:639), gi|34902144 (SEQ ID NO:640), CeresClone:1315656 (SEQ ID NO:641), gi|45602841 (SEQ ID NO:642), gi|45544873 (SEQ ID NO:643), gi|45758663 (SEQ ID NO:644), gi|62320820 (SEQ ID NO:645), gi|92888885 (SEQ ID NO:647), gi|40807658 (SEQ ID NO:648), and CeresAnnot:1486505 (SEQ ID NO:650).

FIG. 35 is an alignment of the amino acid sequence of Ceres Clone 2913 (SEQ ID NO:661) with homologous and/or orthologous amino acid sequences CeresClone:1384592 (SEQ ID NO:662), CeresClone:1121989 (SEQ ID NO:663), 1463575 (SEQ ID NO:665), gi|48209882 (SEQ ID NO:666), gi|48209945 (SEQ ID NO:667), gi|349379 (SEQ ID NO:668), and CeresClone:677386 (SEQ ID NO:669).

FIG. 36 is an alignment of the amino acid sequence of Ceres Clone 2942 (SEQ ID NO:671) with homologous and/or orthologous amino acid sequences CeresClone:1619846 (SEQ ID NO:672), gi|50925955 (SEQ ID NO:673), 1455934 (SEQ ID NO:675), and CeresClone:337432 (SEQ ID NO:676).

FIG. 37 is an alignment of the amino acid sequence of Ceres Clone 31044 (SEQ ID NO:680) with homologous and/or orthologous amino acid sequences 1496976 (SEQ ID NO:682) and 1444027 (SEQ ID NO:684).

FIG. 38 is an alignment of the amino acid sequence of Ceres Clone 312833 (SEQ ID NO:686) with homologous and/or orthologous amino acid sequence gi|50920025 (SEQ ID NO:687).

FIG. 39 is an alignment of the amino acid sequence of Ceres Clone 31322 (SEQ ID NO:689) with homologous and/or orthologous amino acid sequences CeresClone:980901 (SEQ ID NO:690), CeresClone:1030653 (SEQ ID NO:691), CeresClone:956177 (SEQ ID NO:692), and CeresClone:1620744 (SEQ ID NO:693).

FIG. 40 is an alignment of the amino acid sequence of Ceres Clone 325679 (SEQ ID NO:695) with homologous and/or orthologous amino acid sequence gi|50910213 (SEQ ID NO:696).

FIG. 41 is an alignment of the amino acid sequence of Ceres Clone 32754 (SEQ ID NO:698) with homologous and/or orthologous amino acid sequences CeresClone:1855403 (SEQ ID NO:700) and CeresClone:572426 (SEQ ID NO:701).

FIG. 42 is an alignment of the amino acid sequence of Ceres Clone 33139 (SEQ ID NO:703) with homologous and/or orthologous amino acid sequences 1503188 (SEQ ID NO:705) and gi|21386951 (SEQ ID NO:2067).

FIG. 43 is an alignment of the amino acid sequence of Ceres Clone 331755 (SEQ ID NO:707) with homologous and/or orthologous amino acid sequences CeresClone:1775942 (SEQ ID NO:709), gi|34913016 (SEQ ID NO:710), CeresClone:1723374 (SEQ ID NO:711), CeresClone:1847251 (SEQ ID NO:713), gi|38566494 (SEQ ID NO:716), CeresAnnot:1514100 (SEQ ID NO:718), CeresClone:638126 (SEQ ID NO:725), gi|7981380 (SEQ ID NO:726), gi|92894385 (SEQ ID NO:727), and gi|61652985 (SEQ ID NO:728).

FIG. 45 is an alignment of the amino acid sequence of Ceres Clone 337432 (SEQ ID NO:737) with homologous and/or orthologous amino acid sequences gi|50925955 (SEQ ID NO:738), CeresClone:1619846 (SEQ ID NO:739), gi|27754217 (SEQ ID NO:740), and CeresAnnot:1509127 (SEQ ID NO:742).

FIG. 46 is an alignment of the amino acid sequence of Ceres Clone 339518 (SEQ ID NO:744) with homologous and/or orthologous amino acid sequences CeresClone:243130 (SEQ ID NO:745), CeresClone:1776411 (SEQ ID NO:747), gi|50911777 (SEQ ID NO:748), gi|100796 (SEQ ID NO:750), CeresAnnot:1500106 (SEQ ID NO:753), gi|23197622 (SEQ ID NO:756), and gi|21279 (SEQ ID NO:758).

FIG. 47 is an alignment of the amino acid sequence of Ceres Clone 34635 (SEQ ID NO:760) with homologous and/or orthologous amino acid sequences gi|6707088 (SEQ ID NO:761), gi|48375197 (SEQ ID NO:762), gi|1561782 (SEQ ID NO:763), CeresClone:1921942 (SEQ ID NO:765), gi|1370276 (SEQ ID NO:766), gi|22665 (SEQ ID NO:767), gi|60858812 (SEQ ID NO:768), gi|82734191 (SEQ ID NO:769), gi|99109361 (SEQ ID NO:770), gi|42795301 (SEQ ID NO:771), gi|83999564 (SEQ ID NO:772), gi|42795285 (SEQ ID NO:773), gi|42795257 (SEQ ID NO:774), gi|16549070 (SEQ ID NO:775), gi|60100348 (SEQ ID NO:776), and gi|5825623 (SEQ ID NO:777).

FIG. 48 is an alignment of the amino acid sequence of Ceres Clone 36370 (SEQ ID NO:781) with homologous and/or orthologous amino acid sequences CeresClone:627169 (SEQ ID NO:784), CeresClone:1724787 (SEQ ID NO:786), gi|34914598 (SEQ ID NO:787), CeresClone:1397168 (SEQ ID NO:788), CeresAnnot:1481678 (SEQ ID NO:790), and CeresClone:704527 (SEQ ID NO:791).

FIG. 49 is an alignment of the amino acid sequence of Ceres Clone 37739 (SEQ ID NO:793) with homologous and/or orthologous amino acid sequences gi|20259555 (SEQ ID NO:794), CeresClone:1754197 (SEQ ID NO:796), CeresClone:1856164 (SEQ ID NO:798), 1488340 (SEQ ID NO:800), CeresClone:1807870 (SEQ ID NO:802), gi|45935145 (SEQ ID NO:803), CeresClone:383227 (SEQ ID NO:804), gi|70664005 (SEQ ID NO:805), and CeresClone:909699 (SEQ ID NO:806).

FIG. 50 is an alignment of the amino acid sequence of Ceres Clone 37980 (SEQ ID NO:808) with homologous and/or orthologous amino acid sequences CeresClone:630887 (SEQ ID NO:809), 1460561 (SEQ ID NO:811), and gi|50919643 (SEQ ID NO:812).

FIG. 53 is an alignment of the amino acid sequence of Ceres Clone 3900 (SEQ ID NO:838) with homologous and/or orthologous amino acid sequences CeresClone:158765 (SEQ ID NO:839), CeresClone:1839717 (SEQ ID NO:841), 1480628 (SEQ ID NO:843), gi|5669656 (SEQ ID NO:844), CeresClone:1329861 (SEQ ID NO:845), CeresClone:537752 (SEQ ID NO:846), CeresClone:1322549 (SEQ ID NO:847), 1533351 (SEQ ID NO:849), and CeresClone:282892 (SEQ ID NO:850).

FIG. 54 is an alignment of the amino acid sequence of Ceres Clone 39855 (SEQ ID NO:852) with homologous and/or orthologous amino acid sequences CeresClone:1065335 (SEQ ID NO:853), CeresClone:1793747 (SEQ ID NO:855), CeresClone:788576 (SEQ ID NO:856), CeresClone:465010 (SEQ ID NO:857), CeresClone:1832492 (SEQ ID NO:859), CeresClone:1801885 (SEQ ID NO:861), CeresClone:1060804 (SEQ ID NO:862), gi|50948587 (SEQ ID NO:863), and gi|20259185 (SEQ ID NO:2066).

FIG. 55 is an alignment of the amino acid sequence of Ceres Clone 40334 (SEQ ID NO:865) with homologous and/or orthologous amino acid sequences gi|67043456 (SEQ ID NO:866), 1452158 (SEQ ID NO:868), gi|4105097 (SEQ ID NO:869), gi|56785938 (SEQ ID NO:870), CeresClone:1625939 (SEQ ID NO:871), gi|12666533 (SEQ ID NO:872), gi|60100344 (SEQ ID NO:873), gi|51832629 (SEQ ID NO:874), CeresClone:474230 (SEQ ID NO:875), gi|454265 (SEQ ID NO:876), gi|53988171 (SEQ ID NO:877), gi|48727608 (SEQ ID NO:878), gi|602902 (SEQ ID NO:879), gi|33338587 (SEQ ID NO:880), gi|4218173 (SEQ ID NO:881), gi|33309888 (SEQ ID NO:882), and gi|84578879 (SEQ ID NO:883).

FIG. 56 is an alignment of the amino acid sequence of Ceres Clone 41634 (SEQ ID NO:885) with homologous and/or orthologous amino acid sequences CeresClone:1360604 (SEQ ID NO:887), CeresClone:1844070 (SEQ ID NO:890), and CeresAnnot:1457905 (SEQ ID NO:892).

FIG. 57 is an alignment of the amino acid sequence of Ceres Clone 478453 (SEQ ID NO:900) with homologous and/or orthologous amino acid sequences CeresClone:1923578 (SEQ ID NO:904), gi|51535194 (SEQ ID NO:905), CeresClone:1956222 (SEQ ID NO:907), CeresClone:291139 (SEQ ID NO:908), and CeresClone:569584 (SEQ ID NO:910).

FIG. 58 is an alignment of the amino acid sequence of Ceres Clone 479006 (SEQ ID NO:914) with homologous and/or orthologous amino acid sequences CeresAnnot:1444387 (SEQ ID NO:917), CeresClone:1886347 (SEQ ID NO:919), gi|13508844 (SEQ ID NO:922), gi|14532902 (SEQ ID NO:923), CeresClone:1858581 (SEQ ID NO:927), CeresClone:630211 (SEQ ID NO:930), CeresClone:1534695 (SEQ ID NO:931), and gi|77551916 (SEQ ID NO:932).

FIG. 59 is an alignment of the amino acid sequence of Ceres Clone 534281 (SEQ ID NO:938) with homologous and/or orthologous amino acid sequences gi|92877732 (SEQ ID NO:939), CeresAnnot:1471100 (SEQ ID NO:943), gi|21280839 (SEQ ID NO:946), gi|50911116 (SEQ ID NO:947), CeresClone:1580901 (SEQ ID NO:950), CeresClone:703763 (SEQ ID NO:954), and CeresClone:1795581 (SEQ ID NO:959).

FIG. 61 is an alignment of the amino acid sequence of Ceres Clone 542773 (SEQ ID NO:980) with homologous and/or orthologous amino acid sequences CeresClone:1845589 (SEQ ID NO:982), gi|50924820 (SEQ ID NO:983), gi|34452085 (SEQ ID NO:984), gi|1816459 (SEQ ID NO:985), gi|15081463 (SEQ ID NO:986), gi|2959320 (SEQ ID NO:987), and gi|29611976 (SEQ ID NO:988).

FIG. 65 is an alignment of the amino acid sequence of Ceres Clone 6639 (SEQ ID NO:1083) with homologous and/or orthologous amino acid sequences CeresClone:1834027 (SEQ ID NO:1085), 1482536 (SEQ ID NO:1087), CeresClone:463157 (SEQ ID NO:1088), gi|92875402 (SEQ ID NO:1089), 1478227 (SEQ ID NO:1091), gi|21667487 (SEQ ID NO:1092), CeresClone:1755065 (SEQ ID NO:1094), gi|21281083, and gi|9759262.

FIG. 66 is an alignment of the amino acid sequence of Ceres Clone 7774 (SEQ ID NO:1096) with homologous and/or orthologous amino acid sequences 1449565 (SEQ ID NO:1098), gi|92875130 (SEQ ID NO:1099), CeresClone:1728645 (SEQ ID NO:1100), CeresClone:892214 (SEQ ID NO:1101), and gi|50913251 (SEQ ID NO:1102).

FIG. 67 is an alignment of the amino acid sequence of Ceres Clone 8334 (SEQ ID NO:1104) with homologous and/or orthologous amino acid sequences gi|30984532 (SEQ ID NO:1105) and CeresClone:1923641 (SEQ ID NO:1125).

FIG. 68 is an alignment of the amino acid sequence of Ceres Clone 963031 (SEQ ID NO:1131) with homologous and/or orthologous amino acid sequence gi|21554154 (SEQ ID NO:1132).

FIG. 69 is an alignment of the amino acid sequence of Ceres Clone 9804 (SEQ ID NO:1136) with homologous and/or orthologous amino acid sequences CeresClone:1832094 (SEQ ID NO:1143) and CeresClone:1887966 (SEQ ID NO:2065).

FIG. 70 is an alignment of the amino acid sequence of Ceres Clone 99033 (SEQ ID NO:1165) with homologous and/or orthologous amino acid sequences CeresClone:1840223 (SEQ ID NO:1171), CeresAnnot:1514944 (SEQ ID NO:1173), gi|90399248 (SEQ ID NO:1174), CeresClone:1827510 (SEQ ID NO:1176), CeresClone:467336 (SEQ ID NO:1177), CeresClone:1555943 (SEQ ID NO:1180), and gi|9294812 (SEQ ID NO:1181).

FIG. 71 is an alignment of the amino acid sequence of cDNA ID 23389966 (Ceres CLONE ID no. 3929; SEQ ID NO:1185) with homologous and/or orthologous amino acid sequences gi|20197615 (SEQ ID NO:1187), CeresClone:18215 (SEQ ID NO:1188), CeresClone:105261 (SEQ ID NO:1190), CeresClone:24667 (SEQ ID NO:1193), CeresClone:118878 (SEQ ID NO:1195), CeresClone:12459 (SEQ ID NO:1196), and CeresClone:1354021 (SEQ ID NO:1197).

FIG. 72 is an alignment of the amino acid sequence of Ceres Clone 14909 (SEQ ID NO:1211) with homologous and/or orthologous amino acid sequences CeresClone:1561415 (SEQ ID NO:1226), CeresClone:380874 (SEQ ID NO:1227), CeresClone:416460 (SEQ ID NO:1228), CeresClone:631823 (SEQ ID NO:1229), CeresClone:1535974 (SEQ ID NO:1230), CeresClone:1428788 (SEQ ID NO:1231), CeresClone:738726 (SEQ ID NO:1232), CeresClone:276776 (SEQ ID NO:1233), CeresClone:240510 (SEQ ID NO:1234), and CeresClone:529239 (SEQ ID NO:1235).

FIG. 73 is an alignment of the amino acid sequence of Ceres Clone 19340 (SEQ ID NO:1239) with homologous and/or orthologous amino acid sequences CeresClone:573293 (SEQ ID NO:1931), gi|50919203 (SEQ ID NO:1933), CeresClone:230342 (SEQ ID NO:1934), and CeresClone:537080 (SEQ ID NO:1932).

FIG. 74 is an alignment of the amino acid sequence of cDNA ID 23383311 (Ceres CLONE ID no. 21604; SEQ ID NO:1249) with homologous and/or orthologous amino acid sequences CeresClone:824827 (SEQ ID NO:2018), CeresClone:245683 (SEQ ID NO:2015), CeresClone:1283552 (SEQ ID NO:2016), CeresClone:272426 (SEQ ID NO:2017), CeresClone:659723 (SEQ ID NO:2012), CeresClone:1585988 (SEQ ID NO:2014), and CeresClone:953644 (SEQ ID NO:2013).

FIG. 75 is an alignment of the amino acid sequence of Ceres Clone 29637 (SEQ ID NO:1259) with homologous and/or orthologous amino acid sequence gi|34896798 (SEQ ID NO:1946).

FIG. 76 is an alignment of the amino acid sequence of cDNA ID 23384563 (Ceres CLONE ID no. 34414; SEQ ID NO:1267) with homologous and/or orthologous amino acid sequences CeresClone:14909 (SEQ ID NO:1986), CeresClone:1535974 (SEQ ID NO:1991), CeresClone:276776 (SEQ ID NO:1990), CeresClone:240510 (SEQ ID NO:1992), gi|39653273 (SEQ ID NO:1989), CeresClone: 33126 (SEQ ID NO:1987), and CeresClone:1338585 (SEQ ID NO:1988).

FIG. 77 is an alignment of the amino acid sequence of Ceres Clone 38311 (SEQ ID NO:1285) with homologous and/or orthologous amino acid sequences CeresClone:19561 (SEQ ID NO:1957), gi|33320073 (SEQ ID NO:1959), CeresClone:597624 (SEQ ID NO:1958), CeresClone:331400 (SEQ ID NO:1961), CeresClone:705041 (SEQ ID NO:1960), and gi|50932645 (SEQ ID NO:1962).

FIG. 78 is an alignment of the amino acid sequence of cDNA ID 23365746 (Ceres CLONE ID no. 109490; SEQ ID NO:1294) with homologous and/or orthologous amino acid sequences CeresClone:475016 (SEQ ID NO:1976), CeresClone:1571937 (SEQ ID NO:1977), and gi|34907424 (SEQ ID NO:1978).

FIG. 79 is an alignment of the amino acid sequence of Ceres Clone 124720 (SEQ ID NO:1302) with homologous and/or orthologous amino acid sequences CeresClone: 975672 (SEQ ID NO:1303), CeresClone:1044385 (SEQ ID NO:1304), gi|55419650 (SEQ ID NO:1305), gi|56384582 (SEQ ID NO:1306), gi|57012880 (SEQ ID NO:1307), gi|50929507 (SEQ ID NO:1308), and CeresClone:273307 (SEQ ID NO:1309).

FIG. 80 is an alignment of the amino acid sequence of cDNA ID 23740209 (Ceres CLONE ID no. 208429; SEQ ID NO:1315) with homologous and/or orthologous amino acid sequences CeresClone:471377 (SEQ ID NO:1985), CeresClone:207075 (SEQ ID NO:1982), gi|21554154 (SEQ ID NO:1983), gi|9759080 (SEQ ID NO:1984), CeresClone: 617111 (SEQ ID NO:1981), and gi|50940237 (SEQ ID NO:1980).

FIG. 81 is an alignment of the amino acid sequence of Ceres Clone 225321 (SEQ ID NO:1323) with homologous and/or orthologous amino acid sequences gi|1429228 (SEQ ID NO:1945), CeresClone:8364 (SEQ ID NO:1944), CeresClone:530235 (SEQ ID NO:1943), gi|57899877 (SEQ ID NO:1942), CeresClone:1541168 (SEQ ID NO:1939), gi|55585039 (SEQ ID NO:1941), and CeresClone:699465 (SEQ ID NO:1940).

FIG. 82 is an alignment of the amino acid sequence of Ceres Clone 333753 (SEQ ID NO:1333) with homologous and/or orthologous amino acid sequences gi|50726318 (SEQ ID NO:1950) and gi|17017392 (SEQ ID NO:1949).

FIG. 83 is an alignment of the amino acid sequence of Ceres Clone 475689 (SEQ ID NO:1345) with homologous and/or orthologous amino acid sequences gi|50251896 (SEQ ID NO:1970), CeresClone:783774 (SEQ ID NO:1968), gi|37544703 (SEQ ID NO:1969), CeresClone:1151902 (SEQ ID NO:1964), gi|10636051 (SEQ ID NO:1965), gi|22324807 (SEQ ID NO:1963), gi|14270085 (SEQ ID NO:1971), gi|2290532 (SEQ ID NO:1967), and gi|6752886 (SEQ ID NO:1966).

FIG. 85 is an alignment of the amino acid sequence of cDNA ID 23402435 (Ceres CLONE ID no. 597624; SEQ ID NO:1371) with homologous and/or orthologous amino acid sequences gi|33320073 (SEQ ID NO:1288) and gi|15810645.

FIG. 88 is an alignment of the amino acid sequence of cDNA ID 23449314 (Ceres CLONE ID no. 120302; SEQ ID NO:1395) with homologous and/or orthologous amino acid sequences CeresClone:1459729 (SEQ ID NO:2032), gi|56749359 (SEQ ID NO:2019), gi|1167484 (SEQ ID NO:2027), gi|50726662 (SEQ ID NO:2028), gi|19053 (SEQ ID NO:2029), gi|47680445 (SEQ ID NO:2033), gi|39725415 (SEQ ID NO:2025), gi|31980095 (SEQ ID NO:2026), and gi|13346194 (SEQ ID NO:2023).

FIG. 89 is an alignment of the amino acid sequence of Ceres Clone 12071 (SEQ ID NO:1405) with homologous and/or orthologous amino acid sequences gi|55419652 (SEQ ID NO:1406), gi|1183866 (SEQ ID NO:1407), CeresClone: 538817 (SEQ ID NO:1408), gi|30577630 (SEQ ID NO:1409), and gi|62856979 (SEQ ID NO:2059).

FIG. 90 is an alignment of the amino acid sequence of Ceres Clone 12997 (SEQ ID NO:1414) with homologous and/or orthologous amino acid sequence CeresClone:465893 (SEQ ID NO:1415).

FIG. 91 is an alignment of the amino acid sequence of Ceres Clone 14246 (SEQ ID NO:1423) with homologous and/or orthologous amino acid sequences gi|3550485 (SEQ ID NO:1424), CeresClone:1537388 (SEQ ID NO:1425), CeresClone:511197 (SEQ ID NO:1426), gi|50934311 (SEQ ID NO:1929), gi|311952 (SEQ ID NO:1926), and gi|20005 (SEQ ID NO:1927).

FIG. 92 is an alignment of the amino acid sequence of CeresClone:149496 (SEQ ID NO:1436) with homologous and/or orthologous amino acid sequences CeresClone: 833872 (SEQ ID NO:1439) and CeresClone:1579587 (SEQ ID NO:1442).

FIG. 94 is an alignment of the amino acid sequence of Ceres Clone 207419 (SEQ ID NO:1465) with homologous and/or orthologous amino acid sequences CeresClone: 212775 (SEQ ID NO:1936) and gi|2597770 (SEQ ID NO:1935).

FIG. 95 is an alignment of the amino acid sequence of Ceres Clone 20769 (SEQ ID NO:1469) with homologous and/or orthologous amino acid sequences CeresClone: 477718 (SEQ ID NO:1937) and CeresClone:518521 (SEQ ID NO:1938).

FIG. 96 is an alignment of the amino acid sequence of CeresClone:21374 (SEQ ID NO:1475) with homologous and/or orthologous amino acid sequence 1471763 (SEQ ID NO:1477).

FIG. 97 is an alignment of the amino acid sequence of cDNA ID 23369680 (Ceres CLONE ID no. 21863; SEQ ID NO:1481) with homologous and/or orthologous amino acid sequences gi|34902106 (SEQ ID NO:1488), CeresClone: 677852 (SEQ ID NO:1490), and CeresClone:637282 (SEQ ID NO:1491).

FIG. 98 is an alignment of the amino acid sequence of cDNA ID 23371050 (Ceres CLONE ID no. 250132; SEQ ID NO:1493) with homologous and/or orthologous amino acid sequences CeresClone:962327 (SEQ ID NO:1494), Ceres-Clone:1101577 (SEQ ID NO:1495), CeresClone:634261 (SEQ ID NO:1496), gi|5031281 (SEQ ID NO:1497), gi|35187687 (SEQ ID NO:1498), gi|34978689 (SEQ ID NO:1499), and gi|34909836 (SEQ ID NO:1500).

FIG. 99 is an alignment of the amino acid sequence of 532H5 (Ceres CLONE ID no. 251466; SEQ ID NO:1504) with homologous and/or orthologous amino acid sequences gi|50253268 (SEQ ID NO:1505), gi|45826359 (SEQ ID NO:1506), gi|45826360 (SEQ ID NO:1507), gi|37993864 (SEQ ID NO:1508), CeresClone:707775 (SEQ ID NO:1509), gi|38257023 (SEQ ID NO:1510), gi|37147896 (SEQ ID NO:1511), gi|41351817 (SEQ ID NO:1512), gi|55824656 (SEQ ID NO:1513), gi|66269671 (SEQ ID NO:1514), gi|33638194 (SEQ ID NO:1515), and gi|21908034 (SEQ ID NO:1516).

FIG. 100 is an alignment of the amino acid sequence of Ceres Clone 25795 (SEQ ID NO:1518) with homologous and/or orthologous amino acid sequence CeresClone: 1104601.

FIG. 101 is an alignment of the amino acid sequence of CeresClone:26867 (SEQ ID NO:1526) with homologous and/or orthologous amino acid sequence Annot ID:1486918 (SEQ ID NO:1528).

FIG. 102 is an alignment of the amino acid sequence of cDNA ID 23792467 (Ceres CLONE ID no. 325800; SEQ ID NO:1540) with homologous and/or orthologous amino acid sequences gi|4519671, gi|32470645, CeresClone:677527, CeresClone:537360, and gi|4835766.

FIG. 103 is an alignment of the amino acid sequence of cDNA ID 23377150 (Ceres CLONE ID no. 33333; SEQ ID NO:1552) with homologous and/or orthologous amino acid sequences CeresClone:543289 (SEQ ID NO:2036), gi|30575840 (SEQ ID NO:2034), and gi|22795039 (SEQ ID NO:2035).

FIG. 105 is an alignment of the amino acid sequence of ME LINE ME01130 (Ceres CLONE ID no. 34589; SEQ ID NO:1570) with homologous and/or orthologous amino acid sequence CeresClone:975220 (SEQ ID NO:1979).

FIG. 106 is an alignment of the amino acid sequence of Ceres Clone 36272 (SEQ ID NO:1573) with homologous and/or orthologous amino acid sequences CeresClone: 573215 (SEQ ID NO:1955), CeresClone:474481 (SEQ ID NO:1956), gi|1922964 (SEQ ID NO:1954), gi|6289057 (SEQ ID NO:1953), CeresClone:1911 (SEQ ID NO:1951), and gi|23505813 (SEQ ID NO:1952).

FIG. 107 is an alignment of the amino acid sequence of cDNA ID 23814706 (Ceres CLONE ID no. 397320; SEQ ID NO:1585) with homologous and/or orthologous amino acid sequences gi|37991859 (SEQ ID NO:2055), CeresClone: 327449 (SEQ ID NO:2054), CeresClone:476445 (SEQ ID NO:2053), CeresClone:1066463 (SEQ ID NO:2052), Ceres-Clone:1349 (SEQ ID NO:2046), and CeresClone:1099781 (SEQ ID NO:2051).

FIG. 108 is an alignment of the amino acid sequence of CeresClone:41439 (SEQ ID NO:1595) with homologous and/or orthologous amino acid sequences CeresClone: 701379 (SEQ ID NO:1602) and CeresClone:638614 (SEQ ID NO:1604).

FIG. 109 is an alignment of the amino acid sequence of Ceres CLONE ID no. 42530 (SEQ ID NO:1610) with homologous and/or orthologous amino acid sequences CeresClone:30700 (SEQ ID NO:2068), gi|19698881 (SEQ ID NO:2070), gi|25809054 (SEQ ID NO:2083), gi|2119932 (SEQ ID NO:2076), gi|19697 (SEQ ID NO:2071), gi|475216 (SEQ ID NO:2073), and gi|2119933 (SEQ ID NO:2080).

FIG. 110 is an alignment of the amino acid sequence of Ceres Clone 45 (SEQ ID NO:1620) with homologous and/or orthologous amino acid sequences CeresClone:962327 (SEQ ID NO:1621) and CeresClone:1360570 (SEQ ID NO:1622).

FIG. 111 is an alignment of the amino acid sequence of Ceres Clone 560731 (SEQ ID NO:1628) with homologous and/or orthologous amino acid sequences CeresClone:4267 (SEQ ID NO:1972) and CeresClone:1377336 (SEQ ID NO:1973).

FIG. 112 is an alignment of the amino acid sequence of Ceres Clone 6397 (SEQ ID NO:1637) with homologous and/or orthologous amino acid sequences gi|57012876 (SEQ ID NO:1645) and gi|3342211 (SEQ ID NO:1651).

FIG. 113 is an alignment of the amino acid sequence of CeresClone:660003 (SEQ ID NO:1653) with homologous and/or orthologous amino acid sequences CeresClone: 763852 (SEQ ID NO:1655) and Annot ID:1508184 (SEQ ID NO:1657).

FIG. 114 is an alignment of the amino acid sequence of CeresClone:681088 (SEQ ID NO:1661) with homologous and/or orthologous amino acid sequence Annot ID:1471330 (SEQ ID NO:1663).

FIG. 116 is an alignment of the amino acid sequence of cDNA ID 23380615 (Ceres CLONE ID no. 7559; SEQ ID NO:1681) with homologous and/or orthologous amino acid sequences CeresClone:844350 (SEQ ID NO:1685), gi|52140009 (SEQ ID NO:1686), CeresClone:298172 (SEQ ID NO:1687), gi|52140013 (SEQ ID NO:1688), CeresClone: 541062 (SEQ ID NO:1689), gi|52140015 (SEQ ID NO:1690), and gi|52140010 (SEQ ID NO:2006).

FIG. 117 is an alignment of the amino acid sequence of CeresClone:92102 (SEQ ID NO:1692) with homologous and/or orthologous amino acid sequences CeresClone: 965028, gi|45642990, gi|40060531, gi|38260618, and Ceres-Clone:548557.

FIG. 118 is an alignment of the amino acid sequence of ME05220 (Ceres CLONE ID no. 968026; SEQ ID NO:1698)

with homologous and/or orthologous amino acid sequences CeresClone:596510 (SEQ ID NO:2057) and gi|28466913 (SEQ ID NO:2056).

FIG. 119 is an alignment of the amino acid sequence of cDNA ID 23498685 5109H3 (Ceres ANNOT ID no. 552542; SEQ ID NO:1722) with homologous and/or orthologous amino acid sequences CeresClone:727056 (SEQ ID NO:1996), gi|52077327 (SEQ ID NO:1993), CeresClone:1548279 (SEQ ID NO:1995), and CeresClone:1044645 (SEQ ID NO:1994).

FIG. 120 is an alignment of the amino acid sequence of cDNA ID 23653450 5109C6 (Ceres ANNOT ID no. 574705; SEQ ID NO:1728) with homologous and/or orthologous amino acid sequences gi|50938747 (SEQ ID NO:1729), CeresClone:458156 (SEQ ID NO:1730), and CeresClone:918824 (SEQ ID NO:1731).

Figure 121:
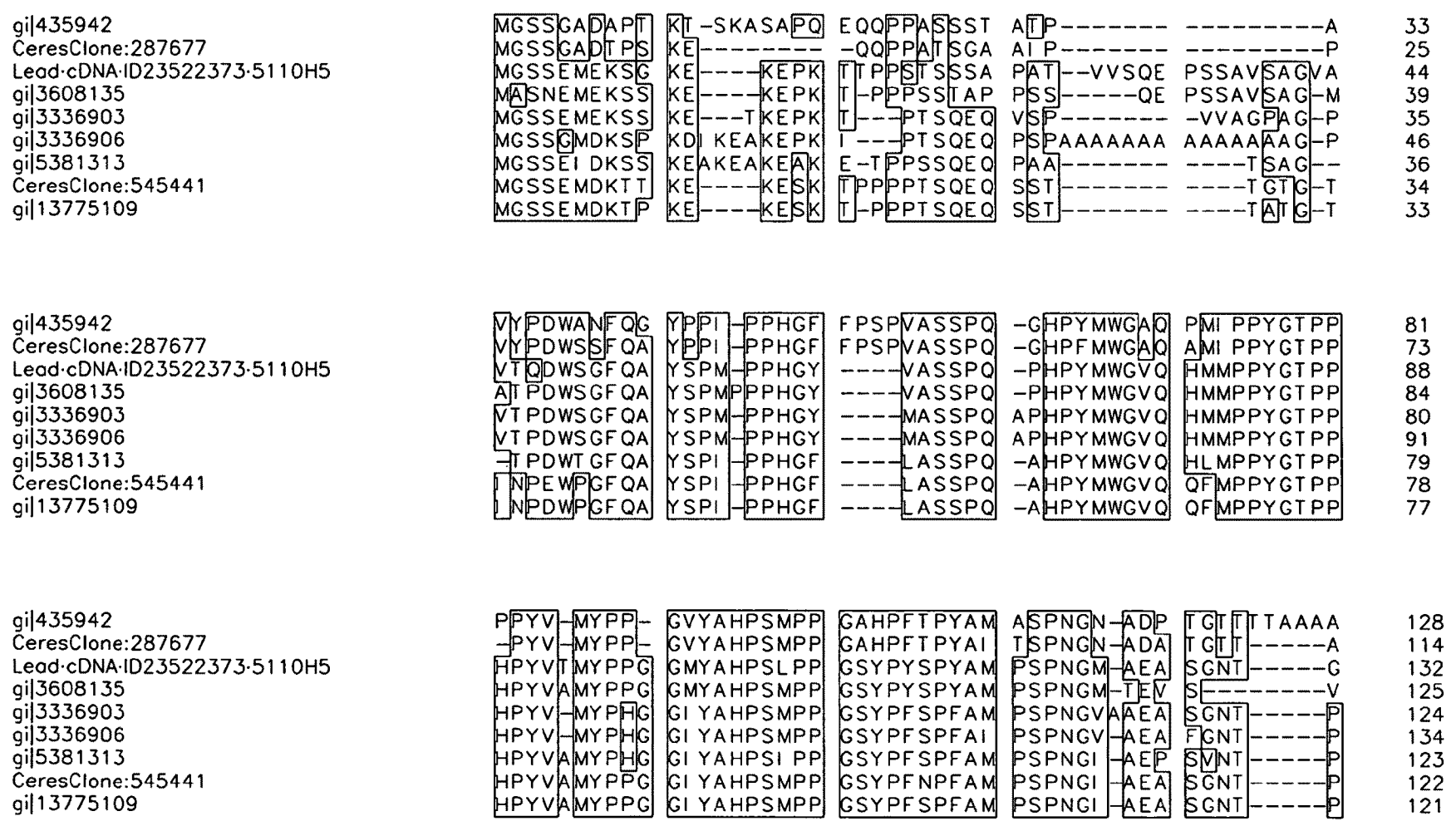
Figure 121:
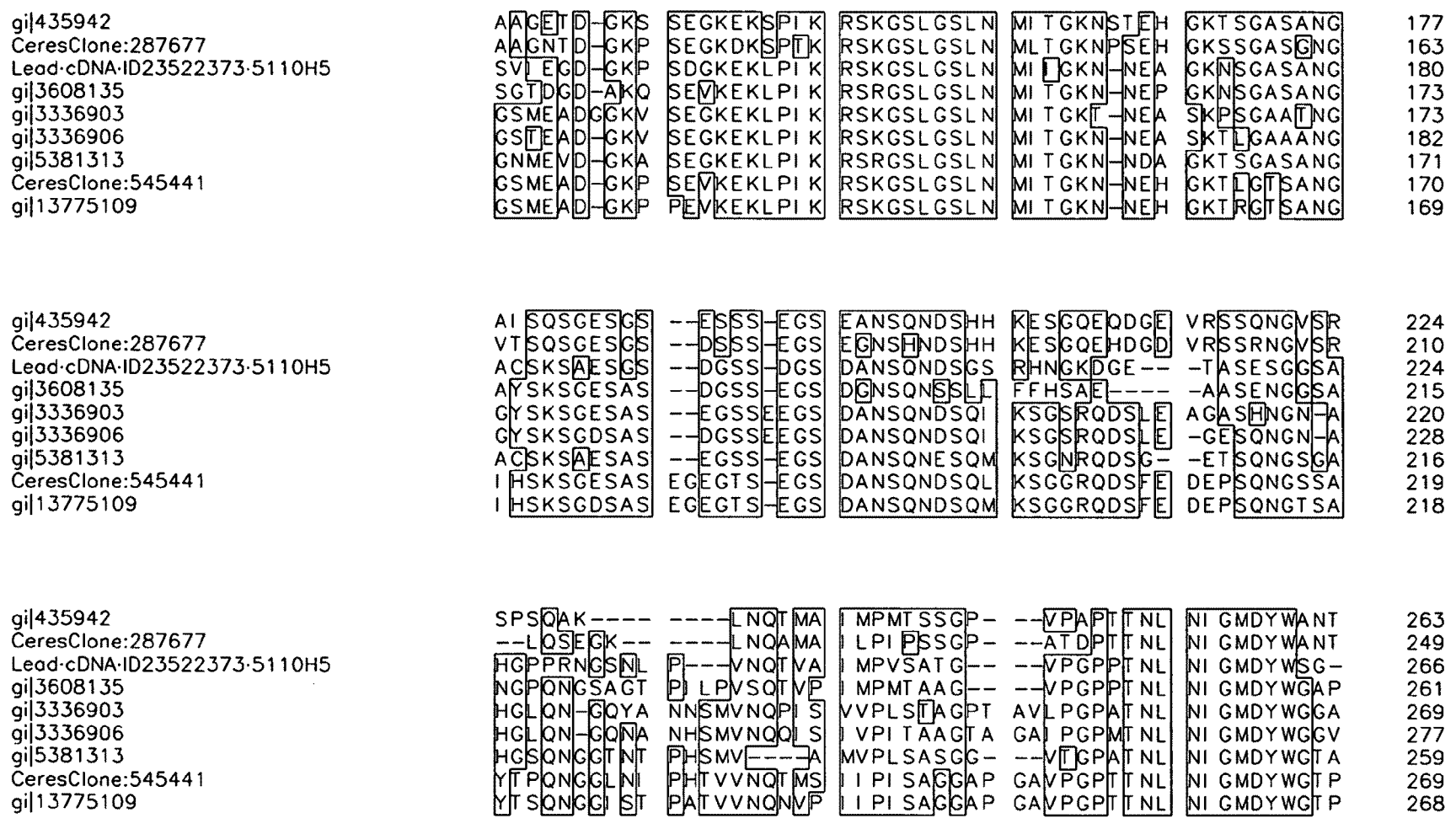
Figure 121:
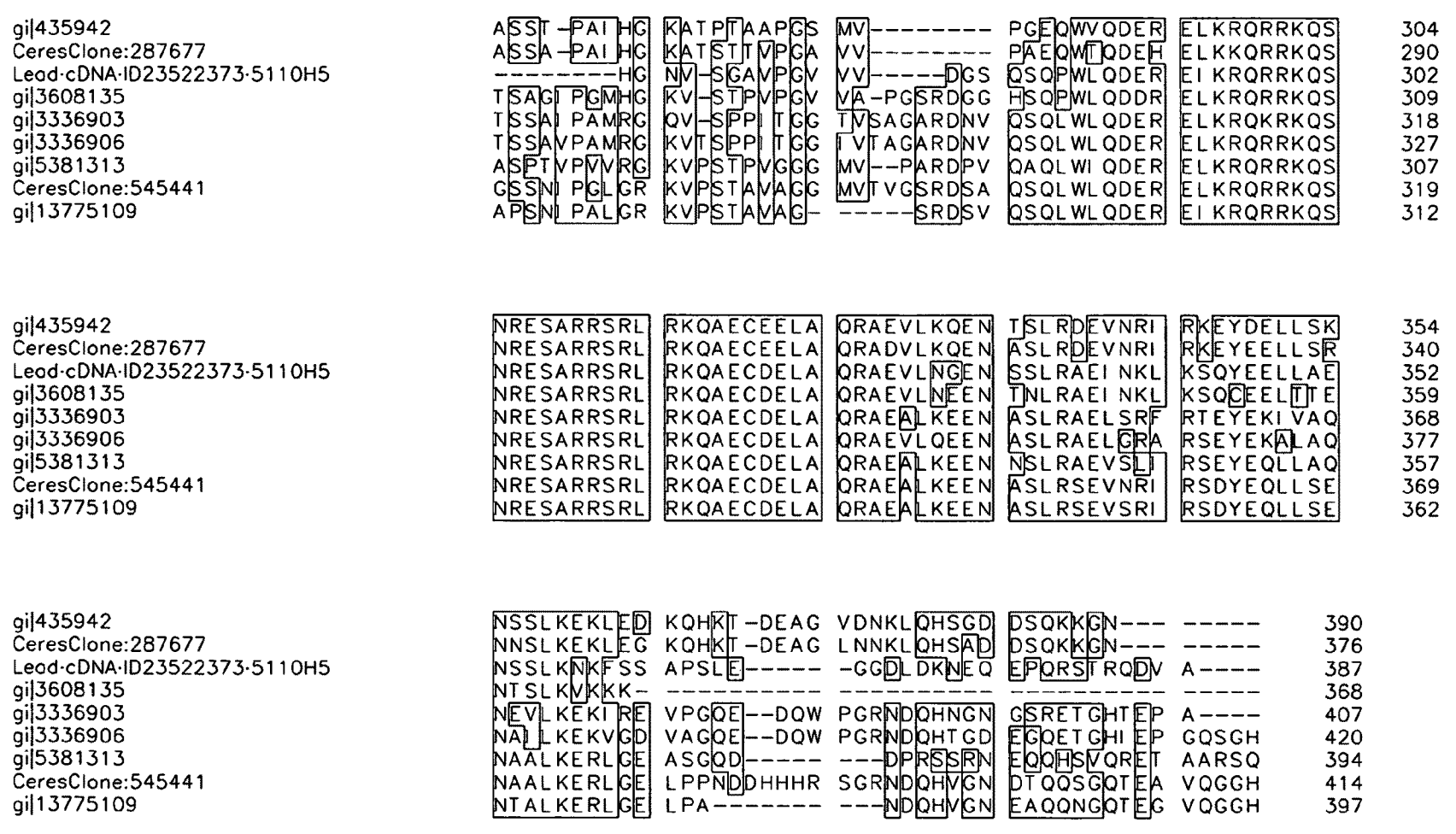

FIG. 121 is an alignment of the amino acid sequence of cDNA ID 23522373 5110H5 (Ceres ANNOT ID no. 834509; SEQ ID NO:1735) with homologous and/or orthologous amino acid sequences gi|3608135 (SEQ ID NO:1736), gi|3336903 (SEQ ID NO:1738), CeresClone:545441 (SEQ ID NO:1739), gi|5381313 (SEQ ID NO:1740), gi|3336906 (SEQ ID NO:1741), gi|13775109 (SEQ ID NO:1742), gi|435942 (SEQ ID NO:1743), and CeresClone:287677 (SEQ ID NO:1746).

Figure 122:
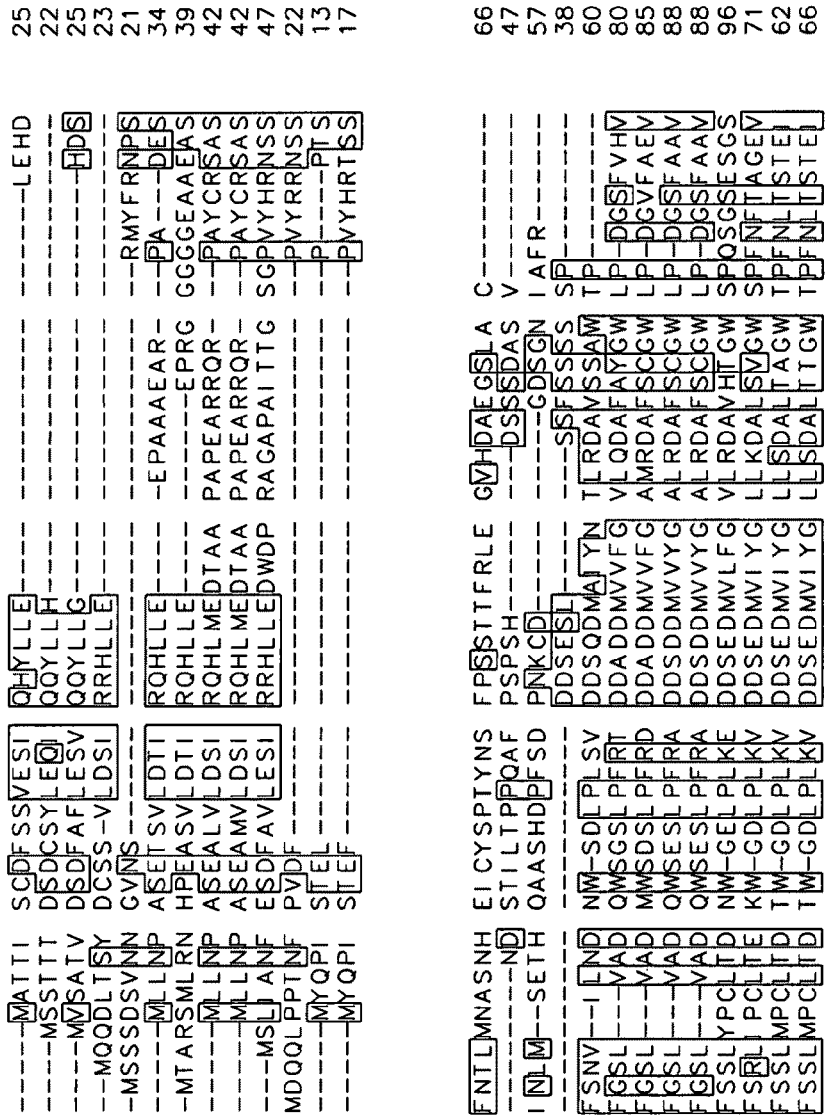

FIG. 122 is an alignment of the amino acid sequence of cDNA ID 23401690 (Ceres CLONE ID no. 603410; SEQ ID NO:1752) with homologous and/or orthologous amino acid sequences CeresClone:605218 (SEQ ID NO:1753), gi|57012759 (SEQ ID NO:1754), CeresClone:6397 (SEQ ID NO:1755), CeresClone:282666 (SEQ ID NO:1756), gi|32401273 (SEQ ID NO:1757), CeresClone:592713 (SEQ ID NO:1758), gi|3342211 (SEQ ID NO:1759), gi|57012876 (SEQ ID NO:1760), CeresClone:555364 (SEQ ID NO:1761), CeresClone:944101 (SEQ ID NO:1762), CeresClone:569593 (SEQ ID NO:1763), and gi|50927517 (SEQ ID NO:1764).

Figure 123:
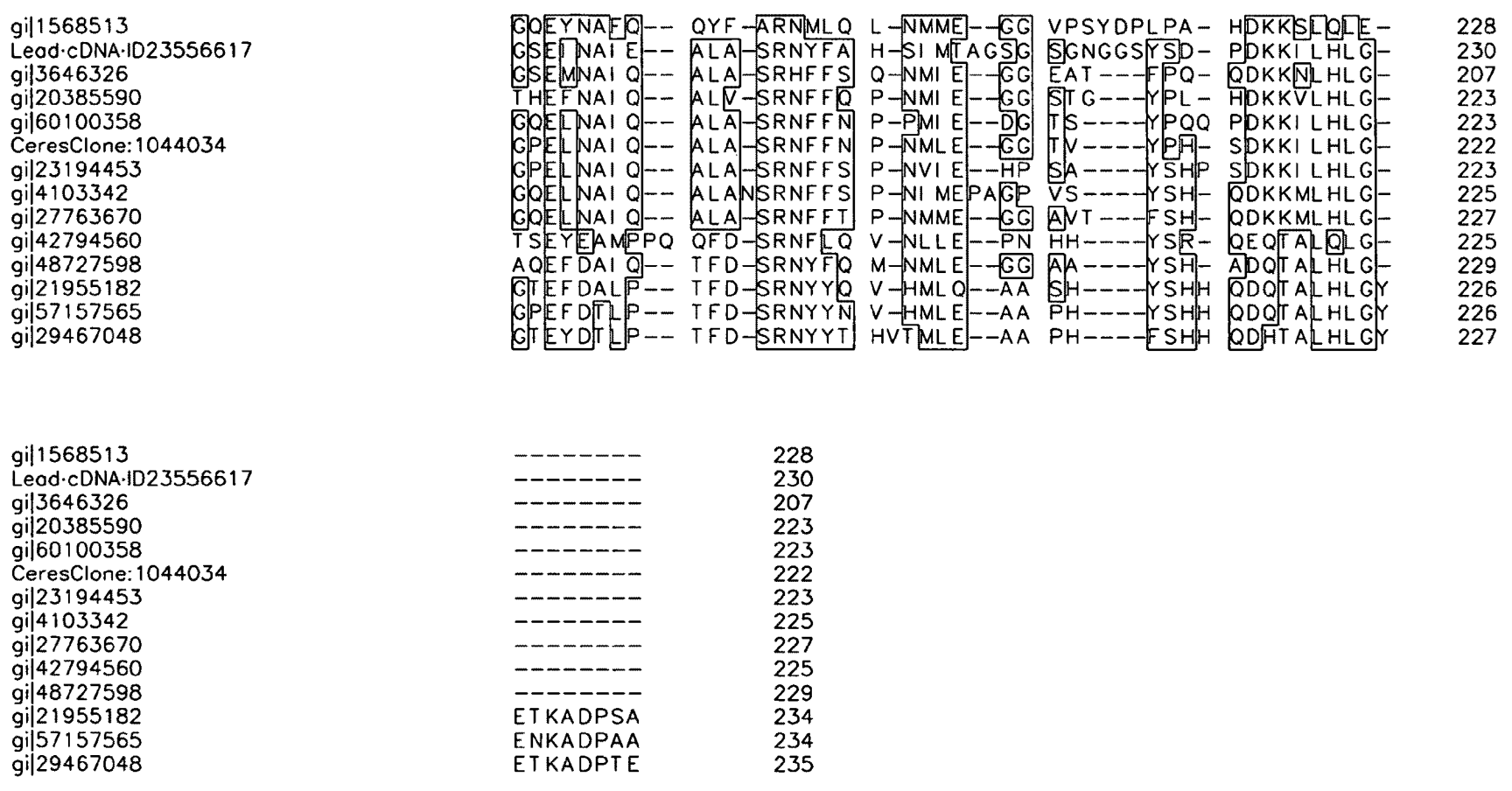

FIG. 123 is an alignment of the amino acid sequence of cDNA ID 23556617 (Ceres CLONE ID no. 32791; SEQ ID NO:1767) with homologous and/or orthologous amino acid sequences gi|1568513 (SEQ ID NO:1769), gi|20385590 (SEQ ID NO:1770), gi|27763670 (SEQ ID NO:1771), gi|60100358 (SEQ ID NO:1772), gi|48727598 (SEQ ID NO:1774), gi|21955182 (SEQ ID NO:1775), gi|3646326 (SEQ ID NO:1998), CeresClone:1044034 (SEQ ID NO:1999), gi|23194453 (SEQ ID NO:1997), gi|4103342 (SEQ ID NO:2000), gi|42794560 (SEQ ID NO:2003), gi|57157565 (SEQ ID NO:2002), and gi|29467048 (SEQ ID NO:2004).

FIG. 124 is an alignment of the amino acid sequence of CeresClone:541719 (SEQ ID NO:1779) with homologous and/or orthologous amino acid sequence Annot ID:1535677 (SEQ ID NO:1783).

FIG. 125 is an alignment of the amino acid sequence of cDNA ID 23557650 (Ceres CLONE ID no. 8607; SEQ ID NO:1785) with homologous and/or orthologous amino acid sequences CeresClone:1033993 (SEQ ID NO:1786), CeresClone:703180 (SEQ ID NO:1787), CeresClone:560681 (SEQ ID NO:1788), CeresClone:560948 (SEQ ID NO:1790), CeresClone:653656 (SEQ ID NO:1792), gi|50929085 (SEQ ID NO:1794), gi|50912765 (SEQ ID NO:1795), CeresClone:503296 (SEQ ID NO:1796), and CeresClone:486120 (SEQ ID NO:1797).

FIG. 126 is an alignment of the amino acid sequence of CeresClone:519 (SEQ ID NO:1806) with homologous and/or orthologous amino acid sequences CeresClone:951040 (SEQ ID NO:1811), CeresClone:703180 (SEQ ID NO:1814), and 1247092 (SEQ ID NO:1820).

FIG. 127 is an alignment of the amino acid sequence of CeresClone:106887 (SEQ ID NO:1832) with homologous and/or orthologous amino acid sequence 1796871 (SEQ ID NO:1834).

FIG. 128 is an alignment of the amino acid sequence of CeresClone:25793 (SEQ ID NO:1854) with homologous and/or orthologous amino acid sequence CeresClone:1881639 (SEQ ID NO:1856).

FIG. 129 is an alignment of the amino acid sequence of Annot ID:1493072 (SEQ ID NO:1892) with homologous and/or orthologous amino acid sequences gi|39725413 (SEQ ID NO:1894) and gi|71041096 (SEQ ID NO:1895).

FIG. 130 is an alignment of the amino acid sequence of CeresClone:5398 (SEQ ID NO:1897) with homologous and/or orthologous amino acid sequences CeresClone:1836567 (SEQ ID NO:1899), 1458988 (SEQ ID NO:1901), and gi|92899044 (SEQ ID NO:1902).

FIG. 131 is an alignment of the amino acid sequence of cDNA ID 23367406 (Ceres CLONE ID no. 9325; SEQ ID NO:1906) with homologous and/or orthologous amino acid sequences gi|7443216, CeresClone:982579 (SEQ ID NO:2045), gi|11133887 (SEQ ID NO:2041), CeresClone:1139782 (SEQ ID NO:2042), gi|42569485 (SEQ ID NO:2044), gi|21133 (SEQ ID NO:2040), CeresClone:1063835 (SEQ ID NO:2038), CeresClone:1027529 (SEQ ID NO:2039), and CeresClone:142681 (SEQ ID NO:2037).

DETAILED DESCRIPTION

Applicants have identified regulatory proteins (e.g., transcription factors) that are "associated" with regulatory regions (e.g., promoters) of genes encoding enzymes involved in lignin biosynthesis. A regulatory protein and a regulatory region are considered to be "associated" when the regulatory protein is capable of modulating expression, either directly or indirectly, of a nucleic acid operably linked to the regulatory region. For example, a regulatory protein and a regulatory region can be said to be associated when the regulatory protein directly binds to the regulatory region, as in a transcription factor-promoter complex. In some cases, a regulatory protein and regulatory region can be said to be associated when the regulatory protein does not directly bind to the regulatory region. A regulatory protein and a regulatory region can also be said to be associated when the regulatory protein indirectly affects transcription by being a component of a protein complex involved in transcriptional regulation or by noncovalently binding to a protein complex involved in transcriptional regulation. In some cases, a regulatory protein and regulatory region can be said to be associated and indirectly affect transcription when the regulatory protein participates in or is a component of a signal transduction cascade or a proteasome degradation pathway (e.g., of repressors) that results in transcriptional amplification or repression. In some cases, regulatory proteins associate with regulatory regions and indirectly affect expression by, e.g., binding to methylated DNA, unwinding chromatin, or binding to RNA.

Knowledge of associations between regulatory proteins and regulatory regions can be used to create plant cells and plants having modulated levels of expression of a sequence of interest, such as a sequence comprising a coding sequence for an enzyme involved in lignin biosynthesis. For example, plant cells and plants can be created that contain a nucleic acid encoding a regulatory protein that is associated with an endogenous regulatory region of an endogenous gene encoding an enzyme involved in lignin biosynthesis. The regulatory protein can modulate expression of the endogenous gene operably linked to the associated, endogenous regulatory region. In some embodiments, plant cells and plants can be created that contain (1) a nucleic acid encoding a regulatory protein, and (2) a nucleic acid including a regulatory region that is associated with the regulatory protein and that is operably linked to a sequence of interest. Thus, a regulatory protein can modulate expression of any sequence of interest operably linked to an associated regulatory region.

Selective modulation of the expression of a sequence of interest, such as a sequence encoding a polypeptide involved in lignin biosynthesis, can allow biosynthetic pathways, such as the lignin biosynthesis pathway, to be manipulated. In addition, the use of regulatory protein-regulatory region associations in plants can permit selective modulation of the amount or rate of biosynthesis of plant polypeptides, e.g., enzymes involved in lignin biosynthesis, and plant compounds, e.g., lignin monomers and polymers, under a desired environmental condition or in a desired plant developmental pathway.

Polypeptides

The term "polypeptide" as used herein refers to a compound of two or more subunit amino acids, amino acid analogs, or other peptidomimetics, regardless of post-translational modification, e.g., phosphorylation or glycosylation. The subunits may be linked by peptide bonds or other bonds such as, for example, ester or ether bonds. The term "amino acid" refers to natural and/or unnatural or synthetic amino acids, including D/L optical isomers. Full-length proteins, analogs, mutants, and fragments thereof are encompassed by this definition.

The term "isolated" with respect to a polypeptide refers to a polypeptide that has been separated from cellular components that naturally accompany it. Typically, the polypeptide is isolated when it is at least 60%, e.g., 70%, 80%, 90%, 95%, or 99%, by weight, free from polypeptides and naturally occurring organic molecules that are naturally associated with it. In general, an isolated polypeptide will yield a single major band on a reducing and/or non-reducing polyacrylamide gel. Isolated polypeptides can be obtained, for example, by extraction from a natural source (e.g., plant tissue), chemical synthesis, or by recombinant production in a host plant cell. To recombinantly produce a polypeptide, a nucleic acid sequence containing a nucleotide sequence encoding a polypeptide of interest can be ligated into an expression vector and used to transform a bacterial, eukaryotic, or plant host cell, e.g., insect, yeast, mammalian, or plant cells. The expressed polypeptide can be extracted from the host cells and purified using techniques known to those of skill in the art.

Polypeptides described herein include regulatory proteins. Such a regulatory protein typically is effective for modulating expression of a nucleic acid sequence operably linked to an associated regulatory region (e.g., an associated promoter) when expressed in a plant or plant cell. Modulation of expression of a nucleic acid sequence can be either an increase or a decrease in expression of the nucleic acid sequence relative to the average rate or level of expression of the nucleic acid sequence in a control plant. Such polypeptides typically contain at least one domain indicative of regulatory proteins, as described in more detail herein. Regulatory proteins typically have an HMM bit score that is greater than about 25, as described in more detail herein. In some embodiments, regulatory proteins have greater than 30% identity to SEQ ID NOs:96, 106, 119, 134, 149, 165, 178, 221, 339, 357, 361, 374, 381, 417, 432, 438, 445, 461, 465, 490, 504, 520, 526, 529, 548, 555, 566, 585, 590, 601, 614, 638, 652, 661, 671, 680, 686, 689, 695, 698, 703, 707, 730, 737, 744, 760, 781, 793, 808, 816, 838, 852, 865, 885, 900, 914, 938, 964, 980, 994, 1052, 1064, 1083, 1096, 1104, 1131, 1136, 1165, 1185, 1211, 1239, 1249, 1259, 1267, 1285, 1294, 1302, 1315, 1323, 1333, 1345, 1361, 1371, 1377, 1383, 1395, 1405, 1414, 1423, 1436, 1444, 1465, 1469, 1475, 1481, 1493, 1504, 1518, 1526, 1540, 1552, 1564, 1570, 1573, 1585, 1595, 1610, 1620, 1628, 1637, 1653, 1661, 1675, 1681, 1692, 1698, 1722, 1728, 1735, 1752, 1767, 1779, 1785, 1806, 1832, 1854, 1892, 1897, and 1906, as described in more detail herein.

In some embodiments, one or more functional homologs of a reference regulatory protein defined by one or more of the pfam descriptions indicated herein are suitable for use as regulatory proteins. A functional homolog is a polypeptide that has sequence similarity to a reference polypeptide, and that carries out one or more of the biochemical or physiological function(s) of the reference polypeptide. A functional homolog and the reference polypeptide may be natural occurring polypeptides, and the sequence similarity may be due to convergent or divergent evolutionary events. As such, functional homologs are sometimes designated in the literature as homologs, or orthologs, or paralogs. Variants of a naturally occurring functional homolog, such as polypeptides encoded by mutants of a wild type coding sequence, may themselves be functional homologs. Functional homologs can also be created via site-directed mutagenesis of the coding sequence for a regulatory protein, or by combining domains from the coding sequences for different naturally-occurring regulatory proteins ("domain swapping"). The term "functional homolog" is sometimes applied to the nucleic acid that encodes a functionally homologous polypeptide.

Functional homologs can be identified by analysis of nucleotide and polypeptide sequence alignments. For example, performing a query on a database of nucleotide or polypeptide sequences can identify homologs of regulatory proteins. Sequence analysis can involve BLAST, Reciprocal BLAST, or PSI-BLAST analysis of nonredundant databases using a regulatory protein amino acid sequence as the reference sequence. Amino acid sequence is, in some instances, deduced from the nucleotide sequence. Those polypeptides in the database that have greater than 40% sequence identity are candidates for further evaluation for suitability as a regulatory protein. Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have domains present in regulatory proteins, e.g., conserved functional domains.

Conserved regions can be identified by locating a region within the primary amino acid sequence of a regulatory protein that is a repeated sequence, forms some secondary structure (e.g., helices and beta sheets), establishes positively or negatively charged domains, or represents a protein motif or domain. See, e.g., the Pfam web site describing consensus sequences for a variety of protein motifs and domains on the World Wide Web at sanger.ac.uk/Software/Pfam/ and pfam.janelia.org/. A description of the information included at the Pfam database is described in Sonnhammer et al., *Nucl. Acids Res.*, 26:320-322 (1998); Sonnhammer et al., *Proteins*, 28:405-420 (1997); and Bateman et al., *Nucl. Acids Res.*, 27:260-262 (1999). Conserved regions also can be determined by aligning sequences of the same or related polypeptides from closely related species. Closely related species preferably are from the same family. In some embodiments, alignment of sequences from two different species is adequate.

Typically, polypeptides that exhibit at least about 40% amino acid sequence identity are useful to identify conserved regions. Conserved regions of related polypeptides exhibit at least 45% amino acid sequence identity (e.g., at least 50%, at least 60%, at least 70%, at least 80%, or at least 90% amino acid sequence identity). In some embodiments, a conserved region exhibits at least 92%, 94%, 96%, 98%, or 99% amino acid sequence identity.

A regulatory protein can have one or more zinc finger domains. Zinc finger domains are found in numerous nucleic acid-binding polypeptides. A zinc finger domain is composed of about 25 to 30 amino acid residues, typically including two conserved cysteine (C) and two conserved histidine (H) residues in a C-2-C-12-H-3-H type motif. The 12 residues separating the second cysteine and the first histidine are mainly polar and basic, implicating this region, in particular, in nucleic acid binding. The zinc finger motif is a small, self-folding domain in which zinc is a crucial component of the tertiary structure. Zinc finger domains bind one atom of zinc in a tetrahedral array to yield a finger-like projection, which interacts with nucleotides in the major groove of a nucleic acid. The zinc atom binds to the conserved cysteine and histidine residues. Zinc fingers have been found to bind to about five base pairs of nucleic acid containing short runs of guanine residues. Zinc fingers can bind to RNA and DNA, and it has been suggested that the zinc finger may thus represent the original nucleic acid binding polypeptide. It has also been suggested that a zinc-centered domain can be used in a polypeptide interaction, e.g., in protein kinase C. Many classes of zinc fingers are characterized according to the number and positions of the histidine and cysteine residues involved in the zinc atom coordination. In the C2H2 class, for example, the first pair of zinc coordinating residues are cysteines, while the second pair are histidines.

In some cases, a regulatory protein can contain a zf-C3HC4 domain characteristic of a C3HC4 type (RING finger) zinc-finger polypeptide. The RING finger is a specialized type of zinc-finger of 40 to 60 residues that binds two atoms of zinc and is reported to be involved in mediating polypeptide-polypeptide interactions. There are two different variants, the C3HC4-type and a C3H2C3-type, which are related despite the different cysteine/histidine pattern. The RING domain has been implicated in diverse biological processes. Ubiquitin-protein ligases (E3s), which determine the substrate specificity for ubiquitylation, have been classified into HECT and RING-finger families. Various RING fingers exhibit binding to E2 ubiquitin-conjugating enzymes. SEQ ID NO:134, SEQ ID NO:161, SEQ ID NO:163, SEQ ID NO:355, SEQ ID NO:405, SEQ ID NO:411, SEQ ID NO:490, SEQ ID NO:529, SEQ ID NO:1165, SEQ ID NO:1481, SEQ ID NO:1628, SEQ ID NO:1858, and SEQ ID NO:1884 set forth the amino acid sequences of DNA clones, identified herein as Ceres ANNOT ID no. 550729 (SEQ ID NO:133), Ceres ANNOT ID no. 829219 (SEQ ID NO:160), Ceres ANNOT ID no. 830468 (SEQ ID NO:162), Ceres CLONE ID no. 110419 (SEQ ID NO:354), Ceres CLONE ID no. 116968 (SEQ ID NO:404), Ceres CLONE ID no. 118756 (SEQ ID NO:410), Ceres CLONE ID no. 156298 (SEQ ID NO:489), Ceres CLONE ID no. 17402 (SEQ ID NO:528), Ceres CLONE ID no. 99033 (SEQ ID NO:1164), Ceres CLONE ID no. 21863 (SEQ ID NO:1480), Ceres CLONE ID no. 560731 (SEQ ID NO:1627), Ceres CLONE ID no. 261272 (SEQ ID NO:1857), and Ceres CLONE ID no. 6163 (SEQ ID NO:1883), respectively, each of which is predicted to encode a polypeptide having a Pfam domain as indicated in the Sequence Listing (e.g., a zf-C3HC4 domain).

In some cases, a regulatory protein can contain a zf-C2H2 domain characteristic of C2H2 type zinc finger transcription factor polypeptides. C2H2 zinc-finger family polypeptides play important roles in plant development including floral organogenesis, leaf initiation, lateral shoot initiation, gametogenesis, and seed development. SEQ ID NO:1060, SEQ ID NO:1136, SEQ ID NO:1595, SEQ ID NO:1822, and SEQ ID NO:1870 set forth the amino acid sequences of DNA clones, identified herein as Ceres CLONE ID no. 560765 (SEQ ID NO:1059), Ceres CLONE ID no. 9804 (SEQ ID NO:1135), Ceres CLONE ID no. 41439 (SEQ ID NO:1594), Ceres ANNOT ID no. 541941 (SEQ ID NO:1821), and Ceres CLONE ID no. 306139 (SEQ ID NO:1869), respectively, each of which is predicted to encode a polypeptide containing a Pfam domain as indicated in the Sequence Listing (e.g., a zf-C2H2 domain).

In some cases, a regulatory protein can contain a zf-CCCH domain characteristic of C-x8-C-x5-C-x3-H type (and similar) zinc finger transcription factor polypeptides. Polypeptides containing zinc finger domains of the C-x8-C-x5-C-x3-H type include zinc finger polypeptides from eukaryotes involved in cell cycle or growth phase-related regulation, e.g., human TIS11B (butyrate response factor 1), a predicted regulatory protein involved in regulating the response to growth factors. Another polypeptide containing this domain is the human splicing factor U2AF 35 kD subunit, which plays a critical role in both constitutive and enhancer-dependent splicing by mediating essential polypeptide-polypeptide interactions and polypeptide-RNA interactions required for 3' splice site selection. It has been shown that different zf-CCCH zinc finger polypeptides interact with the 3' untranslated regions of various mRNAs. SEQ ID NO:1465 and SEQ ID NO:1878 set forth the amino acid sequences of DNA clones, identified herein as Ceres CLONE ID no. 207419 (SEQ ID NO:1464) and Ceres CLONE ID no. 558431 (SEQ ID NO:1877), respectively, each of which is predicted to encode a polypeptide having a Pfam domain as indicated in the Sequence Listing (e.g., a zf-CCCH domain).

In some cases, a regulatory protein can contain a zf-B_box domain characteristic of a B-box zinc finger polypeptide. The B-box zinc finger domain consists of about 40 amino acids. One or two copies of the B-box domain generally are associated with a ring finger and a coiled coil motif to form the so-called tripartite motif. The B-box domain is found in transcription factors, ribonucleoproteins, and proto-oncoproteins. NMR analysis has revealed that the B-box structure comprises two beta-strands, two helical turns, and three extended loop regions that differ from other zinc binding motifs. SEQ ID NO:370 and SEQ ID NO:1722 set forth the amino acid sequences of DNA clones, referred to herein as Ceres CLONE ID no. 112194 (SEQ ID NO:369) and Ceres Annot ID no. 552542 (SEQ ID NO:1721), respectively, each of which is predicted to encode a polypeptide containing a Pfam domain as indicated in the Sequence Listing (e.g., a zf-B_box).

In some cases, a regulatory protein can contain a zf-B_box domain and a CCT motif. The CCT (CONSTANS, CO-like, and TOC1) domain is a highly conserved motif that is rich in basic amino acids. The second half of the CCT motif contains a putative nuclear localization signal and has been shown to be involved in nuclear localization. In addition, the CCT domain may have a role in polypeptide-polypeptide interactions. The CCT domain is found near the C-terminus of plant polypeptides, many of which are involved in light signal transduction. Other domains, such as the B-box zinc finger, the GATA-type zinc finger, the ZIM motif, or the response regulatory domain, are found in association with the CCT domain. SEQ ID NO:1083 and SEQ ID NO:1377 set forth the amino acid sequences of DNA clones, referred to herein as Ceres CLONE ID no. 6639 (SEQ ID NO:1082) and Ceres CLONE ID no. 108109 (SEQ ID NO:1376), respectively, each of which is predicted to encode a polypeptide containing a Pfam domain as indicated in the Sequence Listing (e.g., a zf-B_box and a CCT motif).

In some cases, a regulatory protein can contain a GATA domain characteristic of a GATA zinc finger transcription factor polypeptide. A number of transcription factor polypeptides, including erythroid-specific transcription factor polypeptides and nitrogen regulatory polypeptides, specifically bind the DNA sequence (A/T)GATA(A/G) in the regulatory regions of genes. Such transcription factor polypeptides are therefore termed GATA-binding transcription factors. The interactions occur via highly-conserved zinc finger domains in which the zinc ion is coordinated by four cysteine residues. NMR studies have shown that the core of the zinc finger comprises two irregular anti-parallel beta-sheets and an alpha-helix followed by a long loop to the C-terminal end of the finger. The N-terminus, which includes the helix, is similar in structure, but not sequence, to the N-terminal zinc module of the glucocorticoid receptor DNA binding domain. The helix and the loop connecting the two beta-sheets interact with the major groove of the DNA, while the C-terminal tail wraps around into the minor groove. This tail is the essential determinant of specific binding. Interactions between the zinc finger and DNA are mainly hydrophobic, explaining the preponderance of thymines in the binding site. A large number of interactions with the phosphate backbone have also been observed. Two GATA zinc fingers are found in the GATA transcription factors. However there are several proteins which only contain a single copy of the domain. SEQ ID NO:885 sets forth the amino acid sequence of a DNA clone, identified herein as Ceres CLONE ID no. 41634 (SEQ ID NO:884), that is predicted to encode a polypeptide having a Pfam domain as indicated in the Sequence Listing (e.g., a GATA domain).

In some cases, a regulatory protein containing a GATA domain can also contain a CCT motif described above and a ZIM motif. The ZIM motif is found in a variety of plant transcription factors that contain GATA domains and other motifs. The most conserved amino acids form the pattern TIFF/YXG. The ZIM domain may be involved in DNA binding. SEQ ID NO:1469 sets forth the amino acid sequence of a DNA clone, identified herein as Ceres CLONE ID no. 20769 (SEQ ID NO:1468), that is predicted to encode a polypeptide containing a Pfam domain as indicated in the Sequence Listing (e.g., a GATA domain, a CCT motif, and a ZIM motif).

In some cases, a regulatory protein can contain a zf-AN1 domain characteristic of an AN1-like zinc finger transcription factor polypeptide. The zf-AN1 domain was first identified as a zinc finger at the C-terminus of AN1, a ubiquitin-like polypeptide in *Xenopus laevis*. The following pattern describes the zinc finger: C-X2-C-X(9-12)-C-X(1-2)-C-X4-C-X2-H-X5-H-X-C, where X can be any amino acid, and the numbers in brackets indicate the number of residues. SEQ ID NO:1620 sets forth the amino acid sequence of a DNA clone, identified herein as Ceres CLONE ID no. 45 (SEQ ID NO:1619), that is predicted to encode a polypeptide having a Pfam domain as indicated in the Sequence Listing (e.g., a zf-AN1 domain).

In some cases, a regulatory protein can contain a zf-A20 domain. The zf-A20 domain is a zinc finger domain that is found in an A20 (an inhibitor of cell death) polypeptide and is believed to mediate self-association of an A20 polypeptide. These zinc finger domains also mediate IL-1-induced NF-kappa B activation. SEQ ID NO:1493 sets forth the amino acid sequence of a DNA clone, identified herein as Ceres CLONE ID no. 250132 (SEQ ID NO:1492), that is predicted to encode a polypeptide having a Pfam domain as indicated in the Sequence Listing (e.g., a zf-A20 domain).

In some cases, a regulatory protein can have a zf-AN1 domain described above and a zf-A20 domain described above. SEQ ID NO:445 sets forth the amino acid sequence of a DNA clone, referred to herein as Ceres CLONE ID no. 14203 (SEQ ID NO:444), that is predicted to encode a polypeptide having a Pfam domain as indicated in the Sequence Listing (e.g., a zf-AN1 domain and a zf-A20 domain).

In some cases, a regulatory protein can contain a zf-DHHC domain. The DHHC zinc finger domain, also known as NEW1, is predicted to be a zinc binding domain involved in polypeptide-polypeptide or polypeptide-DNA interactions, and palmitoyltransferase activity. SEQ ID NO:816 and SEQ ID NO:1239 set forth the amino acid sequences of DNA clones, identified herein as Ceres CLONE ID no. 38360 (SEQ ID NO:815) and Ceres CLONE ID no. 19340 (SEQ ID NO:1238), respectively, each of which is predicted to encode a polypeptide containing a Pfam domain as indicated in the Sequence Listing (e.g., a zf-DHHC domain).

In some cases, a regulatory protein can contain a zf-D of domain characteristic of a D of domain zinc finger transcription factor polypeptide. D of (DNA binding with one finger) domain polypeptides are plant-specific transcription factor polypeptides having a highly conserved DNA binding domain. A D of domain is a zinc finger DNA binding domain that resembles the Cys2 zinc finger, although it has a longer putative loop containing an extra Cys residue that is conserved. AOBP, a DNA binding polypeptide in pumpkin (*Cucurbita maxima*), contains a 52 amino acid D of domain, which is highly conserved in several DNA binding polypeptides of higher plants. SEQ ID NO:374 sets forth the amino acid sequence of a DNA clone, identified herein as Ceres CLONE ID no. 113639 (SEQ ID NO:373), that is predicted to encode a polypeptide having a Pfam domain as indicated in the Sequence Listing (e.g., a zf-D of domain).

In some cases, a regulatory protein can contain a zf-U1 domain characteristic of U1 zinc finger polypeptides. The zf-U1 domain is found in several U1 small nuclear ribonucleoprotein C (U1-C) polypeptides. The U1 small nuclear ribonucleoprotein (U1 snRNP) binds to the pre-mRNA 5' splice site at early stages of spliceosome assembly. Recruitment of U1 snRNP to a class of weak 5' splice sites is promoted by binding of a TIA-1 polypeptide to uridine-rich sequences immediately downstream from the 5' splice site. Binding of a TIA-1 polypeptide in the vicinity of a 5' splice site is thought to help stabilize U1 snRNP via a direct interaction with a U1-C polypeptide. It is likely that the zf-U1 domain is a zinc-binding motif. SEQ ID NO:852 sets forth the amino acid sequence of a DNA clone, identified herein as Ceres CLONE ID no. 39855 (SEQ ID NO:851), that is predicted to encode a polypeptide having a Pfam domain as indicated in the Sequence Listing (e.g., a zf-U1 domain).

In some cases, a regulatory protein can contain a zf-MYND, or MYND finger, domain. The MYND (myeloid, Nervy, and DEAF-1) domain is present in a group of proteins that includes RP-8 (PDCD2), Nervy, and predicted proteins from *Drosophila*, mammals, *Caenorhabditis elegans*, yeast, and plants. The MYND domain consists of a cluster of invariantly spaced cysteine and histidine residues that form a potential zinc-binding motif. Mutating conserved cysteine residues in the DEAF-1 MYND domain does not abolish DNA binding, which suggests that the MYND domain might be involved in polypeptide-polypeptide interactions. The MYND domain of ETO/MTG8 interacts directly with the N-CoR and SMRT co-repressors. The MYND motif in mammalian polypeptides appears to constitute a polypeptide-polypeptide interaction domain that functions as a co-repressor-recruiting interface. SEQ ID NO:106 sets forth the amino acid sequence of a DNA clone, identified herein as Ceres ANNOT ID no. 548715 (SEQ ID NO:105), that is predicted to encode a polypeptide containing a Pfam domain as indicated in the Sequence Listing (e.g., a zf-MYND domain).

In some cases, a regulatory protein can contain a zf-RanBP domain characteristic of zinc finger domains in Ran binding polypeptides. Ran is an evolutionary conserved member of the Ras superfamily that regulates receptor-mediated transport between the nucleus and the cytoplasm. Ran binding protein 2 (RanBP2) is a 358 kDa nucleoporin located on the cytoplasmic side of the nuclear pore complex which plays a role in nuclear polypeptide import. RanBP2 contains multiple zinc fingers that mediate binding to RanGDP. SEQ ID NO:1826 sets forth the amino acid sequence of a DNA clone, identified herein as Ceres ANNOT ID no. 566835 (SEQ ID NO:1825), that is predicted to encode a polypeptide containing a Pfam domain as indicated in the Sequence Listing (e.g., a zf-RanBP domain).

In some cases, a regulatory protein can contain a zf-CCHC domain characteristic of a zinc knuckle polypeptide. The zinc knuckle is a zinc binding motif with the sequence CX2CX4HX4C, where X can be any amino acid. The motifs are common to the nucleocapsid polypeptides of retroviruses, and the prototype structure is from HIV. The zinc knuckle family also contains members involved in eukaryotic gene regulation. A zinc knuckle is found in eukaryotic polypeptides involved in RNA binding or single strand DNA binding. SEQ ID NO:1828 sets forth the amino acid sequence of a DNA clone, identified herein as Ceres ANNOT ID no. 841947 (SEQ ID NO:1827), that is predicted to encode a polypeptide having a Pfam domain as indicated in the Sequence Listing (e.g., a zf-CCHC domain).

A regulatory protein can comprise the amino acid sequence set forth in SEQ ID NO:134, SEQ ID NO:161, SEQ ID NO:163, SEQ ID NO:355, SEQ ID NO:405, SEQ ID NO:411, SEQ ID NO:490, SEQ ID NO:529, SEQ ID NO:1165, SEQ ID NO:1481, SEQ ID NO:1628, SEQ ID NO:1858, SEQ ID NO:1884, SEQ ID NO:1060, SEQ ID NO:1136, SEQ ID NO:1595, SEQ ID NO:1822, SEQ ID NO:1870, SEQ ID NO:1465, SEQ ID NO:1878, SEQ ID NO:370, SEQ ID NO:1722, SEQ ID NO:1083, SEQ ID NO:1377, SEQ ID NO:885, SEQ ID NO:1469, SEQ ID NO:1620, SEQ ID NO:1493, SEQ ID NO:445, SEQ ID NO:816, SEQ ID NO:1239, SEQ ID NO:374, SEQ ID NO:852, SEQ ID NO:106, SEQ ID NO:1826, or SEQ ID NO:1828. In some cases, a regulatory protein can be a homolog, ortholog, or variant of the polypeptide having the amino acid sequence set forth in SEQ ID NO:134, SEQ ID NO:161, SEQ ID NO:163, SEQ ID NO:355, SEQ ID NO:405, SEQ ID NO:411, SEQ ID NO:490, SEQ ID NO:529, SEQ ID NO:1165, SEQ ID NO:1481, SEQ ID NO:1628, SEQ ID NO:1858, SEQ ID NO:1884, SEQ ID NO:1060, SEQ ID NO:1136, SEQ ID NO:1595, SEQ ID NO:1822, SEQ ID NO:1870, SEQ ID NO:1465, SEQ ID NO:1878, SEQ ID NO:370, SEQ ID NO:1722, SEQ ID NO:1083, SEQ ID NO:1377, SEQ ID NO:885, SEQ ID NO:1469, SEQ ID NO:1620, SEQ ID NO:1493, SEQ ID NO:445, SEQ ID NO:816, SEQ ID NO:1239, SEQ ID NO:374, SEQ ID NO:852, SEQ ID NO:106, SEQ ID NO:1826, or SEQ ID NO:1828. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:134, SEQ ID NO:161, SEQ ID NO:163, SEQ ID NO:355, SEQ ID NO:405, SEQ ID NO:411, SEQ ID NO:490, SEQ ID NO:529, SEQ ID NO:1165, SEQ ID NO:1481, SEQ ID NO:1628, SEQ ID NO:1858, SEQ ID NO:1884, SEQ ID NO:1060, SEQ ID NO:1136, SEQ ID NO:1595, SEQ ID NO:1822, SEQ ID NO:1870, SEQ ID NO:1465, SEQ ID NO:1878, SEQ ID NO:370, SEQ ID NO:1722, SEQ ID NO:1083, SEQ ID NO:1377, SEQ ID NO:885, SEQ ID NO:1469, SEQ ID NO:1620, SEQ ID NO:1493, SEQ ID NO:445, SEQ ID NO:816, SEQ ID NO:1239, SEQ ID NO:374, SEQ ID NO:852, SEQ ID NO:106, SEQ ID NO:1826, or SEQ ID NO:1828.

Amino acid sequences of homologs and/or orthologs of the polypeptide having the amino acid sequence set forth in SEQ ID NO:134, SEQ ID NO:490, SEQ ID NO:529, SEQ ID NO:1165, SEQ ID NO:1481, SEQ ID NO:1628, SEQ ID NO:1136, SEQ ID NO:1595, SEQ ID NO:1465, SEQ ID NO:1722, SEQ ID NO:1083, SEQ ID NO:1377, SEQ ID NO:885, SEQ ID NO:1469, SEQ ID NO:1620, SEQ ID NO:1493, SEQ ID NO:445, SEQ ID NO:816, SEQ ID NO:1239, SEQ ID NO:374, SEQ ID NO:852, and SEQ ID NO:106 are provided in FIG. 4, FIG. 21, FIG. 25, FIG. 70, FIG. 97, FIG. 111, FIG. 69, FIG. 108, FIG. 94, FIG. 119, FIG. 65, FIG. 86, FIG. 56, FIG. 95, FIG. 110, FIG. 98, FIG. 18, FIG. 51, FIG. 73, FIG. 13, FIG. 54, and FIG. 2, respectively.

For example, the alignment in FIG. 4 provides the amino acid sequences of Annot ID 550729 (SEQ ID NO:134), gi|20340241 (SEQ ID NO:136), CeresClone:473509 (SEQ ID NO:137), CeresAnnot:1525600 (SEQ ID NO:139), CeresClone:1922929 (SEQ ID NO:141), gi|76446335 (SEQ ID NO:146), and gi|37901055 (SEQ ID NO:147). Other homologs and/or orthologs of SEQ ID NO:134 include Public GI no. 15228108 (SEQ ID NO:135), Ceres CLONE ID no. 1841236 (SEQ ID NO:143), and Ceres CLONE ID no. 1931361 (SEQ ID NO:145).

Figure 21:
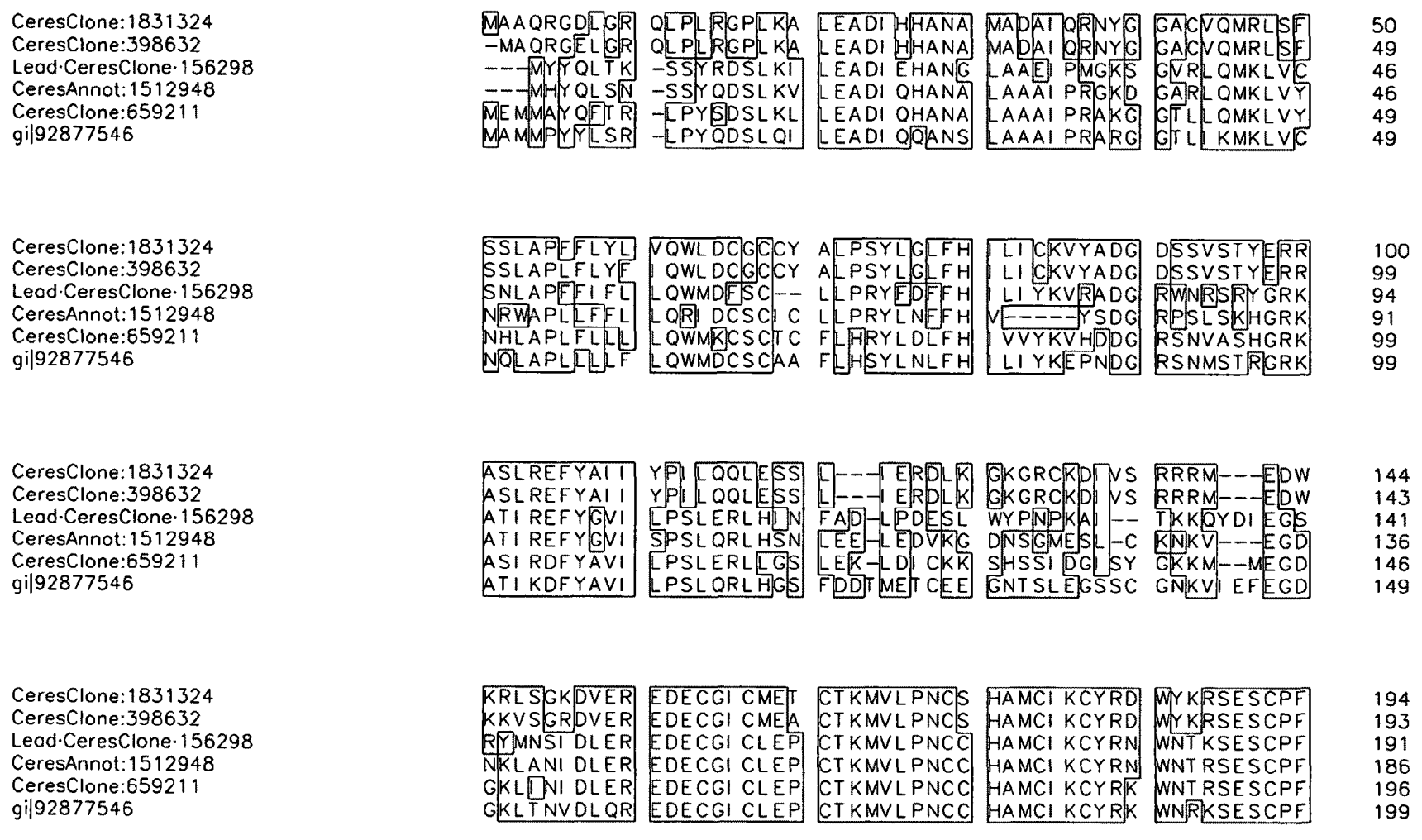

The alignment in FIG. 21 provides the amino acid sequences of Ceres Clone 156298 (SEQ ID NO:490), CeresAnnot:1512948 (SEQ ID NO:492), CeresClone:659211 (SEQ ID NO:497), gi|92877546 (SEQ ID NO:498), CeresClone:1831324 (SEQ ID NO:501), and CeresClone:398632 (SEQ ID NO:502). Other homologs and/or orthologs of SEQ ID NO:490 include Ceres ANNOT ID no. 1459679 (SEQ ID NO:494), Ceres ANNOT ID no. 1463114 (SEQ ID NO:496), Ceres CLONE ID no. 1662905 (SEQ ID NO:499), Ceres ANNOT ID no. 6094234 (SEQ ID NO:2326), and Ceres ANNOT ID no. 6108173 (SEQ ID NO:2340).

Figure 25:
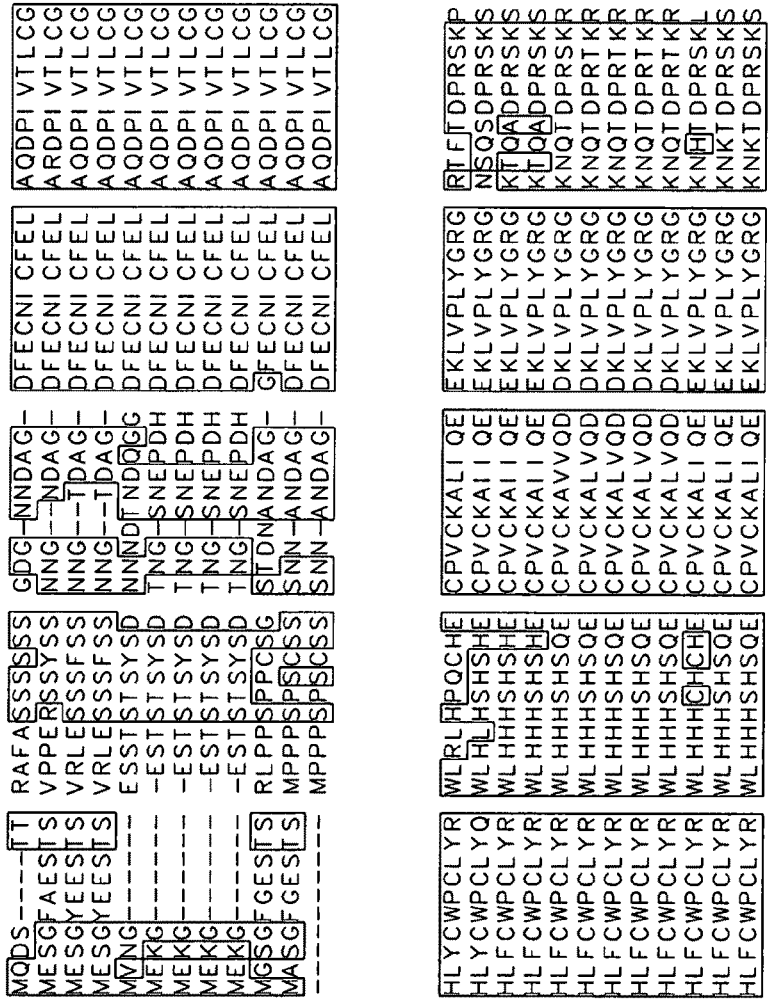
FIG. 25 is an alignment of the amino acid sequence of Ceres Clone 17402 (SEQ ID NO:529) with homologous and/or orthologous amino acid sequences CeresClone:1432566 (SEQ ID NO:530), CeresClone:1500962 (SEQ ID NO:531), CeresClone:1387733 (SEQ ID NO:532), CeresClone:1408748 (SEQ ID NO:533), CeresClone:1834915 (SEQ ID NO:535), CeresClone:1841007 (SEQ ID NO:537), CeresClone:1836048 (SEQ ID NO:539), CeresAnnot:1541305 (SEQ ID NO:541), CeresAnnot:1487895 (SEQ ID NO:543), CeresAnnot:1510353 (SEQ ID NO:545), and gi|68299223 (SEQ ID NO:546).
Figure 25:
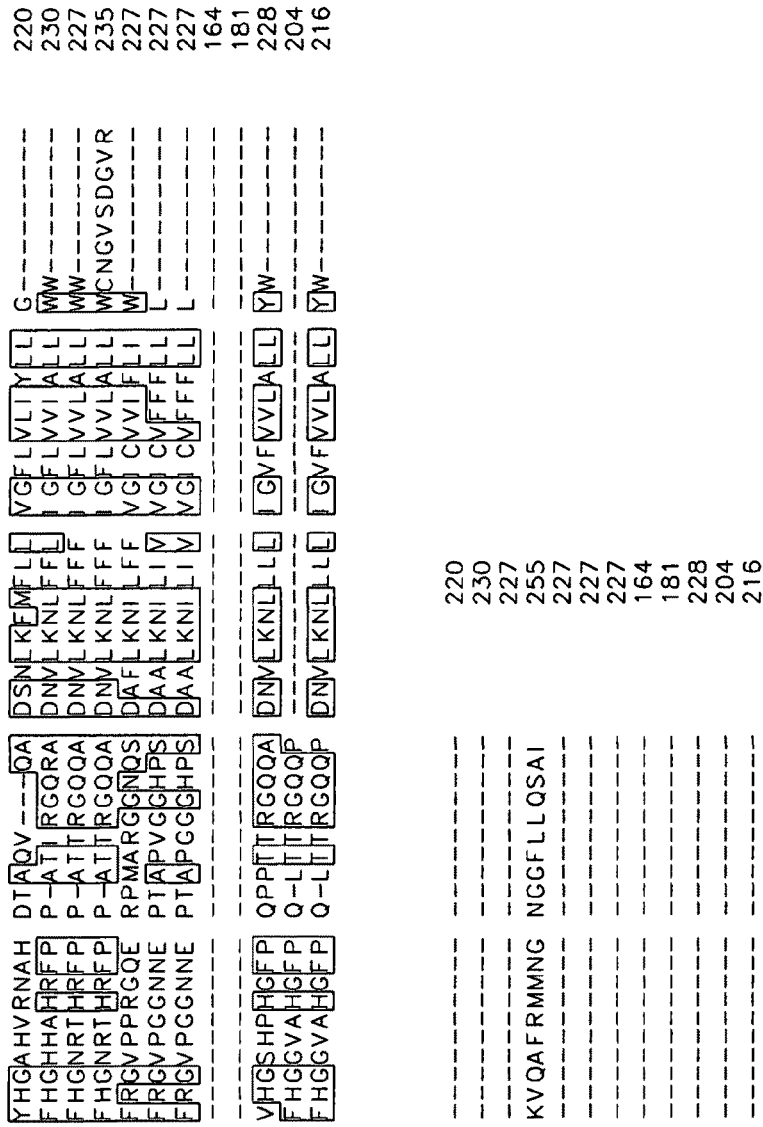

The alignment in FIG. 25 provides the amino acid sequences of Ceres Clone 17402 (SEQ ID NO:529), CeresClone:1432566 (SEQ ID NO:530), CeresClone:1500962 (SEQ ID NO:531), CeresClone:1387733 (SEQ ID NO:532), CeresClone:1408748 (SEQ ID NO:533), CeresClone:1834915 (SEQ ID NO:535), CeresClone:1841007 (SEQ ID NO:537), CeresClone:1836048 (SEQ ID NO:539), CeresAnnot:1541305 (SEQ ID NO:541), CeresAnnot:1487895 (SEQ ID NO:543), CeresAnnot:1510353 (SEQ ID NO:545), and gi|68299223 (SEQ ID NO:546). Other homologs and/or orthologs of SEQ ID NO:529 include gi|30794130 (SEQ ID NO:1921) and Ceres ANNOT ID no. 6039428 (SEQ ID NO:2262).

The alignment in FIG. 70 provides the amino acid sequences of Ceres Clone 99033 (SEQ ID NO:1165), Ceres-Clone:1840223 (SEQ ID NO:1171), CeresAnnot:1514944 (SEQ ID NO:1173), gi|90399248 (SEQ ID NO:1174), Ceres-Clone:1827510 (SEQ ID NO:1176), CeresClone:467336 (SEQ ID NO:1177), CeresClone:1555943 (SEQ ID NO:1180), and gi|9294812 (SEQ ID NO:1181). Other homologs and/or orthologs of SEQ ID NO:1165 include Public GI no. 79331357 (SEQ ID NO:1166), Public GI no. 21618121 (SEQ ID NO:1167), Ceres CLONE ID no. 9763 (SEQ ID NO:1168), Public GI no. 20466304 (SEQ ID NO:1169), Ceres CLONE ID no. 481884 (SEQ ID NO:1178), Public GI no. 22165059 (SEQ ID NO:1179), Ceres ANNOT ID no. 6086887 (SEQ ID NO:2316), Ceres ANNOT ID no. 6094234 (SEQ ID NO:2328), and Ceres ANNOT ID no. 6106161 (SEQ ID NO:2336).

The alignment in FIG. 97 provides the amino acid sequences of cDNA ID 23369680 (Ceres CLONE ID no. 21863; SEQ ID NO:1481), gi|34902106 (SEQ ID NO:1488), CeresClone:677852 (SEQ ID NO:1490), and CeresClone:637282 (SEQ ID NO:1491). Other homologs and/or orthologs of SEQ ID NO:1481 include Ceres ANNOT ID no. 1464854 (SEQ ID NO:1483), Ceres ANNOT ID no. 1511378 (SEQ ID NO:1485), Ceres ANNOT ID no. 1454043 (SEQ ID NO:1487), and SEQ ID NO:1489.

The alignment in FIG. 111 provides the amino acid sequences of Ceres Clone 560731 (SEQ ID NO:1628), Ceres-Clone:4267 (SEQ ID NO:1972) and CeresClone:1377336 (SEQ ID NO:1973). Other homologs and/or orthologs of SEQ ID NO:1628 include Ceres GDNA ANNOT ID no. 1506045 (SEQ ID NO:1630) and Ceres GDNA ANNOT ID no. 1495397 (SEQ ID NO:1632).

The alignment in FIG. 69 provides the amino acid sequences of Ceres Clone 9804 (SEQ ID NO:1136), Ceres-Clone:1832094 (SEQ ID NO:1143) and CeresClone:1887966 (SEQ ID NO:2065). Other homologs and/or orthologs of SEQ ID NO:1136 include Ceres CLONE ID no. 1303137 (SEQ ID NO:1137), Ceres CLONE ID no. 1832735 (SEQ ID NO:1139), Public GI no. 29028906 (SEQ ID NO:1140), Public GI no. 4038045 (SEQ ID NO:1141), Ceres CLONE ID no. 624726 (SEQ ID NO:1144), Public GI no. 19698935 (SEQ ID NO:1145), Public GI no. 15810271 (SEQ ID NO:1146), Ceres CLONE ID no. 1551497 (SEQ ID NO:1147), Ceres ANNOT ID no. 1516953 (SEQ ID NO:1149), Public GI no. 7527719 (SEQ ID NO:1150), Public GI no. 45935057 (SEQ ID NO:1151), Ceres CLONE ID no. 1167848 (SEQ ID NO:1152), Public GI no. 51965086 (SEQ ID NO:1153), Public GI no. 55418542 (SEQ ID NO:1154), Ceres ANNOT ID no. 1463658 (SEQ ID NO:1156), Public GI no. 22136762 (SEQ ID NO:1157), Ceres CLONE ID no. 1877855 (SEQ ID NO:1159), Ceres CLONE ID no. 1940423 (SEQ ID NO:1161), Ceres CLONE ID no. 1887966 (SEQ ID NO:2145), and Ceres ANNOT ID no. 6032020 (SEQ ID NO:2250).

The alignment in FIG. 108 provides the amino acid sequences of CeresClone:41439 (SEQ ID NO:1595), Ceres-Clone:701379 (SEQ ID NO:1602) and CeresClone:638614 (SEQ ID NO:1604). Other homologs and/or orthologs of SEQ ID NO:1595 include Public GI no. 7228329 (SEQ ID NO:1596), Public GI no. 2981169 (SEQ ID NO:1597), Public GI no. 55734108 (SEQ ID NO:1598), Public GI no. 439493 (SEQ ID NO:1599), Public GI no. 7488707 (SEQ ID NO:1600), Public GI no. 33771374 (SEQ ID NO:1601), Public GI no. 2058504 (SEQ ID NO:1603), Public GI no. 33331578 (SEQ ID NO:1605), Public GI no. 4666360 (SEQ ID NO:1606), Public GI no. 28849865 (SEQ ID NO:1607), and Public GI no. 2058506 (SEQ ID NO:1608).

The alignment in FIG. 94 provides the amino acid sequences of Ceres Clone 207419 (SEQ ID NO:1465), Ceres-Clone:212775 (SEQ ID NO:1936) and gi|12597770 (SEQ ID NO:1935). Other homologs and/or orthologs of SEQ ID NO:1465 include Ceres ANNOT ID no. 1517208 (SEQ ID NO:1467) and Ceres ANNOT ID no. 6042650 (SEQ ID NO:2274).

The alignment in FIG. 119 provides the amino acid sequences of cDNA ID 23498685 5109H3 (Ceres ANNOT ID no. 552542; SEQ ID NO:1722), CeresClone:727056 (SEQ ID NO:1996), gi|52077327 (SEQ ID NO:1993), Ceres-Clone:1548279 (SEQ ID NO:1995), and CeresClone:1044645 (SEQ ID NO:1994). Other homologs and/or orthologs of SEQ ID NO:1722 include Ceres ANNOT ID no. 1514007 (SEQ ID NO:1724) and Ceres ANNOT ID no. 1460742 (SEQ ID NO:1726).

The alignment in FIG. 65 provides the amino acid sequences of Ceres Clone 6639 (SEQ ID NO:1083), Ceres-Clone:1834027 (SEQ ID NO:1085), 1482536 (SEQ ID NO:1087), CeresClone:463157 (SEQ ID NO:1088), gi|92875402 (SEQ ID NO:1089), 1478227 (SEQ ID NO:1091), gi|21667487 (SEQ ID NO:1092), CeresClone:1755065 (SEQ ID NO:1094), gi|21281083, and gi|9759262.

Figure 86:
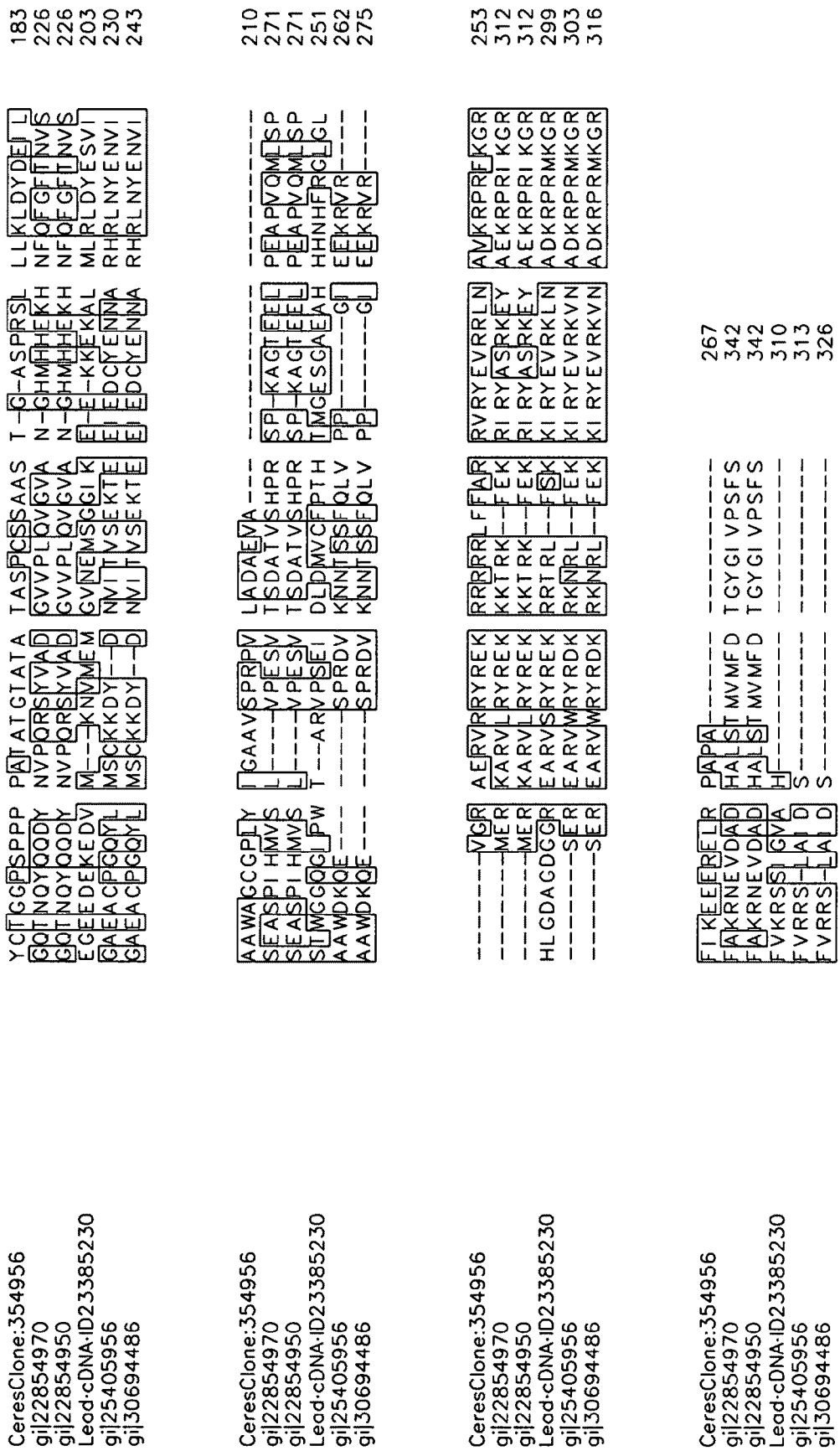
FIG. 86 is an alignment of the amino acid sequence of cDNA ID 23385230 (Ceres CLONE ID no. 108109; SEQ ID NO:1377) with homologous and/or orthologous amino acid sequences CeresClone:354956 (SEQ ID NO:2009), gi|22854970 (SEQ ID NO:2010), gi|22854950 (SEQ ID NO:2011), gi|25405956 (SEQ ID NO:2007), and gi|30694486 (SEQ ID NO:2008).

The alignment in FIG. 86 provides the amino acid sequences of cDNA ID 23385230 (Ceres CLONE ID no. 108109; SEQ ID NO:1377), CeresClone:354956 (SEQ ID NO:2009), gi|22854970 (SEQ ID NO:2010), gi|22854950 (SEQ ID NO:2011), gi|25405956 (SEQ ID NO:2007), and gi|30694486 (SEQ ID NO:2008). Other homologs and/or orthologs of SEQ ID NO:1377 include Ceres ANNOT ID no. 1469082 (SEQ ID NO:1379) and Ceres ANNOT ID no. 1522474 (SEQ ID NO:1381).

The alignment in FIG. 56 provides the amino acid sequences of Ceres Clone 41634 (SEQ ID NO:885), Ceres-Clone:1360604 (SEQ ID NO:887), CeresClone:1844070 (SEQ ID NO:890), and CeresAnnot:1457905 (SEQ ID NO:892). Other homologs and/or orthologs of SEQ ID NO:885 include Public GI no. 4678312 (SEQ ID NO:886), Ceres CLONE ID no. 1380534 (SEQ ID NO:888), Ceres ANNOT ID no. 1465103 (SEQ ID NO:894), and Ceres CLONE ID no. 1919992 (SEQ ID NO:896).

The alignment in FIG. 95 provides the amino acid sequences of Ceres Clone 20769 (SEQ ID NO:1469), Ceres-Clone:477718 (SEQ ID NO:1937) and CeresClone:518521 (SEQ ID NO:1938). Other homologs and/or orthologs of SEQ ID NO:1469 include Ceres ANNOT ID no. 1443644 (SEQ ID NO:1471) and Ceres ANNOT ID no. 6020292 (SEQ ID NO:2220).

The alignment in FIG. 110 provides the amino acid sequences of Ceres Clone 45 (SEQ ID NO:1620), Ceres-Clone:962327 (SEQ ID NO:1621) and CeresClone:1360570 (SEQ ID NO:1622). Other homologs and/or orthologs of SEQ ID NO:1620 include Ceres ANNOT ID no. 1447323 (SEQ ID NO:1624) and Ceres ANNOT ID no. 1491680 (SEQ ID NO:1626).

The alignment in FIG. 98 provides the amino acid sequences of cDNA ID 23371050 (Ceres CLONE ID no. 250132; SEQ ID NO:1493), CeresClone:962327 (SEQ ID NO:1494), CeresClone:1101577 (SEQ ID NO:1495), Ceres-Clone:634261 (SEQ ID NO:1496), gi|5031281 (SEQ ID NO:1497), gi|35187687 (SEQ ID NO:1498), gi|34978689 (SEQ ID NO:1499), and gi|34909836 (SEQ ID NO:1500). Other homologs and/or orthologs of SEQ ID NO:1493 include Ceres ANNOT ID no. 1527653 (SEQ ID NO:1502).

The alignment in FIG. 18 provides the amino acid sequences of Ceres Clone 14203 (SEQ ID NO:445), Ceres-Clone:1021029 (SEQ ID NO:446), CeresClone:974951

(SEQ ID NO:447), 1460527 (SEQ ID NO:449), CeresClone: 1853189 (SEQ ID NO:451), gi|92896423 (SEQ ID NO:452), CeresClone:1853430 (SEQ ID NO:454), CeresClone: 1734621 (SEQ ID NO:455), gi|50909195 (SEQ ID NO:456), gi|66271037 (SEQ ID NO:457), and 1450673 (SEQ ID NO:459). Other homologs and/or orthologs of SEQ ID NO:445 include Ceres ANNOT ID no. 6063956 (SEQ ID NO:2286).

Figure 51:
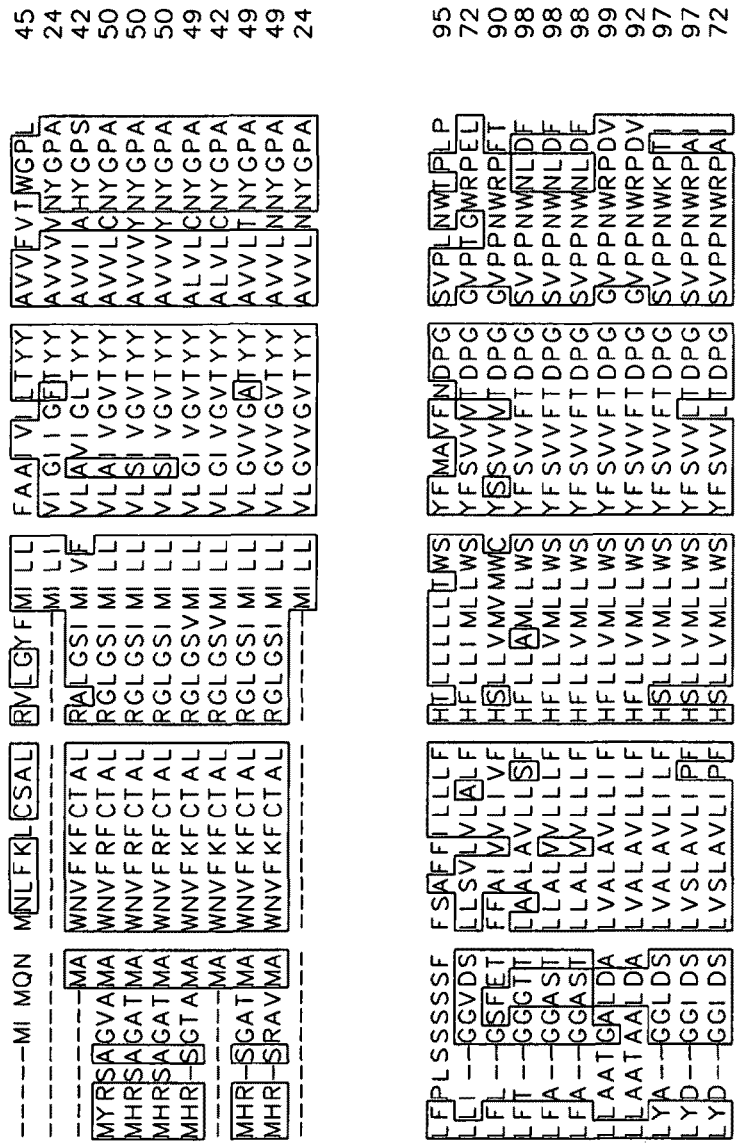
FIG. 51 is an alignment of the amino acid sequence of Ceres Clone 38360 (SEQ ID NO:816) with homologous and/or orthologous amino acid sequences gi|108711626 (SEQ ID NO:817), CeresClone:573293 (SEQ ID NO:818), CeresClone:1825572 (SEQ ID NO:820), 1524357 (SEQ ID NO:822), CeresClone:1819666 (SEQ ID NO:824), gi|50919203 (SEQ ID NO:825), CeresClone:230342 (SEQ ID NO:826), CeresClone:1850953 (SEQ ID NO:828), 1470949 (SEQ ID NO:830), and gi|92897066 (SEQ ID NO:831).

The alignment in FIG. 51 provides the amino acid sequences of Ceres Clone 38360 (SEQ ID NO:816), gi|108711626 (SEQ ID NO:817), CeresClone:573293 (SEQ ID NO:818), CeresClone:1825572 (SEQ ID NO:820), 1524357 (SEQ ID NO:822), CeresClone:1819666 (SEQ ID NO:824), gi|50919203 (SEQ ID NO:825), CeresClone: 230342 (SEQ ID NO:826), CeresClone:1850953 (SEQ ID NO:828), 1470949 (SEQ ID NO:830), and gi|92897066 (SEQ ID NO:831).

The alignment in FIG. 73 provides the amino acid sequences of Ceres Clone 19340 (SEQ ID NO:1239), Ceres-Clone:573293 (SEQ ID NO:1931), gi|50919203 (SEQ ID NO:1933), CeresClone:230342 (SEQ ID NO:1934), and CeresClone:537080 (SEQ ID NO:1932). Other homologs and/or orthologs of SEQ ID NO:1239 include Ceres ANNOT ID no. 1524357 (SEQ ID NO:1241), Ceres ANNOT ID no. 1497053 (SEQ ID NO:1243), Ceres ANNOT ID no. 1500296 (SEQ ID NO:1245), and Ceres CLONE ID no. 1819666 (SEQ ID NO:1247).

The alignment in FIG. 13 provides the amino acid sequences of CeresClone:113639 (SEQ ID NO:374), Ceres-Clone:562894 (SEQ ID NO:375) and CeresAnnot:1503065 (SEQ ID NO:377).

The alignment in FIG. 54 provides the amino acid sequences of Ceres Clone 39855 (SEQ ID NO:852), Ceres-Clone:1065335 (SEQ ID NO:853), CeresClone:1793747 (SEQ ID NO:855), CeresClone:788576 (SEQ ID NO:856), CeresClone:465010 (SEQ ID NO:857), CeresClone: 1832492 (SEQ ID NO:859), CeresClone:1801885 (SEQ ID NO:861), CeresClone:1060804 (SEQ ID NO:862), gi|50948587 (SEQ ID NO:863), and gi|20259185 (SEQ ID NO:2066).

The alignment in FIG. 2 provides the amino acid sequences of Annot ID 548715 (SEQ ID NO:106), CeresAnnot: 1447956 (SEQ ID NO:108), CeresClone:1923054 (SEQ ID NO:110), CeresClone:1051305 (SEQ ID NO:111), gi|50923813 (SEQ ID NO:112), CeresClone:1746793 (SEQ ID NO:114), CeresClone:843382 (SEQ ID NO:115), and CeresClone:1540519 (SEQ ID NO:116). Other homologs and/or orthologs of SEQ ID NO:106 include Ceres CLONE ID no. 488960 (SEQ ID NO:117).

Amino acid sequences of homologs and/or orthologs of the polypeptide having the amino acid sequence set forth in SEQ ID NO:370 include Ceres CLONE ID no. 1768915 (SEQ ID NO:2121) and Ceres ANNOT ID no. 6025808 (SEQ ID NO:2230).

Amino acid sequences of homologs and/or orthologs of the polypeptide having the amino acid sequence set forth in SEQ ID NO:1858 include Ceres ANNOT ID no. 6007065 (SEQ ID NO:2168) and Ceres ANNOT ID no. 6007067 (SEQ ID NO:2170).

Amino acid sequences of homologs and/or orthologs of the polypeptide having the amino acid sequence set forth in SEQ ID NO:411 include Ceres ANNOT ID no. 6009287 (SEQ ID NO:2172).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 135-137, SEQ ID NO:139, SEQ ID NO:141, SEQ ID NO:143, SEQ ID NOs:145-147, SEQ ID NO:492, SEQ ID NO:494, SEQ ID NOs:496-499, SEQ ID NOs:501-502, SEQ ID NOs:530-533, SEQ ID NO:535, SEQ ID NO:537, SEQ ID NO:539, SEQ ID NO:541, SEQ ID NO:543, SEQ ID NOs: 545-546, SEQ ID NO:1921, SEQ ID NOs:1166-1169, SEQ ID NO:1171, SEQ ID NOs:1173-1174, SEQ ID NOs:1176-1181, SEQ ID NO:1483, SEQ ID NO:1485, SEQ ID NOs: 1487-1491, SEQ ID NO:1630, SEQ ID NO:1632, SEQ ID NOs:1972-1973, SEQ ID NO:1137, SEQ ID NOs:1139-1141, SEQ ID NOs:1143-1147, SEQ ID NOs:1149-1154, SEQ ID NOs:1156-1157, SEQ ID NO:1159, SEQ ID NO:1161, SEQ ID NO:2065, SEQ ID NOs:1596-1608, SEQ ID NO:1467, SEQ ID NOs:1935-1936, SEQ ID NO:1724, SEQ ID NO:1726, SEQ ID NOs:1993-1996, SEQ ID NO:1085, SEQ ID NOs:1087-1089, SEQ ID NOs:1091-1092, SEQ ID NO:1094, gi|21281083, gi|9759262, SEQ ID NO:1379, SEQ ID NO:1381, SEQ ID NOs:2007-2011, SEQ ID NOs:886-888, SEQ ID NO:890, SEQ ID NO:892, SEQ ID NO:894, SEQ ID NO:896, SEQ ID NO:1471, SEQ ID NOs: 1937-1938, SEQ ID NOs:1621-1622, SEQ ID NO:1624, SEQ ID NO:1626, SEQ ID NOs:1494-1500, SEQ ID NO:1502, SEQ ID NOs:446-447, SEQ ID NO:449, SEQ ID NOs:451-452, SEQ ID NOs:454-457, SEQ ID NO:459, SEQ ID NOs:817-818, SEQ ID NO:820, SEQ ID NO:822, SEQ ID NOs:824-826, SEQ ID NO:828, SEQ ID NOs:830-831, SEQ ID NO:1241, SEQ ID NO:1243, SEQ ID NO:1245, SEQ ID NO:1247, SEQ ID NOs:1931-1934, SEQ ID NO:375, SEQ ID NO:377, SEQ ID NO:853, SEQ ID NOs:855-857, SEQ ID NO:859, SEQ ID NOs:861-863, SEQ ID NO:2066, SEQ ID NO:108, SEQ ID NOs:110-112, SEQ ID NOs:114-117, SEQ ID NO:2121, SEQ ID NO:2145, SEQ ID NO:2168, SEQ ID NO:2170, SEQ ID NO:2172, SEQ ID NO:2220, SEQ ID NO:2230, SEQ ID NO:2250, SEQ ID NO:2262, SEQ ID NO:2274, SEQ ID NO:2286, SEQ ID NO:2316, SEQ ID NO:2326, SEQ ID NO:2328, SEQ ID NO:2336, or SEQ ID NO:2340.

A regulatory protein can contain an AP2 domain characteristic of polypeptides belonging to the AP2/EREBP family of plant transcription factor polypeptides. AP2 (APETALA2) and EREBPs (ethylene-responsive element binding proteins) are prototypic members of a family of transcription factors unique to plants, whose distinguishing characteristic is that they contain the so-called AP2 DNA binding domain. AP2/ EREBP genes form a large multigene family encoding polypeptides that play a variety of roles throughout the plant life cycle: from being key regulators of several developmental processes, such as floral organ identity determination and control of leaf epidermal cell identity, to forming part of the mechanisms used by plants to respond to various types of biotic and environmental stress. SEQ ID NO:379, SEQ ID NO:583, SEQ ID NO:680, SEQ ID NO:1052, SEQ ID NO:1062, SEQ ID NO:1064, SEQ ID NO:1081, SEQ ID NO:1183, SEQ ID NO:1302, SEQ ID NO:1504, SEQ ID NO:1526, SEQ ID NO:1637, SEQ ID NO:1661, SEQ ID NO:1675, SEQ ID NO:1692, SEQ ID NO:1752, SEQ ID NO:1850, SEQ ID NO:1882, and SEQ ID NO:1886 set forth the amino acid sequences of DNA clones, identified herein as Ceres CLONE ID no. 115358 (SEQ ID NO:378), Ceres CLONE ID no. 222885 (SEQ ID NO:582), Ceres CLONE ID no. 31044 (SEQ ID NO:679), Ceres CLONE ID no. 557009 (SEQ ID NO:1051), Ceres CLONE ID no. 560961 (SEQ ID NO:1061), Ceres CLONE ID no. 6042 (SEQ ID NO:1063), Ceres CLONE ID no. 626054 (SEQ ID NO:1080), Ceres CLONE ID no. 99612 (SEQ ID NO:1182), Ceres CLONE ID no. 124720 (SEQ ID NO:1301), Ceres CLONE ID no. 251466 (SEQ ID NO:1503), Ceres CLONE ID no. 26867

(SEQ ID NO:1525), Ceres CLONE ID no. 6397 (SEQ ID NO:1636), Ceres CLONE ID no. 681088 (SEQ ID NO:1660), Ceres CLONE ID no. 691319 (SEQ ID NO:1674), Ceres CLONE ID no. 92102 (SEQ ID NO:1691), Ceres CLONE ID no. 603410 (SEQ ID NO:1751), Ceres CLONE ID no. 231890 (SEQ ID NO:1849), Ceres CLONE ID no. 605218 (SEQ ID NO:1881), and Ceres CLONE ID no. 625035 (SEQ ID NO:1885), respectively, each of which is predicted to encode a polypeptide containing a Pfam domain as indicated in the Sequence Listing (e.g., an AP2 domain).

A regulatory protein can comprise the amino acid sequence set forth in SEQ ID NO:379, SEQ ID NO:583, SEQ ID NO:680, SEQ ID NO:1052, SEQ ID NO:1062, SEQ ID NO:1064, SEQ ID NO:1081, SEQ ID NO:1183, SEQ ID NO:1302, SEQ ID NO:1504, SEQ ID NO:1526, SEQ ID NO:1637, SEQ ID NO:1661, SEQ ID NO:1675, SEQ ID NO:1692, SEQ ID NO:1752, SEQ ID NO:1850, SEQ ID NO:1882, or SEQ ID NO:1886. In some cases, a regulatory protein can be a homolog, ortholog, or variant of the polypeptide having the amino acid sequence set forth in SEQ ID NO:379, SEQ ID NO:583, SEQ ID NO:680, SEQ ID NO:1052, SEQ ID NO:1062, SEQ ID NO:1064, SEQ ID NO:1081, SEQ ID NO:1183, SEQ ID NO:1302, SEQ ID NO:1504, SEQ ID NO:1526, SEQ ID NO:1637, SEQ ID NO:1661, SEQ ID NO:1675, SEQ ID NO:1692, SEQ ID NO:1752, SEQ ID NO:1850, SEQ ID NO:1882, or SEQ ID NO:1886. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:379, SEQ ID NO:583, SEQ ID NO:680, SEQ ID NO:1052, SEQ ID NO:1062, SEQ ID NO:1064, SEQ ID NO:1081, SEQ ID NO:1183, SEQ ID NO:1302, SEQ ID NO:1504, SEQ ID NO:1526, SEQ ID NO:1637, SEQ ID NO:1661, SEQ ID NO:1675, SEQ ID NO:1692, SEQ ID NO:1752, SEQ ID NO:1850, SEQ ID NO:1882, or SEQ ID NO:1886.

Amino acid sequences of homologs and/or orthologs of the polypeptide having the amino acid sequence set forth in SEQ ID NO:680, SEQ ID NO:1052, SEQ ID NO:1064, SEQ ID NO:1302, SEQ ID NO:1504, SEQ ID NO:1526, SEQ ID NO:1637, SEQ ID NO:1661, SEQ ID NO:1675, SEQ ID NO:1692, and SEQ ID NO:1752 are provided in FIG. 37, FIG. 63, FIG. 64, FIG. 79, FIG. 99, FIG. 101, FIG. 112, FIG. 114, FIG. 115, FIG. 117, and FIG. 122, respectively.

For example, the alignment in FIG. 37 provides the amino acid sequences of Ceres Clone 31044 (SEQ ID NO:680), 1496976 (SEQ ID NO:682), and 1444027 (SEQ ID NO:684). Other homologs and/or orthologs of SEQ ID NO:680 include Ceres CLONE ID no. 902699 (SEQ ID NO:1529), Ceres CLONE ID no. 709819 (SEQ ID NO:1530), Public GI no. 37536842 (SEQ ID NO:1531), Public GI no. 21908034 (SEQ ID NO:1532), Public GI no. 25990951 (SEQ ID NO:1533), SEQ ID NO:1534, Ceres ANNOT ID no. 1486207 (SEQ ID NO:1536), Ceres ANNOT ID no. 1496976 (SEQ ID NO:1538), Ceres ANNOT ID no. 6017518 (SEQ ID NO:2214), Ceres ANNOT ID no. 6017519 (SEQ ID NO:2216), and Ceres ANNOT ID no. 6026758 (SEQ ID NO:2234).

Figure 63:
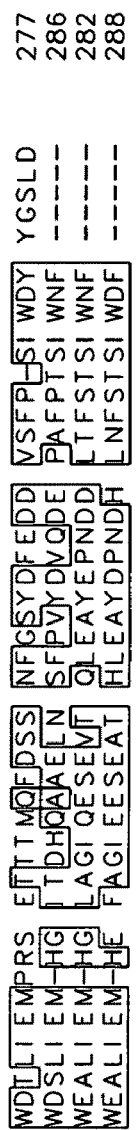
FIG. 63 is an alignment of the amino acid sequence of Ceres Clone 557009 (SEQ ID NO:1052) with homologous and/or orthologous amino acid sequences gi|92897616 (SEQ ID NO:1053), CeresAnnot:1474923 (SEQ ID NO:1055), and gi|21592849 (SEQ ID NO:1056).

The alignment in FIG. 63 provides the amino acid sequences of Ceres Clone 557009 (SEQ ID NO:1052), gi|92897616 (SEQ ID NO:1053), CeresAnnot:1474923 (SEQ ID NO:1055), and gi|21592849 (SEQ ID NO:1056). Other homologs and/or orthologs of SEQ ID NO:1052 include Ceres ANNOT ID no. 6005736 (SEQ ID NO:2162).

Figure 64:
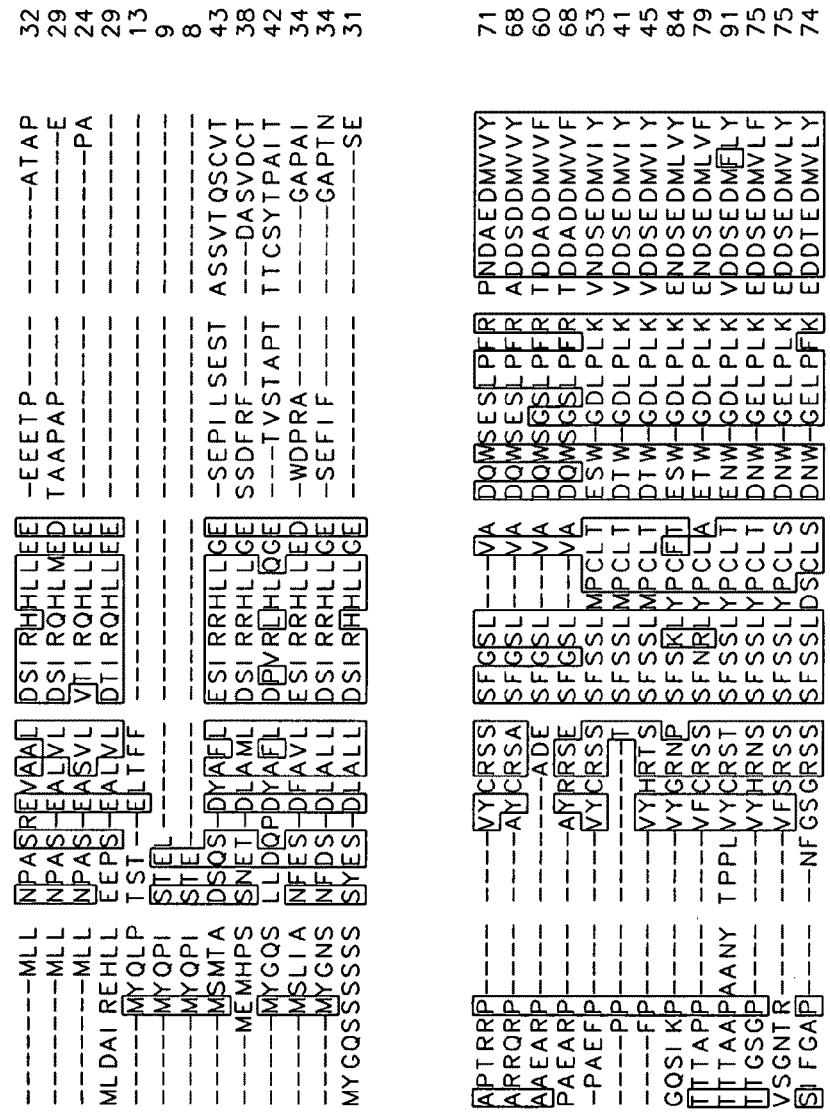
FIG. 64 is an alignment of the amino acid sequence of Ceres Clone 6042 (SEQ ID NO:1064) with homologous and/or orthologous amino acid sequences gi|32401273 (SEQ ID NO:1065), gi|28274828 (SEQ ID NO:1066), CeresClone:1926437 (SEQ ID NO:1068), gi|92878372 (SEQ ID NO:1069), 1446840 (SEQ ID NO:1071), CeresClone:582684 (SEQ ID NO:1072), gi|1208498 (SEQ ID NO:1073), gi|8809571 (SEQ ID NO:1074), CeresClone:1443683 (SEQ ID NO:1075), gi|50911399 (SEQ ID NO:1076), CeresClone:1809375 (SEQ ID NO:1078), and CeresClone:555364 (SEQ ID NO:1079).

The alignment in FIG. 64 provides the amino acid sequences of Ceres Clone 6042 (SEQ ID NO:1064), gi|32401273 (SEQ ID NO:1065), gi|28274828 (SEQ ID NO:1066), CeresClone:1926437 (SEQ ID NO:1068), gi|92878372 (SEQ ID NO:1069), 1446840 (SEQ ID NO:1071), CeresClone:582684 (SEQ ID NO:1072), gi|1208498 (SEQ ID NO:1073), gi|8809571 (SEQ ID NO:1074), CeresClone:1443683 (SEQ ID NO:1075), gi|50911399 (SEQ ID NO:1076), CeresClone:1809375 (SEQ ID NO:1078), and CeresClone:555364 (SEQ ID NO:1079). Other homologs and/or orthologs of SEQ ID NO:1064 include Ceres ANNOT ID no. 6079953 (SEQ ID NO:2308).

The alignment in FIG. 79 provides the amino acid sequences of Ceres Clone 124720 (SEQ ID NO:1302), CeresClone:975672 (SEQ ID NO:1303), CeresClone:1044385 (SEQ ID NO:1304), gi|55419650 (SEQ ID NO:1305), gi|56384582 (SEQ ID NO:1306), gi|57012880 (SEQ ID NO:1307), gi|50929507 (SEQ ID NO:1308), and CeresClone:273307 (SEQ ID NO:1309). Other homologs and/or orthologs of SEQ ID NO:1302 include Ceres ANNOT ID no. 1441430 (SEQ ID NO:1311), Ceres CLONE ID no. 1761125 (SEQ ID NO:1313), and Ceres ANNOT ID no. 6111686 (SEQ ID NO:2344).

Figure 99:
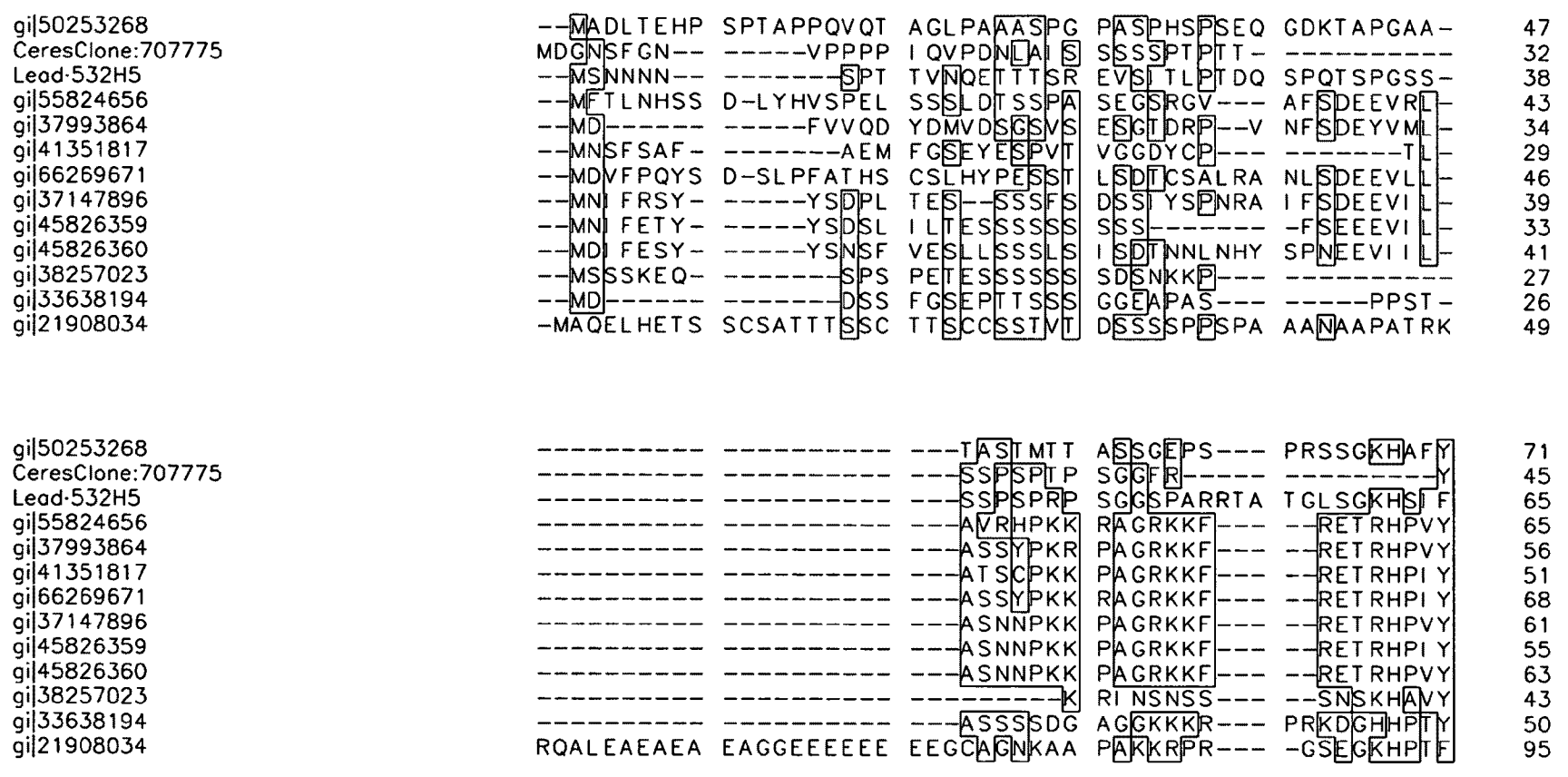
Figure 99:
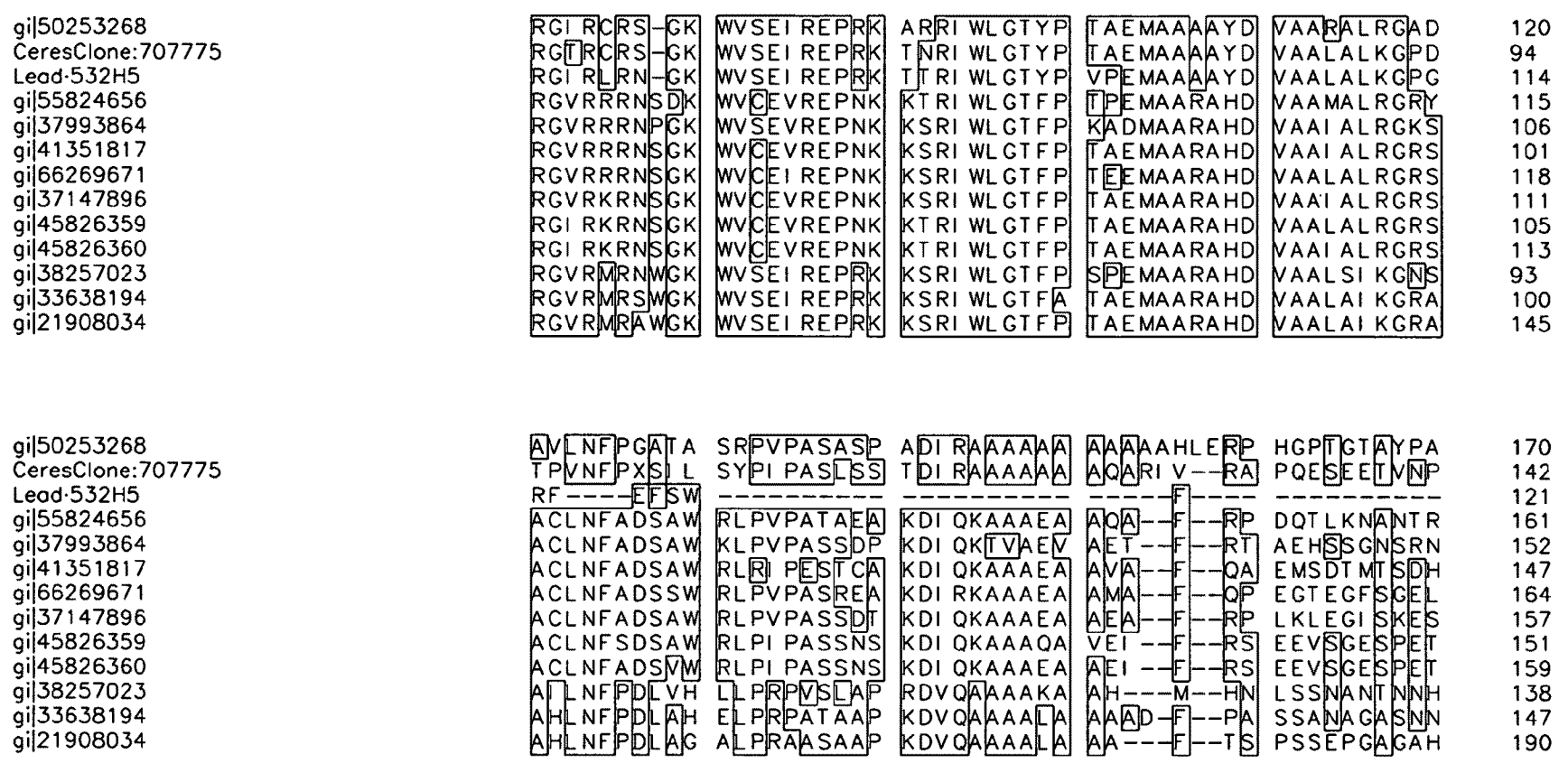

The alignment in FIG. 99 provides the amino acid sequences of 532H5 (Ceres CLONE ID no. 251466; SEQ ID NO:1504), gi|50253268 (SEQ ID NO:1505), gi|45826359 (SEQ ID NO:1506), gi|45826360 (SEQ ID NO:1507), gi|37993864 (SEQ ID NO:1508), CeresClone:707775 (SEQ ID NO:1509), gi|38257023 (SEQ ID NO:1510), gi|37147896 (SEQ ID NO:1511), gi|41351817 (SEQ ID NO:1512), gi|55824656 (SEQ ID NO:1513), gi|66269671 (SEQ ID NO:1514), gi|33638194 (SEQ ID NO:1515), and gi|21908034 (SEQ ID NO:1516).

The alignment in FIG. 101 provides the amino acid sequences of CeresClone:26867 (SEQ ID NO:1526) and Annot ID:1486918 (SEQ ID NO:1528).

The alignment in FIG. 112 provides the amino acid sequences of Ceres Clone 6397 (SEQ ID NO:1637), gi|57012876 (SEQ ID NO:1645), and gi|3342211 (SEQ ID NO:1651). Other homologs and/or orthologs of SEQ ID NO:1637 include Ceres CDNA ID no. 23401690 (SEQ ID NO:1638), Ceres CLONE ID no. 605218 (SEQ ID NO:1639), Public GI no. 57012759 (SEQ ID NO:1640), Ceres CLONE ID no. 282666 (SEQ ID NO:1641), Public GI no. 32401273 (SEQ ID NO:1642), Ceres CLONE ID no. 592713 (SEQ ID NO:1643), Public GI no. 3342211 (SEQ ID NO:1644), Ceres CLONE ID no. 555364 (SEQ ID NO:1646), Ceres CLONE ID no. 944101 (SEQ ID NO:1647), Ceres CLONE ID no. 569593 (SEQ ID NO:1648), Public GI no. 50927517 (SEQ ID NO:1649), Public GI no. 57012876 (SEQ ID NO:1650), and Ceres ANNOT ID no. 6064272 (SEQ ID NO:2290).

The alignment in FIG. 114 provides the amino acid sequences of CeresClone:681088 (SEQ ID NO:1661) and Annot ID:1471330 (SEQ ID NO:1663). Other homologs and/or orthologs of SEQ ID NO:1661 include Ceres ANNOT ID no. 1444437 (SEQ ID NO:1665), Ceres ANNOT ID no. 1444439 (SEQ ID NO:1667), Ceres ANNOT ID no. 1486891 (SEQ ID NO:1669), Ceres ANNOT ID no. 1479637 (SEQ ID NO:1671), and Ceres ANNOT ID no. 1446530 (SEQ ID NO:1673).

Figure 115:
FIG. 115 is an alignment of the amino acid sequence of CeresClone:691319 (SEQ ID NO:1675) with homologous and/or orthologous amino acid sequence CeresClone: 1475648 (SEQ ID NO:1676).

The alignment in FIG. 115 provides the amino acid sequences of CeresClone:691319 (SEQ ID NO:1675) and CeresClone:1475648 (SEQ ID NO:1676). Other homologs and/or orthologs of SEQ ID NO:1675 include Public GI no. 30725634 (SEQ ID NO:1677), Ceres ANNOT ID no.

1452324 (SEQ ID NO:1678), Ceres ANNOT ID no. 1443093 (SEQ ID NO:1679), and Ceres ANNOT ID no. 6014857 (SEQ ID NO:2188).

The alignment in FIG. 117 provides the amino acid sequences of CeresClone:92102 (SEQ ID NO:1692), Ceres-Clone:965028, gi|45642990, gi|40060531, gi|38260618, and CeresClone:548557. Other homologs and/or orthologs of SEQ ID NO:1692 include Ceres ANNOT ID no. 1484557 (SEQ ID NO:1694) and Ceres ANNOT ID no. 1438401 (SEQ ID NO:1696).

The alignment in FIG. 122 provides the amino acid sequences of cDNA ID 23401690 (Ceres CLONE ID no. 603410; SEQ ID NO:1752), CeresClone:605218 (SEQ ID NO:1753), gi|57012759 (SEQ ID NO:1754), CeresClone:6397 (SEQ ID NO:1755), CeresClone:282666 (SEQ ID NO:1756), gi|32401273 (SEQ ID NO:1757), CeresClone:592713 (SEQ ID NO:1758), gi|3342211 (SEQ ID NO:1759), gi|57012876 (SEQ ID NO:1760), CeresClone:555364 (SEQ ID NO:1761), CeresClone:944101 (SEQ ID NO:1762), CeresClone:569593 (SEQ ID NO:1763), and gi|50927517 (SEQ ID NO:1764). Other homologs and/or orthologs of SEQ ID NO:1752 include Ceres CLONE ID no. 661590 (SEQ ID NO:1765) and Ceres ANNOT ID no. 6064272 (SEQ ID NO:2288).

Amino acid sequences of homologs and/or orthologs of the polypeptide having the amino acid sequence set forth in SEQ ID NO:583 include Ceres CLONE ID no. 1897613 (SEQ ID NO:2149).

Amino acid sequences of homologs and/or orthologs of the polypeptide having the amino acid sequence set forth in SEQ ID NO:1062 include Ceres ANNOT ID no. 6015724 (SEQ ID NO:2190) and Ceres ANNOT ID no. 6111686 (SEQ ID NO:2346).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NO:682, SEQ ID NO:684, SEQ ID NOs:1529-1533, SEQ ID NO:1536, SEQ ID NO:1538, SEQ ID NO:1053, SEQ ID NOs:1055-1056, SEQ ID NOs:1065-1066, SEQ ID NOs:1068-1069, SEQ ID NOs:1071-1076, SEQ ID NOs:1078-1079, SEQ ID NOs:1303-1309, SEQ ID NO:1311, SEQ ID NO:1313, SEQ ID NOs:1505-1516, SEQ ID NO:1528, SEQ ID NOs:1638-1651, SEQ ID NO:1663, SEQ ID NO:1665, SEQ ID NO:1667, SEQ ID NO:1669, SEQ ID NO:1671, SEQ ID NO:1673, SEQ ID NOs:1676-1679, SEQ ID NO:1694, SEQ ID NO:1696, CeresClone:965028, gi|45642990, gi|40060531, gi|38260618, CeresClone:548557, SEQ ID NOs:1753-1765, SEQ ID NO:2149, SEQ ID NO:2162, SEQ ID NO:2188, SEQ ID NO:2190, SEQ ID NO:2214, SEQ ID NO:2216, SEQ ID NO:2234, SEQ ID NO:2288, SEQ ID NO:2290, SEQ ID NO:2308, SEQ ID NO:2344, or SEQ ID NO:2346.

A regulatory protein can contain a B3 DNA binding domain characteristic of a family of plant transcription factors with various roles in development. A B3 DNA binding domain is found in VP1/AB13 transcription factors. Some polypeptides, such as RAV1, also have an AP2 DNA binding domain. SEQ ID NO:835, SEQ ID NO:1285, and SEQ ID NO:1653 set forth the amino acid sequences of DNA clones, identified herein as Ceres CLONE ID no. 38961 (SEQ ID NO:834), Ceres CLONE ID no. 38311 (SEQ ID NO:1284), and Ceres CLONE ID no. 660003 (SEQ ID NO:1652), respectively, each of which is predicted to encode a polypeptide containing a Pfam domain as indicated in the Sequence Listing (e.g., a B3 DNA binding domain).

A regulatory protein can comprise the amino acid sequence set forth in SEQ ID NO:835, SEQ ID NO:1285, or SEQ ID NO:1653. In some cases, a regulatory protein can be a homolog, ortholog, or variant of the polypeptide having the amino acid sequence set forth in SEQ ID NO:835, SEQ ID NO:1285, or SEQ ID NO:1653. For example, a regulatory protein can have an amino acid sequence with at least 50% sequence identity, e.g., 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:835, SEQ ID NO:1285, or SEQ ID NO:1653.

Amino acid sequences of homologs and/or orthologs of the polypeptide having the amino acid sequence set forth in SEQ ID NO:1285 and SEQ ID NO:1653 are provided in FIG. 77 and FIG. 113, respectively.

For example, the alignment in FIG. 77 provides the amino acid sequences of Ceres Clone 38311 (SEQ ID NO:1285), CeresClone:19561 (SEQ ID NO:1957), gi|33320073 (SEQ ID NO:1959), CeresClone:597624 (SEQ ID NO:1958), CeresClone:331400 (SEQ ID NO:1961), CeresClone:705041 (SEQ ID NO:1960), and gi|50932645 (SEQ ID NO:1962). Other homologs and/or orthologs of SEQ ID NO:1285 include Public GI no. 72140114 (SEQ ID NO:1287), Public GI no. 34895690 (SEQ ID NO:1290), and Ceres CLONE ID no. 1781615 (SEQ ID NO:1292).

The alignment in FIG. 113 provides the amino acid sequences of CeresClone:660003 (SEQ ID NO:1653), CeresClone:763852 (SEQ ID NO:1655), and Annot ID:1508184 (SEQ ID NO:1657). Other homologs and/or orthologs of SEQ ID NO:1653 include Public GI no. 26450255 (SEQ ID NO:1654), Ceres ANNOT ID no. 1528645 (SEQ ID NO:1659), and Ceres ANNOT ID no. 6038039 (SEQ ID NO:2258).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 1957-1962, SEQ ID NO:1287, SEQ ID NO:1290, SEQ ID NO:1292, SEQ ID NOs:1654-1655, SEQ ID NO:1657, SEQ ID NO:1659, or SEQ ID NO:2258.

In some cases, a regulatory protein can contain an AP2 domain described above and a B3 DNA binding domain described above. SEQ ID NO:1371 and SEQ ID NO:1844 set forth the amino acid sequences of DNA clones, identified herein as Ceres CLONE ID no. 597624 (SEQ ID NO:1370) and Ceres CLONE ID no. 19561 (SEQ ID NO:1843), respectively, each of which is predicted to encode a polypeptide having a Pfam domain as indicated in the Sequence Listing (e.g., an AP2 and a B3 DNA binding domain).

A regulatory protein can comprise the amino acid sequence set forth in SEQ ID NO:1371 or SEQ ID NO:1844. In some cases, a regulatory protein can be a homolog, ortholog, or variant of the polypeptide having the amino acid sequence set forth in SEQ ID NO:1371 or SEQ ID NO:1844. For example, a regulatory protein can have an amino acid sequence with at least 50% sequence identity, e.g., 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:1371 or SEQ ID NO:1844.

Amino acid sequences of homologs and/or orthologs of the polypeptide having the amino acid sequence set forth in SEQ ID NO:1371 are provided in FIG. 85.

For example, the alignment in FIG. 85 provides the amino acid sequences of cDNA ID 23402435 (Ceres CLONE ID no. 597624; SEQ ID NO:1371), gi|33320073 (SEQ ID NO:1288), and gi|15810645. Other homologs and/or orthologs of SEQ ID NO:1371 include Ceres ANNOT ID no. 1464039 (SEQ ID NO:1373) and Ceres CLONE ID no. 1781615 (SEQ ID NO:1375).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NO:1288, SEQ ID NO:1373, SEQ ID NO:1375, or gi|15810645.

A regulatory protein can contain a myb-like DNA binding domain characteristic of myb-like transcription factor polypeptides. The retroviral oncogene v-myb and its cellular counterpart c-myb encode nuclear DNA binding polypeptides. These polypeptides belong to the SANT domain family that specifically recognize the sequence YAAC(G/T)G. In myb, one of the most conserved regions consisting of three tandem repeats has been shown to be involved in DNA binding. *Arabidopsis thaliana* is estimated to contain more than 140 MYB or MYB-related genes. In contrast to animals, plants contain a MYB-protein subfamily that is characterized by the R2R3-type MYB domain. Classical MYB factors, which are related to c-MYB, seem to be involved in the control of the cell cycle in animals, plants and other higher eukaryotes. R2R3-type MYB genes control many aspects of plant secondary metabolism, as well as the identity and fate of plant cells. SEQ ID NO:518, SEQ ID NO:590, SEQ ID NO:599, SEQ ID NO:601, SEQ ID NO:671, SEQ ID NO:703, SEQ ID NO:707, SEQ ID NO:814, SEQ ID NO:1383, SEQ ID NO:1395, SEQ ID NO:1518, SEQ ID NO:1540, SEQ ID NO:1552, SEQ ID NO:1570, SEQ ID NO:1836, SEQ ID NO:1838, SEQ ID NO:1842, and SEQ ID NO:1892 set forth the amino acid sequences of DNA clones, identified herein as Ceres CLONE ID no. 157740 (SEQ ID NO:517), Ceres CLONE ID no. 22671 (SEQ ID NO:589), Ceres CLONE ID no. 231109 (SEQ ID NO:598), Ceres CLONE ID no. 240112 (SEQ ID NO:600), Ceres CLONE ID no. 2942 (SEQ ID NO:670), Ceres CLONE ID no. 33139 (SEQ ID NO:702), Ceres CLONE ID no. 331755 (SEQ ID NO:706), Ceres CLONE ID no. 382267 (SEQ ID NO:813), Ceres CLONE ID no. 115924 (SEQ ID NO:1382), Ceres CLONE ID no. 120302 (SEQ ID NO:1394), Ceres CLONE ID no. 25795 (SEQ ID NO:1517), Ceres CLONE ID no. 325800 (SEQ ID NO:1539), Ceres CLONE ID no. 33333 (SEQ ID NO:1551), Ceres CLONE ID no. 34589 (SEQ ID NO:1569), Ceres CLONE ID no. 114074 (SEQ ID NO:1835), Ceres CLONE ID no. 143475 (SEQ ID NO:1837), Ceres CLONE ID no. 152630 (SEQ ID NO:1841), and Ceres LOCUS ID no. 1493072 (SEQ ID NO:1891), respectively, each of which is predicted to encode a polypeptide containing a Pfam domain as indicated in the Sequence Listing (e.g., a myb-like DNA binding domain).

A regulatory protein can comprise the amino acid sequence set forth in SEQ ID NO:518, SEQ ID NO:590, SEQ ID NO:599, SEQ ID NO:601, SEQ ID NO:671, SEQ ID NO:703, SEQ ID NO:707, SEQ ID NO:814, SEQ ID NO:1383, SEQ ID NO:1395, SEQ ID NO:1518, SEQ ID NO:1540, SEQ ID NO:1552, SEQ ID NO:1570, SEQ ID NO:1836, SEQ ID NO:1838, SEQ ID NO:1842, or SEQ ID NO:1892. In some cases, a regulatory protein can be a homolog, ortholog, or variant of the polypeptide having the amino acid sequence set forth in SEQ ID NO:518, SEQ ID NO:590, SEQ ID NO:599, SEQ ID NO:601, SEQ ID NO:671, SEQ ID NO:703, SEQ ID NO:707, SEQ ID NO:814, SEQ ID NO:1383, SEQ ID NO:1395, SEQ ID NO:1518, SEQ ID NO:1540, SEQ ID NO:1552, SEQ ID NO:1570, SEQ ID NO:1836, SEQ ID NO:1838, SEQ ID NO:1842, or SEQ ID NO:1892. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:518, SEQ ID NO:590, SEQ ID NO:599, SEQ ID NO:601, SEQ ID NO:671, SEQ ID NO:703, SEQ ID NO:707, SEQ ID NO:814, SEQ ID NO:1383, SEQ ID NO:1395, SEQ ID NO:1518, SEQ ID NO:1540, SEQ ID NO:1552, SEQ ID NO:1570, SEQ ID NO:1836, SEQ ID NO:1838, SEQ ID NO:1842, or SEQ ID NO:1892.

Amino acid sequences of homologs and/or orthologs of the polypeptide having the amino acid sequence set forth in SEQ ID NO:590, SEQ ID NO:601, SEQ ID NO:671, SEQ ID NO:703, SEQ ID NO:707, SEQ ID NO:1383, SEQ ID NO:1395, SEQ ID NO:1518, SEQ ID NO:1540, SEQ ID NO:1552, SEQ ID NO:1570, and SEQ ID NO:1892 are provided in FIG. 30, FIG. 31, FIG. 36, FIG. 42, FIG. 43, FIG. 87, FIG. 88, FIG. 100, FIG. 102, FIG. 103, FIG. 105, and FIG. 129, respectively.

For example, the alignment in FIG. 30 provides the amino acid sequences of Ceres Clone 22671 (SEQ ID NO:590), CeresClone:1079601 (SEQ ID NO:591), 1483277 (SEQ ID NO:593), CeresClone:690625 (SEQ ID NO:594), 1467420 (SEQ ID NO:596), and gi|15042132 (SEQ ID NO:597). Other homologs and/or orthologs of SEQ ID NO:590 include Ceres ANNOT ID no. 6042920 (SEQ ID NO:2276).

The alignment in FIG. 31 provides the amino acid sequences of Ceres Clone 240112 (SEQ ID NO:601), CeresClone:1791988 (SEQ ID NO:603), and gi|50918981 (SEQ ID NO:604). Other homologs and/or orthologs of SEQ ID NO:601 include Ceres CLONE ID no. 1797459 (SEQ ID NO:2133) and Ceres ANNOT ID no. 6011964 (SEQ ID NO:2186).

The alignment in FIG. 36 provides the amino acid sequences of Ceres Clone 2942 (SEQ ID NO:671), CeresClone:1619846 (SEQ ID NO:672), gi|50925955 (SEQ ID NO:673), 1455934 (SEQ ID NO:675), and CeresClone: 337432 (SEQ ID NO:676). Other homologs and/or orthologs of SEQ ID NO:671 include Ceres ANNOT ID no. 6064740 (SEQ ID NO:2292).

The alignment in FIG. 42 provides the amino acid sequences of Ceres Clone 33139 (SEQ ID NO:703), 1503188 (SEQ ID NO:705) and gi|21386951 (SEQ ID NO:2067).

The alignment in FIG. 43 provides the amino acid sequences of Ceres Clone 331755 (SEQ ID NO:707), CeresClone:1775942 (SEQ ID NO:709), gi|34913016 (SEQ ID NO:710), CeresClone:1723374 (SEQ ID NO:711), CeresClone:1847251 (SEQ ID NO:713), gi|38566494 (SEQ ID NO:716), CeresAnnot:1514100 (SEQ ID NO:718), CeresClone:638126 (SEQ ID NO:725), gi|7981380 (SEQ ID NO:726), gi|92894385 (SEQ ID NO:727), and gi|61652985 (SEQ ID NO:728). Other homologs and/or orthologs of SEQ ID NO:707 include Ceres CLONE ID no. 1916571 (SEQ ID NO:715), Ceres ANNOT ID no. 1450327 (SEQ ID NO:720), Ceres ANNOT ID no. 1460832 (SEQ ID NO:722), and Ceres CLONE ID no. 1927753 (SEQ ID NO:724).

Figure 87:
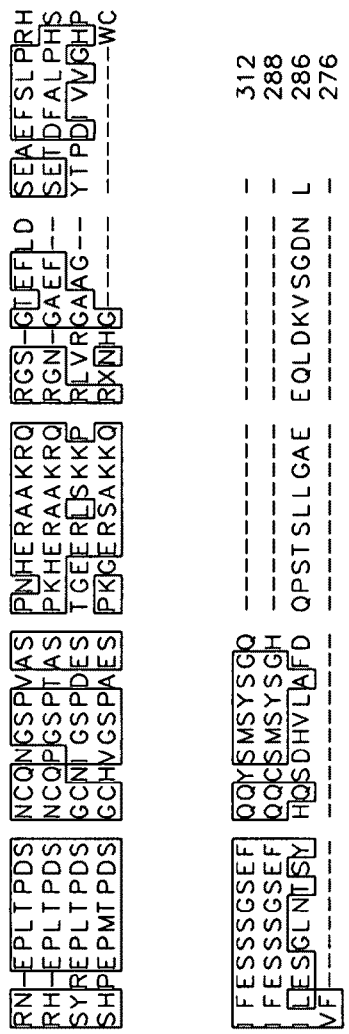
FIG. 87 is an alignment of the amino acid sequence of Ceres Clone 115924 (SEQ ID NO:1383) with homologous and/or orthologous amino acid sequences CeresClone: 894637 (SEQ ID NO:1923), gi|50725048 (SEQ ID NO:1924), and CeresClone:477003 (SEQ ID NO:1922).

The alignment in FIG. 87 provides the amino acid sequences of Ceres Clone 115924 (SEQ ID NO:1383), CeresClone:894637 (SEQ ID NO:1923), gi|50725048 (SEQ ID NO:1924), and CeresClone:477003 (SEQ ID NO:1922). Other homologs and/or orthologs of SEQ ID NO:1383 include Ceres ANNOT ID no. 1453127 (SEQ ID NO:1385), Ceres ANNOT ID no. 1506261 (SEQ ID NO:1387), Ceres ANNOT ID no. 1480332 (SEQ ID NO:1389), Ceres ANNOT ID no. 1454197 (SEQ ID NO:1391), Ceres ANNOT ID no. 6040047 (SEQ ID NO:2268), and Ceres ANNOT ID no. 6078685 (SEQ ID NO:2306).

Figure 88:
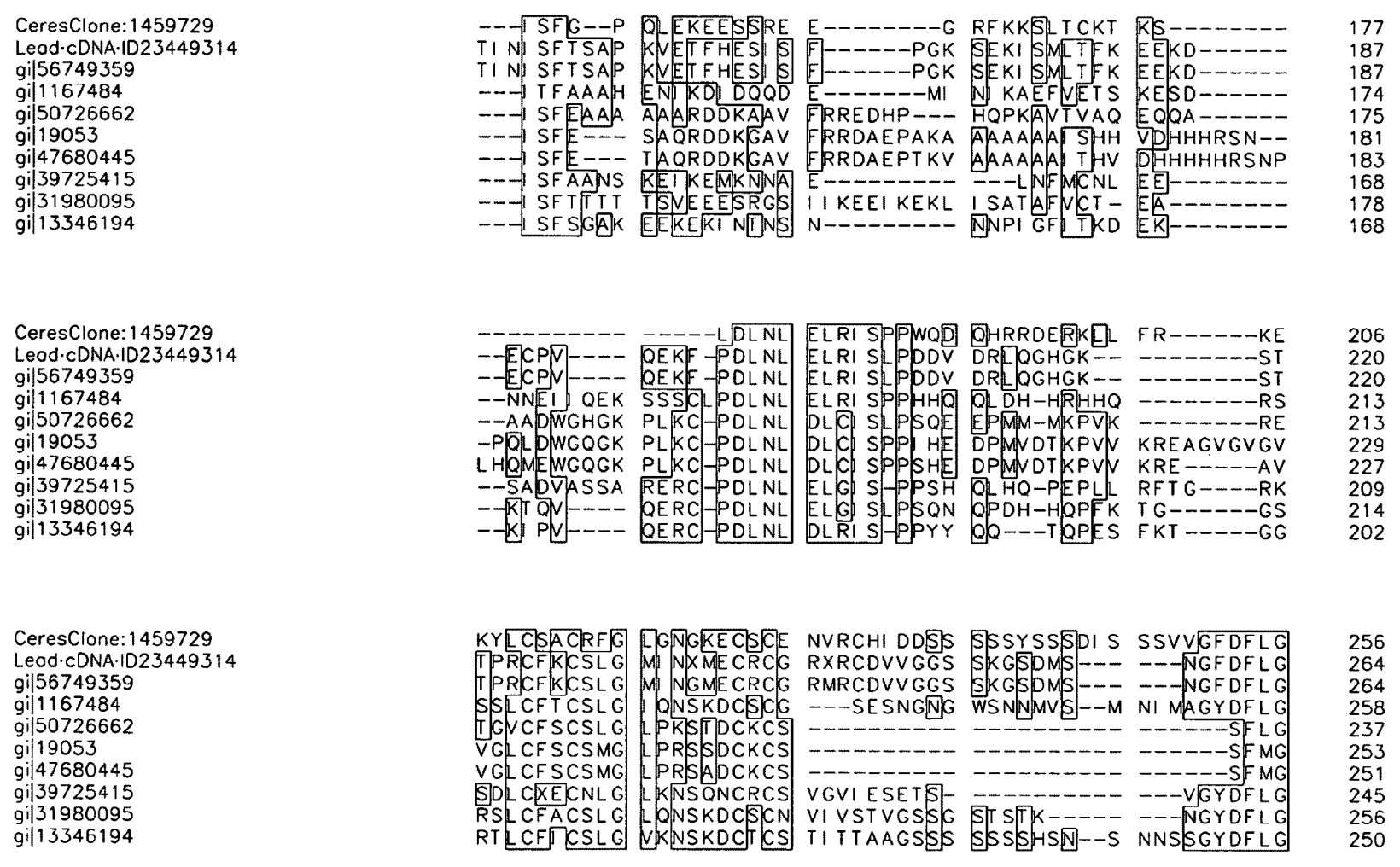

The alignment in FIG. 88 provides the amino acid sequences of cDNA ID 23449314 (Ceres CLONE ID no. 120302; SEQ ID NO:1395), CeresClone:1459729 (SEQ ID NO:2032), gi|56749359 (SEQ ID NO:2019), gi|1167484 (SEQ ID NO:2027), gi|50726662 (SEQ ID NO:2028), gi|19053 (SEQ ID NO:2029), gi|47680445 (SEQ ID NO:2033), gi|39725415 (SEQ ID NO:2025), gi|31980095 (SEQ ID NO:2026), and gi|13346194 (SEQ ID NO:2023). Other homologs and/or orthologs of SEQ ID NO:1395 include Ceres ANNOT ID no. 1450548 (SEQ ID NO:1397), Ceres ANNOT ID no. 1460633 (SEQ ID NO:1399), Ceres ANNOT ID no. 1480232 (SEQ ID NO:1401), Ceres ANNOT ID no. 1478804 (SEQ ID NO:1403), Public GI no. 3941412 (SEQ ID NO:2020), Public GI no. 28628965 (SEQ ID NO:2021), Public GI no. 82308 (SEQ ID NO:2022), Public GI no. 42541167 (SEQ ID NO:2024), Public GI no. 19072766 (SEQ ID NO:2030), Public GI no. 50948275 (SEQ ID NO:2031), and Ceres CLONE ID no. 1963208 (SEQ ID NO:2159).

The alignment in FIG. 100 provides the amino acid sequences of Ceres Clone 25795 (SEQ ID NO:1518) and CeresClone:1104601. Other homologs and/or orthologs of SEQ ID NO:1518 include Ceres ANNOT ID no. 1471291 (SEQ ID NO:1520), Ceres ANNOT ID no. 1444391 (SEQ ID NO:1522), Ceres ANNOT ID no. 1488042 (SEQ ID NO:1524), and Ceres ANNOT ID no. 6042920 (SEQ ID NO:2278).

The alignment in FIG. 102 provides the amino acid sequences of cDNA ID 23792467 (Ceres CLONE ID no. 325800; SEQ ID NO:1540), gi|4519671, gi|32470645, CeresClone:677527, CeresClone:537360, and gi|4835766. Other homologs and/or orthologs of SEQ ID NO:1540 include Ceres ANNOT ID no. 1517851 (SEQ ID NO:1542), Ceres ANNOT ID no. 1464534 (SEQ ID NO:1544), Ceres ANNOT ID no. 1511678 (SEQ ID NO:1546), Ceres ANNOT ID no. 1458433 (SEQ ID NO:1548), and Ceres ANNOT ID no. 1529923 (SEQ ID NO:1550).

The alignment in FIG. 103 provides the amino acid sequences of cDNA ID 23377150 (Ceres CLONE ID no. 33333; SEQ ID NO:1552), CeresClone:543289 (SEQ ID NO:2036), gi|30575840 (SEQ ID NO:2034), and gi|22795039 (SEQ ID NO:2035). Other homologs and/or orthologs of SEQ ID NO:1552 include Ceres ANNOT ID no. 1501772 (SEQ ID NO:1554), Ceres ANNOT ID no. 1519164 (SEQ ID NO:1556), Ceres ANNOT ID no. 1480076 (SEQ ID NO:1558), Ceres ANNOT ID no. 1524008 (SEQ ID NO:1560), and Ceres ANNOT ID no. 1480159 (SEQ ID NO:1562).

The alignment in FIG. 105 provides the amino acid sequences of ME LINE ME0130 (Ceres CLONE ID no. 34589; SEQ ID NO:1570) and CeresClone:975220 (SEQ ID NO:1979). Other homologs and/or orthologs of SEQ ID NO:1570 include Ceres CLONE ID no. 539578 (SEQ ID NO:1571).

The alignment in FIG. 129 provides the amino acid sequences of Annot ID:1493072 (SEQ ID NO:1892), gi|39725413 (SEQ ID NO:1894) and gi|71041096 (SEQ ID NO:1895). Other homologs and/or orthologs of SEQ ID NO:1892 include Ceres ANNOT ID no. 1461478 (SEQ ID NO:1893).

Amino acid sequences of homologs and/or orthologs of the polypeptide having the amino acid sequence set forth in SEQ ID NO:1838 include Ceres ANNOT ID no. 1487827 (SEQ ID NO:2113), Ceres ANNOT ID no. 6040882 (SEQ ID NO:2270), and Ceres ANNOT ID no. 6108946 (SEQ ID NO:2372).

Amino acid sequences of homologs and/or orthologs of the polypeptide having the amino acid sequence set forth in SEQ ID NO:599 include Ceres ANNOT ID no. 6018481 (SEQ ID NO:2218).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NO:591, SEQ ID NOs:593-594, SEQ ID NOs:596-597, SEQ ID NOs:603-604, SEQ ID NOs:672-673, SEQ ID NOs:675-676, SEQ ID NO:705, SEQ ID NO:2067, SEQ ID NOs:709-711, SEQ ID NO:713, SEQ ID NOs:715-716, SEQ ID NO:718, SEQ ID NO:720, SEQ ID NO:722, SEQ ID NOs:724-728, SEQ ID NO:1385, SEQ ID NO:1387, SEQ ID NO:1389, SEQ ID NO:1391, SEQ ID NOs:1922-1924, SEQ ID NO:1397, SEQ ID NO:1399, SEQ ID NO:1401, SEQ ID NO:1403, SEQ ID NOs:2019-2033, SEQ ID NO:1520, SEQ ID NO:1522, SEQ ID NO:1524, CeresClone:1104601, SEQ ID NO:1542, SEQ ID NO:1544, SEQ ID NO:1546, SEQ ID NO:1548, SEQ ID NO:1550, gi|4519671, gi|32470645, CeresClone:677527, CeresClone:537360, gi|4835766, SEQ ID NO:1554, SEQ ID NO:1556, SEQ ID NO:1558, SEQ ID NO:1560, SEQ ID NO:1562, SEQ ID NOs:2034-2036, SEQ ID NO:1571, SEQ ID NO:1979, SEQ ID NOs:1893-1895, SEQ ID NO:2113, SEQ ID NO:2133, SEQ ID NO:2159, SEQ ID NO:2186, SEQ ID NO:2218, SEQ ID NO:2268, SEQ ID NO:2270, SEQ ID NO:2276, SEQ ID NO:2278, SEQ ID NO:2292, SEQ ID NO:2306, or SEQ ID NO:2342.

A regulatory protein can have an HLH (helix-loop-helix) DNA binding domain characteristic of basic-helix-loop-helix (bHLH) transcription factors. Basic-helix-loop-helix transcription factors belong to a family of transcriptional regulators present in eukaryotes. Many different functions have been identified for bHLH transcription factors in animals, including control of cell proliferation and development of specific cell lineages. In plants, bHLH transcription factors are thought to have various roles in plant cell and tissue development as well as plant metabolism. The mechanism whereby bHLH transcription factors control gene transcription often involves homo- or hetero-dimerization. Basic-helix-loop-helix transcription factors constitute one of the largest families of transcription factors in *Arabidopsis thaliana*. Comparisons with animal sequences suggest that the majority of plant bHLH genes have evolved from the ancestral group B class of bHLH genes. Twelve sub-families have been identified. Within each of these main groups, there are conserved amino acid sequence motifs outside the DNA binding domain. SEQ ID NO:409, SEQ ID NO:526, SEQ ID NO:566, SEQ ID NO:833, SEQ ID NO:1058, SEQ ID NO:1129, SEQ ID NO:1163, SEQ ID NO:1361, SEQ ID NO:1785, SEQ ID NO:1806, and SEQ ID NO:1872 set forth the amino acid sequences of DNA clones, identified herein as Ceres CLONE ID no. 118001 (SEQ ID NO:408), Ceres CLONE ID no. 16284 (SEQ ID NO:525), Ceres CLONE ID no. 21406 (SEQ ID NO:565), Ceres CLONE ID no. 388074 (SEQ ID NO:832), Ceres CLONE ID no. 558003 (SEQ ID NO:1057), Ceres CLONE ID no. 93825 (SEQ ID NO:1128), Ceres CLONE ID no. 98716 (SEQ ID NO:1162), Ceres CLONE ID no. 560948 (SEQ ID NO:1360), Ceres CLONE ID no. 8607 (SEQ ID NO:1784), Ceres CLONE ID no. 519 (SEQ ID NO:1805), and Ceres CLONE ID no. 35890 (SEQ ID NO:1871), respectively, each of which is predicted to encode a polypeptide having a Pfam domain as indicated in the Sequence Listing (e.g., an HLH DNA binding domain).

A regulatory protein can comprise the amino acid sequence set forth in SEQ ID NO:409, SEQ ID NO:526, SEQ ID NO:566, SEQ ID NO:833, SEQ ID NO:1058, SEQ ID NO:1129, SEQ ID NO:1163, SEQ ID NO:1361, SEQ ID NO:1785, SEQ ID NO:1806, or SEQ ID NO:1872. In some cases, a regulatory protein can be a homolog, ortholog, or variant of the polypeptide having the amino acid sequence set forth in SEQ ID NO:409, SEQ ID NO:526, SEQ ID NO:566, SEQ ID NO:833, SEQ ID NO:1058, SEQ ID NO:1129, SEQ ID NO:1163, SEQ ID NO:1361, SEQ ID NO:1785, SEQ ID NO:1806, or SEQ ID NO:1872. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:409, SEQ ID NO:526, SEQ ID NO:566, SEQ ID NO:833, SEQ ID NO:1058, SEQ ID NO:1129, SEQ ID NO:1163, SEQ ID NO:1361, SEQ ID NO:1785, SEQ ID NO:1806, or SEQ ID NO:1872.

Amino acid sequences of homologs and/or orthologs of the polypeptide having the amino acid sequence set forth in SEQ ID NO:526, SEQ ID NO:566, SEQ ID NO:1361, SEQ ID NO:1785, and SEQ ID NO:1806 are provided in FIG. 24, FIG. 28, FIG. 84, FIG. 125, and FIG. 126, respectively.

For example, the alignment in FIG. 24 provides the amino acid sequences of Ceres Clone 16284 (SEQ ID NO:526) and CeresClone:976709 (SEQ ID NO:527). Other homologs and/or orthologs of SEQ ID NO:526 include Ceres ANNOT ID no. 6106469 (SEQ ID NO:2338).

The alignment in FIG. 28 provides the amino acid sequences of Ceres Clone 21406 (SEQ ID NO:566), gi|24030386 (SEQ ID NO:567), gi|6850309 (SEQ ID NO:568), CeresAnnot:1498288 (SEQ ID NO:572), and CeresAnnot:1471938 (SEQ ID NO:574). Other homologs and/or orthologs of SEQ ID NO:566 include Ceres ANNOT ID no. 1525350 (SEQ ID NO:570), Public GI no. 34907702 (SEQ ID NO:575), Ceres CLONE ID no. 474693 (SEQ ID NO:576), Ceres ANNOT ID no. 1445304 (SEQ ID NO:578), Ceres CLONE ID no. 324760 (SEQ ID NO:579), Ceres CLONE ID no. 1940689 (SEQ ID NO:581), and Ceres CLONE ID no. 1806146 (SEQ ID NO:2063).

Figure 84:
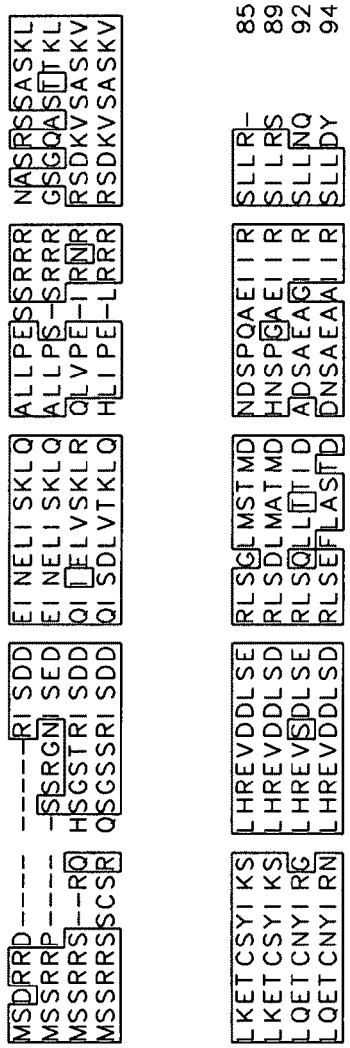
FIG. 84 is an alignment of the amino acid sequence of CeresClone:560948 (SEQ ID NO:1361) with homologous and/or orthologous amino acid sequences Ceres Clone: 945972 (SEQ ID NO:1362), Ceres Clone: 503296 (SEQ ID NO:1367), and CeresClone:1759397 (SEQ ID NO:1369).

The alignment in FIG. 84 provides the amino acid sequences of CeresClone:560948 (SEQ ID NO:1361), Ceres Clone: 945972 (SEQ ID NO:1362), Ceres Clone: 503296 (SEQ ID NO:1367), and CeresClone:1759397 (SEQ ID NO:1369). Other homologs and/or orthologs of SEQ ID NO:1361 include Public GI no. 22331645 (SEQ ID NO:1363), Public GI no. 31431968 (SEQ ID NO:1364), Public GI no. 50912765 (SEQ ID NO:1365), and Ceres CLONE ID no. 486120 (SEQ ID NO:1366).

The alignment in FIG. 125 provides the amino acid sequences of cDNA ID 23557650 (Ceres CLONE ID no. 8607; SEQ ID NO:1785), CeresClone:1033993 (SEQ ID NO:1786), CeresClone:703180 (SEQ ID NO:1787), CeresClone:560681 (SEQ ID NO:1788), CeresClone:560948 (SEQ ID NO:1790), CeresClone:653656 (SEQ ID NO:1792), gi|50929085 (SEQ ID NO:1794), gi|50912765 (SEQ ID NO:1795), CeresClone:503296 (SEQ ID NO:1796), and CeresClone:486120 (SEQ ID NO:1797). Other homologs and/or orthologs of SEQ ID NO:1785 include Ceres CLONE ID no. 562428 (SEQ ID NO:1789), Ceres CLONE ID no. 630731 (SEQ ID NO:1791), Ceres CLONE ID no. 663844 (SEQ ID NO:1793), Ceres CLONE ID no. 237390 (SEQ ID NO:1798), Public GI no. 22331645 (SEQ ID NO:1799), Public GI no. 31431968 (SEQ ID NO:1800), Public GI no. 50912765 (SEQ ID NO:1801), Public GI no. 78708592 (SEQ ID NO:1802), Ceres CLONE ID no. 486120 (SEQ ID NO:1803), and Ceres CLONE ID no. 503296 (SEQ ID NO:1804).

The alignment in FIG. 126 provides the amino acid sequences of CeresClone:519 (SEQ ID NO:1806), CeresClone:951040 (SEQ ID NO:1811), CeresClone:703180 (SEQ ID NO:1814), and 1247092 (SEQ ID NO:1820). Other homologs and/or orthologs of SEQ ID NO:1806 include Public GI no. 90399109 (SEQ ID NO:1807), Public GI no. 21671920 (SEQ ID NO:1808), Ceres CLONE ID no. 609713 (SEQ ID NO:1809), Public GI no. 22331645 (SEQ ID NO:1810), Public GI no. 28416803 (SEQ ID NO:1812), Ceres CLONE ID no. 18200 (SEQ ID NO:1813), Ceres CLONE ID no. 560681 (SEQ ID NO:1815), Ceres CLONE ID no. 562428 (SEQ ID NO:1816), Ceres CLONE ID no. 560948 (SEQ ID NO:1817), Ceres CLONE ID no. 653656 (SEQ ID NO:1818), Ceres CLONE ID no. 663844 (SEQ ID NO:1819), and Ceres ANNOT ID no. 1468218 (SEQ ID NO:2105).

Amino acid sequences of homologs and/or orthologs of the polypeptide having the amino acid sequence set forth in SEQ ID NO:1163 include Ceres ANNOT ID no. 6016768 (SEQ ID NO:2208).

Amino acid sequences of homologs and/or orthologs of the polypeptide having the amino acid sequence set forth in SEQ ID NO:409 include Ceres ANNOT ID no. 6039189 (SEQ ID NO:2260).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NO:527, SEQ ID NOs:567-568, SEQ ID NO:570, SEQ ID NO:572, SEQ ID NOs:574-576, SEQ ID NOs:578-579, SEQ ID NO:581, SEQ ID NO:2063, SEQ ID NOs:1362-1367, SEQ ID NO:1369, SEQ ID NOs:1786-1804, SEQ ID NOs:1807-1820, SEQ ID NO:2105, SEQ ID NO:2208, SEQ ID NO:2260, or SEQ ID NO:2338.

A regulatory protein can contain an SRF-TF domain characteristic of an SRF-type transcription factor (DNA binding and dimerization domain) polypeptide. Human serum response factor (SRF) is a ubiquitous nuclear polypeptide important for cell proliferation and differentiation. SRF function is essential for transcriptional regulation of numerous growth-factor-inducible genes, such as the c-fos oncogene and muscle-specific actin genes. A core domain of about 90 amino acids is sufficient for the activities of DNA binding, dimerization, and interaction with accessory factors. Within the core is a DNA binding region, designated the MADS box, that is highly similar to many eukaryotic regulatory proteins, including the Agamous and Deficiens families of plant homeotic polypeptides. SEQ ID NO:461 sets forth the amino acid sequence of a DNA clone, identified herein as Ceres CLONE ID no. 1480 (SEQ ID NO:460), that is predicted to encode a polypeptide containing a Pfam domain as indicated in the Sequence Listing (e.g., an SRF-TF domain).

In some cases, a regulatory protein can contain an SRF-TF domain and a K-box region. Moreover, a K-box region is commonly found associated with SRF-type transcription factors. The K-box is predicted to have a coiled-coil structure and play a role in multimer formation. SEQ ID NO:760, SEQ ID NO:865, SEQ ID NO:980, and SEQ ID NO:1767 set forth the amino acid sequences of DNA clones, identified herein as Ceres CLONE ID no. 34635 (SEQ ID NO:759), Ceres CLONE ID no. 40334 (SEQ ID NO:864), Ceres CLONE ID no. 542773 (SEQ ID NO:979), and Ceres CLONE ID no. 32791 (SEQ ID NO:1766), respectively, each of which is predicted to encode a Pfam domain as indicated in the Sequence Listing (e.g., an SRF-type transcription factor polypeptide having a K-box region).

A regulatory protein can comprise the amino acid sequence set forth in SEQ ID NO:461, SEQ ID NO:760, SEQ ID NO:865, SEQ ID NO:980, or SEQ ID NO:1767. In some cases, a regulatory protein can be a homolog, ortholog, or variant of the polypeptide having the amino acid sequence set forth in SEQ ID NO:461, SEQ ID NO:760, SEQ ID NO:865, SEQ ID NO:980, or SEQ ID NO:1767. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:461, SEQ ID NO:760, SEQ ID NO:865, SEQ ID NO:980, or SEQ ID NO:1767.

Amino acid sequences of homologs and/or orthologs of the polypeptide having the amino acid sequence set forth in SEQ ID NO:461, SEQ ID NO:760, SEQ ID NO:865, SEQ ID NO:980, and SEQ ID NO:1767 are provided in FIG. 19, FIG. 47, FIG. 55, FIG. 61, and FIG. 123, respectively.

For example, the alignment in FIG. 19 provides the amino acid sequences of CeresClone:1480 (SEQ ID NO:461), CeresClone:1067639 (SEQ ID NO:462) and CeresClone:1068473 (SEQ ID NO:463). Other homologs and/or orthologs of SEQ ID NO:461 include Ceres ANNOT ID no. 6016483 (SEQ ID NO:2196).

Figure 47:
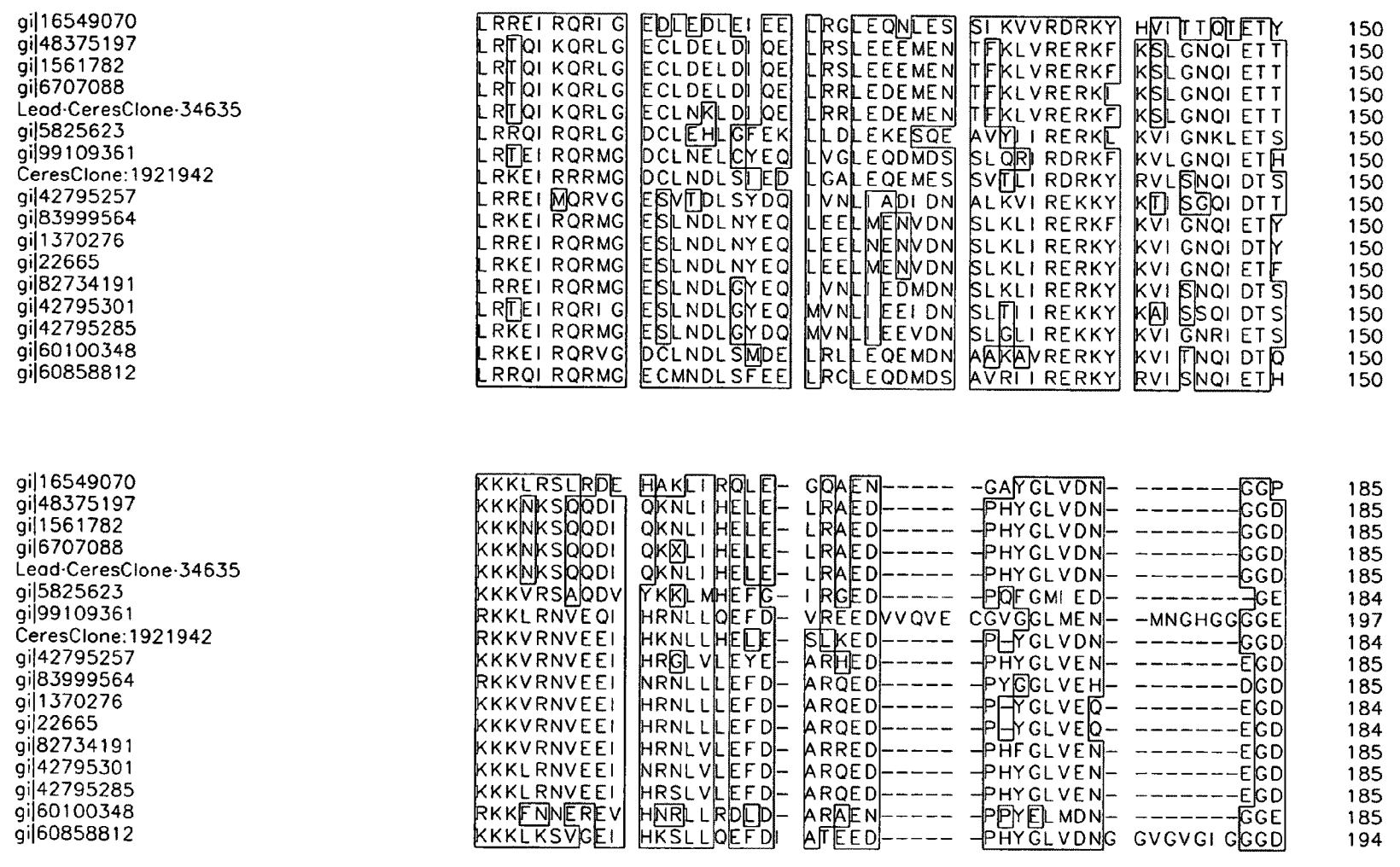
Figure 47:
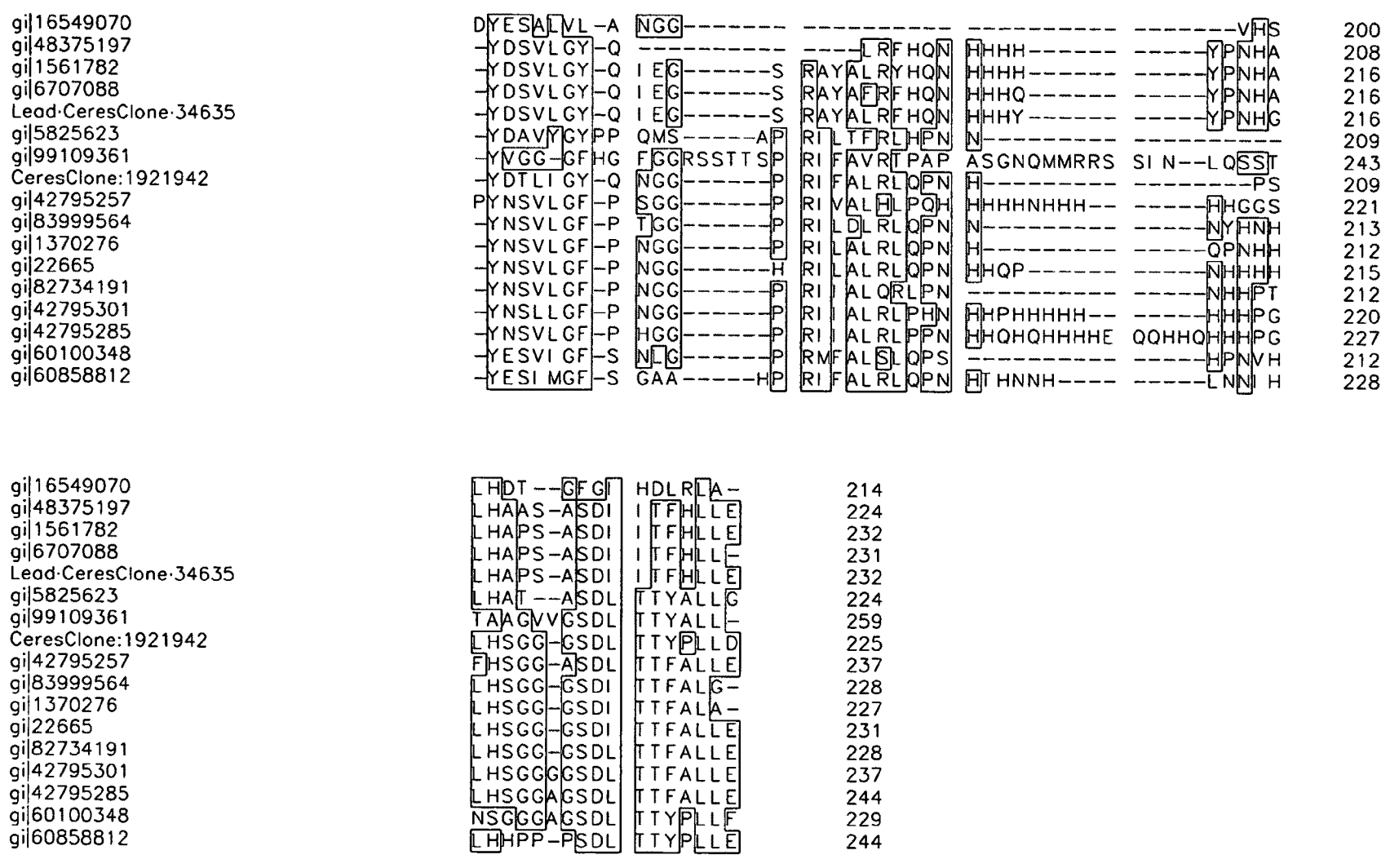

The alignment in FIG. 47 provides the amino acid sequences of Ceres Clone 34635 (SEQ ID NO:760), gi|6707088 (SEQ ID NO:761), gi|48375197 (SEQ ID NO:762), gi|11561782 (SEQ ID NO:763), CeresClone:1921942 (SEQ ID NO:765), gi|1370276 (SEQ ID NO:766), gi|22665 (SEQ ID NO:767), gi|60858812 (SEQ ID NO:768), gi|82734191 (SEQ ID NO:769), gi|99109361 (SEQ ID NO:770), gi|42795301 (SEQ ID NO:771), gi|83999564 (SEQ ID NO:772), gi|42795285 (SEQ ID NO:773), gi|42795257 (SEQ ID NO:774), gi|16549070 (SEQ ID NO:775), gi|60100348 (SEQ ID NO:776), and gi|5825623 (SEQ ID NO:777).

Figure 55:
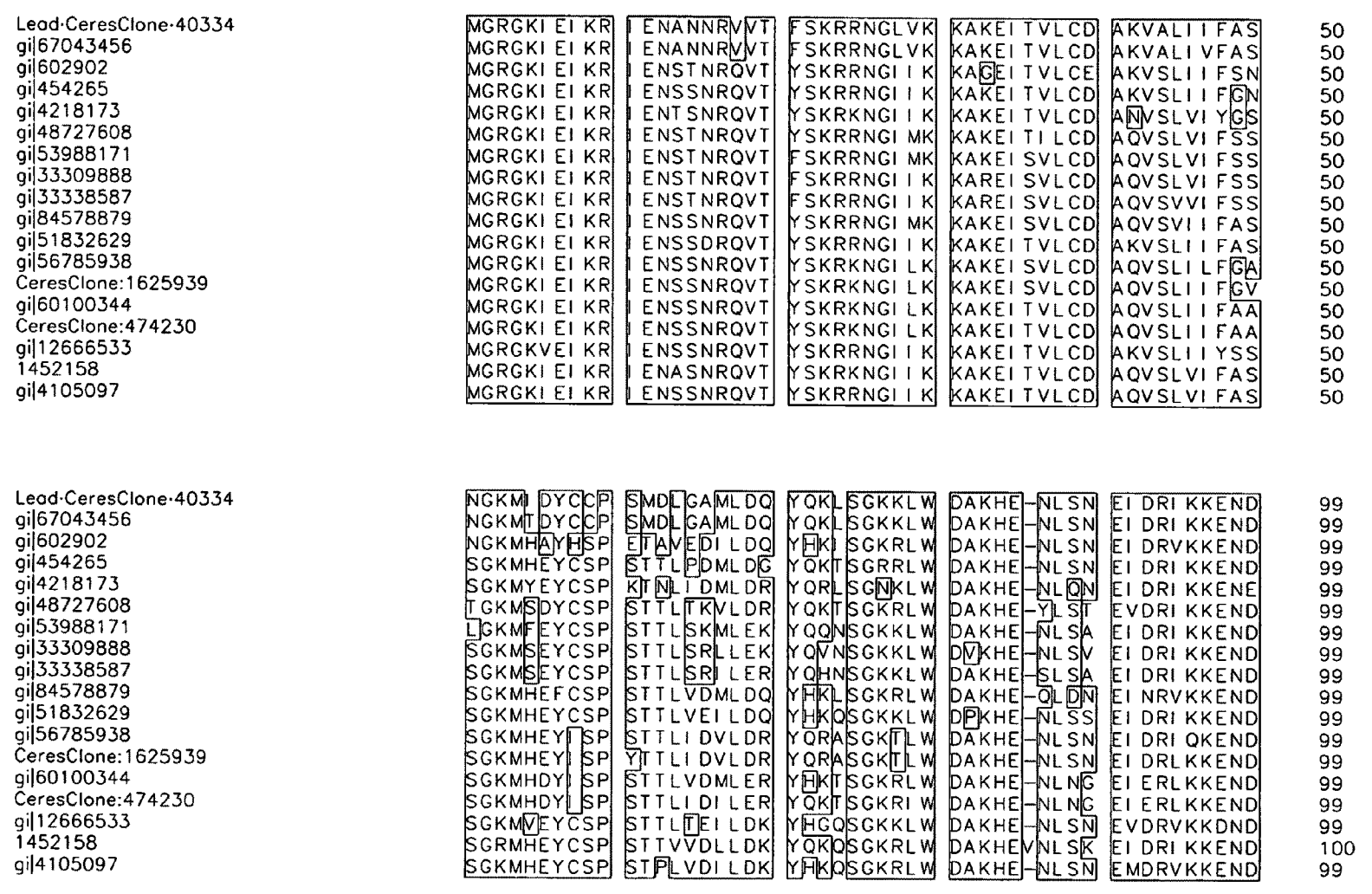

The alignment in FIG. 55 provides the amino acid sequences of Ceres Clone 40334 (SEQ ID NO:865), gi|67043456 (SEQ ID NO:866), 1452158 (SEQ ID NO:868), gi|4105097 (SEQ ID NO:869), gi|56785938 (SEQ ID NO:870), CeresClone:1625939 (SEQ ID NO:871), gi|12666533 (SEQ ID NO:872), gi|60100344 (SEQ ID NO:873), gi|51832629 (SEQ ID NO:874), CeresClone:474230 (SEQ ID NO:875), gi|454265 (SEQ ID NO:876), gi|53988171 (SEQ ID NO:877), gi|48727608 (SEQ ID NO:878), gi|602902 (SEQ ID NO:879), gi|33338587 (SEQ ID NO:880), gi|4218173 (SEQ ID NO:881), gi|33309888 (SEQ ID NO:882), and gi|84578879 (SEQ ID NO:883). Other homologs and/or orthologs of SEQ ID NO:865 include Ceres ANNOT ID no. 6016483 (SEQ ID NO:2198) and Ceres ANNOT ID no. 6031322 (SEQ ID NO:2246).

The alignment in FIG. 61 provides the amino acid sequences of Ceres Clone 542773 (SEQ ID NO:980), CeresClone:1845589 (SEQ ID NO:982), gi|50924820 (SEQ ID NO:983), gi|34452085 (SEQ ID NO:984), gi|1816459 (SEQ ID NO:985), gi|15081463 (SEQ ID NO:986), gi|2959320 (SEQ ID NO:987), and gi|29611976 (SEQ ID NO:988). Other homologs and/or orthologs of SEQ ID NO:980 include Public GI no. 9964296 (SEQ ID NO:989), Public GI no. 30313677 (SEQ ID NO:990), Public GI no. 29028834 (SEQ ID NO:991), Public GI no. 63079855 (SEQ ID NO:992), Ceres ANNOT ID no. 6016517 (SEQ ID NO:2200), and Ceres ANNOT ID no. 6025104 (SEQ ID NO:2228).

The alignment in FIG. 123 provides the amino acid sequences of cDNA ID 23556617 (Ceres CLONE ID no. 32791; SEQ ID NO:1767), gi|1568513 (SEQ ID NO:1769), gi|20385590 (SEQ ID NO:1770), gi|27763670 (SEQ ID NO:1771), gi|60100358 (SEQ ID NO:1772), gi|48727598 (SEQ ID NO:1774), gi|21955182 (SEQ ID NO:1775), gi|3646326 (SEQ ID NO:1998), CeresClone:1044034 (SEQ ID NO:1999), gi|23194453 (SEQ ID NO:1997), gi|4103342 (SEQ ID NO:2000), gi|42794560 (SEQ ID NO:2003), gi|57157565 (SEQ ID NO:2002), and gi|29467048 (SEQ ID NO:2004). Other homologs and/or orthologs of SEQ ID NO:1767 include Public GI no. 30313671 (SEQ ID NO:1768), Public GI no. 42794566 (SEQ ID NO:1773), Ceres ANNOT ID no. 1540248 (SEQ ID NO:1777), Public GI no. 2997615 (SEQ ID NO:2001), and Public GI no. 1067169 (SEQ ID NO:2005).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 462-463, SEQ ID NOs:761-763, SEQ ID NOs:765-777, SEQ ID NO:866, SEQ ID NOs:868-883, SEQ ID NOs:982-992, SEQ ID NOs:1768-1775, SEQ ID NO:1777, SEQ ID NOs:1997-2005, SEQ ID NO:2196, SEQ ID NO:2198, SEQ ID NO:2200, SEQ ID NO:2228, or SEQ ID NO:2246.

A regulatory protein can have one or more domains characteristic of a basic-leucine zipper (bZIP) transcription factor polypeptide. For example, a regulatory protein can have a bZIP_1 domain. The bZIP transcription factor polypeptides of eukaryotes contain a basic region mediating sequence-specific DNA binding and a leucine zipper region that is required for dimerization. In plants, bZIP transcription factors regulate processes including pathogen defense, light and stress signaling, seed maturation and flower development. The *Arabidopsis* genome sequence contains at least 70 distinct members of the bZIP family. SEQ ID NO:1840 and SEQ ID NO:1904 set forth the amino acid sequences of DNA clones, identified herein as Ceres CLONE ID no. 14432 (SEQ ID NO:1839) and Ceres CLONE ID no. 33016 (SEQ ID NO:1903), respectively, each of which is predicted to encode a polypeptide containing a Pfam domain as indicated in the Sequence Listing (e.g., a bZIP_1 domain).

In some cases, a regulatory protein can contain a bZIP_2 domain characteristic of a bZIP transcription factor polypeptide. SEQ ID NO:608 and SEQ ID NO:614 set forth the amino acid sequences of DNA clones, identified herein as Ceres CLONE ID no. 25211 (SEQ ID NO:607) and Ceres CLONE ID no. 2831 (SEQ ID NO:613), respectively, each of which is predicted to encode a polypeptide containing a Pfam domain as indicated in the Sequence Listing (e.g., a bZIP_2 domain).

In some cases, a regulatory protein can have a bZIP_Maf domain and an MFMR domain, both of which are characteristic of basic region leucine zipper (bZIP) domain-containing transcription factor polypeptides. The Maf family of basic region leucine zipper (bZIP) domain-containing transcription factor polypeptides may be related to bZIP_1. An MFMR region is found in the N-terminus of the bZIP_1 transcription factor domain. The N-terminal half is rich in proline residues and has been termed the PRD (proline rich domain). The C-terminal half is more polar and has been called the MFMR (multifunctional mosaic region). SEQ ID NO:1735 sets forth the amino acid sequence of a DNA clone, identified herein as Ceres ANNOT ID no. 834509 (SEQ ID NO:1734), that is predicted to encode a polypeptide having a Pfam domain as indicated in the Sequence Listing (e.g., a bZIP_Maf domain and an MFMR domain).

A regulatory protein can comprise the amino acid sequence set forth in SEQ ID NO:1840, SEQ ID NO:1904, SEQ ID NO:608, SEQ ID NO:614, or SEQ ID NO:1735. In some cases, a regulatory protein can be a homolog, ortholog, or variant of the polypeptide having the amino acid sequence set forth in SEQ ID NO:1840, SEQ ID NO:1904, SEQ ID NO:608, SEQ ID NO:614, or SEQ ID NO:1735. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:1840, SEQ ID NO:1904, SEQ ID NO:608, SEQ ID NO:614, or SEQ ID NO:1735.

Figure 32:
FIG. 32 is an alignment of the amino acid sequence of Ceres Clone 2831 (SEQ ID NO:614) with homologous and/or orthologous amino acid sequences CeresClone:1385680 (SEQ ID NO:617), CeresAnnot:1497776 (SEQ ID NO:619), gi|9650826 (SEQ ID NO:622), CeresClone:1728175 (SEQ ID NO:623), gi|2244744 (SEQ ID NO:624), CeresClone:676378 (SEQ ID NO:625), gi|77999786 (SEQ ID NO:626), gi|16580132 (SEQ ID NO:627), gi|3986151 (SEQ ID NO:629), gi|77556137 (SEQ ID NO:630), gi|72398495 (SEQ ID NO:631), gi|5901747 (SEQ ID NO:633), gi|40019253 (SEQ ID NO:634), and gi|62898531 (SEQ ID NO:635).

Amino acid sequences of homologs and/or orthologs of the polypeptide having the amino acid sequence set forth in SEQ ID NO:614 and SEQ ID NO:1735 are provided in FIG. 32 and FIG. 121, respectively.

Amino acid sequences of homologs and/or orthologs of the polypeptide having the amino acid sequence set forth in SEQ ID NO:1904 include Ceres ANNOT ID no. 1451996 (SEQ ID NO:2097) and Ceres ANNOT ID no. 6006703 (SEQ ID NO:2166).

For example, the alignment in FIG. 32 provides the amino acid sequences of Ceres Clone 2831 (SEQ ID NO:614), CeresClone:1385680 (SEQ ID NO:617), CeresAnnot: 1497776 (SEQ ID NO:619), gi|9650826 (SEQ ID NO:622), CeresClone:1728175 (SEQ ID NO:623), gi|2244744 (SEQ ID NO:624), CeresClone:676378 (SEQ ID NO:625), gi|77999786 (SEQ ID NO:626), gi|16580132 (SEQ ID NO:627), gi|3986151 (SEQ ID NO:629), gi|77556137 (SEQ ID NO:630), gi|72398495 (SEQ ID NO:631), gi|5901747 (SEQ ID NO:633), gi|40019253 (SEQ ID NO:634), and gi|62898531 (SEQ ID NO:635). Other homologs and/or orthologs of SEQ ID NO:614 include Public GI no. 15228754 (SEQ ID NO:615), Ceres CLONE ID no. 29982 (SEQ ID NO:616), Ceres ANNOT ID no. 1471578 (SEQ ID NO:621), Public GI no. 10241920 (SEQ ID NO:628), Public GI no. 72398497 (SEQ ID NO:632), and Ceres CLONE ID no. 869920 (SEQ ID NO:636).

The alignment in FIG. 121 provides the amino acid sequences of cDNA ID 23522373 5110H5 (Ceres ANNOT ID no. 834509; SEQ ID NO:1735), gi|3608135 (SEQ ID NO:1736), gi|3336903 (SEQ ID NO:1738), CeresClone: 545441 (SEQ ID NO:1739), gi|5381313 (SEQ ID NO:1740), gi|3336906 (SEQ ID NO:1741), gi|13775109 (SEQ ID NO:1742), gi|435942 (SEQ ID NO:1743), and CeresClone: 287677 (SEQ ID NO:1746). Other homologs and/or orthologs of SEQ ID NO:1735 include Ceres CLONE ID no. 1188156 (SEQ ID NO:1737), Ceres CLONE ID no. 523155 (SEQ ID NO:1744), Public GI no. 13775107 (SEQ ID NO:1745), Ceres ANNOT ID no. 1538994 (SEQ ID NO:1747), Ceres ANNOT ID no. 1447080 (SEQ ID NO:1749), and Ceres CLONE ID no. 1188156 (SEQ ID NO:1750).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 615-617, SEQ ID NO:619, SEQ ID NOs:621-636, SEQ ID NOs:1736-1747, SEQ ID NOs:1749-1750, SEQ ID NO:2097, or SEQ ID NO:2166.

A regulatory protein can have a NAM domain characteristic of a No apical meristem (NAM) polypeptide. No apical meristem (NAM) polypeptides are plant development polypeptides. NAM is indicated as having a role in determining positions of meristems and primordia. The NAM domain (NAM for *Petunia hybrida* and ATAF1, ATAF2, and CUC2 for *Arabidopsis*) is an N-terminal module of about 160 amino acids, which is found in polypeptides of the NAC family of plant-specific transcriptional regulators (no apical meristem polypeptides). NAC proteins are involved in developmental processes, including formation of the shoot apical meristem, floral organs and lateral shoots, as well as in plant hormonal control and defense. The NAC domain is accompanied by diverse C-terminal transcriptional activation domains. The NAC domain has been shown to be a DNA-binding domain and a dimerization domain. SEQ ID NO:165, SEQ ID NO:413, SEQ ID NO:555, SEQ ID NO:1104, and SEQ ID NO:1830 set forth the amino acid sequences of DNA clones, identified herein as Ceres ANNOT ID no. 840236 (SEQ ID NO:164), Ceres CLONE ID no. 119460 (SEQ ID NO:412), Ceres CLONE ID no. 205648 (SEQ ID NO:554), Ceres CLONE ID no. 8334 (SEQ ID NO:1103), and Ceres CLONE ID no. 100085 (SEQ ID NO:1829), respectively, each of which is predicted to encode a polypeptide containing a Pfam domain as indicated in the Sequence Listing (e.g., a NAM domain).

A regulatory protein can comprise the amino acid sequence set forth in SEQ ID NO:165, SEQ ID NO:413, SEQ ID NO:555, SEQ ID NO:1104, or SEQ ID NO:1830. In some cases, a regulatory protein can be a homolog, ortholog, or variant of the polypeptide having the amino acid sequence set forth in SEQ ID NO:165, SEQ ID NO:413, SEQ ID NO:555, SEQ ID NO:1104, or SEQ ID NO:1830. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:165, SEQ ID NO:413, SEQ ID NO:555, SEQ ID NO:1104, or SEQ ID NO:1830.

Amino acid sequences of homologs and/or orthologs of the polypeptide having the amino acid sequence set forth in SEQ ID NO:165, SEQ ID NO:555, and SEQ ID NO:1104 are provided in FIG. 6, FIG. 27, and FIG. 67, respectively.

For example, the alignment in FIG. 6 provides the amino acid sequences of Annot ID 840236 (SEQ ID NO:165) and gi|21105736 (SEQ ID NO:168). Other homologs and/or orthologs of SEQ ID NO:165 include Public GI no. 8567777 (SEQ ID NO:166) and Public GI no. 42572353 (SEQ ID NO:167).

The alignment in FIG. 27 provides the amino acid sequences of Ceres Clone 205648 (SEQ ID NO:555), gi|102139801 (SEQ ID NO:556), gi|15148912 (SEQ ID NO:557), CeresClone:577178 (SEQ ID NO:558), Ceres-Clone:644344 (SEQ ID NO:559), gi|52076897 (SEQ ID NO:560), CeresClone:1674566 (SEQ ID NO:561), CeresAnnot:1456842 (SEQ ID NO:563), and gi|34558777 (SEQ ID NO:564). Other homologs and/or orthologs of SEQ ID NO:555 include Ceres ANNOT ID no. 6090309 (SEQ ID NO:2322) and Ceres ANNOT ID no. 6099734 (SEQ ID NO:2334).

The alignment in FIG. 67 provides the amino acid sequences of Ceres Clone 8334 (SEQ ID NO:1104), gi|30984532 (SEQ ID NO:1105) and CeresClone:1923641 (SEQ ID NO:1125). Other homologs and/or orthologs of SEQ ID NO:1104 include Ceres CLONE ID no. 114858 (SEQ ID NO:1106), Ceres CLONE ID no. 1296788 (SEQ ID NO:1107), Ceres CLONE ID no. 1927853 (SEQ ID NO:1109), Ceres CLONE ID no. 673567 (SEQ ID NO:1110), Ceres CLONE ID no. 1306145 (SEQ ID NO:1111), Public GI no. 27529810 (SEQ ID NO:1112), Public GI no. 50924810

(SEQ ID NO:1113), Ceres CLONE ID no. 900490 (SEQ ID NO:1114), Ceres CLONE ID no. 1564140 (SEQ ID NO:1115), Ceres CLONE ID no. 1862399 (SEQ ID NO:1117), Ceres CLONE ID no. 835085 (SEQ ID NO:1118), Ceres CLONE ID no. 1562064 (SEQ ID NO:1119), Public GI no. 4218537 (SEQ ID NO:1120), Ceres CLONE ID no. 1821898 (SEQ ID NO:1122), Public GI no. 82400209 (SEQ ID NO:1123), Public GI no. 53749461 (SEQ ID NO:1126), Ceres CLONE ID no. 1603975 (SEQ ID NO:1127), and Ceres ANNOT ID no. 6112668 (SEQ ID NO:2348).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 166-168, SEQ ID NOs:556-561, SEQ ID NOs:563-564, SEQ ID NOs:1105-1107, SEQ ID NOs:1109-1115, SEQ ID NOs: 1117-1120, SEQ ID NOs:1122-1123, SEQ ID NOs:1125-1127, SEQ ID NO:2322, SEQ ID NO:2334, or SEQ ID NO:2348.

A regulatory protein can contain an SBP domain. SBP (SQUAMOSA-PROMOTER BINDING PROTEIN) domains are found in plant polypeptides. The SBP plant polypeptide domain is a sequence specific DNA-binding domain. Polypeptides with this domain probably function as transcription factors involved in the control of early flower development. The domain contains 10 conserved cysteine and histidine residues that are likely to be zinc ligands. SEQ ID NO:1405 sets forth the amino acid sequence of a DNA clone, identified herein as Ceres CLONE ID no. 12071 (SEQ ID NO:1404), that is predicted to encode a polypeptide containing a Pfam domain as indicated in the Sequence Listing (e.g., an SBP domain).

A regulatory protein can comprise the amino acid sequence set forth in SEQ ID NO:1405. In some cases, a regulatory protein can be a homolog, ortholog, or variant of the polypeptide having the amino acid sequence set forth in SEQ ID NO:1405. For example, a regulatory protein can have an amino acid sequence with at least 50% sequence identity, e.g., 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:1405.

Amino acid sequences of homologs and/or orthologs of the polypeptide having the amino acid sequence set forth in SEQ ID NO:1405 are provided in FIG. 89.

For example, the alignment in FIG. 89 provides the amino acid sequences of Ceres Clone 12071 (SEQ ID NO:1405), gi|55419652 (SEQ ID NO:1406), gi|1183866 (SEQ ID NO:1407), CeresClone:538817 (SEQ ID NO:1408), gi|30577630 (SEQ ID NO:1409), and gi|62856979 (SEQ ID NO:2059). Other homologs and/or orthologs of SEQ ID NO:1405 include SEQ ID NO:1410, Ceres ANNOT ID no. 1466704 (SEQ ID NO:1412), Public GI no. 30577630 (SEQ ID NO:2058), and Ceres ANNOT ID no. 6032291 (SEQ ID NO:2252).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 1406-1410, SEQ ID NO:1412, SEQ ID NOs:2058-2059, or SEQ ID NO:2252.

A regulatory protein can have an mTERF domain. The human mitochondrial transcription termination factor (mTERF) polypeptide possesses three putative leucine zippers, one of which is bipartite. The mTERF polypeptide also contains two widely spaced basic domains. Both of the basic domains and the three leucine zipper motifs are necessary for DNA binding. The mTERF polypeptide binds DNA as a monomer. While evidence of intramolecular leucine zipper interactions exists, the leucine zippers are not implicated in dimerization, unlike other leucine zippers. SEQ ID NO:695 and SEQ ID NO:1728 set forth the amino acid sequences of DNA clones, identified herein as Ceres CLONE ID no. 325679 (SEQ ID NO:694) and Ceres Annot ID no. 574705 (SEQ ID NO:1727), respectively, each of which is predicted to encode a polypeptide having a Pfam domain as indicated in the Sequence Listing (e.g., an mTERF domain).

A regulatory protein can comprise the amino acid sequence set forth in SEQ ID NO:695 or SEQ ID NO:1728. Alternatively, a regulatory protein can be a homolog, ortholog, or variant of the polypeptide having the amino acid sequence set forth in SEQ ID NO:695 or SEQ ID NO:1728. For example, a regulatory protein can have an amino acid sequence with at least 60% sequence identity, e.g., 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:695 or SEQ ID NO:1728.

Amino acid sequences of homologs and/or orthologs of the polypeptide having the amino acid sequence set forth in SEQ ID NO:695 and SEQ ID NO:1728 are provided in FIG. 40 and FIG. 120, respectively.

For example, the alignment in FIG. 40 provides the amino acid sequences of Ceres Clone 325679 (SEQ ID NO:695) and gi|50910213 (SEQ ID NO:696). Other homologs and/or orthologs of SEQ ID NO:695 include Ceres ANNOT ID no. 6023883 (SEQ ID NO:2226).

The alignment in FIG. 120 provides the amino acid sequences of cDNA ID 23653450 5109C6 (Ceres ANNOT ID no. 574705; SEQ ID NO:1728), gi|50938747 (SEQ ID NO:1729), CeresClone:458156 (SEQ ID NO:1730), and CeresClone:918824 (SEQ ID NO:1731). Other homologs and/or orthologs of SEQ ID NO:1728 include Ceres ANNOT ID no. 1441536 (SEQ ID NO:1733).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NO:696, SEQ ID NOs:1729-1731, SEQ ID NO:1733, or SEQ ID NO:2226.

A regulatory protein can have a TCP domain characteristic of a TCP family transcription factor polypeptide. Members of the TCP family contain conserved regions that are predicted to form a non-canonical basic-helix-loop-helix (bHLH) structure. In rice, this domain was shown to be involved in DNA binding and dimerization. In *Arabidopsis*, members of the TCP family were found to be expressed in rapidly growing floral primordia. It is likely that members of the TCP family affect cell division. SEQ ID NO:436 sets forth the amino acid sequence of a DNA clone, identified herein as Ceres CLONE ID no. 124496 (SEQ ID NO:435), that is predicted to encode a Pfam domain as indicated in the Sequence Listing (e.g., a TCP family transcription factor polypeptide).

A regulatory protein can comprise the amino acid sequence set forth in SEQ ID NO:436. In some cases, a regulatory protein can be a homolog, ortholog, or variant of the polypeptide having the amino acid sequence set forth in SEQ ID NO:436. For example, a regulatory protein can have an amino acid sequence with at least 40% sequence identity, e.g., 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:436.

A regulatory protein can have a GRAS domain characteristic of a GRAS family transcription factor polypeptide.

Polypeptides in the GRAS family are transcription factors that seem to be involved in development and other processes. For example, mutation of the SCARECROW (SCR) gene results in a radial pattern defect, loss of a ground tissue layer, in the root. The PAT1 protein is involved in phytochrome A signal transduction. GRAS polypeptides, such as GAI, RGA, and SCR, contain a conserved region of about 350 amino acids that can be divided into five motifs, found in the following order: the leucine heptad repeat I, the VHIID motif, the leucine heptad repeat II, the PFYRE motif, and the SAW motif. Plant specific GRAS polypeptides have parallels in their motif structure to the animal Signal Transducers and Activators of Transcription (STAT) family of polypeptides, which suggests parallels in their functions. SEQ ID NO:1294 sets forth the amino acid sequence of a DNA clone, identified herein as Ceres CLONE ID no. 109490 (SEQ ID NO:1293), that is predicted to encode a polypeptide containing a Pfam domain as indicated in the Sequence Listing (e.g., a GRAS domain).

A regulatory protein can comprise the amino acid sequence set forth in SEQ ID NO:1294. In some cases, a regulatory protein can be a homolog, ortholog, or variant of the polypeptide having the amino acid sequence set forth in SEQ ID NO:1294. For example, a regulatory protein can have an amino acid sequence with at least 55% sequence identity, e.g., 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:1294.

Amino acid sequences of homologs and/or orthologs of the polypeptide having the amino acid sequence set forth in SEQ ID NO:1294 are provided in FIG. 78.

For example, the alignment in FIG. 78 provides the amino acid sequences of cDNA ID 23365746 (Ceres CLONE ID no. 109490; SEQ ID NO:1294), CeresClone:475016 (SEQ ID NO:1976), CeresClone:1571937 (SEQ ID NO:1977), and gi|34907424 (SEQ ID NO:1978). Other homologs and/or orthologs of SEQ ID NO:1294 include Ceres ANNOT ID no. 1443194 (SEQ ID NO:1296), Ceres ANNOT ID no. 1505312 (SEQ ID NO:1298), Ceres CLONE ID no. 1810690 (SEQ ID NO:1300), and Ceres ANNOT ID no. 6016469 (SEQ ID NO:2194).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NO:1296, SEQ ID NO:1298, SEQ ID NO:1300, SEQ ID NOs:1976-1978, or SEQ ID NO:2194.

A regulatory protein can contain a Histone domain characteristic of a core histone H2A/H2B/H3/H4 polypeptide. The core histones, together with other DNA binding polypeptides, form a superfamily defined by a common fold and distant sequence similarities. Some polypeptides contain local homology domains related to the histone fold. SEQ ID NO:1249 and SEQ ID NO:1573 set forth the amino acid sequences of DNA clones, identified herein as Ceres CLONE ID no. 21604 (SEQ ID NO:1248) and Ceres CLONE ID no. 36272 (SEQ ID NO:1572), respectively, each of which is predicted to encode a polypeptide containing a Pfam domain as indicated in the Sequence Listing (e.g., a Histone domain).

A regulatory protein can comprise the amino acid sequence set forth in SEQ ID NO:1249 or SEQ ID NO:1573. In some cases, a regulatory protein can be a homolog, ortholog, or variant of the polypeptide having the amino acid sequence set forth in SEQ ID NO:1249 or SEQ ID NO:1573. For example, a regulatory protein can have an amino acid sequence with at least 65% sequence identity, e.g., 65%, 70%, 75%, 80%, 85%, 90%, 95%, 97%, 98%, or 99% sequence identity, to the amino acid sequence set forth in SEQ ID NO:1249 or SEQ ID NO:1573.

Amino acid sequences of homologs and/or orthologs of the polypeptide having the amino acid sequence set forth in SEQ ID NO:1249 and SEQ ID NO:1573 are provided in FIG. 74 and FIG. 106, respectively.

For example, the alignment in FIG. 74 provides the amino acid sequences of cDNA ID 23383311 (Ceres CLONE ID no. 21604; SEQ ID NO:1249), CeresClone:824827 (SEQ ID NO:2018), CeresClone:245683 (SEQ ID NO:2015), CeresClone:1283552 (SEQ ID NO:2016), CeresClone:272426 (SEQ ID NO:2017), CeresClone:659723 (SEQ ID NO:2012), CeresClone:1585988 (SEQ ID NO:2014), and CeresClone:953644 (SEQ ID NO:2013). Other homologs and/or orthologs of SEQ ID NO:1249 include Ceres ANNOT ID no. 1473854 (SEQ ID NO:1251), Ceres ANNOT ID no. 1521997 (SEQ ID NO:1253), Ceres ANNOT ID no. 1468633 (SEQ ID NO:1255), and Ceres CLONE ID no. 1784110 (SEQ ID NO:1257).

The alignment in FIG. 106 provides the amino acid sequences of Ceres Clone 36272 (SEQ ID NO:1573), CeresClone:573215 (SEQ ID NO:1955), CeresClone:474481 (SEQ ID NO:1956), gi|1922964 (SEQ ID NO:1954), gi|6289057 (SEQ ID NO:1953), CeresClone:1911 (SEQ ID NO:1951), and gi|23505813 (SEQ ID NO:1952). Other homologs and/or orthologs of SEQ ID NO:1573 include Ceres ANNOT ID no. 1469342 (SEQ ID NO:1575), Ceres ANNOT ID no. 1513277 (SEQ ID NO:1577), and Ceres ANNOT ID no. 1470275 (SEQ ID NO:1579).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NO:1251, SEQ ID NO:1253, SEQ ID NO:1255, SEQ ID NO:1257, SEQ ID NOs:2012-2018, SEQ ID NO:1575, SEQ ID NO:1577, SEQ ID NO:1579, or SEQ ID NOs:1951-1956.

A regulatory protein can contain one or more domains characteristic of a transcription initiation factor polypeptide. For example, a regulatory protein can contain a TFIIF_beta domain characteristic of the beta subunit of transcription initiation factor IIF. Transcription initiation factor IIF (TFIIF) is a tetramer comprising two beta subunits associated with two alpha subunits. TFIIF interacts directly with RNA polymerase II. The beta subunit of TFIIF is required for recruitment of RNA polymerase II onto the promoter. SEQ ID NO:119 sets forth the amino acid sequence of a DNA clone, identified herein as Ceres ANNOT ID no. 549656 (SEQ ID NO:118), that is predicted to encode a polypeptide containing a Pfam domain as indicated in the Sequence Listing (e.g., a TFIIF_beta domain).

In some cases, a regulatory protein can have a TFIIA_gamma_N domain and a TFIIA_gamma_C domain characteristic of the N-terminal and the C-terminal domain, respectively, of the gamma subunit of TFIIA. TFIIA is a heterotrimer composed of alpha, beta, and gamma subunits. The N-terminal domain of the gamma subunit is a four helix bundle, while the C-terminal domain is a twelve stranded beta-barrel. The TFIIA heterotrimer is a general transcription initiation factor for genes transcribed by RNA polymerase II. Together with TFIID, TFIIA binds to the promoter region. This is the first step in the formation of a pre-initiation complex, which is followed by binding of the rest of the transcription machinery. SEQ ID NO:1323 sets forth the amino acid sequence of a DNA clone, identified herein as Ceres CLONE ID no. 225321 (SEQ ID NO:1322), that is predicted to encode a polypeptide containing a Pfam domain as indicated in the Sequence Listing (e.g., a TFIIA_gamma_N domain and a TFIIA_gamma_C domain).

In some cases, a regulatory protein can contain a TFIID_30 kDa domain characteristic of the transcription initiation factor TFIID 23-30 kDa subunit. Transcription initiation factor TFIID is a multimeric protein complex that plays a central role in mediating promoter responses to various activators and repressors. TFIID acts to nucleate the transcription complex, recruiting the rest of the factors through a direct interaction with TFIIB. The TATA binding protein subunit of TFIID is sufficient for TATA-element binding and TFIIB interaction, and can support basal transcription. SEQ ID NO:1854 sets forth the amino acid sequence of a DNA clone, identified herein as Ceres CLONE ID no. 25793 (SEQ ID NO:1853), that is predicted to encode a polypeptide containing a Pfam domain as indicated in the Sequence Listing (e.g., a TFIID_30 kDa domain).

A regulatory protein can comprise the amino acid sequence set forth in SEQ ID NO:119, SEQ ID NO:1323, or SEQ ID NO:1854. In some cases, a regulatory protein can be a homolog, ortholog, or variant of the polypeptide having the amino acid sequence set forth in SEQ ID NO:119, SEQ ID NO:1323, or SEQ ID NO:1854. For example, a regulatory protein can have an amino acid sequence with at least 50% sequence identity, e.g., 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:119, SEQ ID NO:1323, or SEQ ID NO:1854.

Amino acid sequences of homologs and/or orthologs of the polypeptide having the amino acid sequence set forth in SEQ ID NO:119, SEQ ID NO:1323, and SEQ ID NO:1854 are provided in FIG. 3, FIG. 81, and FIG. 128, respectively.

For example, the alignment in FIG. 3 provides the amino acid sequences of Annot ID 549656 (SEQ ID NO:119), CeresClone:463643 (SEQ ID NO:122), CeresAnnot: 1442640 (SEQ ID NO:124), CeresClone:704938 (SEQ ID NO:127), CeresClone:281395 (SEQ ID NO:128), CeresClone:1784166 (SEQ ID NO:130), and gi|56785216 (SEQ ID NO:131). Other homologs and/or orthologs of SEQ ID NO:119 include Public GI no. 39545896 (SEQ ID NO:120), Ceres CLONE ID no. 24161 (SEQ ID NO:121), Ceres ANNOT ID no. 1452795 (SEQ ID NO:126), and Public GI no. 34909946 (SEQ ID NO:132).

The alignment in FIG. 81 provides the amino acid sequences of Ceres Clone 225321 (SEQ ID NO:1323), gi|1429228 (SEQ ID NO:1945), CeresClone:8364 (SEQ ID NO:1944), CeresClone:530235 (SEQ ID NO:1943), gi|57899877 (SEQ ID NO:1942), CeresClone:1541168 (SEQ ID NO:1939), gi|55585039 (SEQ ID NO:1941), and CeresClone:699465 (SEQ ID NO:1940). Other homologs and/or orthologs of SEQ ID NO:1323 include Ceres ANNOT ID no. 1504670 (SEQ ID NO:1325), Ceres ANNOT ID no. 1451585 (SEQ ID NO:1327), Ceres CLONE ID no. 1785734 (SEQ ID NO:1329), and Ceres CLONE ID no. 1886324 (SEQ ID NO:1331).

The alignment in FIG. 128 provides the amino acid sequences of CeresClone:25793 (SEQ ID NO:1854) and CeresClone:1881639 (SEQ ID NO:1856). Other homologs and/or orthologs of SEQ ID NO:1854 include Ceres ANNOT ID no. 1477838 (SEQ ID NO:2109), Ceres CLONE ID no. 1877540 (SEQ ID NO:2139), and Ceres ANNOT ID no. 6073498 (SEQ ID NO:2304).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 120-122, SEQ ID NO:124, SEQ ID NOs:126-128, SEQ ID NOs:130-132, SEQ ID NO:1325, SEQ ID NO:1327, SEQ ID NO:1329, SEQ ID NO:1331, SEQ ID NOs:1939-1945, SEQ ID NO:1856, SEQ ID NO:2109, SEQ ID NO:2139, or SEQ ID NO:2304.

A regulatory protein can have a paired amphipathic helix (PAH) repeat. The PAH repeat may be distantly related to the helix-loop-helix motif, which mediates polypeptide-polypeptide interactions. Members of the PAH repeat family of polypeptides include the eukaryotic Sin3 polypeptides, which have at least three PAH domains (PAH1, PAH2, and PAH3). Sin3 polypeptides are components of a co-repressor complex that silences transcription, playing important roles in the transition between proliferation and differentiation. SEQ ID NO:1852 sets forth the amino acid sequence of a DNA clone, identified herein as Ceres CLONE ID no. 250028 (SEQ ID NO:1851), that is predicted to encode a polypeptide containing a Pfam domain as indicated in the Sequence Listing (e.g., a PAH repeat).

A regulatory protein can comprise the amino acid sequence set forth in SEQ ID NO:1852. In some cases, a regulatory protein can be a homolog, ortholog, or variant of the polypeptide having the amino acid sequence set forth in SEQ ID NO:1852. For example, a regulatory protein can have an amino acid sequence with at least 40% sequence identity, e.g., 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:1852.

A regulatory protein can have one or more domains characteristic of a homeobox polypeptide. For example, a regulatory protein can contain a homeobox domain and a HALZ domain. The homeobox domain binds DNA through a helix-turn-helix (HTH) structure. The HTH motif is characterized by two alpha-helices, which make intimate contacts with DNA and are joined by a short turn. Examples of homeodomain-containing polypeptides include transcriptional regulators encoded by hox genes that operate differential genetic programs along the anterior-posterior axis of animal bodies. The homeobox associated leucine zipper (HALZ) domain is a plant specific leucine zipper that is associated with a homeobox. SEQ ID NO:661 sets forth the amino acid sequence of a DNA clone, identified herein Ceres CLONE ID no. 2913 (SEQ ID NO:660), that is predicted to encode a polypeptide having a homeobox domain and a Pfam domain as indicated in the Sequence Listing (e.g., a HALZ domain).

In some cases, a regulatory protein can contain a homeobox domain described above, a KNOX1 domain, a KNOX2 domain, and an ELK domain. Knotted1-like homeobox (knox) genes encoding KNOX proteins have been isolated from various plants, including rice, barley, *Arabidopsis*, soybean, tomato, and tobacco. There are four putative functional domains that are conserved in plant KNOX proteins: the MEINOX domain, which can divided into two subdomains, KNOX1 and KNOX2; the GSE domain; the ELK domain; and the homeodomain. KNOX1 plays a role in suppressing target gene expression, and KNOX2 is thought to be necessary for homo-dimerization. The ELK domain has been postulated to be involved in nuclear localization, polypeptide-polypeptide interactions, and suppression of gene activation. SEQ ID NO:1473 and SEQ ID NO:1779 set forth the amino acid sequences of DNA clones, identified herein as Ceres CLONE ID no. 21240 (SEQ ID NO:1472) and Ceres CLONE ID no. 541719 (SEQ ID NO:1778), respectively, each of which is predicted to encode a polypeptide containing a Pfam domain as indicated in the Sequence Listing (e.g., a homeobox domain, a KNOX1 domain, a KNOX2 domain, and an ELK domain).

In some cases, a regulatory protein can contain a KNOX1 domain, a KNOX2 domain, and an ELK domain. SEQ ID NO:1832 sets forth the amino acid sequence of a DNA clone, identified herein as Ceres CLONE ID no. 106887 (SEQ ID NO:1831), that is predicted to encode a polypeptide containing a Pfam domain as indicated in the Sequence Listing (e.g., a KNOX1 domain, a KNOX2 domain, and an ELK domain).

A regulatory protein can comprise the amino acid sequence set forth in SEQ ID NO:661, SEQ ID NO:1473, SEQ ID NO:1779, or SEQ ID NO:1832. In some cases, a regulatory protein can be a homolog, ortholog, or variant of the polypeptide having the amino acid sequence set forth in SEQ ID NO:661, SEQ ID NO:1473, SEQ ID NO:1779, or SEQ ID NO:1832. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:661, SEQ ID NO:1473, SEQ ID NO:1779, or SEQ ID NO:1832.

Amino acid sequences of homologs and/or orthologs of the polypeptide having the amino acid sequence set forth in SEQ ID NO:661, SEQ ID NO:1779, and SEQ ID NO:1832 are provided in FIG. 35, FIG. 124, and FIG. 127, respectively.

For example, the alignment in FIG. 35 provides the amino acid sequences of Ceres Clone 2913 (SEQ ID NO:661), CeresClone:1384592 (SEQ ID NO:662), CeresClone:1121989 (SEQ ID NO:663), 1463575 (SEQ ID NO:665), gi|48209882 (SEQ ID NO:666), gi|48209945 (SEQ ID NO:667), gi|349379 (SEQ ID NO:668), and CeresClone:677386 (SEQ ID NO:669).

The alignment in FIG. 124 provides the amino acid sequences of CeresClone:541719 (SEQ ID NO:1779) and Annot ID:1535677 (SEQ ID NO:1783). Other homologs and/or orthologs of SEQ ID NO:1779 include Ceres ANNOT ID no. 1518918 (SEQ ID NO:1781), Ceres ANNOT ID no. 6011832 (SEQ ID NO:2184), Ceres ANNOT ID no. 6034341 (SEQ ID NO:2254), and Ceres ANNOT ID no. 6034346 (SEQ ID NO:2256).

The alignment in FIG. 127 provides the amino acid sequences of CeresClone:106887 (SEQ ID NO:1832) and 1796871 (SEQ ID NO:1834). Other homologs and/or orthologs of SEQ ID NO:1832 include Ceres ANNOT ID no. 1491629 (SEQ ID NO:2115) and Ceres ANNOT ID no. 6068623 (SEQ ID NO:2302).

Amino acid sequences of homologs and/or orthologs of the polypeptide having the amino acid sequence set forth in SEQ ID NO:1473 include Ceres CLONE ID no. 1826333 (SEQ ID NO:2135).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 662-663, SEQ ID NOs:665-669, SEQ ID NO:1781, SEQ ID NO:1783, SEQ ID NO:1834, SEQ ID NO:2115, SEQ ID NO:2135, SEQ ID NO:2184, SEQ ID NO:2254, SEQ ID NO:2256, or SEQ ID NO:2302.

A regulatory protein can contain a PHD domain. The homeodomain (PHD) finger is a C4HC3 zinc-finger-like motif found in nuclear proteins thought to be involved in chromatin-mediated transcriptional regulation. The PHD finger motif is reminiscent of, but distinct from, the C3HC4 type RING finger. Similar to the RING finger and the LIM domain, the PHD finger is thought to bind two zinc ions. The PHD finger may be involved in polypeptide-polypeptide interactions and assembly or activity of multicomponent complexes involved in transcriptional activation or repression. In addition, the interactions may be intra-molecular and important in maintaining the structural integrity of the polypeptide. SEQ ID NO:504 sets forth the amino acid sequence of a DNA clone, referred to herein as Ceres CLONE ID no. 156373 (SEQ ID NO:503), that is predicted to encode a Pfam domain as indicated in the Sequence Listing (e.g., a PHD domain-containing polypeptide).

A regulatory protein can comprise the amino acid sequence set forth in SEQ ID NO:504. In some cases, a regulatory protein can be a homolog, ortholog, or variant of the polypeptide having the amino acid sequence set forth in SEQ ID NO:504. For example, a regulatory protein can have an amino acid sequence with at least 55% sequence identity, e.g., 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:504.

Amino acid sequences of homologs and/or orthologs of the polypeptide having the amino acid sequence set forth in SEQ ID NO:504 are provided in FIG. 22.

For example, the alignment in FIG. 22 provides the amino acid sequences of Ceres Clone 156373 (SEQ ID NO:504), CeresClone:1393778 (SEQ ID NO:505), CeresAnnot:1518013 (SEQ ID NO:508), CeresClone:477995 (SEQ ID NO:511), gi|45387429 (SEQ ID NO:513), gi|34900462 (SEQ ID NO:514), and CeresClone:1826835 (SEQ ID NO:516). Other homologs and/or orthologs of SEQ ID NO:504 include Public GI no. 21536795 (SEQ ID NO:506), Ceres ANNOT ID no. 1511533 (SEQ ID NO:510), and Ceres CLONE ID no. 1170863 (SEQ ID NO:512).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 505-506, SEQ ID NO:508, SEQ ID NOs:510-514, or SEQ ID NO:516.

A regulatory protein can contain an HTH_3 domain characteristic of members of a family of DNA binding helix-turn helix polypeptides that includes a bacterial plasmid copy control polypeptide, bacterial methylases, various bacteriophage transcription control polypeptides, and a vegetative specific polypeptide from *Dictyostelium discoideum*. SEQ ID NO:1874 sets forth the amino acid sequence of a DNA clone, identified herein as Ceres CLONE ID no. 474636 (SEQ ID NO:1873), that is predicted to encode a polypeptide containing a Pfam domain as indicated in the Sequence Listing (e.g., an HTH_3 domain).

A regulatory protein can comprise the amino acid sequence set forth in SEQ ID NO:1874. In some cases, a regulatory protein can be a homolog, ortholog, or variant of the polypeptide having the amino acid sequence set forth in SEQ ID NO:1874. For example, a regulatory protein can have an amino acid sequence with at least 40% sequence identity, e.g., 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:1874.

Amino acid sequences of homologs and/or orthologs of the polypeptide having the amino acid sequence set forth in SEQ ID NO:1874 include Ceres CLONE ID no. 1775129 (SEQ ID NO:2125).

In some cases, a regulatory protein can include a polypeptide having at least 80% sequence identity, e.g., 80%, 85%, 90%, 93%, 95%, 97%, 98%, or 99% sequence identity, to the amino acid sequence set forth in SEQ ID NO:2125.

A regulatory protein can contain a SAP domain and an Exo_endo_phos domain. The SAP motif, named after SAF-A/B, Acinus and PIAS, is a putative DNA binding domain found in diverse nuclear polypeptides involved in chromosomal organization. The Exo_endo_phos domain is characteristic of polypeptides belonging to the endonuclease/exonuclease/phosphatase family of polypeptides. This large family of polypeptides includes magnesium dependent endonucleases and phosphatases involved in intracellular signaling. For example, the endonuclease/exonuclease/phosphatase family includes AP endonuclease proteins, DNase I proteins, and Synaptojanin, an inositol-1,4,5-trisphosphate phosphatase. SEQ ID NO:149 sets forth the amino acid sequence of a DNA clone, identified herein as Ceres ANNOT ID no. 554970 (SEQ ID NO:148), that is predicted to encode a polypeptide containing a Pfam domain as indicated in the Sequence Listing (e.g., a SAP domain and an Exo_endo_phos domain).

A regulatory protein can comprise the amino acid sequence set forth in SEQ ID NO:149. In some cases, a regulatory protein can be a homolog, ortholog, or variant of the polypeptide having the amino acid sequence set forth in SEQ ID NO:149. For example, a regulatory protein can have an amino acid sequence with at least 50% sequence identity, e.g., 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:149.

Amino acid sequences of homologs and/or orthologs of the polypeptide having the amino acid sequence set forth in SEQ ID NO:149 are provided in FIG. 5.

For example, the alignment in FIG. 5 provides the amino acid sequences of Annot ID 554970 (SEQ ID NO:149), CeresAnnot:1528227 (SEQ ID NO:151), gi|34908948 (SEQ ID NO:152), and CeresClone:1158508 (SEQ ID NO:154). Other homologs and/or orthologs of SEQ ID NO:149 include Public GI no. 55297696 (SEQ ID NO:153) and Ceres CLONE ID no. 1222684 (SEQ ID NO:155).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 151-155.

A regulatory protein can contain a PC4 domain characteristic of the transcriptional coactivator p15 (PC4) polypeptide. The p15 polypeptide has a bipartite structure composed of an amino-terminal regulatory domain and a carboxy-terminal cryptic DNA-binding domain. The DNA-binding activity of the carboxy-terminal domain is disguised by the amino-terminal p15 domain. The activity of the p15 polypeptide is controlled by kinase polypeptides that target the regulatory domain. SEQ ID NO:172 sets forth the amino acid sequence of a DNA clone, identified herein as Ceres CLONE ID no. 1001761 (SEQ ID NO:171), that is predicted to encode a polypeptide containing a Pfam domain as indicated in the Sequence Listing (e.g., a PC4 domain).

A regulatory protein can comprise the amino acid sequence set forth in SEQ ID NO:172. In some cases, a regulatory protein can be a homolog, ortholog, or variant of the polypeptide having the amino acid sequence set forth in SEQ ID NO:172. For example, a regulatory protein can have an amino acid sequence with at least 55% sequence identity, e.g., 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:172.

Amino acid sequences of homologs and/or orthologs of the polypeptide having the amino acid sequence set forth in SEQ ID NO:172 are provided in FIG. 7.

For example, the alignment in FIG. 7 provides the amino acid sequences of CeresClone:1001761 (SEQ ID NO:172), CeresClone:955105 (SEQ ID NO:174) and CeresClone: 1620054 (SEQ ID NO:175). Other homologs and/or orthologs of SEQ ID NO:172 include Public GI no. 28466805 (SEQ ID NO:173) and Ceres CLONE ID no. 1617036 (SEQ ID NO:176).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 173-176.

A regulatory protein can contain an RNA_POL_M_15KD domain characteristic of highly conserved small subunits of about 15 kDa found in RNA polymerase types I and II. These polypeptides contain a probable zinc finger in the N-terminus and a zinc ribbon in the C-terminus. SEQ ID NO:417 sets forth the amino acid sequence of a DNA clone, identified herein as Ceres CLONE ID no. 12256 (SEQ ID NO:416), that is predicted to encode a polypeptide containing a Pfam domain as indicated in the Sequence Listing (e.g., an RNA_POL_M_15KD domain).

A regulatory protein can comprise the amino acid sequence set forth in SEQ ID NO:417. In some cases, a regulatory protein can be a homolog, ortholog, or variant of the polypeptide having the amino acid sequence set forth in SEQ ID NO:417. For example, a regulatory protein can have an amino acid sequence with at least 70% sequence identity, e.g., 75%, 80%, 85%, 90%, 95%, 97%, 98%, or 99% sequence identity, to the amino acid sequence set forth in SEQ ID NO:417.

Amino acid sequences of homologs and/or orthologs of the polypeptide having the amino acid sequence set forth in SEQ ID NO:417 are provided in FIG. 15.

For example, the alignment in FIG. 15 provides the amino acid sequences of CeresClone:12256 (SEQ ID NO:417), CeresClone:976830 (SEQ ID NO:418), gi|87240462 (SEQ ID NO:421), gi|77556133 (SEQ ID NO:422), CeresClone: 305612 (SEQ ID NO:423), CeresClone:686862 (SEQ ID NO:424), and CeresClone:1113246 (SEQ ID NO:425). Other homologs and/or orthologs of SEQ ID NO:417 include Ceres CLONE ID no. 966126 (SEQ ID NO:419), Public GI no. 46359779 (SEQ ID NO:420), Ceres CLONE ID no. 676701 (SEQ ID NO:426), Ceres CLONE ID no. 727529 (SEQ ID NO:427), Ceres CLONE ID no. 218484 (SEQ ID NO:428), Ceres CLONE ID no. 342112 (SEQ ID NO:429), Public GI no. 108705695 (SEQ ID NO:430), Ceres CLONE ID no. 1890779 (SEQ ID NO:2147), Ceres ANNOT ID no. 6009977 (SEQ ID NO:2176), and Ceres ANNOT ID no. 6039826 (SEQ ID NO:2266).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 418-430, SEQ ID NO:2147, SEQ ID NO:2176, or SEQ ID NO:2266.

A regulatory protein can contain an AUX_IAA domain. The AUX/IAA family of genes are key regulators of auxin-modified gene expression. The plant hormone auxin (indole-3-acetic acid, IAA) regulates diverse cellular and developmental responses in plants. The AUX/IAA polypeptides act as repressors of auxin-induced gene expression, possibly by modulating the activity of DNA binding auxin response factors (ARFs). AUX/IAA and ARF are thought to interact through C-terminal polypeptide-polypeptide interaction domains found in both AUX/IAA and ARF. AUX/IAA polypeptides have also been reported to mediate light responses. Some members of the AUX/IAA family are longer, contain an N-terminal DNA binding domain, and may have an early function in the establishment of vascular and body patterns during embryonic and post-embryonic development in some plants. SEQ ID NO:606 sets forth the amino acid sequence of a DNA clone, identified herein as Ceres CLONE ID no. 2499 (SEQ ID NO:605), that is predicted to encode a polypeptide containing a Pfam domain as indicated in the Sequence Listing (e.g., an AUX_IAA domain).

A regulatory protein can comprise the amino acid sequence set forth in SEQ ID NO:606. In some cases, a regulatory protein can be a homolog, ortholog, or variant of the polypeptide having the amino acid sequence set forth in SEQ ID NO:606. For example, a regulatory protein can have an amino acid sequence with at least 40% sequence identity, e.g., 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:606.

A regulatory protein can have a WD-40 repeat, also known as WD or beta-transducin repeats. WD-40 repeats are motifs that often terminate in a Trp-Asp (W-D) dipeptide. Polypeptides containing WD repeats have four to 16 repeating units, which are thought to form a circularized beta-propeller structure. WD-repeat polypeptides serve as an assembly platform for multiprotein complexes in which the repeating units serve as a rigid scaffold for polypeptide interactions. Examples of such complexes include G protein complexes, the beta subunits of which are beta-propellers; TAFII transcription factor complexes; and E3 ubiquitin ligase complexes. WD-repeat polypeptides form a large family of eukaryotic polypeptides implicated in a variety of functions ranging from signal transduction and transcription regulation to cell cycle control and apoptosis. SEQ ID NO:1345 sets forth the amino acid sequence of a DNA clone, identified herein as Ceres CLONE ID no. 475689 (SEQ ID NO:1344), that is predicted to encode a polypeptide containing a Pfam domain as indicated in the Sequence Listing (e.g., a WD-40 repeat).

A regulatory protein can comprise the amino acid sequence set forth in SEQ ID NO:1345. In some cases, a regulatory protein can be a homolog, ortholog, or variant of the polypeptide having the amino acid sequence set forth in SEQ ID NO:1345. For example, a regulatory protein can have an amino acid sequence with at least 60% sequence identity, e.g., 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:1345.

Amino acid sequences of homologs and/or orthologs of the polypeptide having the amino acid sequence set forth in SEQ ID NO:1345 are provided in FIG. 83.

For example, the alignment in FIG. 83 provides the amino acid sequences of Ceres Clone 475689 (SEQ ID NO:1345), gi|50251896 (SEQ ID NO:1970), CeresClone:783774 (SEQ ID NO:1968), gi|37544703 (SEQ ID NO:1969), CeresClone: 1151902 (SEQ ID NO:1964), gi|10636051 (SEQ ID NO:1965), gi|22324807 (SEQ ID NO:1963), gi|14270085 (SEQ ID NO:1971), gi|2290532 (SEQ ID NO:1967), and gi|6752886 (SEQ ID NO:1966). Other homologs and/or orthologs of SEQ ID NO:1345 include Ceres ANNOT ID no. 1472897 (SEQ ID NO:1347), Ceres ANNOT ID no. 1467673 (SEQ ID NO:1349), Ceres ANNOT ID no. 1445014 (SEQ ID NO:1351), Ceres ANNOT ID no. 1471808 (SEQ ID NO:1353), Ceres ANNOT ID no. 1454998 (SEQ ID NO:1355), Ceres ANNOT ID no. 1475212 (SEQ ID NO:1357), and Ceres CLONE ID no. 1821171 (SEQ ID NO:1359).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 1963-1971, SEQ ID NO:1347, SEQ ID NO:1349, SEQ ID NO:1351, SEQ ID NO:1353, SEQ ID NO:1355, SEQ ID NO:1357, or SEQ ID NO:1359.

A regulatory protein can contain an ankyrin repeat and a Chromo (CHRromatin Organization MOdifier) domain. The ankyrin repeat is one of the most common polypeptide-polypeptide interaction motifs in nature. Ankyrin repeats are tandemly repeated modules of about 33 amino acids. The repeat has been found in diverse polypeptides such as transcriptional initiators, cell-cycle regulators, cytoskeletal polypeptides, ion transporters, and signal transducers. Each repeat folds into a helix-loop-helix structure with a beta-hairpin/loop region projecting out from the helices at a 90 degree angle. The repeats stack together to form an L-shaped structure. The Chromo domain is a conserved region of about 60 amino acids that was originally identified in *Drosophila* modifiers of variegation. These polypeptides alter the structure of chromatin to the condensed morphology of heterochromatin, a cytologically visible condition where gene expression is repressed. In one of these polypeptides, Polycomb, the Chromo domain has been shown to be important for chromatin targeting. Polypeptides that contain a Chromo domain appear to fall into three classes. The first class includes polypeptides having an N-terminal Chromo domain followed by a region termed the Chromo shadow domain. Examples of such polypeptides include the *Drosophila* and human heterochromatin polypeptides Su(var)205 and HP1, respectively. The second class includes polypeptides with a single chromo domain, such as the *Drosophila* polypeptide Polycomb, mammalian modifier 3, human Mi-2 auto antigen, and several yeast and *Caenorhabditis elegans* hypothetical polypeptides. Paired tandem Chromo domains are found in polypeptides belonging to the third class, which includes mammalian DNA-binding/helicase polypeptides CHD-1 to CHD-4 and yeast polypeptide CHD1. SEQ ID NO:808 sets forth the amino acid sequence of a DNA clone, identified herein as Ceres CLONE ID no. 37980 (SEQ ID NO:807), that is predicted to encode a polypeptide containing a Pfam domain as indicated in the Sequence Listing (e.g., an ankyrin repeat and a Chromo domain).

A regulatory protein can comprise the amino acid sequence set forth in SEQ ID NO:808. In some cases, a regulatory protein can be a homolog, ortholog, or variant of the polypeptide having the amino acid sequence set forth in SEQ ID NO:808. For example, a regulatory protein can have an amino acid sequence with at least 45% sequence identity, e.g., 45%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:808.

Amino acid sequences of homologs and/or orthologs of the polypeptide having the amino acid sequence set forth in SEQ ID NO:808 are provided in FIG. 50.

For example, the alignment in FIG. 50 provides the amino acid sequences of Ceres Clone 37980 (SEQ ID NO:808), CeresClone:630887 (SEQ ID NO:809), 1460561 (SEQ ID NO:811), and gi|50919643 (SEQ ID NO:812). Other homologs and/or orthologs of SEQ ID NO:808 include Ceres ANNOT ID no. 6068499 (SEQ ID NO:2300).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NO:809, SEQ ID NOs:811-812, or SEQ ID NO:2300.

A regulatory protein can contain a methyl-CpG binding domain (MBD). Regulatory proteins with a methyl-CpG binding domain, in association with other polypeptides, have preferential binding affinity to methylated DNA, which results in changes in chromatin structure leading to transcriptional activation or transcriptional repression of affected genes. SEQ ID NO:934 and SEQ ID NO:1475 set forth the amino acid sequences of DNA clones, identified herein as Ceres CLONE ID no. 479015 (SEQ ID NO:933) and Ceres CLONE ID no. 21374 (SEQ ID NO:1474), respectively, each of which is predicted to encode a polypeptide containing a Pfam domain as indicated in the Sequence Listing (e.g., a methyl-CpG binding domain).

A regulatory protein can comprise the amino acid sequence set forth in SEQ ID NO:934 or SEQ ID NO:1475. In some cases, a regulatory protein can be a homolog, ortholog, or variant of the polypeptide having the amino acid sequence set forth in SEQ ID NO:934 or SEQ ID NO:1475. For example, a regulatory protein can have an amino acid sequence with at least 50% sequence identity, e.g., 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:934 or SEQ ID NO:1475.

Amino acid sequences of homologs and/or orthologs of the polypeptide having the amino acid sequence set forth in SEQ ID NO:1475 are provided in FIG. 96.

For example, the alignment in FIG. 96 provides the amino acid sequences of CeresClone:21374 (SEQ ID NO:1475) and 1471763 (SEQ ID NO:1477). Other homologs and/or orthologs of SEQ ID NO:1475 include Ceres ANNOT ID no. 1482788 (SEQ ID NO:1479) and Ceres ANNOT ID no. 6031141 (SEQ ID NO:2244).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NO:1477, SEQ ID NO:1479, or SEQ ID NO:2244.

A regulatory protein can contain an HMG (high mobility group) box. HMG regulatory proteins can have one or more copies of an HMG-box motif or domain, and are involved in the regulation of DNA-dependent processes such as transcription, replication, and strand repair, all of which require the bending and unwinding of chromatin. Many of these polypeptides regulate gene expression. SEQ ID NO:689, SEQ ID NO:1131, SEQ ID NO:1315, SEQ ID NO:1333, and SEQ ID NO:1444 set forth the amino acid sequences of DNA clones, identified herein as Ceres CLONE ID no. 31322 (SEQ ID NO:688), Ceres CLONE ID no. 963031 (SEQ ID NO:1130), Ceres CLONE ID no. 208429 (SEQ ID NO:1314), Ceres CLONE ID no. 333753 (SEQ ID NO:1332), and Ceres CLONE ID no. 16204 (SEQ ID NO:1443), respectively, each of which is predicted to encode a polypeptide containing a Pfam domain as indicated in the Sequence Listing (e.g., an HMG box).

A regulatory protein can comprise the amino acid sequence set forth in SEQ ID NO:689, SEQ ID NO:1131, SEQ ID NO:1315, SEQ ID NO:1333, or SEQ ID NO:1444. In some cases, a regulatory protein can be a homolog, ortholog, or variant of the polypeptide having the amino acid sequence set forth in SEQ ID NO:689, SEQ ID NO:1131, SEQ ID NO:1315, SEQ ID NO:1333, or SEQ ID NO:1444. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:689, SEQ ID NO:1131, SEQ ID NO:1315, SEQ ID NO:1333, or SEQ ID NO:1444.

Amino acid sequences of homologs and/or orthologs of the polypeptide having the amino acid sequence set forth in SEQ ID NO:689, SEQ ID NO:1131, SEQ ID NO:1315, SEQ ID NO:1333, and SEQ ID NO:1444 are provided in FIG. 39, FIG. 68, FIG. 80, FIG. 82, and FIG. 93, respectively.

For example, the alignment in FIG. 39 provides the amino acid sequences of Ceres Clone 31322 (SEQ ID NO:689), CeresClone:980901 (SEQ ID NO:690), CeresClone: 1030653 (SEQ ID NO:691), CeresClone:956177 (SEQ ID NO:692), and CeresClone:1620744 (SEQ ID NO:693). Other homologs and/or orthologs of SEQ ID NO:689 include Ceres ANNOT ID no. 6023739 (SEQ ID NO:2224).

The alignment in FIG. 68 provides the amino acid sequences of Ceres Clone 963031 (SEQ ID NO:1131) and gi|21554154 (SEQ ID NO:1132). Other homologs and/or orthologs of SEQ ID NO:1131 include Ceres ANNOT ID no. 6030945 (SEQ ID NO:2242).

The alignment in FIG. 80 provides the amino acid sequences of cDNA ID 23740209 (Ceres CLONE ID no. 208429; SEQ ID NO:1315), CeresClone:471377 (SEQ ID NO:1985), CeresClone:207075 (SEQ ID NO:1982), gi|21554154 (SEQ ID NO:1983), gi|9759080 (SEQ ID NO:1984), CeresClone:617111 (SEQ ID NO:1981), and gi|50940237 (SEQ ID NO:1980). Other homologs and/or orthologs of SEQ ID NO:1315 include Ceres ANNOT ID no. 1457538 (SEQ ID NO:1317), Ceres ANNOT ID no. 1510743 (SEQ ID NO:1319), Ceres CLONE ID no. 1963116 (SEQ ID NO:1321), and Ceres ANNOT ID no. 6030945 (SEQ ID NO:2240).

The alignment in FIG. 82 provides the amino acid sequences of Ceres Clone 333753 (SEQ ID NO:1333), gi|50726318 (SEQ ID NO:1950), and gi|17017392 (SEQ ID NO:1949). Other homologs and/or orthologs of SEQ ID NO:1333 include Ceres ANNOT ID no. 1442401 (SEQ ID NO:1335), Ceres ANNOT ID no. 1506142 (SEQ ID NO:1337), Ceres CLONE ID no. 1802372 (SEQ ID NO:1339), Ceres CLONE ID no. 1891458 (SEQ ID NO:1341), Ceres CLONE ID no. 1762738 (SEQ ID NO:1343), and Ceres ANNOT ID no. 6031981 (SEQ ID NO:2248).

Figure 93:
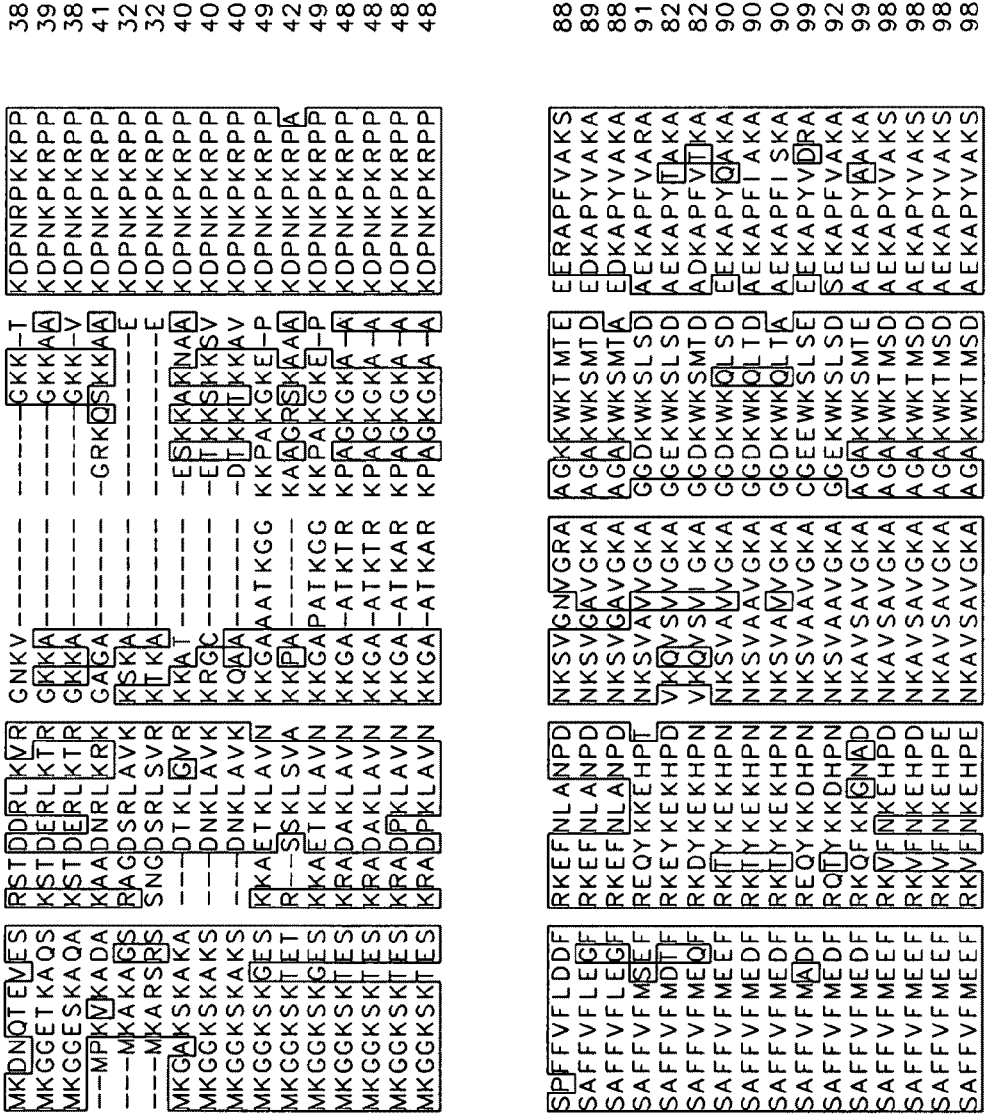
FIG. 93 is an alignment of the amino acid sequence of cDNA ID 23358452 (Ceres CLONE ID no. 16204; SEQ ID NO:1444) with homologous and/or orthologous amino acid sequences CeresClone:873113 (SEQ ID NO:1449), CeresClone:956177 (SEQ ID NO:1450), CeresClone:721511 (SEQ ID NO:1451), CeresClone:641329 (SEQ ID NO:1452), CeresClone:782784 (SEQ ID NO:1453), gi|18645 (SEQ ID NO:1454), gi|1052956 (SEQ ID NO:1455), gi|436424 (SEQ ID NO:1456), gi|2894109 (SEQ ID NO:1457), CeresClone:686294 (SEQ ID NO:1458), gi|50726318 (SEQ ID NO:1459), gi|729737 (SEQ ID NO:1460), gi|729736 (SEQ ID NO:1461), CeresClone: 1060767 (SEQ ID NO:1462), and gi|7446231 (SEQ ID NO:1463).

The alignment in FIG. 93 provides the amino acid sequences of cDNA ID 23358452 (Ceres CLONE ID no. 16204; SEQ ID NO:1444), CeresClone:873113 (SEQ ID NO:1449), CeresClone:956177 (SEQ ID NO:1450), CeresClone:721511 (SEQ ID NO:1451), CeresClone:641329 (SEQ ID NO:1452), CeresClone:782784 (SEQ ID NO:1453), gi|18645 (SEQ ID NO:1454), gi|1052956 (SEQ ID NO:1455), gi|436424 (SEQ ID NO:1456), gi|2894109 (SEQ ID NO:1457), CeresClone:686294 (SEQ ID NO:1458), gi|50726318 (SEQ ID NO:1459), gi|729737 (SEQ ID NO:1460), gi|729736 (SEQ ID NO:1461), CeresClone:1060767 (SEQ ID NO:1462), and gi|7446231 (SEQ ID NO:1463). Other homologs and/or orthologs of SEQ ID NO:1444 include Ceres CLONE ID no. 98140 (SEQ ID NO:1445), Ceres CLONE ID no. 480916 (SEQ ID NO:1147), and Ceres CLONE ID no. 1043468 (SEQ ID NO:1448).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 690-693, SEQ ID NO:1132, SEQ ID NO:1317, SEQ ID NO:1319, SEQ ID NO:1321, SEQ ID NOs:1980-1985, SEQ ID NO:1335, SEQ ID NO:1337, SEQ ID NO:1339, SEQ ID NO:1341, SEQ ID NO:1343, SEQ ID NOs:1949-1950, SEQ ID NO:1445, SEQ ID NOs:1447-1463, SEQ ID NO:2224, SEQ ID NO:2240, SEQ ID NO:2242, or SEQ ID NO:2248.

A regulatory protein can have an FHA domain. The FHA (forkhead-associated) domain is a phosphopeptide recognition domain found in many regulatory proteins. It displays specificity for phosphothreonine-containing epitopes but can also recognize phosphotyrosine with relatively high affinity. The FHA domain spans about 80-100 amino acid residues folded into an eleven-stranded beta sandwich, which sometimes contains small helical insertions between the loops connecting the strands. Genes encoding FHA-containing polypeptides have been identified in eubacterial and eukaryotic but not archaeal genomes. The FHA domain is present in a diverse range of polypeptides, such as kinases, phosphatases, kinesins, transcription factors, RNA binding proteins, and metabolic enzymes involved in many different cellular processes, such as DNA repair, signal transduction, vesicular transport, and protein degradation. SEQ ID NO:1864 and SEQ ID NO:2087 set forth the amino acid sequences of DNA clones, identified herein as Ceres Clone ID no. 280261 (SEQ ID NO:1863) and Ceres Clone ID no. 28026 (SEQ ID NO:2086), respectively, each of which is predicted to encode a polypeptide containing a Pfam domain as indicated in the Sequence Listing (e.g., an FHA domain).

A regulatory protein can comprise the amino acid sequence set forth in SEQ ID NO:1864 or SEQ ID NO:2087. In some cases, a regulatory protein can be a homolog, ortholog, or variant of the polypeptide having the amino acid sequence set forth in SEQ ID NO:1864 or SEQ ID NO:2087. For example, a regulatory protein can have an amino acid sequence with at least 50% sequence identity, e.g., 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:1864 or SEQ ID NO:2087.

Amino acid sequences of homologs and/or orthologs of the polypeptide having the amino acid sequence set forth in SEQ ID NO:1864 include Ceres CLONE ID no. 1776961 (SEQ ID NO:2127).

In some cases, a regulatory protein can include a polypeptide having at least 80% sequence identity, e.g., 80%, 85%, 90%, 93%, 95%, 97%, 98%, or 99% sequence identity, to the amino acid sequence set forth in SEQ ID NO:2127.

A regulatory protein can have one or more RNA recognition motifs, also known as RRM, RBD, or RNP domains. For example, a regulatory protein can have an RRM_1 RNA recognition motif. RNA recognition motifs are found in a variety of RNA binding polypeptides, including heterogeneous nuclear ribonucleoproteins (hnRNPs), polypeptides implicated in regulation of alternative splicing, and polypeptide components of small nuclear ribonucleoproteins (snRNPs). The RRM motif also appears in a few single stranded DNA binding polypeptides. The RRM structure consists of four strands and two helices arranged in an alpha/beta sandwich, with a third helix present during RNA binding in some cases. SEQ ID NO:178, SEQ ID NO:221, SEQ ID NO:361, SEQ ID NO:381, SEQ ID NO:432, SEQ ID NO:698, SEQ ID NO:1134, SEQ ID NO:1259, SEQ ID NO:1423, SEQ ID NO:1681, and SEQ ID NO:1860 set forth the amino acid sequences of DNA clones, identified herein as Ceres CLONE ID no. 1003205 (SEQ ID NO:177), Ceres CLONE ID no. 1011900 (SEQ ID NO:220), Ceres CLONE ID no. 112098 (SEQ ID NO:360), Ceres CLONE ID no. 115366 (SEQ ID NO:380), Ceres CLONE ID no. 123804 (SEQ ID NO:431), Ceres CLONE ID no. 32754 (SEQ ID NO:697), Ceres CLONE ID no. 97001 (SEQ ID NO:1133), Ceres CLONE ID no. 29637 (SEQ ID NO:1258), Ceres CLONE ID no. 14246 (SEQ ID NO:1422), Ceres CLONE ID no. 7559 (SEQ ID NO:1680), and Ceres CLONE ID no. 266712 (SEQ ID NO:1859), respectively, each of which is predicted to encode a polypeptide containing a Pfam domain as indicated in the Sequence Listing (e.g., a RRM_1 domain).

In some cases, a regulatory protein containing an RRM_1 domain can also contain a DnaJ domain associated with chaperone polypeptides involved in polypeptide folding. SEQ ID NO:779 sets forth the amino acid sequence of a DNA clone, identified herein as Ceres CLONE ID no. 362438 (SEQ ID NO:778), that is predicted to encode a polypeptide containing a Pfam domain as indicated in the Sequence Listing (e.g., an RRM_1 domain and a DnaJ domain).

In some cases, a regulatory protein containing an RRM_1 domain can also contain a galanin domain. Galanin is a highly conserved, 29 amino acid peptide that is processed from a larger precursor polypeptide. Galanin is believed to function as a neurotransmitter in mammals. Except in human, galanin is C-terminally amidated. SEQ ID NO:1866 sets forth the amino acid sequence of a DNA clone, identified herein as Ceres CLONE ID no. 280814 (SEQ ID NO:1865), that is predicted to encode a polypeptide containing a Pfam domain as indicated in the Sequence Listing (e.g., an RRM_1 domain and a galanin domain).

In some cases, a regulatory protein containing an RRM_1 domain can also contain a zf-CCHC domain described above. SEQ ID NO:170 sets forth the amino acid sequence of a DNA clone, identified herein as Ceres ANNOT ID no. 844490 (SEQ ID NO:169), that is predicted to encode a polypeptide having a Pfam domain as indicated in the Sequence Listing (e.g., an RRM_1 domain and a zf-CCHC domain).

A regulatory protein can comprise the amino acid sequence set forth in SEQ ID NO:178, SEQ ID NO:221, SEQ ID NO:361, SEQ ID NO:381, SEQ ID NO:432, SEQ ID NO:698, SEQ ID NO:1134, SEQ ID NO:1259, SEQ ID NO:1423, SEQ ID NO:1681, SEQ ID NO:1860, SEQ ID NO:779, SEQ ID NO:1866, or SEQ ID NO:170. In some cases, a regulatory protein can be a homolog, ortholog, or variant of the polypeptide having the amino acid sequence set forth in SEQ ID NO:178, SEQ ID NO:221, SEQ ID NO:361, SEQ ID NO:381, SEQ ID NO:432, SEQ ID NO:698, SEQ ID NO:1134, SEQ ID NO:1259, SEQ ID NO:1423, SEQ ID NO:1681, SEQ ID NO:1860, SEQ ID NO:779, SEQ ID NO:1866, or SEQ ID NO:170. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:178, SEQ ID NO:221, SEQ ID NO:361, SEQ ID NO:381, SEQ ID NO:432, SEQ ID NO:698, SEQ ID NO:1134, SEQ ID NO:1259, SEQ ID NO:1423, SEQ ID NO:1681, SEQ ID NO:1860, SEQ ID NO:779, SEQ ID NO:1866, or SEQ ID NO:170.

Amino acid sequences of homologs and/or orthologs of the polypeptide having the amino acid sequence set forth in SEQ ID NO:178, SEQ ID NO:221, SEQ ID NO:361, SEQ ID NO:381, SEQ ID NO:432, SEQ ID NO:698, SEQ ID NO:1259, SEQ ID NO:1423, and SEQ ID NO:1681 are provided in FIG. 8, FIG. 9, FIG. 12, FIG. 14, FIG. 16, FIG. 41, FIG. 75, FIG. 91, and FIG. 116, respectively.

Figure 8:
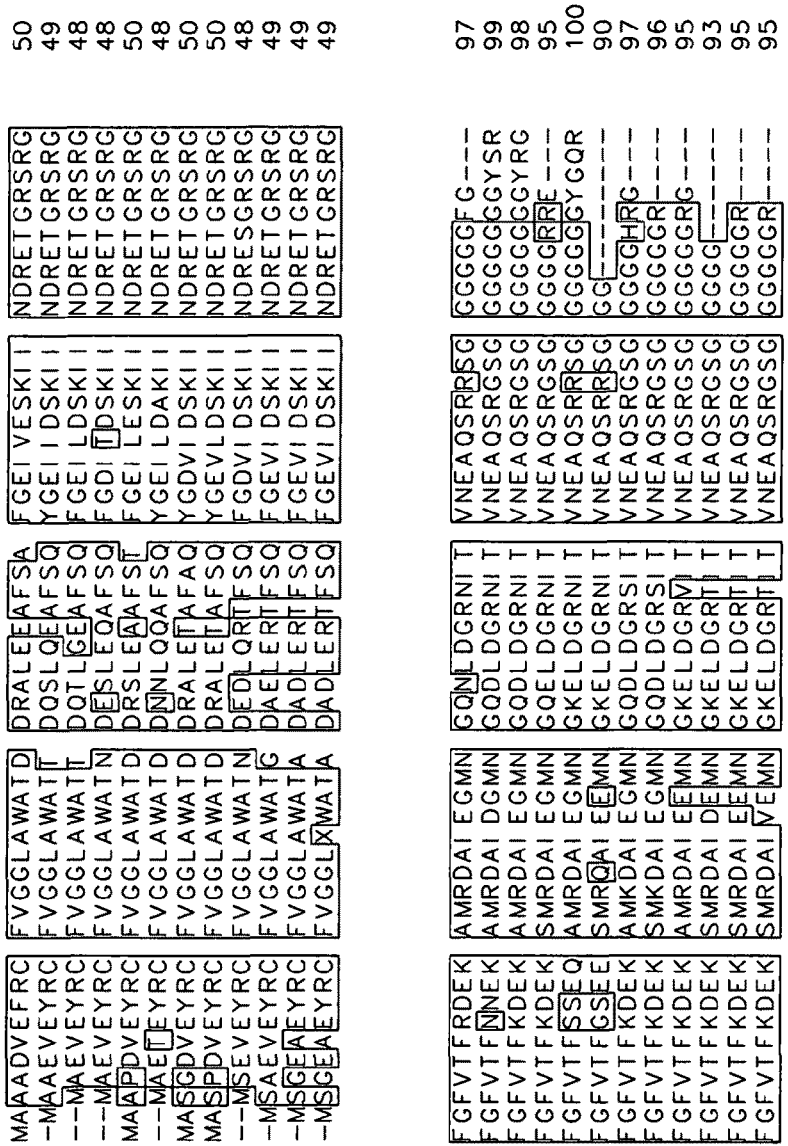
FIG. 8 is an alignment of the amino acid sequence of CeresClone:1003205 (SEQ ID NO:178) with homologous and/or orthologous amino acid sequences CeresClone:1120014 (SEQ ID NO:179), CeresClone:1066826 (SEQ ID NO:180), CeresClone:1465358 (SEQ ID NO:185), gi|18347 (SEQ ID NO:186), CeresClone:1012773 (SEQ ID NO:190), gi|1346180 (SEQ ID NO:192), gi|469070 (SEQ ID NO:194), CeresAnnot:1450324 (SEQ ID NO:196), gi|2624326 (SEQ ID NO:199), CeresClone:815584 (SEQ ID NO:201), and CeresClone:1898837 (SEQ ID NO:217).

For example, the alignment in FIG. 8 provides the amino acid sequences of CeresClone:1003205 (SEQ ID NO:178), CeresClone:1120014 (SEQ ID NO:179), CeresClone:1066826 (SEQ ID NO:180), CeresClone:1465358 (SEQ ID NO:185), gi|18347 (SEQ ID NO:186), CeresClone:1012773 (SEQ ID NO:190), gi|1346180 (SEQ ID NO:192), gi|469070 (SEQ ID NO:194), CeresAnnot:1450324 (SEQ ID NO:196), gi|2624326 (SEQ ID NO:199), CeresClone:815584 (SEQ ID NO:201), and CeresClone:1898837 (SEQ ID NO:217). Other homologs and/or orthologs of SEQ ID NO:178 include Ceres CLONE ID no. 1110162 (SEQ ID NO:181), Public GI no. 17819 (SEQ ID NO:182), Ceres CLONE ID no. 1416673 (SEQ ID NO:183), Ceres CLONE ID no. 1076411 (SEQ ID NO:184), Ceres CLONE ID no. 873740 (SEQ ID NO:187), Ceres CLONE ID no. 1075035 (SEQ ID NO:188), Ceres CLONE ID no. 1083222 (SEQ ID NO:189), Ceres CLONE ID no. 1385361 (SEQ ID NO:191), Ceres CLONE ID no. 1011900 (SEQ ID NO:193), Ceres ANNOT ID no. 1460836 (SEQ ID NO:198), Public GI no. 108863012 (SEQ ID NO:200), Ceres CLONE ID no. 751438 (SEQ ID NO:202), Ceres CLONE ID no. 924811 (SEQ ID NO:203), Ceres CLONE ID no. 741793 (SEQ ID NO:204), Ceres CLONE ID no. 754335 (SEQ ID NO:205), Ceres CLONE ID no. 761865 (SEQ ID NO:206), Ceres CLONE ID no. 785819 (SEQ ID NO:207), Ceres CLONE ID no. 758560 (SEQ ID NO:208), Ceres CLONE ID no. 1467901 (SEQ ID NO:209), Ceres CLONE ID no. 702924 (SEQ ID NO:210), Ceres CLONE ID no. 737259 (SEQ ID NO:211), Ceres CLONE ID no. 867872 (SEQ ID NO:212), Ceres CLONE ID no. 617713 (SEQ ID NO:213), Ceres CLONE ID no. 756168 (SEQ ID NO:214), Ceres CLONE ID no. 731572 (SEQ ID NO:215), and Ceres CLONE ID no. 1834630 (SEQ ID NO:219).

Figure 9:
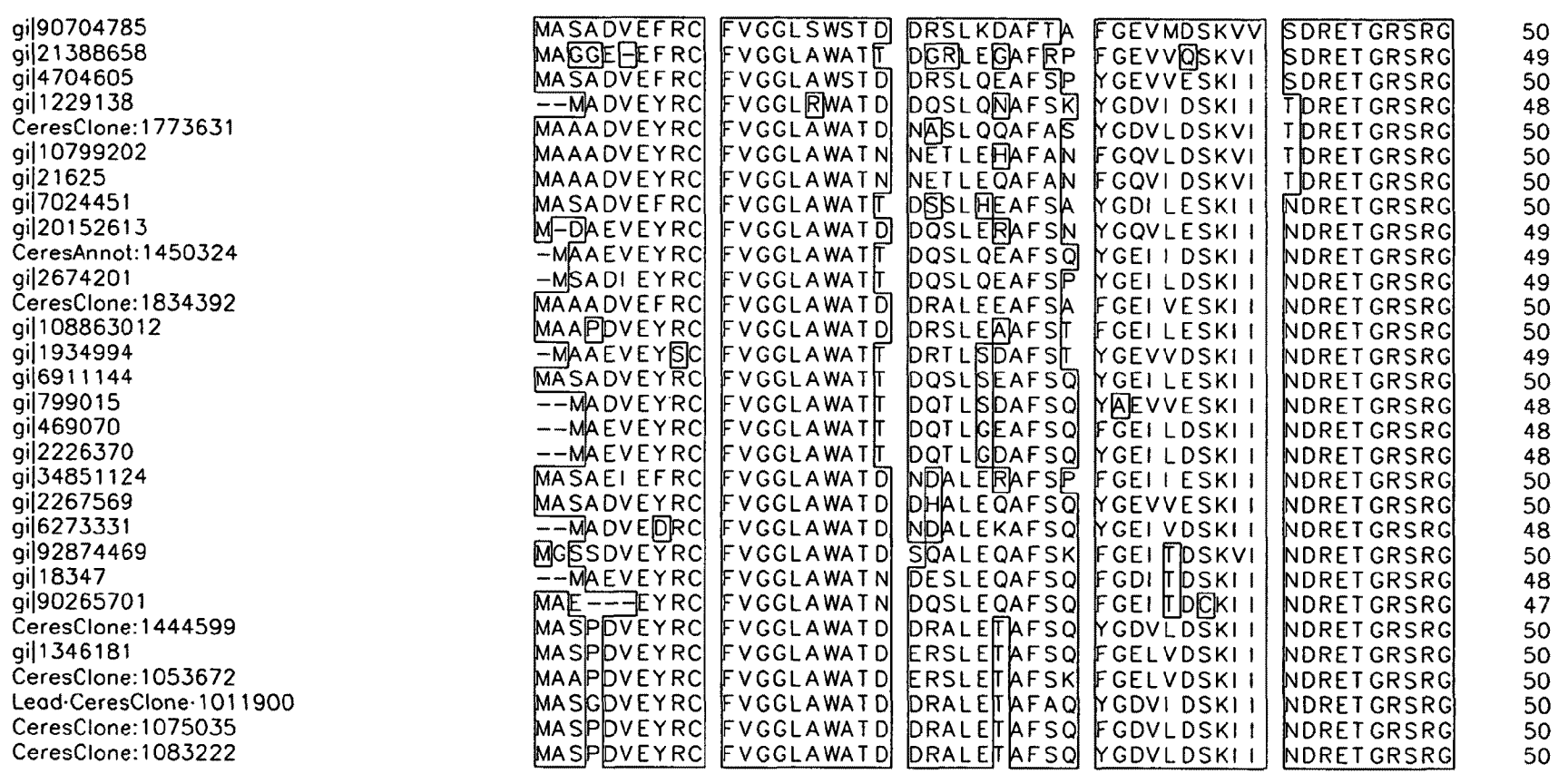
Figure 9:
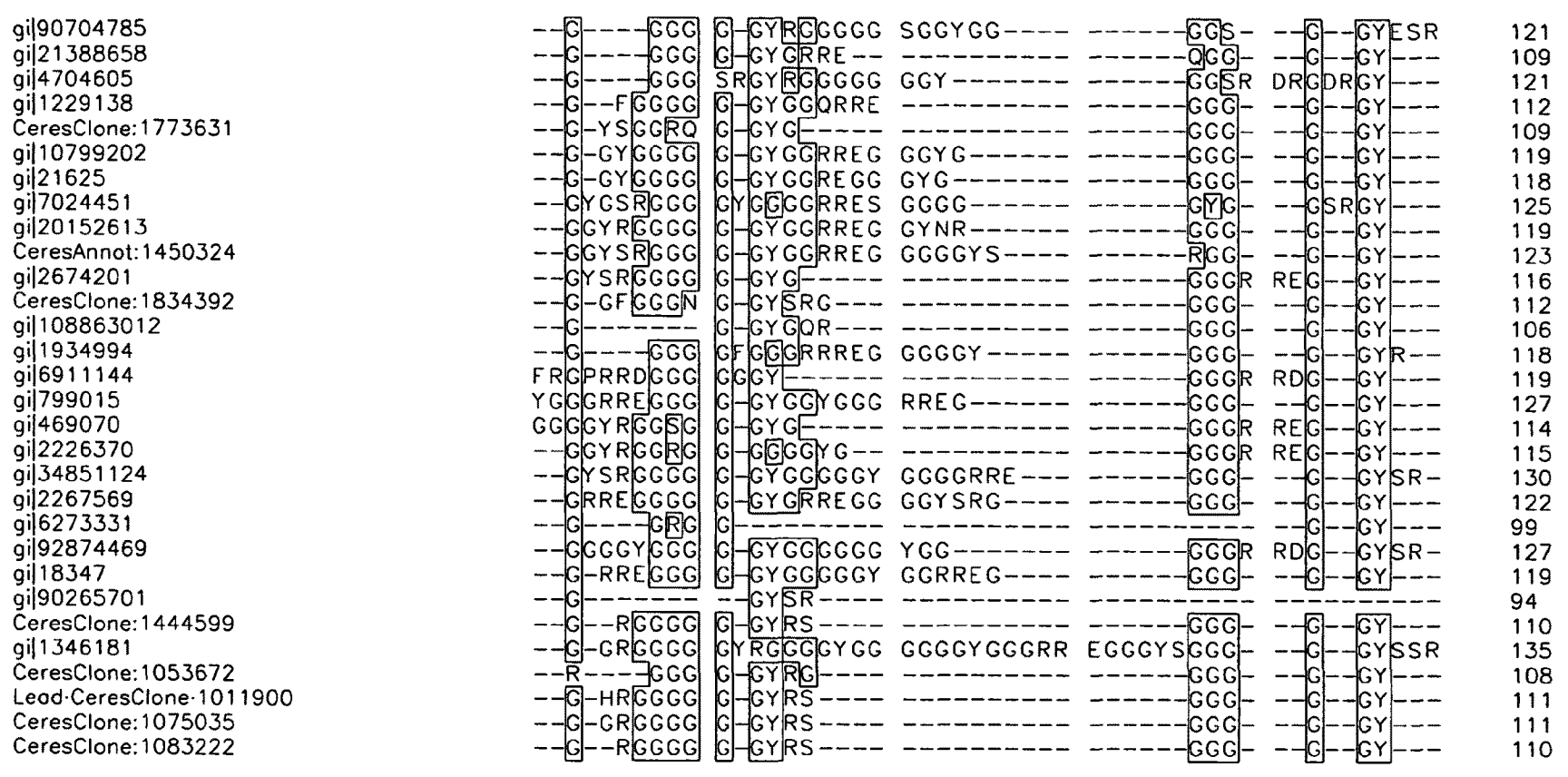
Figure 9:
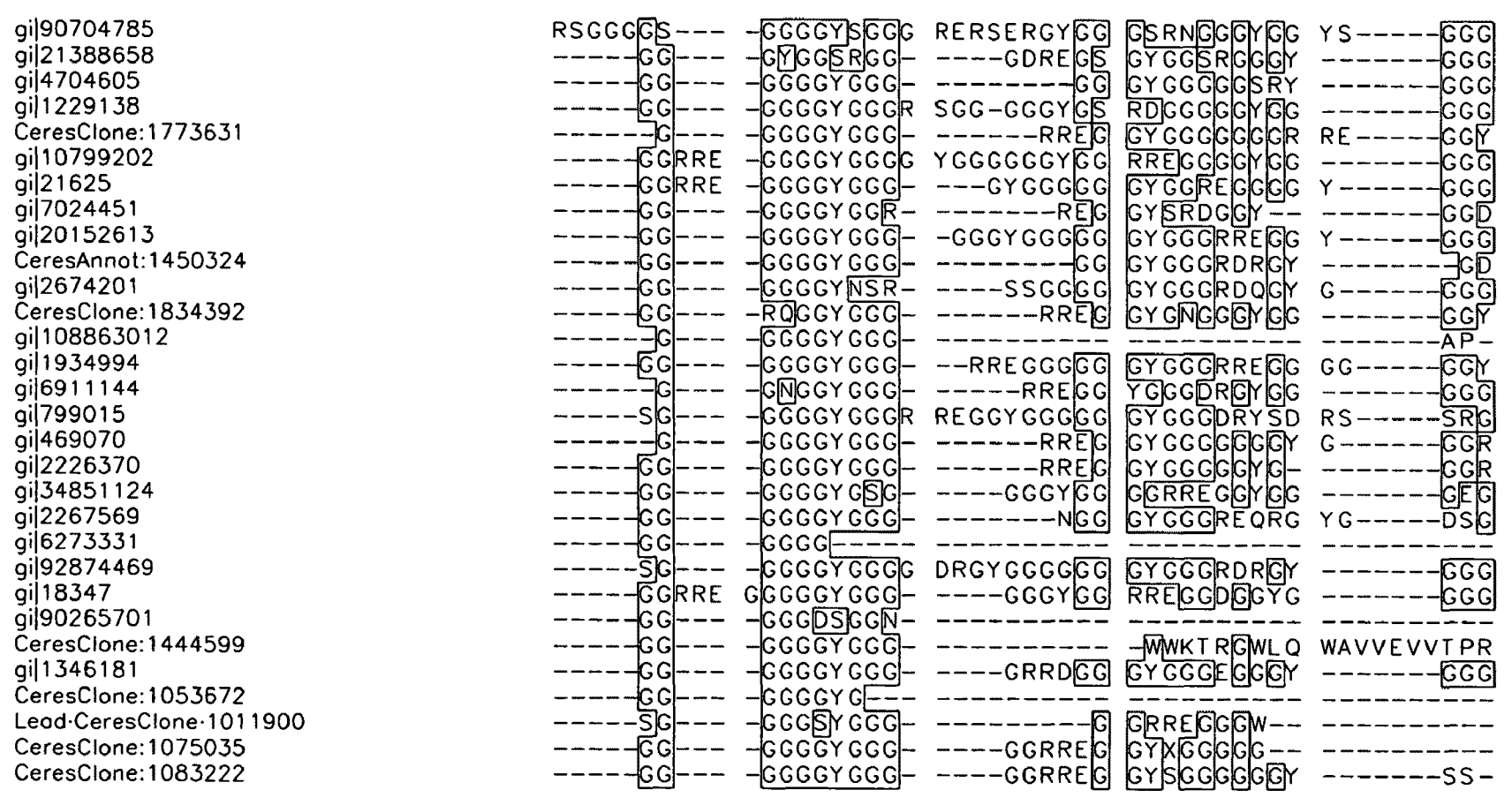

The alignment in FIG. 9 provides the amino acid sequences of CeresClone:1011900 (SEQ ID NO:221), CeresClone:1083222 (SEQ ID NO:222), CeresClone:1075035 (SEQ ID NO:223), CeresClone:1444599 (SEQ ID NO:225), gi|1346181 (SEQ ID NO:227), CeresClone:1053672 (SEQ ID NO:231), gi|469070 (SEQ ID NO:232), gi|2226370 (SEQ ID NO:234), gi|2267569 (SEQ ID NO:235), gi|18347 (SEQ ID NO:244), gi|34851124 (SEQ ID NO:246), gi|7024451 (SEQ ID NO:247), gi|6273331 (SEQ ID NO:248), gi|20152613 (SEQ ID NO:249), gi|92874469 (SEQ ID NO:250), CeresAnnot:1450324 (SEQ ID NO:253), gi|1229138 (SEQ ID NO:256), CeresClone:1834392 (SEQ ID NO:258), gi|108863012 (SEQ ID NO:263), gi|6911144 (SEQ ID NO:270), CeresClone:1773631 (SEQ ID NO:275), gi|1934994 (SEQ ID NO:290), gi|2674201 (SEQ ID NO:296), gi|799015 (SEQ ID NO:297), gi|4704605 (SEQ ID NO:311), gi|10799202 (SEQ ID NO:313), gi|90265701 (SEQ ID NO:316), gi|90704785 (SEQ ID NO:319), gi|21625 (SEQ ID NO:326), and gi|21388658 (SEQ ID NO:335). Other homologs and/or orthologs of SEQ ID NO:221 include Ceres CLONE ID no. 873740 (SEQ ID NO:224), Ceres CLONE ID no. 965777 (SEQ ID NO:226), Ceres CLONE ID no. 973585 (SEQ ID NO:228), Ceres CLONE ID no. 1092319 (SEQ ID NO:229), Ceres CLONE ID no. 945779 (SEQ ID NO:230), Public GI no. 30692254 (SEQ ID NO:233), Public GI no. 469071 (SEQ ID NO:236), Public GI no. 469072 (SEQ ID NO:237), Ceres CLONE ID no. 1120014 (SEQ ID NO:238), Ceres CLONE ID no. 102331 (SEQ ID NO:239), Public GI no. 16305 (SEQ ID NO:240), Ceres CLONE ID no. 14187 (SEQ ID NO:241), Ceres CLONE ID no. 13439 (SEQ ID NO:242), Ceres CLONE ID no. 32548 (SEQ ID NO:243), Ceres CLONE ID no. 1003147 (SEQ ID NO:245), Ceres CLONE ID no. 1110162 (SEQ ID NO:251), Ceres ANNOT ID no. 1460836 (SEQ ID NO:255), Ceres CLONE ID no. 1846800 (SEQ ID NO:260), Ceres CLONE ID no. 1884333 (SEQ ID NO:262), Public GI no. 108710320 (SEQ ID NO:264), Public GI no. 108710321 (SEQ ID NO:265), Ceres CLONE ID no. 1916226 (SEQ ID NO:267), Ceres CLONE ID no. 1898837 (SEQ ID NO:269), Ceres CLONE ID no. 1944006 (SEQ ID NO:272), Public GI no. 6911146 (SEQ ID NO:273), Public GI no. 6911142 (SEQ ID NO:276), Public GI no. 77557139 (SEQ ID NO:277), Ceres CLONE ID no. 1954236 (SEQ ID NO:279), Public GI no. 18103931 (SEQ ID NO:280), Ceres CLONE ID no. 1848150 (SEQ ID NO:282), Ceres CLONE ID no. 1759817 (SEQ ID NO:284), Ceres CLONE ID no. 1792432 (SEQ ID NO:286), Public GI no. 18076086 (SEQ ID NO:287), Ceres CLONE ID no. 1967547 (SEQ ID NO:289), Ceres CLONE ID no. 1772920 (SEQ ID NO:292), Ceres CLONE ID no. 1962722 (SEQ ID NO:294), Public GI no. 2331131 (SEQ ID NO:295), Public GI no. 2331133 (SEQ ID NO:298), Ceres CLONE ID no. 1959885 (SEQ ID NO:300), Ceres CLONE ID no. 1834630 (SEQ ID NO:302), Ceres CLONE ID no. 1810211 (SEQ ID NO:304), Ceres CLONE ID no. 1905168 (SEQ ID NO:306), Ceres CLONE ID no. 1888162 (SEQ ID NO:308), Public GI no. 2645699 (SEQ ID NO:309), Public GI no. 108710322 (SEQ ID NO:310), Public GI no. 2624326 (SEQ ID NO:312), Ceres CLONE ID no. 1966343 (SEQ ID NO:315), Ceres CLONE ID no. 1767411 (SEQ ID NO:318), Ceres CLONE ID no. 1789498 (SEQ ID NO:321), Ceres CLONE ID no. 1768120 (SEQ ID NO:323), Ceres CLONE ID no. 1762613 (SEQ ID NO:325), Ceres CLONE ID no. 1767462 (SEQ ID NO:328), Ceres CLONE ID no. 1721386 (SEQ ID NO:330), Ceres CLONE ID no. 1821019 (SEQ ID NO:332), and Ceres CLONE ID no. 1959598 (SEQ ID NO:334).

The alignment in FIG. 12 provides the amino acid sequences of CeresClone:112098 (SEQ ID NO:361), CeresClone:1376604 (SEQ ID NO:367) and CeresClone:463184 (SEQ ID NO:368). Other homologs and/or orthologs of SEQ ID NO:361 include Public GI no. 21593120 (SEQ ID NO:362), Ceres CLONE ID no. 38780 (SEQ ID NO:363), Ceres CLONE ID no. 36337 (SEQ ID NO:364), Public GI no. 30697598 (SEQ ID NO:365), and Public GI no. 30697595 (SEQ ID NO:366).

Figure 14:
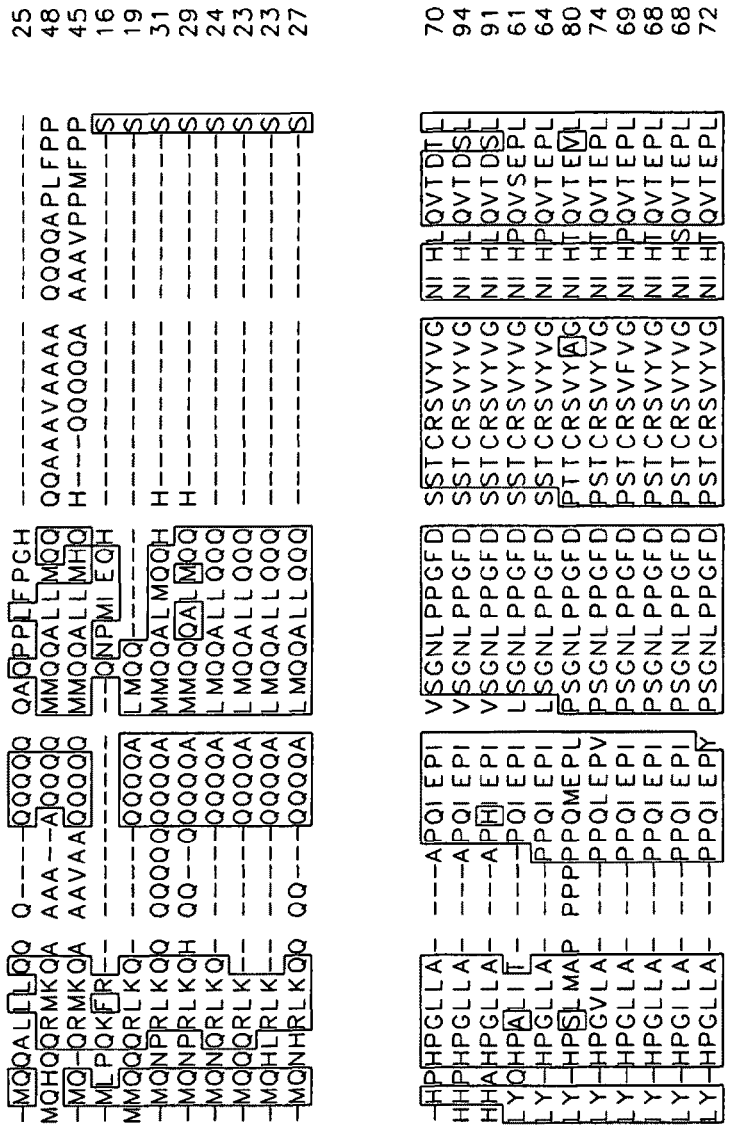
FIG. 14 is an alignment of the amino acid sequence of CeresClone:115366 (SEQ ID NO:381) with homologous and/or orthologous amino acid sequences CeresClone:1376400 (SEQ ID NO:382), CeresClone:1834350 (SEQ ID NO:387), CeresClone:518274 (SEQ ID NO:389), gi|82400162 (SEQ ID NO:392), CeresAnnot:1446310 (SEQ ID NO:394), gi|6996560 (SEQ ID NO:395), gi|77551976 (SEQ ID NO:396), gi|92891800 (SEQ ID NO:398), CeresClone:1790416 (SEQ ID NO:400), and CeresClone:703017 (SEQ ID NO:403).
Figure 14:
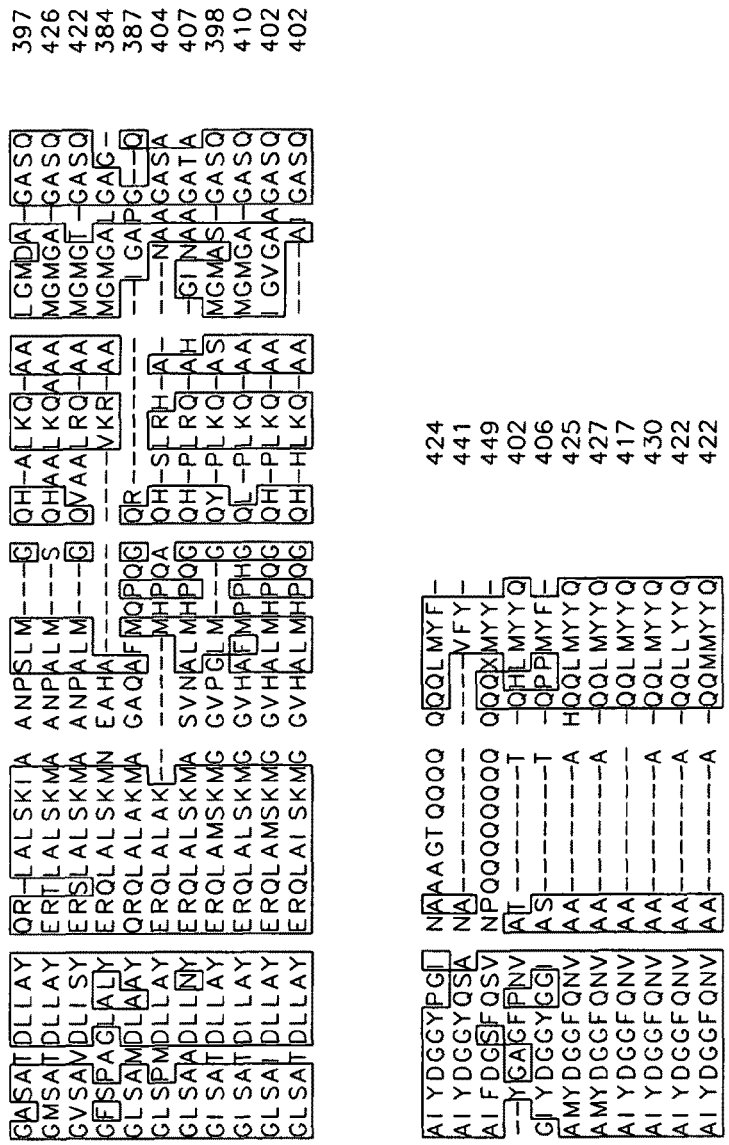

The alignment in FIG. 14 provides the amino acid sequences of CeresClone:115366 (SEQ ID NO:381), CeresClone:1376400 (SEQ ID NO:382), CeresClone:1834350 (SEQ ID NO:387), CeresClone:518274 (SEQ ID NO:389), gi|82400162 (SEQ ID NO:392), CeresAnnot:1446310 (SEQ ID NO:394), gi|6996560 (SEQ ID NO:395), gi|77551976 (SEQ ID NO:396), gi|92891800 (SEQ ID NO:398), CeresClone:1790416 (SEQ ID NO:400), and CeresClone:703017 (SEQ ID NO:403). Other homologs and/or orthologs of SEQ ID NO:381 include Public GI no. 13194792 (SEQ ID NO:383), Public GI no. 30695647 (SEQ ID NO:384), Ceres CLONE ID no. 148506 (SEQ ID NO:385), Public GI no. 21553830 (SEQ ID NO:388), Ceres CLONE ID no. 1836485 (SEQ ID NO:391), Public GI no. 108864589 (SEQ ID NO:397), Ceres CLONE ID no. 1754564 (SEQ ID NO:402), and Ceres ANNOT ID no. 6091796 (SEQ ID NO:2324).

The alignment in FIG. 16 provides the amino acid sequences of CeresClone:123804 (SEQ ID NO:432) and CeresClone:670908 (SEQ ID NO:433). Other homologs and/or orthologs of SEQ ID NO:432 include Ceres CLONE ID no. 614500 (SEQ ID NO:434).

The alignment in FIG. 41 provides the amino acid sequences of Ceres Clone 32754 (SEQ ID NO:698), CeresClone:1855403 (SEQ ID NO:700) and CeresClone:572426 (SEQ ID NO:701). Other homologs and/or orthologs of SEQ ID NO:698 include Ceres ANNOT ID no. 6023650 (SEQ ID NO:2222).

The alignment in FIG. 75 provides the amino acid sequences of Ceres Clone 29637 (SEQ ID NO:1259) and gi|34896798 (SEQ ID NO:1946). Other homologs and/or orthologs of SEQ ID NO:1259 include Ceres ANNOT ID no. 1458617 (SEQ ID NO:1261), Ceres ANNOT ID no. 1464333 (SEQ ID NO:1263), and Ceres CLONE ID no. 1787181 (SEQ ID NO:1265).

The alignment in FIG. 91 provides the amino acid sequences of Ceres Clone 14246 (SEQ ID NO:1423), gi|3550485 (SEQ ID NO:1424), CeresClone:1537388 (SEQ ID NO:1425), CeresClone:511197 (SEQ ID NO:1426), gi|50934311 (SEQ ID NO:1929), gi|311952 (SEQ ID NO:1926), and gi|20005 (SEQ ID NO:1927). Other homologs and/or orthologs of SEQ ID NO:1423 include SEQ ID NO:1427, gi|311952 (SEQ ID NO:1428), gi|115470657 (SEQ ID NO:1429), Ceres ANNOT ID no. 1454534 (SEQ ID NO:1431), Ceres ANNOT ID no. 1507701 (SEQ ID NO:1433), Ceres CLONE ID no. 511197 (SEQ ID NO:1925), Ceres CLONE ID no. 1537388 (SEQ ID NO:1928), Ceres CLONE ID no. 1537388 (SEQ ID NO:1930), and Ceres ANNOT ID no. 6011590 (SEQ ID NO:2182).

Figure 116:
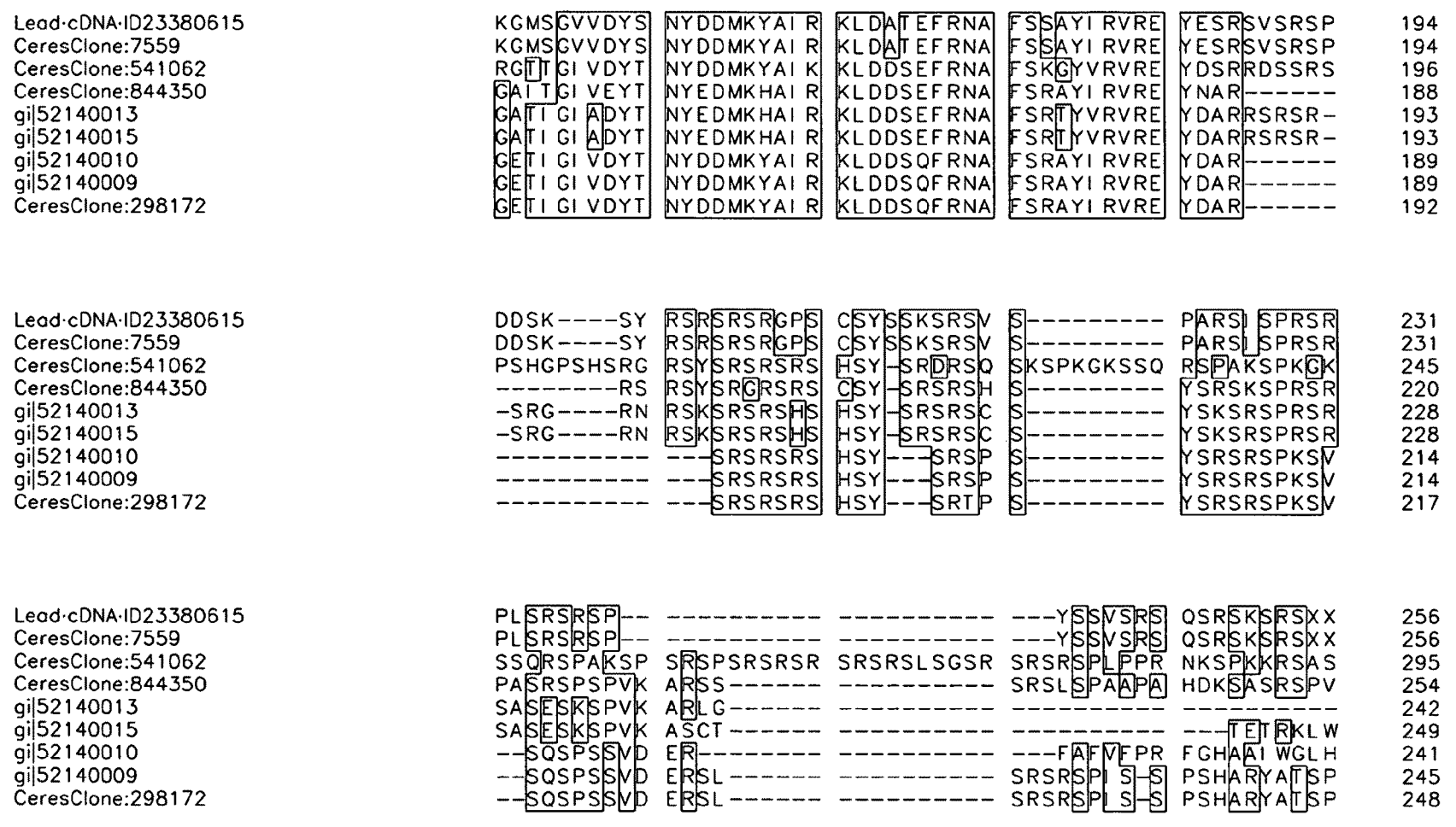

The alignment in FIG. 116 provides the amino acid sequences of cDNA ID 23380615 (Ceres CLONE ID no. 7559; SEQ ID NO:1681), CeresClone:844350 (SEQ ID NO:1685), gi|52140009 (SEQ ID NO:1686), CeresClone: 298172 (SEQ ID NO:1687), gi|52140013 (SEQ ID NO:1688), CeresClone:541062 (SEQ ID NO:1689), gi|52140015 (SEQ ID NO:1690), and gi|52140010 (SEQ ID NO:2006). Other homologs and/or orthologs of SEQ ID NO:1681 include Ceres ANNOT ID no. 1469241 (SEQ ID NO:1683), SEQ ID NO:1684, Ceres CLONE ID no. 844350 (SEQ ID NO:1685), Ceres CLONE ID no. 1950861 (SEQ ID NO:2153), and Ceres ANNOT ID no. 6029526 (SEQ ID NO:2236).

Amino acid sequences of homologs and/or orthologs of the polypeptide having the amino acid sequence set forth in SEQ ID NO:779 include Ceres ANNOT ID no. 1451365 (SEQ ID NO:2095).

Amino acid sequences of homologs and/or orthologs of the polypeptide having the amino acid sequence set forth in SEQ ID NO:1866 include Ceres ANNOT ID no. 1485544 (SEQ ID NO:2111), Ceres CLONE ID no. 1826678 (SEQ ID NO:2137), and Ceres ANNOT ID no. 6026295 (SEQ ID NO:2232).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 179-194, SEQ ID NO:196, SEQ ID NOs:198-215, SEQ ID NO:217, SEQ ID NO:219, SEQ ID NOs:222-251, SEQ ID NO:253, SEQ ID NOs:255-256, SEQ ID NO:258, SEQ ID NO:260, SEQ ID NOs:262-265, SEQ ID NO:267, SEQ ID NOs:269-270, SEQ ID NOs:272-273, SEQ ID NOs:275-277, SEQ ID NOs:279-280, SEQ ID NO:282, SEQ ID NO:284, SEQ ID NOs:286-287, SEQ ID NOs:289-290, SEQ ID NO:292, SEQ ID NOs:294-298, SEQ ID NO:300, SEQ ID NO:302, SEQ ID NO:304, SEQ ID NO:306, SEQ ID NOs: 308-313, SEQ ID NOs:315-316, SEQ ID NOs:318-319, SEQ ID NO:321, SEQ ID NO:323, SEQ ID NOs:325-326, SEQ ID NO:328, SEQ ID NO:330, SEQ ID NO:332, SEQ ID NOs: 334-335, SEQ ID NOs:362-368, SEQ ID NOs:382-385, SEQ ID NOs:387-389, SEQ ID NOs:391-392, SEQ ID NOs:394-398, SEQ ID NO:400, SEQ ID NOs:402-403, SEQ ID NOs: 433-434, SEQ ID NOs:700-701, SEQ ID NO:1261, SEQ ID NO:1263, SEQ ID NO:1265, SEQ ID NO:1946, SEQ ID NOs:1424-1429, SEQ ID NO:1431, SEQ ID NO:1433, SEQ ID NOs:1925-1930, SEQ ID NO:1683-1690, SEQ ID NO:2006, SEQ ID NO:2095, SEQ ID NO:2111, SEQ ID NO:2137, SEQ ID NO:2153, SEQ ID NO:2182, SEQ ID NO:2222, SEQ ID NO:2232, SEQ ID NO:2236, or SEQ ID NO:2324.

A regulatory protein can have a G-patch domain. The D111/G-patch domain is a short conserved region of about 40 amino acids that occurs in a number of putative RNA-binding polypeptides, including tumor suppressor and DNA-damage-repair polypeptides. The G-patch domain may, therefore, have an RNA binding function. There are seven highly conserved glycine residues in the G-patch domain. SEQ ID NO:1564 sets forth the amino acid sequence of a DNA clone, identified herein as Ceres CLONE ID no. 333416 (SEQ ID NO:1563), that is predicted to encode a polypeptide containing a Pfam domain as indicated in the Sequence Listing (e.g., a G-patch domain).

A regulatory protein can comprise the amino acid sequence set forth in SEQ ID NO:1564. In some cases, a regulatory protein can be a homolog, ortholog, or variant of the polypeptide having the amino acid sequence set forth in SEQ ID NO:1564. For example, a regulatory protein can have an amino acid sequence with at least 60% sequence identity, e.g., 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:1564.

Figure 104:
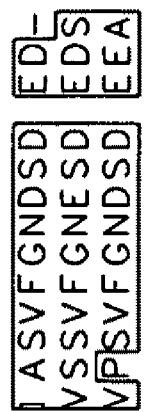
FIG. 104 is an alignment of the amino acid sequence of Ceres Clone 333416 (SEQ ID NO:1564) with homologous and/or orthologous amino acid sequences CeresClone: 108509 (SEQ ID NO:1947) and CeresClone:764678 (SEQ ID NO:1948).

Amino acid sequences of homologs and/or orthologs of the polypeptide having the amino acid sequence set forth in SEQ ID NO:1564 are provided in FIG. 104.

For example, the alignment in FIG. 104 provides the amino acid sequences of Ceres Clone 333416 (SEQ ID NO:1564), CeresClone:108509 (SEQ ID NO:1947) and CeresClone: 764678 (SEQ ID NO:1948). Other homologs and/or orthologs of SEQ ID NO:1564 include Ceres ANNOT ID no. 1469082 (SEQ ID NO:1566) and Ceres ANNOT ID no. 1522474 (SEQ ID NO:1568).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NO:1566, SEQ ID NO:1568, or SEQ ID NOs:1947-1948.

A regulatory protein can contain one or more domains characteristic of a helicase polypeptide. For example, a regulatory protein can contain a DEAD domain characteristic of DEAD/DEAH box helicase polypeptides. Members of the DEAD/DEAH box helicase polypeptide family include the DEAD and DEAH box helicases, which are involved in unwinding nucleic acids. The DEAD box helicases are involved in various aspects of RNA metabolism, including nuclear transcription, pre mRNA splicing, ribosome biogenesis, nucleocytoplasmic transport, translation, RNA decay, and organellar gene expression. SEQ ID NO:1581 sets forth the amino acid sequence of a DNA clone, identified herein as Ceres CLONE ID no. 389585 (SEQ ID NO:1580), that is predicted to encode a polypeptide containing a Pfam domain as indicated in the Sequence Listing (e.g., a DEAD domain).

In some cases, a regulatory protein can contain a DEAD domain and a Helicase_C domain. The Helicase_C, or helicase conserved C-terminal, domain is found in a wide variety of helicases and related polypeptides. The Helicase_C domain may be an integral part of the helicase rather than an autonomously folding unit. SEQ ID NO:938 and SEQ ID NO:1610 set forth the amino acid sequences of DNA clones, identified herein as Ceres CLONE ID no. 534281 (SEQ ID NO:937) and Ceres CLONE ID no. 42530 (SEQ ID NO:1609), respectively, each of which is predicted to encode a polypeptide containing a Pfam domain as indicated in the Sequence Listing (e.g., a DEAD domain and a Helicase_C domain).

A regulatory protein can comprise the amino acid sequence set forth in SEQ ID NO:1581, SEQ ID NO:938, or SEQ ID NO:1610. In some cases, a regulatory protein can be a homolog, ortholog, or variant of the polypeptide having the amino acid sequence set forth in SEQ ID NO:1581, SEQ ID NO:938, or SEQ ID NO:1610. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:1581, SEQ ID NO:938, or SEQ ID NO:1610.

Amino acid sequences of homologs and/or orthologs of the polypeptide having the amino acid sequence set forth in SEQ ID NO:938 and SEQ ID NO:1610 are provided in FIG. 59 and FIG. 109, respectively.

For example, the alignment in FIG. 59 provides the amino acid sequences of Ceres Clone 534281 (SEQ ID NO:938), gi|92877732 (SEQ ID NO:939), CeresAnnot:1471100 (SEQ ID NO:943), gi|21280839 (SEQ ID NO:946), gi|50911116 (SEQ ID NO:947), CeresClone:1580901 (SEQ ID NO:950), CeresClone:703763 (SEQ ID NO:954), and CeresClone: 1795581 (SEQ ID NO:959). Other homologs and/or orthologs of SEQ ID NO:938 include Public GI no. 92877736 (SEQ ID NO:940), Public GI no. 92877733 (SEQ ID NO:941), Ceres ANNOT ID no. 1497192 (SEQ ID NO:945), Public GI no. 3775993 (SEQ ID NO:948), Public GI no. 50926692 (SEQ ID NO:949), Ceres CLONE ID no. 236189 (SEQ ID NO:951), Public GI no. 50911118 (SEQ ID NO:952), Public GI no. 7267405 (SEQ ID NO:953), Ceres CLONE ID no. 777111 (SEQ ID NO:955), Public GI no. 37535822 (SEQ ID NO:956), Public GI no. 78708877 (SEQ ID NO:957), Ceres CLONE ID no. 290675 (SEQ ID NO:960), Public GI no. 62733592 (SEQ ID NO:961), Public GI no. 23197660 (SEQ ID NO:962), Ceres ANNOT ID no. 6094284 (SEQ ID NO:2330), and Ceres ANNOT ID no. 6094287 (SEQ ID NO:2332).

The alignment in FIG. 109 provides the amino acid sequences of Ceres CLONE ID no. 42530 (SEQ ID NO:1610), CeresClone:30700 (SEQ ID NO:2068), gi|19698881 (SEQ ID NO:2070), gi|25809054 (SEQ ID NO:2083), gi|2119932 (SEQ ID NO:2076), gi|19697 (SEQ ID NO:2071), gi|475216 (SEQ ID NO:2073), and gi|2119933 (SEQ ID NO:2080). Other homologs and/or orthologs of SEQ ID NO:1610 include Public GI no. 23397033 (SEQ ID NO:2069), Public GI no. 21555870 (SEQ ID NO:2072), Public GI no. 2119938 (SEQ ID NO:2074), Public GI no. 2119934 (SEQ ID NO:2075), Public GI no. 485949 (SEQ ID NO:2077), Public GI no. 485945 (SEQ ID NO:2078), Public GI no. 485943 (SEQ ID NO:2079), Public GI no. 485951 (SEQ ID NO:2081), Public GI no. 485987 (SEQ ID NO:2082), and Ceres CLONE ID no. 1792937 (SEQ ID NO:2131).

Amino acid sequences of homologs and/or orthologs of the polypeptide having the amino acid sequence set forth in SEQ ID NO:1581 include Ceres CLONE ID no. 1887320 (SEQ ID NO:2143) and Ceres ANNOT ID no. 6009958 (SEQ ID NO:2174).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 939-941, SEQ ID NO:943, SEQ ID NOs:945-957, SEQ ID NOs:959-962, SEQ ID NOs:2068-2083, SEQ ID NO:2131, SEQ ID NO:2143, SEQ ID NO:2174, SEQ ID NO:2330, or SEQ ID NO:2332.

A regulatory protein can contain a GRP domain characteristic of a polypeptide belonging to the glycine-rich protein family. This family of polypeptides includes several glycine-rich proteins as well as nodulins 16 and 24. The family also contains polypeptides that are induced in response to various stresses. Some of the polypeptides that have a glycine-rich domain (i.e., GRPs) are capable of binding to RNA, potentially affecting the stability and translatability of bound RNAs. SEQ ID NO:372, SEQ ID NO:1185, SEQ ID NO:1393, and SEQ ID NO:1846 set forth the amino acid sequences of DNA clones, identified herein as Ceres CLONE ID no. 113443 (SEQ ID NO:371), Ceres CLONE ID no. 3929 (SEQ ID NO:1184), Ceres CLONE ID no. 118184 (SEQ ID NO:1392), and Ceres CLONE ID no. 207629 (SEQ ID NO:1845), respectively, each of which is predicted to encode a polypeptide containing a Pfam domain as indicated in the Sequence Listing (e.g., a GRP domain).

A regulatory protein can comprise the amino acid sequence set forth in SEQ ID NO:372, SEQ ID NO:1185, SEQ ID NO:1393, or SEQ ID NO:1846. In some cases, a regulatory protein can be a homolog, ortholog, or variant of the polypeptide having the amino acid sequence set forth in SEQ ID NO:372, SEQ ID NO:1185, SEQ ID NO:1393, or SEQ ID NO:1846. For example, a regulatory protein can have an amino acid sequence with at least 55% sequence identity, e.g., 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:372, SEQ ID NO:1185, SEQ ID NO:1393, or SEQ ID NO:1846.

Amino acid sequences of homologs and/or orthologs of the polypeptide having the amino acid sequence set forth in SEQ ID NO:1185 are provided in FIG. 71.

For example, the alignment in FIG. 71 provides the amino acid sequences of cDNA ID 23389966 (Ceres CLONE ID no. 3929; SEQ ID NO:1185), gi|20197615 (SEQ ID NO:1187), CeresClone:18215 (SEQ ID NO:1188), CeresClone:105261 (SEQ ID NO:1190), CeresClone:24667 (SEQ ID NO:1193), CeresClone:118878 (SEQ ID NO:1195), CeresClone:12459 (SEQ ID NO:1196), and CeresClone:1354021 (SEQ ID NO:1197). Other homologs and/or orthologs of SEQ ID NO:1185 include Ceres CDNA ID no. 23389966 (SEQ ID NO:1186), Public GI no. 21536606 (SEQ ID NO:1189), Ceres CLONE ID no. 23214 (SEQ ID NO:1191), Ceres CLONE ID no. 207629 (SEQ ID NO:1192), Ceres CLONE ID no. 1006473 (SEQ ID NO:1194), Public GI no. 30017217 (SEQ ID NO:1198), Ceres CLONE ID no. 109026 (SEQ ID NO:1199), SEQ ID NO:1200, Ceres CLONE ID no. 118184 (SEQ ID NO:1201), Ceres CLONE ID no. 118878 (SEQ ID NO:1202), Ceres CLONE ID no. 12459 (SEQ ID NO:1203), Ceres CLONE ID no. 1354021 (SEQ ID NO:1204), Public GI no. 30017217 (SEQ ID NO:1205), Ceres CLONE ID no. 109026 (SEQ ID NO:1206), Public GI no. 1252961811 (SEQ ID NO:1207), and Ceres CLONE ID no. 1767187 (SEQ ID NO:1209).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 1186-1207, or SEQ ID NO:1209.

A regulatory protein can contain a Usp domain characteristic of a polypeptide belonging to the universal stress protein family. The universal stress protein UspA is a small cytoplasmic bacterial polypeptide whose expression is enhanced when the cell is exposed to stress agents. UspA enhances the rate of cell survival during prolonged exposure to such conditions, and may provide a general "stress endurance" activity. SEQ ID NO:1096 and SEQ ID NO:1862 set forth the amino acid sequences of DNA clones, identified herein as Ceres CLONE ID no. 7774 (SEQ ID NO:1095) and Ceres CLONE ID no. 2767 (SEQ ID NO:1861), respectively, each of which is predicted to encode a polypeptide containing a Pfam domain as indicated in the Sequence Listing (e.g., a Usp domain).

A regulatory protein can comprise the amino acid sequence set forth in SEQ ID NO:1096 or SEQ ID NO:1862. In some cases, a regulatory protein can be a homolog, ortholog, or variant of the polypeptide having the amino acid sequence set forth in SEQ ID NO:1096 or SEQ ID NO:1862. For example, a regulatory protein can have an amino acid sequence with at least 55% sequence identity, e.g., 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:1096 or SEQ ID NO:1862.

Amino acid sequences of homologs and/or orthologs of the polypeptide having the amino acid sequence set forth in SEQ ID NO:1096 are provided in FIG. 66.

For example, the alignment in FIG. 66 provides the amino acid sequences of Ceres Clone 7774 (SEQ ID NO:1096), 1449565 (SEQ ID NO:1098), gi|92875130 (SEQ ID NO:1099), CeresClone:1728645 (SEQ ID NO:1100), CeresClone:892214 (SEQ ID NO:101), and gi|50913251 (SEQ ID NO:1102).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 1098-1102.

A regulatory protein can contain a GASA domain characteristic of a polypeptide belonging to the GASA gibberellin regulated cysteine rich protein family. The expression of these polypeptides is up-regulated by the plant hormone gibberellin. Most of these gibberellin regulated polypeptides have a role in plant development. There are 12 conserved cysteine residues, making it possible for these proteins to possess six disulphide bonds. SEQ ID NO:548 sets forth the amino acid sequence of a DNA clone, identified herein as Ceres CLONE ID no. 1845 (SEQ ID NO:547), that is predicted to encode a Pfam domain as indicated in the Sequence Listing (e.g., a gibberellin regulated polypeptide).

A regulatory protein can comprise the amino acid sequence set forth in SEQ ID NO:548. In some cases, a regulatory protein can be a homolog, ortholog, or variant of the polypeptide having the amino acid sequence set forth in SEQ ID NO:548. For example, a regulatory protein can have an amino acid sequence with at least 50% sequence identity, e.g., 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:548.

Amino acid sequences of homologs and/or orthologs of the polypeptide having the amino acid sequence set forth in SEQ ID NO:548 are provided in FIG. 26.

For example, the alignment in FIG. 26 provides the amino acid sequences of Ceres Clone 1845 (SEQ ID NO:548), CeresClone:890211 (SEQ ID NO:549), CeresClone:556120 (SEQ ID NO:550), and CeresAnnot:1483577 (SEQ ID NO:553). Other homologs and/or orthologs of SEQ ID NO:548 include Ceres CLONE ID no. 1618178 (SEQ ID NO:551).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 549-551 or SEQ ID NO:553.

A regulatory protein can contain one or more tetratricopeptide repeats (TPRs). For example, a regulatory protein can contain a TPR_2 motif. Tetratricopeptide repeats, such as TPR_1, TPR_2, TPR_3, and TPR_4, are structural motifs that are present in a wide range of polypeptides and that mediate polypeptide-polypeptide interactions and assembly of multi-polypeptide complexes. The TPR motif consists of 3 to 16 tandem repeats of 34 amino acid residues, although individual TPR motifs can be dispersed in the polypeptide sequence. Sequence alignment of TPR domains has revealed a consensus sequence defined by a pattern of small and large amino acids. TPR motifs have been identified in various different organisms, ranging from bacteria to humans. Polypeptides containing TPRs are involved in a variety of biological processes, such as cell cycle regulation, transcriptional control, mitochondrial and peroxisomal protein transport, neurogenesis, and protein folding. SEQ ID NO:1421 sets forth the amino acid sequence of a DNA clone, identified herein as Ceres CLONE ID no. 13930 (SEQ ID NO:1420), that is predicted to encode a polypeptide containing a Pfam domain as indicated in the Sequence Listing (e.g., a TPR_2 motif).

In some cases, a regulatory protein can contain a TPR_1 motif and a TPR_2 motif. SEQ ID NO:781, SEQ ID NO:964, and SEQ ID NO:1897 set forth the amino acid sequences of DNA clones, identified herein as Ceres CLONE ID no. 36370 (SEQ ID NO:780), Ceres CLONE ID no. 539801 (SEQ ID NO:963), and Ceres CLONE ID no. 5398 (SEQ ID NO:1896), respectively, each of which is predicted to encode a polypeptide containing a Pfam domain as indicated in the Sequence Listing (e.g., a TPR_1 motif and a TPR_2 motif).

A regulatory protein can comprise the amino acid sequence set forth in SEQ ID NO:1421, SEQ ID NO:781, SEQ ID NO:964, or SEQ ID NO:1897. In some cases, a regulatory protein can be a homolog, ortholog, or variant of the polypeptide having the amino acid sequence set forth in SEQ ID NO:1421, SEQ ID NO:781, SEQ ID NO:964, or SEQ ID NO:1897. For example, a regulatory protein can have an amino acid sequence with at least 40% sequence identity, e.g., 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:1421, SEQ ID NO:781, SEQ ID NO:964, or SEQ ID NO:1897.

Figure 60:
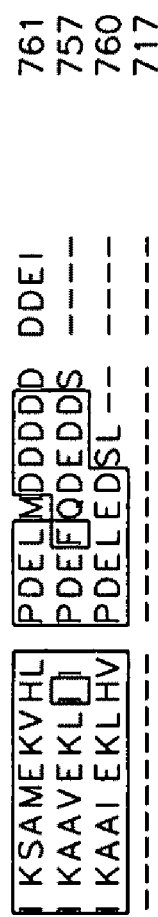
FIG. 60 is an alignment of the amino acid sequence of Ceres Clone 539801 (SEQ ID NO:964) with homologous and/or orthologous amino acid sequences CeresAnnot:1531585 (SEQ ID NO:966), CeresClone:1209672 (SEQ ID NO:969), and gi|51090847 (SEQ ID NO:971).

Amino acid sequences of homologs and/or orthologs of the polypeptide having the amino acid sequence set forth in SEQ ID NO:781, SEQ ID NO:964, and SEQ ID NO:1897 are provided in FIG. 48, FIG. 60, and FIG. 130, respectively.

For example, the alignment in FIG. 48 provides the amino acid sequences of Ceres Clone 36370 (SEQ ID NO:781), CeresClone:627169 (SEQ ID NO:784), CeresClone: 1724787 (SEQ ID NO:786), gi|34914598 (SEQ ID NO:787), CeresClone:1397168 (SEQ ID NO:788), CeresAnnot: 1481678 (SEQ ID NO:790), and CeresClone:704527 (SEQ ID NO:791). Other homologs and/or orthologs of SEQ ID NO:781 include Public GI no. 18400278 (SEQ ID NO:782) and Public GI no. 9294636 (SEQ ID NO:783).

The alignment in FIG. 60 provides the amino acid sequences of Ceres Clone 539801 (SEQ ID NO:964), CeresAnnot:1531585 (SEQ ID NO:966), CeresClone:1209672 (SEQ ID NO:969), and gi|51090847 (SEQ ID NO:971). Other homologs and/or orthologs of SEQ ID NO:964 include Ceres ANNOT ID no. 1537203 (SEQ ID NO:968), Public GI no. 21304447 (SEQ ID NO:970), Ceres ANNOT ID no. 1531585 (SEQ ID NO:973), Ceres ANNOT ID no. 1537203 (SEQ ID NO:975), Ceres CLONE ID no. 1209672 (SEQ ID NO:976), Public GI no. 21304447 (SEQ ID NO:977), Public GI no. 51090847 (SEQ ID NO:978), Ceres ANNOT ID no. 6017514 (SEQ ID NO:2212), and Ceres ANNOT ID no. 6054789 (SEQ ID NO:2284).

The alignment in FIG. 130 provides the amino acid sequences of CeresClone:5398 (SEQ ID NO:1897), Ceres-Clone:1836567 (SEQ ID NO:1899), 1458988 (SEQ ID NO:1901), and gi|92899044 (SEQ ID NO:1902). Other homologs and/or orthologs of SEQ ID NO:1897 include Ceres ANNOT ID no. 6017514 (SEQ ID NO:2210) and Ceres ANNOT ID no. 6054789 (SEQ ID NO:2282).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 782-784, SEQ ID NOs:786-788, SEQ ID NOs:790-791, SEQ ID NO:966, SEQ ID NOs:968-971, SEQ ID NO:973, SEQ ID NOs:975-978, SEQ ID NO:1899, SEQ ID NOs:1901-1902, SEQ ID NO:2210, SEQ ID NO:2212, SEQ ID NO:2282, or SEQ ID NO:2284.

A regulatory protein can contain a Response_reg domain. The response regulator receiver domain, which belongs to the CheY family, receives the signal from the sensor partner in the two-component system. The response regulator polypeptides act as phosphorylation-activated switches to affect a cellular response, usually by transcriptional regulation. Most of these polypeptides consist of two domains, an N-terminal response regulator receiver domain, and a variable C-terminal effector domain with DNA-binding activity. SEQ ID NO:1698 sets forth the amino acid sequence of a DNA clone, identified herein as Ceres CLONE ID no. 968026 (SEQ ID NO:1697), that is predicted to encode a polypeptide containing a Pfam domain as indicated in the Sequence Listing (e.g., a Response_reg domain).

In some cases, a regulatory protein can contain a Response_reg domain and a myb-like DNA binding domain described above. SEQ ID NO:898 sets forth the amino acid sequence of a DNA clone, identified herein as Ceres CLONE ID no. 41875 (SEQ ID NO:897), that is predicted to encode a polypeptide containing a Pfam domain as indicated in the Sequence Listing (e.g., a Response_reg domain and a myb-like DNA binding domain).

A regulatory protein can comprise the amino acid sequence set forth in SEQ ID NO:1698 or SEQ ID NO:898. In some cases, a regulatory protein can be a homolog, ortholog, or variant of the polypeptide having the amino acid sequence set forth in SEQ ID NO:1698 or SEQ ID NO:898. For example, a regulatory protein can have an amino acid sequence with at least 50% sequence identity, e.g., 50%, 55%, 60%, 65%, 67%, 68%, 70%, 75%, 80%, 85%, 90%, 95%, 97%, 98%, or 99% sequence identity, to the amino acid sequence set forth in SEQ ID NO:1698 or SEQ ID NO:898.

Amino acid sequences of homologs and/or orthologs of the polypeptide having the amino acid sequence set forth in SEQ ID NO:1698 are provided in FIG. 118.

For example, the alignment in FIG. 118 provides the amino acid sequences of ME05220 (Ceres CLONE ID no. 968026; SEQ ID NO:1698), CeresClone:596510 (SEQ ID NO:2057) and gi|28466913 (SEQ ID NO:2056). Other homologs and/or orthologs of SEQ ID NO:1698 include Public GI No. 4678318 (SEQ ID NO:1975), Ceres ANNOT ID no. 1473516 (SEQ ID NO:1700), Ceres ANNOT ID no. 1526929 (SEQ ID NO:1702), Ceres ANNOT ID no. 1513366 (SEQ ID NO:1704), Ceres ANNOT ID no. 1460097 (SEQ ID NO:1706), Ceres ANNOT ID no. 1459838 (SEQ ID NO:1708), Ceres ANNOT ID no. 1474764 (SEQ ID NO:1710), Ceres ANNOT ID no. 1453555 (SEQ ID NO:1712), Ceres ANNOT ID no. 1448253 (SEQ ID NO:1714), Ceres ANNOT ID no. 1437849 (SEQ ID NO:1716), Ceres ANNOT ID no. 1443270 (SEQ ID NO:1718), and Ceres ANNOT ID no. 1496190 (SEQ ID NO:1720).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 2056-2057, SEQ ID NO:1975, SEQ ID NO:1700, SEQ ID NO:1702, SEQ ID NO:1704, SEQ ID NO:1706, SEQ ID NO:1708, SEQ ID NO:1710, SEQ ID NO:1712, SEQ ID NO:1714, SEQ ID NO:1716, SEQ ID NO:1718, or SEQ ID NO:1720.

A regulatory protein can contain a Ras domain characteristic of a Ras family polypeptide. Most of the members of the Ras superfamily have GTPase activity and some of the members have been implicated in various processes including cell development, cell and tissue differentiation, growth, survival, cytokine production, and vesicle-trafficking. The small Ras-GTPases are involved in intracellular cell signaling transduction pathway leading to modulation of gene expression, thus affecting the various processes mentioned above. SEQ ID NO:652, SEQ ID NO:1267, and SEQ ID NO:1888 set forth the amino acid sequences of DNA clones, identified herein as Ceres CLONE ID no. 2898 (SEQ ID NO:651), Ceres CLONE ID no. 34414 (SEQ ID NO:1266), and Ceres CLONE ID no. 6827 (SEQ ID NO:1887), respectively, each of which is predicted to encode a polypeptide containing a Pfam domain as indicated in the Sequence Listing (e.g., a Ras domain).

A regulatory protein can comprise the amino acid sequence set forth in SEQ ID NO:652, SEQ ID NO:1267, or SEQ ID NO:1888. In some cases, a regulatory protein can be a homolog, ortholog, or variant of the polypeptide having the amino acid sequence set forth in SEQ ID NO:652, SEQ ID NO:1267, or SEQ ID NO:1888. For example, a regulatory protein can have an amino acid sequence with at least 65% sequence identity, e.g., 65%, 67%, 68%, 70%, 75%, 80%, 85%, 90%, 95%, 97%, 98%, or 99% sequence identity, to the amino acid sequence set forth in SEQ ID NO:652, SEQ ID NO:1267, or SEQ ID NO:1888.

Figure 34:
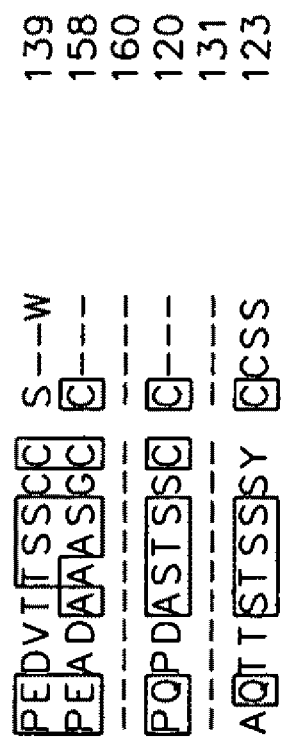
FIG. 34 is an alignment of the amino acid sequence of Ceres Clone 2898 (SEQ ID NO:652) with homologous and/or orthologous amino acid sequences CeresClone:1716210 (SEQ ID NO:653), CeresClone:1421639 (SEQ ID NO:654), 1443201 (SEQ ID NO:656), CeresClone:749118 (SEQ ID NO:657), and 1450718 (SEQ ID NO:659).

Amino acid sequences of homologs and/or orthologs of the polypeptide having the amino acid sequence set forth in SEQ ID NO:652 and SEQ ID NO:1267 are provided in FIG. 34 and FIG. 76, respectively.

For example, the alignment in FIG. 34 provides the amino acid sequences of Ceres Clone 2898 (SEQ ID NO:652), CeresClone:1716210 (SEQ ID NO:653), CeresClone: 1421639 (SEQ ID NO:654), 1443201 (SEQ ID NO:656), CeresClone:749118 (SEQ ID NO:657), and 1450718 (SEQ ID NO:659). Other homologs and/or orthologs of SEQ ID NO:652 include Ceres ANNOT ID no. 1450718 (SEQ ID NO:2091) and Ceres CLONE ID no. 1956018 (SEQ ID NO:2155).

The alignment in FIG. 76 provides the amino acid sequences of cDNA ID 23384563 (Ceres CLONE ID no. 34414; SEQ ID NO:1267), CeresClone:14909 (SEQ ID NO:1986), CeresClone:1535974 (SEQ ID NO:1991), Ceres-Clone:276776 (SEQ ID NO:1990), CeresClone:240510 (SEQ ID NO:1992), gi|39653273 (SEQ ID NO:1989), Ceres-Clone:33126 (SEQ ID NO:1987), and CeresClone:1338585 (SEQ ID NO:1988). Other homologs and/or orthologs of SEQ ID NO:1267 include Ceres ANNOT ID no. 1471525 (SEQ ID NO:1269), Ceres ANNOT ID no. 1497838 (SEQ ID NO:1271), Ceres ANNOT ID no. 1511908 (SEQ ID NO:1273), Ceres ANNOT ID no. 1464305 (SEQ ID NO:1275), Ceres ANNOT ID no. 1451416 (SEQ ID NO:1277), Ceres ANNOT ID no. 1514324 (SEQ ID NO:1279), Ceres ANNOT ID no. 1461050 (SEQ ID NO:1281), and Ceres CLONE ID no. 1724996 (SEQ ID NO:1283).

Amino acid sequence of homologs and/or orthologs of the polypeptide having the amino acid sequence set forth in SEQ ID NO:1888 include Ceres ANNOT ID no. 1453294 (SEQ ID NO:2099) and Ceres ANNOT ID no. 6087117 (SEQ ID NO:2318).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 653-654, SEQ ID NOs:656-657, SEQ ID NO:659, SEQ ID NO:1269, SEQ ID NO:1271, SEQ ID NO:1273, SEQ ID NO:1275, SEQ ID NO:1277, SEQ ID NO:1279, SEQ ID NO:1281, SEQ ID NO:1283, SEQ ID NOs:1986-1992, SEQ ID NO:2091, SEQ ID NO:2099, SEQ ID NO:2155, or SEQ ID NO:2318.

A regulatory protein can contain an MMR_HSR1 domain characteristic of a GTPase polypeptide belonging to a subfamily of GTP-binding polypeptides. Polypeptides representing this subfamily include human HSR1, which has been localized to the human MHC class I region and is highly homologous to a putative GTP-binding protein, MMR1, from mouse. SEQ ID NO:585 and SEQ ID NO:1890 set forth the amino acid sequences of DNA clones, identified herein as Ceres CLONE ID no. 224919 (SEQ ID NO:584) and Ceres CLONE ID no. 969682 (SEQ ID NO:1889), respectively, each of which is predicted to encode a polypeptide containing a Pfam domain as indicated in the Sequence Listing (e.g., an MMR_HSR1 domain).

A regulatory protein can comprise the amino acid sequence set forth in SEQ ID NO:585 or SEQ ID NO:1890. In some cases, a regulatory protein can be a homolog, ortholog, or variant of the polypeptide having the amino acid sequence set forth in SEQ ID NO:585 or SEQ ID NO:1890. For example, a regulatory protein can have an amino acid sequence with at least 80% sequence identity, e.g., 80%, 85%, 90%, 95%, 97%, 98%, or 99% sequence identity, to the amino acid sequence set forth in SEQ ID NO:585 or SEQ ID NO:1890.

Amino acid sequences of homologs and/or orthologs of the polypeptide having the amino acid sequence set forth in SEQ ID NO:585 are provided in FIG. 29. Other homologs and/or orthologs of SEQ ID NO:585 include Ceres CLONE ID no. 1963936 (SEQ ID NO:2129).

For example, the alignment in FIG. 29 provides the amino acid sequences of Ceres Clone 224919 (SEQ ID NO:585), gi|50933495 (SEQ ID NO:586) and CeresClone:1556085 (SEQ ID NO:587). Other homologs and/or orthologs of SEQ ID NO:585 include Public GI no. 218204 (SEQ ID NO:588).

Amino acid sequences of homologs and/or orthologs of the polypeptide having the amino acid sequence set forth in SEQ ID NO:1890 include Ceres ANNOT ID no. 1475363 (SEQ ID NO:2107).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 586-588, SEQ ID NO:2107, or SEQ ID NO:2129.

A regulatory protein can contain a Ras domain and an MMR_HSR1 domain, both of which are described above. SEQ ID NO:465 sets forth the amino acid sequence of a DNA clone, identified herein as Ceres CLONE ID no. 1492 (SEQ ID NO:464), that is predicted to encode a polypeptide containing a Pfam domain as indicated in the Sequence Listing (e.g., a Ras domain and an MMR_HSR1 domain).

A regulatory protein can comprise the amino acid sequence set forth in SEQ ID NO:465. In some cases, a regulatory protein can be a homolog, ortholog, or variant of the polypeptide having the amino acid sequence set forth in SEQ ID NO:465. For example, a regulatory protein can have an amino acid sequence with at least 75% sequence identity, e.g., 75%, 80%, 85%, 90%, 95%, 97%, 98%, or 99% sequence identity, to the amino acid sequence set forth in SEQ ID NO:465.

Amino acid sequences of homologs and/or orthologs of the polypeptide having the amino acid sequence set forth in SEQ ID NO:465 are provided in FIG. 20.

For example, the alignment in FIG. 20 provides the amino acid sequences of CeresClone:1492 (SEQ ID NO:465), gi|89257443 (SEQ ID NO:466), CeresClone:1128644 (SEQ ID NO:467), gi|4586580 (SEQ ID NO:468), CeresClone:1835140 (SEQ ID NO:470), gi|50911379 (SEQ ID NO:471), 1538756 (SEQ ID NO:473), CeresClone:1840642 (SEQ ID NO:475), gi|311907 (SEQ ID NO:476), CeresClone:1932400 (SEQ ID NO:478), gi|1053067 (SEQ ID NO:479), CeresClone:727613 (SEQ ID NO:480), gi|34914060 (SEQ ID NO:481), CeresClone:1834939 (SEQ ID NO:483), gi|2500073 (SEQ ID NO:484), gi|5902803 (SEQ ID NO:485), CeresClone:1785552 (SEQ ID NO:487), and gi|401686 (SEQ ID NO:488). Other homologs and/or orthologs of SEQ ID NO:465 include Ceres ANNOT ID no. 1539674 (SEQ ID NO:2117), Ceres CLONE ID no. 1771639 (SEQ ID NO:2123), and Ceres ANNOT ID no. 6052977 (SEQ ID NO:2280).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 466-468, SEQ ID NOs:470-471, SEQ ID NO:473, SEQ ID NOs:475-476, SEQ ID NOs:478-481, SEQ ID NOs:483-485, SEQ ID NOs:487-488, SEQ ID NO:2117, SEQ ID NO:2123, or SEQ ID NO:2280.

A regulatory protein can contain an Arf domain characteristic of polypeptides belonging to the ADP-ribosylation factor family. The small ADP ribosylation factor (Arf) GTP-binding polypeptides are major regulators of vesicle biogenesis in intracellular traffic. They are the founding members of a growing family that includes Arl (Arf-like), Arp (Arf-related proteins), and the remotely related Sar (Secretion-associated and Ras-related) polypeptides. Arf polypeptides cycle between inactive GDP-bound and active GTP-bound forms that bind selectively to effectors. Members of the ADP-ribosylation factor family may indirectly affect transcription through polypeptide-polypeptide interactions. SEQ ID NO:686, SEQ ID NO:994, and SEQ ID NO:1211 set forth the amino acid sequences of DNA clones, identified herein as Ceres CLONE ID no. 312833 (SEQ ID NO:685), Ceres CLONE ID no. 543118 (SEQ ID NO:993), and Ceres CLONE ID no. 14909 (SEQ ID NO:1210), respectively, each of which is predicted to encode a polypeptide containing a Pfam domain as indicated in the Sequence Listing (e.g., an Arf domain).

A regulatory protein can comprise the amino acid sequence set forth in SEQ ID NO:686, SEQ ID NO:994, or SEQ ID NO:1211. In some cases, a regulatory protein can be a homolog, ortholog, or variant of the polypeptide having the amino acid sequence set forth in SEQ ID NO:686, SEQ ID NO:994, or SEQ ID NO:1211. For example, a regulatory protein can have an amino acid sequence with at least 60% sequence identity, e.g., 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:686, SEQ ID NO:994, or SEQ ID NO:1211.

Figure 62:
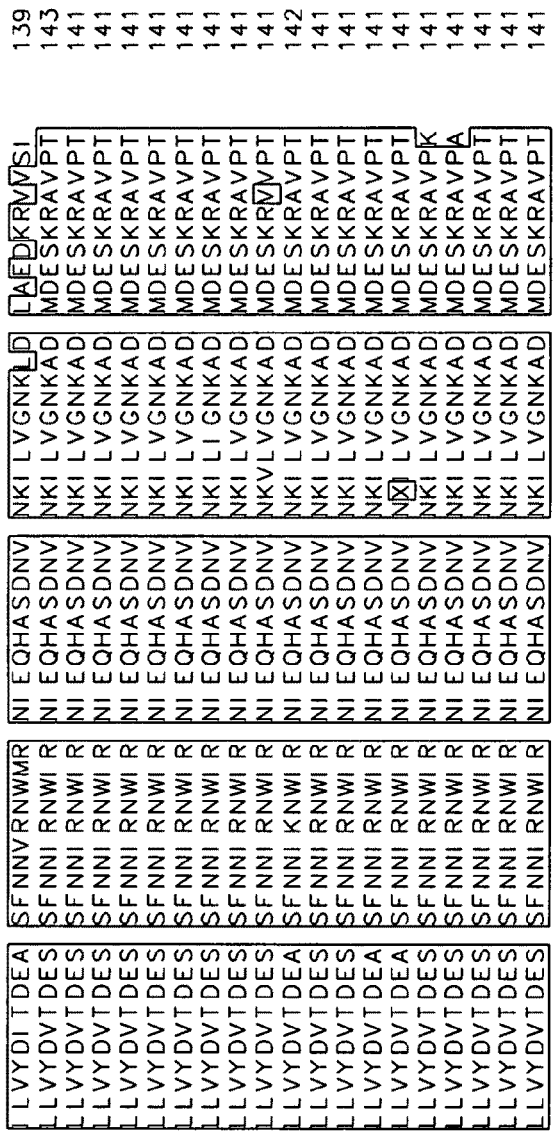
FIG. 62 is an alignment of the amino acid sequence of Ceres Clone 543118 (SEQ ID NO:994) with homologous and/or orthologous amino acid sequences gi|871508 (SEQ ID NO:995), gi|1370190 (SEQ ID NO:996), gi|1654144 (SEQ ID NO:998), gi|18447913 (SEQ ID NO:999), gi|92897911 (SEQ ID NO:1000), gi|28973447 (SEQ ID NO:1005), CeresAnnot:1458068 (SEQ ID NO:1007), CeresClone:636809 (SEQ ID NO:1008), CeresClone:1895506 (SEQ ID NO:1011), gi|974776 (SEQ ID NO:1019), gi|5669640 (SEQ ID NO:1020), CeresClone:1390343 (SEQ ID NO:1021), CeresClone:683923 (SEQ ID NO:1023), gi|313029 (SEQ ID NO:1024), CeresClone:1725800 (SEQ ID NO:1025), gi|2808638 (SEQ ID NO:1026), gi|50935375 (SEQ ID NO:1029), CeresClone:1802574 (SEQ ID NO:1031), and gi|549809 (SEQ ID NO:1048).

Amino acid sequences of homologs and/or orthologs of the polypeptide having the amino acid sequence set forth in SEQ ID NO:686, SEQ ID NO:994, and SEQ ID NO:1211 are provided in FIG. 38, FIG. 62, and FIG. 72, respectively.

For example, the alignment in FIG. 38 provides the amino acid sequences of Ceres Clone 312833 (SEQ ID NO:686) and gi|50920025 (SEQ ID NO:687). Other homologs and/or orthologs of SEQ ID NO:686 include Ceres ANNOT ID no. 6010155 (SEQ ID NO:2178).

The alignment in FIG. 62 provides the amino acid sequences of Ceres Clone 543118 (SEQ ID NO:994), gi|871508 (SEQ ID NO:995), gi|1370190 (SEQ ID NO:996), gi|1654144 (SEQ ID NO:998), gi|18447913 (SEQ ID NO:999), gi|92897911 (SEQ ID NO:1000), gi|28973447 (SEQ ID NO:1005), CeresAnnot:1458068 (SEQ ID NO:1007), CeresClone:636809 (SEQ ID NO:1008), CeresClone:1895506 (SEQ ID NO:1011), gi|974776 (SEQ ID NO:1019), gi|5669640 (SEQ ID NO:1020), CeresClone:1390343 (SEQ ID NO:1021), CeresClone:683923 (SEQ ID NO:1023), gi|313029 (SEQ ID NO:1024), CeresClone:1725800 (SEQ ID NO:1025), gi|2808638 (SEQ ID NO:1026), gi|50935375 (SEQ ID NO:1029), CeresClone:1802574 (SEQ ID NO:1031), and gi|549809 (SEQ ID NO:1048). Other homologs and/or orthologs of SEQ ID NO:994 include Public GI no. 871506 (SEQ ID NO:997), Public GI no. 18447921 (SEQ ID NO:1001), Public GI no. 871514 (SEQ ID NO:1002), Public GI no. 1370194 (SEQ ID NO:1003), Public GI no. 18447917 (SEQ ID NO:1004), Public GI no. 18447919 (SEQ ID NO:1009), Public GI no. 14334918 (SEQ ID NO:1012), Public GI no. 871510 (SEQ ID NO:1013), Ceres CLONE ID no. 256151 (SEQ ID NO:1014), Ceres ANNOT ID no. 1461863 (SEQ ID NO:1016), Public GI no. 1370196 (SEQ ID NO:1017), Public GI no. 1370198 (SEQ ID NO:1018), Public GI no. 21555222 (SEQ ID NO:1022), Ceres CLONE ID no. 1851155 (SEQ ID NO:1028), Public GI no. 50919469 (SEQ ID NO:1032), Ceres CLONE ID no. 1281221 (SEQ ID NO:1033), Ceres CLONE ID no. 1724467 (SEQ ID NO:1035), Ceres CLONE ID no. 1076158 (SEQ ID NO:1036), Ceres CLONE ID no. 689414 (SEQ ID NO:1037), Ceres CLONE ID no. 1290569 (SEQ ID NO:1038), Ceres CLONE ID no. 1021031 (SEQ ID NO:1039), Public GI no. 50931689 (SEQ ID NO:1040), Ceres CLONE ID no. 239853 (SEQ ID NO:1041), Public GI no. 46326983 (SEQ ID NO:1042), Public GI no. 15810625 (SEQ ID NO:1043), Public GI no. 21592670 (SEQ ID NO:1044), Ceres CLONE ID no. 3115 (SEQ ID NO:1045), Public GI no. 6681329 (SEQ ID NO:1046), Ceres CLONE ID no. 10506 (SEQ ID NO:1047), Ceres ANNOT ID no. 6011078 (SEQ ID NO:2180), and Ceres ANNOT ID no. 6039802 (SEQ ID NO:2264).

The alignment in FIG. 72 provides the amino acid sequences of Ceres Clone 14909 (SEQ ID NO:1211), CeresClone:1561415 (SEQ ID NO:1226), CeresClone:380874 (SEQ ID NO:1227), CeresClone:416460 (SEQ ID NO:1228), CeresClone:631823 (SEQ ID NO:1229), CeresClone:1535974 (SEQ ID NO:1230), CeresClone:1428788 (SEQ ID NO:1231), CeresClone:738726 (SEQ ID NO:1232), CeresClone:276776 (SEQ ID NO:1233), CeresClone:240510 (SEQ ID NO:1234), and CeresClone:529239 (SEQ ID NO:1235). Other homologs and/or orthologs of SEQ ID NO:1211 include Ceres ANNOT ID no. 1497838 (SEQ ID NO:1213), Ceres ANNOT ID no. 1522523 (SEQ ID NO:1215), Ceres ANNOT ID no. 1471525 (SEQ ID NO:1217), Ceres ANNOT ID no. 1511908 (SEQ ID NO:1219), Ceres ANNOT ID no. 1464305 (SEQ ID NO:1221), Ceres ANNOT ID no. 1451416 (SEQ ID NO:1223), Ceres ANNOT ID no. 1461050 (SEQ ID NO:1225), Ceres CLONE ID no. 1724996 (SEQ ID NO:1237), and Ceres ANNOT ID no. 6085974 (SEQ ID NO:2310).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NO:687, SEQ ID NOs:995-1005, SEQ ID NOs:1007-1009, SEQ ID NOs:1011-1014, SEQ ID NOs:1016-1026, SEQ ID NOs:1028-1029, SEQ ID NOs:1031-1033, SEQ ID NOs:1035-1048, SEQ ID NO:1213, SEQ ID NO:1215, SEQ ID NO:1217, SEQ ID NO:1219, SEQ ID NO:1221, SEQ ID NO:1223, SEQ ID NOs:1225-1235, SEQ ID NO:1237, SEQ ID NO:2178, SEQ ID NO:2180, SEQ ID NO:2264, or SEQ ID NO:2310.

A regulatory protein can contain a PsbP domain. The PsbP polypeptide family consists of the 23 kDa subunit of oxygen evolving system of photosystem II or PsbP from various plants, where it is encoded by the nuclear genome, and cyanobacteria. Both PsbP and PsbQ are regulators that are necessary for the biogenesis of optically active PSII. The 23 KDa PsbP polypeptide is required for PSII to be fully operational in vivo. PsbP increases the affinity of the water oxidation site for chloride ions and provides the conditions required for high affinity binding of calcium ions. SEQ ID NO:1906 sets forth the amino acid sequence of a DNA clone, identified herein as Ceres CLONE ID no. 9325 (SEQ ID NO:1905), that is predicted to encode a polypeptide containing a Pfam domain as indicated in the Sequence Listing (e.g., a PsbP domain).

A regulatory protein can comprise the amino acid sequence set forth SEQ ID NO:1906. In some cases, a regulatory protein can be a homolog, ortholog, or variant of the polypeptide having the amino acid sequence set forth in SEQ ID NO:1906. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:1906.

Amino acid sequences of homologs and/or orthologs of the polypeptide having the amino acid sequence set forth in SEQ ID NO:1906 are provided in FIG. 131.

For example, the alignment in FIG. 131 provides the amino acid sequences of cDNA ID 23367406 (Ceres CLONE ID no. 9325; SEQ ID NO:1906), gi|7443216, CeresClone:982579 (SEQ ID NO:2045), gi|11133887 (SEQ ID NO:2041), CeresClone:1139782 (SEQ ID NO:2042), gi|42569485 (SEQ ID NO:2044), gi|21133 (SEQ ID NO:2040), CeresClone:1063835 (SEQ ID NO:2038), CeresClone:1027529 (SEQ ID NO:2039), and CeresClone:142681 (SEQ ID NO:2037). Other homologs and/or orthologs of SEQ ID NO:1906 include Ceres ANNOT ID no. 1461478 (SEQ ID NO:1908), Public GI no. 2880056 (SEQ ID NO:2043), Ceres ANNOT ID no. 1442982 (SEQ ID NO:2089), and Ceres CLONE ID no. 1756586 (SEQ ID NO:2119).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NO:1908, SEQ ID NOs:2037-2045, SEQ ID NO:2089, SEQ ID NO:2119, or gi|7443216.

A regulatory protein can have a PRK domain characteristic of polypeptides belonging to the phosphoribulokinase/uridine kinase family. Phosphoribulokinase (PRK) catalyzes the ATP-dependent phosphorylation of ribulose-5-phosphate to ribulose-1,5-phosphate, a key step in the pentose phosphate pathway where carbon dioxide is assimilated by autotrophic organisms. Uridine kinase (pyrimidine ribonucleoside kinase) is the rate-limiting enzyme in the pyrimidine salvage pathway. SEQ ID NO:744 sets forth the amino acid sequence of a DNA clone, identified herein as Ceres CLONE ID no. 339518 (SEQ ID NO:743), that is predicted to encode a polypeptide containing a Pfam domain as indicated in the Sequence Listing (e.g., a PRK domain).

A regulatory protein can comprise the amino acid sequence set forth SEQ ID NO:744. In some cases, a regulatory protein can be a homolog, ortholog, or variant of the polypeptide having the amino acid sequence set forth in SEQ ID NO:744. For example, a regulatory protein can have an amino acid sequence with at least 70% sequence identity, e.g., 75%, 80%, 85%, 90%, 95%, 97%, 98%, or 99% sequence identity, to the amino acid sequence set forth in SEQ ID NO:744.

Amino acid sequences of homologs and/or orthologs of the polypeptide having the amino acid sequence set forth in SEQ ID NO:744 are provided in FIG. 46.

For example, the alignment in FIG. 46 provides the amino acid sequences of Ceres Clone 339518 (SEQ ID NO:744), CeresClone:243130 (SEQ ID NO:745), CeresClone:1776411 (SEQ ID NO:747), gi|50911777 (SEQ ID NO:748), gi|100796 (SEQ ID NO:750), CeresAnnot:1500106 (SEQ ID NO:753), gi|23197622 (SEQ ID NO:756), and gi|21279 (SEQ ID NO:758). Other homologs and/or orthologs of SEQ ID NO:744 include Public GI no. 5924030 (SEQ ID NO:749), Public GI no. 21839 (SEQ ID NO:751), Ceres ANNOT ID no. 1539024 (SEQ ID NO:755), and Ceres CLONE ID no. 11226 (SEQ ID NO:757).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NO:745, SEQ ID NOs:747-751, SEQ ID NO:753, or SEQ ID NOs:755-758.

A regulatory protein can have a DLH domain characteristic of a polypeptide belonging to the dienelactone hydrolase family. Dienelactone hydrolases play a crucial role in chlorocatechol degradation via the modified ortho cleavage pathway. Enzymes induced in 4-fluorobenzoate-utilizing bacteria have been classified into three groups based on their specificity towards cis- and trans-dienelactone. Some polypeptides, such as the rat kan-1 polypeptide, contain repeated small fragments of the DLH domain. SEQ ID NO:1876 sets forth the amino acid sequence of a DNA clone, identified herein as Ceres CLONE ID no. 520515 (SEQ ID NO:1875), that is predicted to encode a polypeptide having a Pfam domain as indicated in the Sequence Listing (e.g., a DLH domain).

A regulatory protein can comprise the amino acid sequence set forth SEQ ID NO:1876. In some cases, a regulatory protein can be a homolog, ortholog, or variant of the polypeptide having the amino acid sequence set forth in SEQ ID NO:1876. For example, a regulatory protein can have an amino acid sequence with at least 40% sequence identity, e.g., 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:1876.

Amino acid sequences of homologs and/or orthologs of the polypeptide having the amino acid sequence set forth in SEQ ID NO:1876 include Ceres ANNOT ID no. 1450854 (SEQ ID NO:2093).

In some cases, a regulatory protein can include a polypeptide having at least 80% sequence identity, e.g., 80%, 85%, 90%, 93%, 95%, 97%, 98%, or 99% sequence identity, to the amino acid sequence set forth in SEQ ID NO:2093.

A regulatory protein can have a PDT domain found in prephenate dehydratase polypeptides. Prephenate dehydratase polypeptides catalyze the decarboxylation of prephenate to phenylpyruvate. In microorganisms, the prephenate dehydratase polypeptide is part of the terminal pathway of phenylalanine biosynthesis. In some bacteria, such as *Escherichia coli*, the PDT domain is included in a bifunctional enzyme, P-protein, that also catalyzes the transformation of chorismate into prephenate. In other bacteria, prephenate dehydratase enzymes occur as monofunctional polypeptides. The sequence of monofunctional prephenate dehydratase aligns well with the C-terminal part of P-proteins. SEQ ID NO:793 sets forth the amino acid sequence of a DNA clone, identified herein as Ceres CLONE ID no. 37739 (SEQ ID NO:792), that is predicted to encode a polypeptide containing a Pfam domain as indicated in the Sequence Listing (e.g., a PDT domain).

A regulatory protein can comprise the amino acid sequence set forth SEQ ID NO:793. In some cases, a regulatory protein can be a homolog, ortholog, or variant of the polypeptide having the amino acid sequence set forth in SEQ ID NO:793. For example, a regulatory protein can have an amino acid sequence with at least 65% sequence identity, e.g., 67%, 68%, 70%, 75%, 80%, 85%, 90%, 95%, 97%, 98%, or 99% sequence identity, to the amino acid sequence set forth in SEQ ID NO:793.

Figure 49:
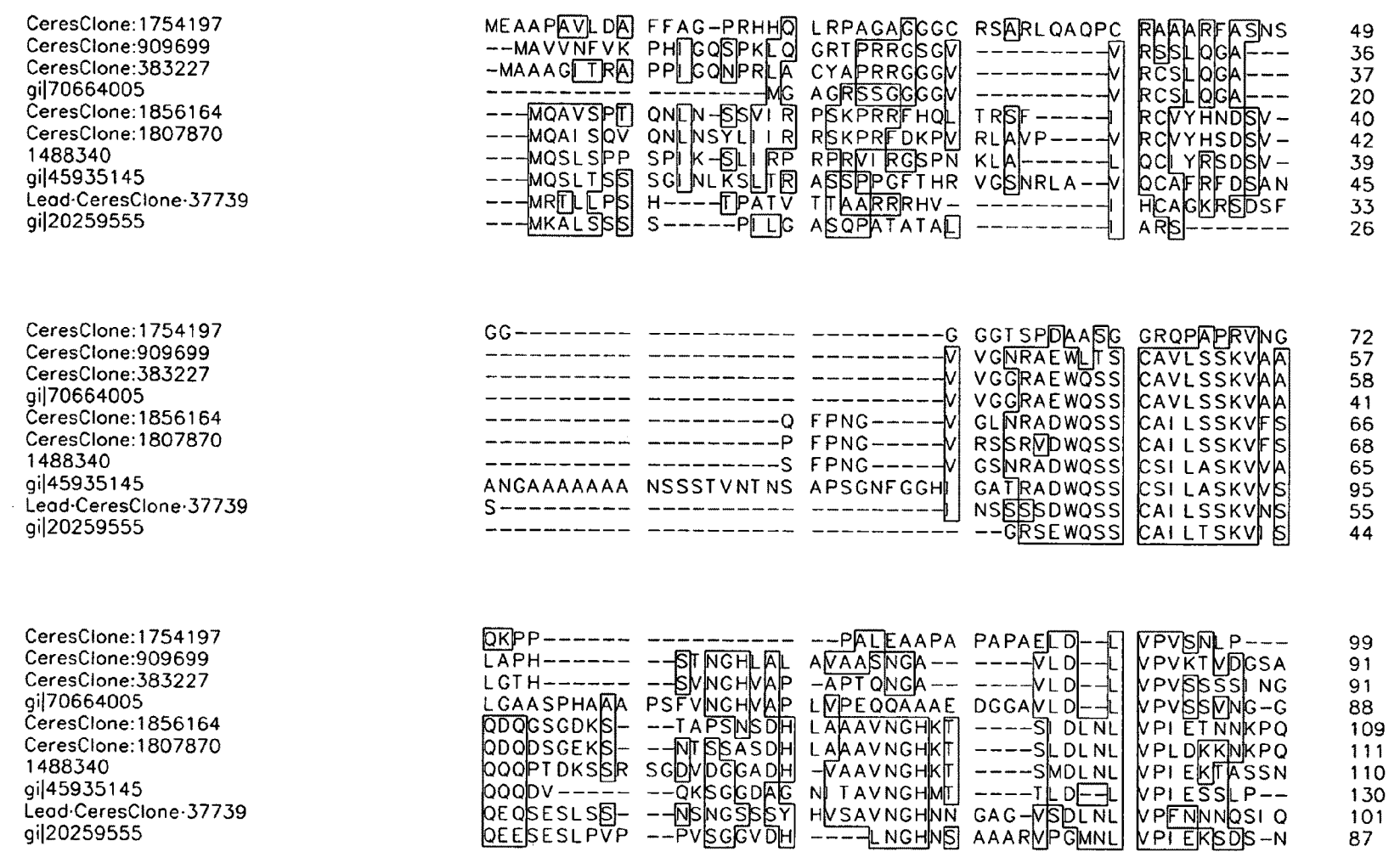

Amino acid sequences of homologs and/or orthologs of the polypeptide having the amino acid sequence set forth in SEQ ID NO:793 are provided in FIG. 49.

For example, the alignment in FIG. 49 provides the amino acid sequences of Ceres Clone 37739 (SEQ ID NO:793), gi|20259555 (SEQ ID NO:794), CeresClone:1754197 (SEQ ID NO:796), CeresClone:1856164 (SEQ ID NO:798), 1488340 (SEQ ID NO:800), CeresClone:1807870 (SEQ ID NO:802), gi|45935145 (SEQ ID NO:803), CeresClone:383227 (SEQ ID NO:804), gi|70664005 (SEQ ID NO:805), and CeresClone:909699 (SEQ ID NO:806). Other homologs and/or orthologs of SEQ ID NO:793 include Ceres ANNOT ID no. 6030226 (SEQ ID NO:2238).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NO:794, SEQ ID NO:796, SEQ ID NO:798, SEQ ID NO:800, SEQ ID NOs:802-806, or SEQ ID NO:2238.

A regulatory protein can contain a UDPGT domain characteristic of UDP-glucoronosyl and UDP-glucosyl transferase polypeptides. UDP glycosyltransferases (UGT) constitute a superfamily of enzymes that catalyze the addition of the glycosyl group from a UTP-sugar to a small hydrophobic molecule. Members of this family from plants include the flavonol O(3)-glucosyltransferase enzyme, which catalyzes the transfer of glucose from UDP-glucose to a flavanol. This reaction is one of the last steps in anthocyanin pigment biosynthesis. SEQ ID NO:914 sets forth the amino acid sequence of a DNA clone, identified herein as Ceres CLONE ID no. 479006 (SEQ ID NO:913), that is predicted to encode a polypeptide containing a Pfam domain as indicated in the Sequence Listing (e.g., a UDPGT domain).

A regulatory protein can comprise the amino acid sequence set forth SEQ ID NO:914. In some cases, a regulatory protein can be a homolog, ortholog, or variant of the polypeptide having the amino acid sequence set forth in SEQ ID NO:914.

For example, a regulatory protein can have an amino acid sequence with at least 40% sequence identity, e.g., 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:914.

Figure 58:
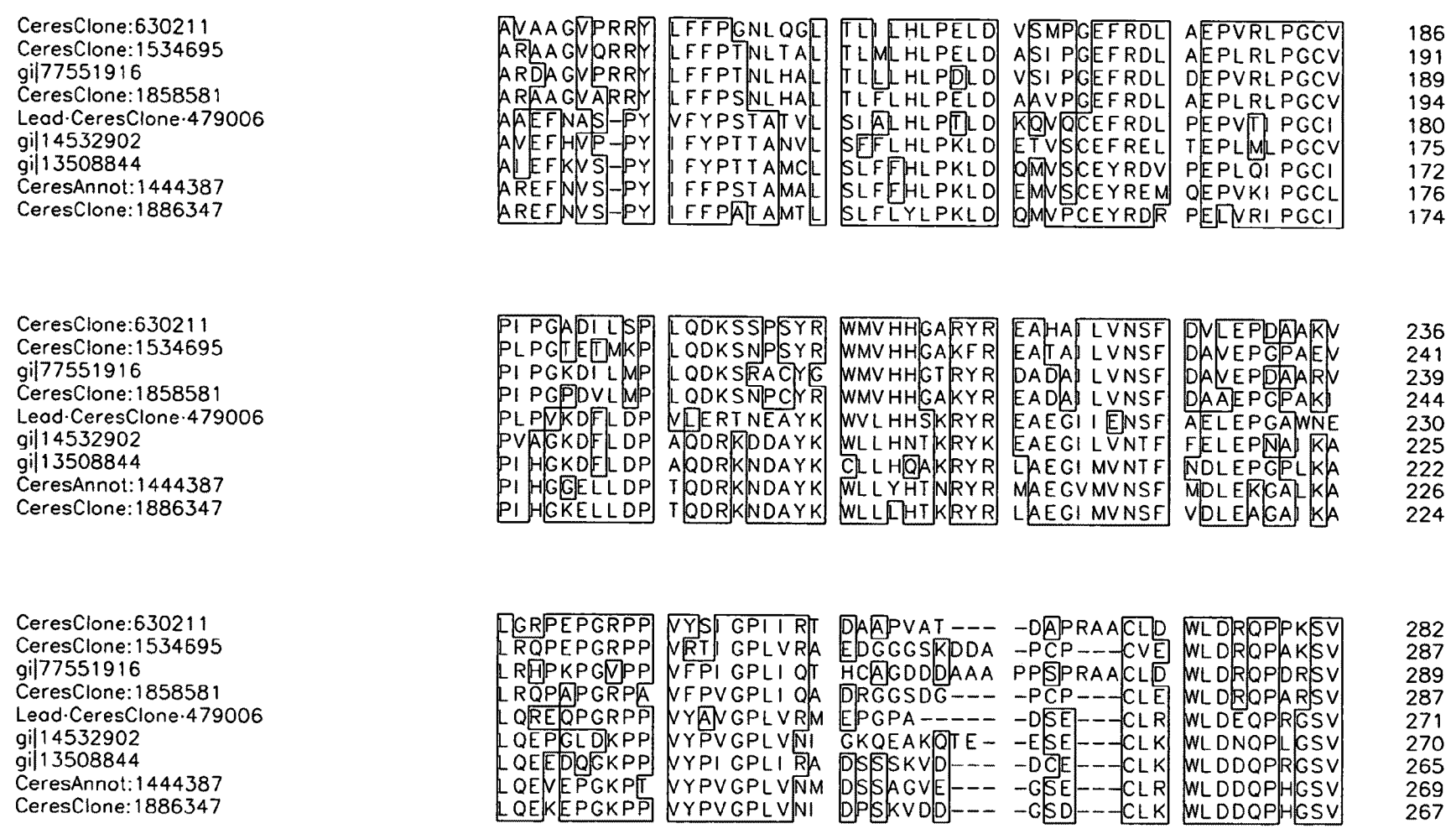
Figure 58:
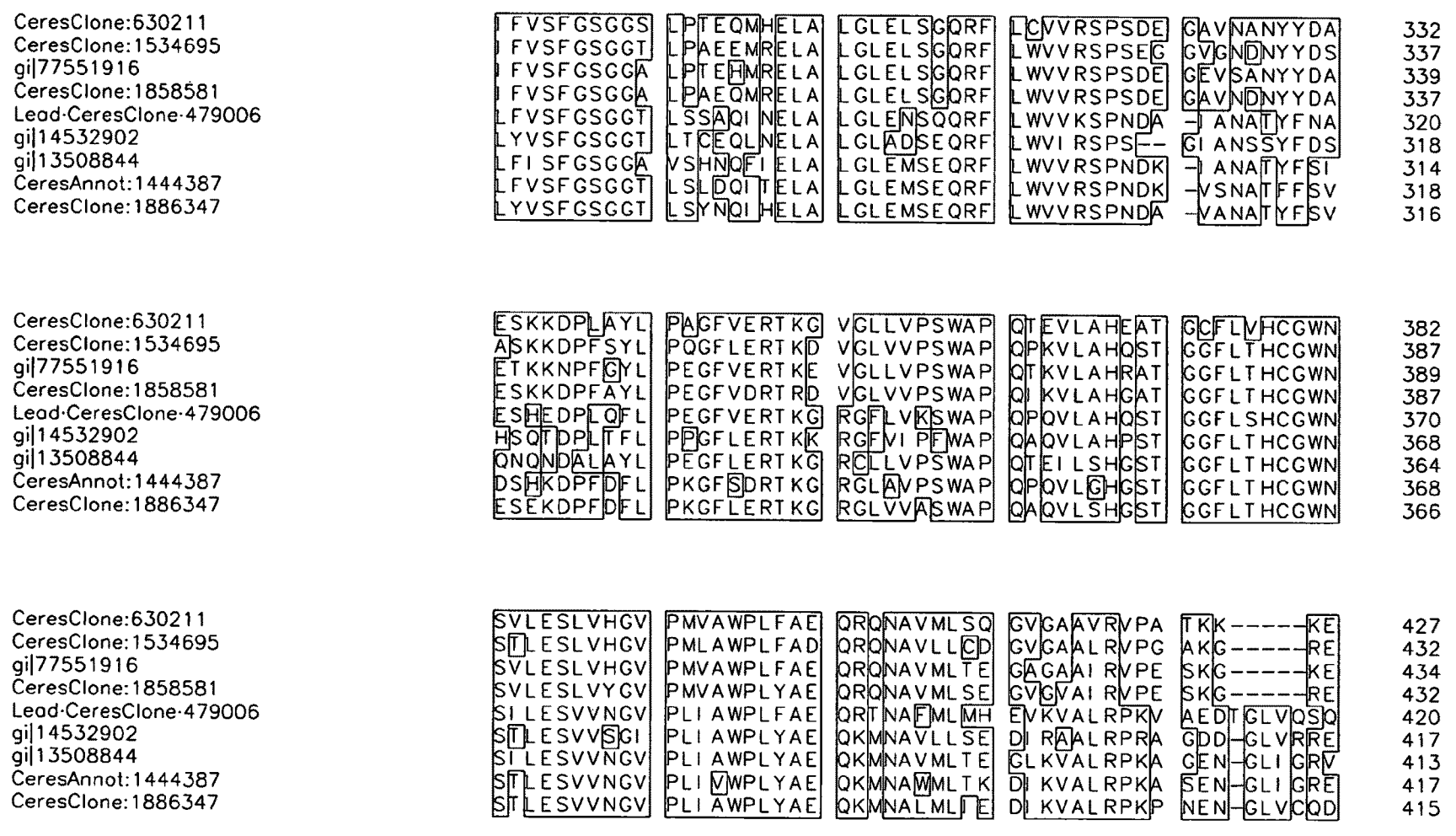

Amino acid sequences of homologs and/or orthologs of the polypeptide having the amino acid sequence set forth in SEQ ID NO:914 are provided in FIG. 58.

For example, the alignment in FIG. 58 provides the amino acid sequences of Ceres Clone 479006 (SEQ ID NO:914), CeresAnnot:1444387 (SEQ ID NO:917), CeresClone: 1886347 (SEQ ID NO:919), gi|13508844 (SEQ ID NO:922), gi|14532902 (SEQ ID NO:923), CeresClone:1858581 (SEQ ID NO:927), CeresClone:630211 (SEQ ID NO:930), Ceres-Clone:1534695 (SEQ ID NO:931), and gi|77551916 (SEQ ID NO:932). Other homologs and/or orthologs of SEQ ID NO:914 include Ceres CLONE ID no. 1054168 (SEQ ID NO:915), Ceres ANNOT ID no. 1471286 (SEQ ID NO:921), Ceres CLONE ID no. 1204 (SEQ ID NO:924), Public GI no. 2191136 (SEQ ID NO:925), and Ceres CLONE ID no. 1769251 (SEQ ID NO:929).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NO:915, SEQ ID NO:917, SEQ ID NO:919, SEQ ID NOs: 921-925, SEQ ID NO:927, or SEQ ID NOs:929-932.

A regulatory protein can contain a ZIP domain characteristic of a ZIP Zinc transporter polypeptide. The ZIP family of polypeptides consists of zinc transport polypeptides and putative metal transporter polypeptides. *Arabidopsis thaliana* ZIP family polypeptides are expressed in roots in response to zinc deficiency, suggesting that they may transport zinc from the soil into the plant. SEQ ID NO:339 sets forth the amino acid sequence of a DNA clone, identified herein as Ceres CLONE ID no. 105162 (SEQ ID NO:338), that is predicted to encode a polypeptide containing a Pfam domain as indicated in the Sequence Listing (e.g., a ZIP domain).

A regulatory protein can comprise the amino acid sequence set forth in SEQ ID NO:339. In some cases, a regulatory protein can be a homolog, ortholog, or variant of the polypeptide having the amino acid sequence set forth in SEQ ID NO:339. For example, a regulatory protein can have an amino acid sequence with at least 55% sequence identity, e.g., 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:339.

Amino acid sequences of homologs and/or orthologs of the polypeptide having the amino acid sequence set forth in SEQ ID NO:339 are provided in FIG. 10.

For example, the alignment in FIG. 10 provides the amino acid sequences of CeresClone:105162 (SEQ ID NO:339), CeresClone:1853694 (SEQ ID NO:343), CeresAnnot: 1494468 (SEQ ID NO:345), gi|38036140 (SEQ ID NO:348), CeresClone:1649800 (SEQ ID NO:349), CeresClone: 984060 (SEQ ID NO:350), gi|31872116 (SEQ ID NO:351), and CeresClone:1816624 (SEQ ID NO:353). Other homologs and/or orthologs of SEQ ID NO:339 include Public GI no. 20147287 (SEQ ID NO:340), Public GI no. 8778308 (SEQ ID NO:341), and Ceres ANNOT ID no. 1441572 (SEQ ID NO:347).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 340-341, SEQ ID NO:343, SEQ ID NO:345, SEQ ID NOs: 347-351, or SEQ ID NO:353.

A regulatory protein can have a UPF0060 domain characteristic of polypeptides belonging to the uncharacterized BCR, YnfA/UPF0060 family of integral membrane polypeptides. SEQ ID NO:159 sets forth the amino acid sequence of a DNA clone, identified herein as Ceres ANNOT ID no. 574716 (SEQ ID NO:158), that is predicted to encode a polypeptide containing a Pfam domain as indicated in the Sequence Listing (e.g., a UPF0060 domain).

A regulatory protein can comprise the amino acid sequence set forth SEQ ID NO:159. In some cases, a regulatory protein can be a homolog, ortholog, or variant of the polypeptide having the amino acid sequence set forth in SEQ ID NO:159. For example, a regulatory protein can have an amino acid sequence with at least 40% sequence identity, e.g., 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:159.

A regulatory protein can have a DUF298 domain. Members of the DUF298 polypeptide family contain a basic helix-loop-helix leucine zipper motif. The DUF298 domain is implicated in some aspect of neddylation of the cullin 3 family and has a possible role in the regulation of the polypeptide modifier Nedd8 E3 ligase. Neddylation is the process by which the C-terminal glycine of the ubiquitin-like protein Nedd8 is covalently linked to lysine residues in a polypeptide through an isopeptide bond. SEQ ID NO:900 sets forth the amino acid sequence of a DNA clone, identified herein as Ceres CLONE ID no. 478453 (SEQ ID NO:899), that is predicted to encode a polypeptide containing a Pfam domain as indicated in the Sequence Listing (e.g., a DUF298 domain).

A regulatory protein can comprise the amino acid sequence set forth SEQ ID NO:900. In some cases, a regulatory protein can be a homolog, ortholog, or variant of the polypeptide having the amino acid sequence set forth in SEQ ID NO:900. For example, a regulatory protein can have an amino acid sequence with at least 65% sequence identity, e.g., 67%, 68%, 70%, 75%, 80%, 85%, 90%, 95%, 97%, 98%, or 99% sequence identity, to the amino acid sequence set forth in SEQ ID NO:900.

Amino acid sequences of homologs and/or orthologs of the polypeptide having the amino acid sequence set forth in SEQ ID NO:900 are provided in FIG. 57.

For example, the alignment in FIG. 57 provides the amino acid sequences of Ceres Clone 478453 (SEQ ID NO:900), CeresClone:1923578 (SEQ ID NO:904), gi|51535194 (SEQ ID NO:905), CeresClone:1956222 (SEQ ID NO:907), Ceres-Clone:291139 (SEQ ID NO:908), and CeresClone:569584 (SEQ ID NO:910). Other homologs and/or orthologs of SEQ ID NO:900 include SEQ ID NO:901, Ceres CLONE ID no. 480964 (SEQ ID NO:902), Ceres CLONE ID no. 689194 (SEQ ID NO:909), Ceres CLONE ID no. 1724040 (SEQ ID NO:912), Ceres ANNOT ID no. 1458456 (SEQ ID NO:2103), Ceres ANNOT ID no. 6086494 (SEQ ID NO:2312), and Ceres ANNOT ID no. 6087143 (SEQ ID NO:2320).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 901-902, SEQ ID NOs:904-905, SEQ ID NOs:907-910, SEQ ID NO:912, SEQ ID NO:2103, SEQ ID NO:2312, or SEQ ID NO:2320.

A regulatory protein can have a DUF1313 domain characteristic of members of a polypeptide family comprising several hypothetical plant polypeptides of about 100 residues in length. SEQ ID NO:1585 sets forth the amino acid sequence of a DNA clone, identified herein as Ceres CLONE ID no. 397320 (SEQ ID NO:1584), that is predicted to encode a polypeptide containing a Pfam domain as indicated in the Sequence Listing (e.g., a DUF1313 domain).

A regulatory protein can comprise the amino acid sequence set forth SEQ ID NO:1585. In some cases, a regulatory protein can be a homolog, ortholog, or variant of the polypeptide having the amino acid sequence set forth in SEQ ID NO:1585. For example, a regulatory protein can have an amino acid sequence with at least 55% sequence identity, e.g., 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:1585.

Amino acid sequences of homologs and/or orthologs of the polypeptide having the amino acid sequence set forth in SEQ ID NO:1585 are provided in FIG. 107.

For example, the alignment in FIG. 107 provides the amino acid sequences of cDNA ID 23814706 (Ceres CLONE ID no. 397320; SEQ ID NO:1585), gi|37991859 (SEQ ID NO:2055), CeresClone:327449 (SEQ ID NO:2054), CeresClone:476445 (SEQ ID NO:2053), CeresClone:1066463 (SEQ ID NO:2052), CeresClone:1349 (SEQ ID NO:2046), and CeresClone:1099781 (SEQ ID NO:2051). Other homologs and/or orthologs of SEQ ID NO:1585 include Ceres ANNOT ID no. 1484716 (SEQ ID NO:1587), Ceres ANNOT ID no. 1499354 (SEQ ID NO:1589), Ceres ANNOT ID no. 1491719 (SEQ ID NO:1591), Ceres ANNOT ID no. 1533409 (SEQ ID NO:1593), Public GI no. 62318582 (SEQ ID NO:2047), Public GI no. 8778455 (SEQ ID NO:2048), Ceres CLONE ID no. 19640 (SEQ ID NO:2049), Public GI no. 19310623 (SEQ ID NO:2050), and Ceres CLONE ID no. 1958407 (SEQ ID NO:2157).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 2046-2055, SEQ ID NO:1587, SEQ ID NO:1589, SEQ ID NO:1591, SEQ ID NO:1593, or SEQ ID NO:2157.

A regulatory protein can have a Lipoxygenase domain and a PLAT domain. Lipoxygenases are a class of iron-containing dioxygenases that catalyze the hydroperoxidation of lipids containing a cis,cis-1,4-pentadiene structure. Lipoxygenases are common in plants, where they may be involved in diverse aspects of plant physiology including growth and development, pest resistance, and senescence or responses to wounding. The PLAT (Polycystin-1, Lipoxygenase, Alpha-Toxin) domain, or LH2 (Lipoxygenase homology) domain, is found in a variety of membrane or lipid associated polypeptides, such as lipogenase enzymes that are involved at various steps in the biosynthesis of leukotrienes and use iron as the cofactor. The PLAT domain has a beta sandwich structure and may mediate membrane attachment via other protein binding partners. SEQ ID NO:2085 sets forth the amino acid sequence of a DNA clone, identified herein as Ceres CLONE ID no. 362993 (SEQ ID NO:2084), that is predicted to encode a polypeptide having a Pfam domain as indicated in the Sequence Listing (e.g., a Lipoxygenase domain and a PLAT domain).

A regulatory protein can comprise the amino acid sequence set forth SEQ ID NO:2085. In some cases, a regulatory protein can be a homolog, ortholog, or variant of the polypeptide having the amino acid sequence set forth in SEQ ID NO:2085. For example, a regulatory protein can have an amino acid sequence with at least 40% sequence identity, e.g., 45%, 50%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:2085.

Amino acid sequences of homologs and/or orthologs of the polypeptide having the amino acid sequence set forth in SEQ ID NO:2085 include Ceres ANNOT ID no. 6016572 (SEQ ID NO:2202) and Ceres ANNOT ID no. 6016579 (SEQ ID NO:2204).

SEQ ID NO:96, SEQ ID NO:104, SEQ ID NO:157, SEQ ID NO:337, SEQ ID NO:357, SEQ ID NO:407, SEQ ID NO:415, SEQ ID NO:438, SEQ ID NO:520, SEQ ID NO:524, SEQ ID NO:610, SEQ ID NO:638, SEQ ID NO:678, SEQ ID NO:730, SEQ ID NO:737, SEQ ID NO:838, SEQ ID NO:936, SEQ ID NO:1050, SEQ ID NO:1414, SEQ ID NO:1436, SEQ ID NO:1824, SEQ ID NO:1848, SEQ ID NO:1868, and SEQ ID NO:1880 set forth the amino acid sequences of DNA clones, identified herein as Ceres ANNOT ID no. 541887 (SEQ ID NO:95), Ceres ANNOT ID no. 542746 (SEQ ID NO:103), Ceres ANNOT ID no. 568299 (SEQ ID NO:156), Ceres CLONE ID no. 104839 (SEQ ID NO:336), Ceres CLONE ID no. 110428 (SEQ ID NO:356), Ceres CLONE ID no. 117643 (SEQ ID NO:406), Ceres CLONE ID no. 119790 (SEQ ID NO:414), Ceres CLONE ID no. 125917 (SEQ ID NO:437), Ceres CLONE ID no. 158240 (SEQ ID NO:519), Ceres CLONE ID no. 15990 (SEQ ID NO:523), Ceres CLONE ID no. 25816 (SEQ ID NO:609), Ceres CLONE ID no. 285598 (SEQ ID NO:637), Ceres CLONE ID no. 299144 (SEQ ID NO:677), Ceres CLONE ID no. 33435 (SEQ ID NO:729), Ceres CLONE ID no. 337432 (SEQ ID NO:736), Ceres CLONE ID no. 3900 (SEQ ID NO:837), Ceres CLONE ID no. 531573 (SEQ ID NO:935), Ceres CLONE ID no. 545182 (SEQ ID NO:1049), Ceres CLONE ID no. 12997 (SEQ ID NO:1413), Ceres CLONE ID no. 149496 (SEQ ID NO:1435), Ceres ANNOT ID no. 543489 (SEQ ID NO:1823), Ceres CLONE ID no. 21674 (SEQ ID NO:1847), Ceres CLONE ID no. 284030 (SEQ ID NO:1867), and Ceres CLONE ID no. 560898 (SEQ ID NO:1879), respectively, each of which is predicted to encode a polypeptide that does not have homology to an existing polypeptide family based on Pfam analysis or encodes a polypeptide having a Pfam domain as indicated in the Sequence Listing (e.g., a zf-C3HC4 domain, a tetratricopeptide motif, an AP2 domain, a zf-CCCH domain, or an ACT domain). A regulatory protein can comprise the amino acid sequence set forth in SEQ ID NO:96, SEQ ID NO:104, SEQ ID NO:157, SEQ ID NO:337, SEQ ID NO:357, SEQ ID NO:407, SEQ ID NO:415, SEQ ID NO:438, SEQ ID NO:520, SEQ ID NO:524, SEQ ID NO:610, SEQ ID NO:638, SEQ ID NO:678, SEQ ID NO:730, SEQ ID NO:737, SEQ ID NO:838, SEQ ID NO:936, SEQ ID NO:1050, SEQ ID NO:1414, SEQ ID NO:1436, SEQ ID NO:1824, SEQ ID NO:1848, SEQ ID NO:1868, or SEQ ID NO:1880. In some cases, a regulatory protein can be a homolog, ortholog, or variant of the polypeptide having the amino acid sequence set forth in SEQ ID NO:96, SEQ ID NO:104, SEQ ID NO:157, SEQ ID NO:337, SEQ ID NO:357, SEQ ID NO:407, SEQ ID NO:415, SEQ ID NO:438, SEQ ID NO:520, SEQ ID NO:524, SEQ ID NO:610, SEQ ID NO:638, SEQ ID NO:678, SEQ ID NO:730, SEQ ID NO:737, SEQ ID NO:838, SEQ ID NO:936, SEQ ID NO:1050, SEQ ID NO:1414, SEQ ID NO:1436, SEQ ID NO:1824, SEQ ID NO:1848, SEQ ID NO:1868, or SEQ ID NO:1880. For example, a regulatory polypeptide can have an amino acid sequence with at least 30% sequence identity, e.g., 35%, 40%, 45%, 50%, 55%, 60%, 65%, 70%, 75%, 80%, 85%, 90%, 95%, 97%, 98%, or 99% sequence identity, to the amino acid sequence set forth in SEQ ID NO:96, SEQ ID NO:104, SEQ ID NO:157, SEQ ID NO:337, SEQ ID NO:357, SEQ ID NO:407, SEQ ID NO:415, SEQ ID NO:438, SEQ ID NO:520, SEQ ID NO:524, SEQ ID NO:610, SEQ ID NO:638, SEQ ID NO:678, SEQ ID NO:730, SEQ ID NO:737, SEQ ID NO:838, SEQ ID NO:936, SEQ ID NO:1050, SEQ ID NO:1414, SEQ ID NO:1436, SEQ ID NO:1824, SEQ ID NO:1848, SEQ ID NO:1868, or SEQ ID NO:1880.

Amino acid sequences of homologs and/or orthologs of the polypeptide having the amino acid sequence set forth in SEQ ID NO:96, SEQ ID NO:357, SEQ ID NO:438, SEQ ID NO:520, SEQ ID NO:638, SEQ ID NO:730, SEQ ID NO:737, SEQ ID NO:838, SEQ ID NO:1414, and SEQ ID NO:1436 are provided in FIG. 1, FIG. 11, FIG. 17, FIG. 23, FIG. 33, FIG. 44, FIG. 45, FIG. 53, FIG. 90, and FIG. 92, respectively.

For example, the alignment in FIG. 1 provides the amino acid sequences of Annot ID 541887 (SEQ ID NO:96), CeresAnnot:1448288 (SEQ ID NO:98), CeresClone:644583 (SEQ ID NO:99), gi|50926522 (SEQ ID NO:100), and CeresClone:1791381 (SEQ ID NO:102).

The alignment in FIG. 11 provides the amino acid sequences of CeresClone:110428 (SEQ ID NO:357) and CeresClone:1444428 (SEQ ID NO:359). Other homologs and/or orthologs of SEQ ID NO:357 include Public GI no. 11994473 (SEQ ID NO:358).

The alignment in FIG. 17 provides the amino acid sequences of CeresClone:125917 (SEQ ID NO:438), CeresAnnot:1456569 (SEQ ID NO:440), CeresAnnot:1450998 (SEQ ID NO:442), and gi|92873189 (SEQ ID NO:443).

The alignment in FIG. 23 provides the amino acid sequences of Ceres Clone 158240 (SEQ ID NO:520), gi|37538128 (SEQ ID NO:521) and gi|84453218 (SEQ ID NO:522). Other homologs and/or orthologs of SEQ ID NO:520 include Ceres ANNOT ID no. 6006556 (SEQ ID NO:2164), Ceres ANNOT ID no. 6067965 (SEQ ID NO:2298), and Ceres ANNOT ID no. 6086771 (SEQ ID NO:2314).

The alignment in FIG. 33 provides the amino acid sequences of Ceres Clone 285598 (SEQ ID NO:638), CeresClone:236111 (SEQ ID NO:639), gi|34902144 (SEQ ID NO:640), CeresClone:1315656 (SEQ ID NO:641), gi|45602841 (SEQ ID NO:642), gi|45544873 (SEQ ID NO:643), gi|45758663 (SEQ ID NO:644), gi|62320820 (SEQ ID NO:645), gi|92888885 (SEQ ID NO:647), gi|40807658 (SEQ ID NO:648), and CeresAnnot:1486505 (SEQ ID NO:650). Other homologs and/or orthologs of SEQ ID NO:638 include Ceres CLONE ID no. 1344853 (SEQ ID NO:646) and Ceres CLONE ID no. 1911944 (SEQ ID NO:2151).

Figure 44:
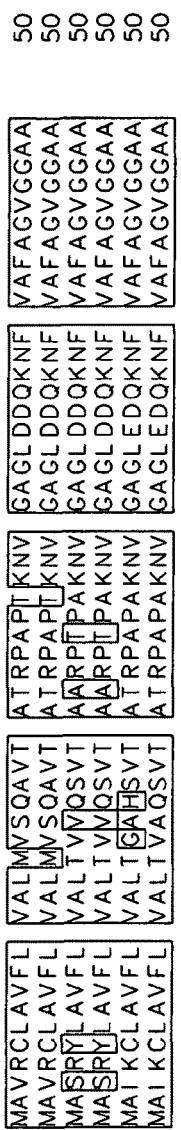
FIG. 44 is an alignment of the amino acid sequence of Ceres Clone 33435 (SEQ ID NO:730) with homologous and/or orthologous amino acid sequences CeresClone:116606 (SEQ ID NO:731), CeresClone:1079147 (SEQ ID NO:732), CeresClone:957098 (SEQ ID NO:733), CeresClone:1435704 (SEQ ID NO:734), and CeresClone:1496331 (SEQ ID NO:735).

The alignment in FIG. 44 provides the amino acid sequences of Ceres Clone 33435 (SEQ ID NO:730), CeresClone:116606 (SEQ ID NO:731), CeresClone:1079147 (SEQ ID NO:732), CeresClone:957098 (SEQ ID NO:733), CeresClone:1435704 (SEQ ID NO:734), and CeresClone:1496331 (SEQ ID NO:735).

The alignment in FIG. 45 provides the amino acid sequences of Ceres Clone 337432 (SEQ ID NO:737), gi|50925955 (SEQ ID NO:738), CeresClone:1619846 (SEQ ID NO:739), gi|27754217 (SEQ ID NO:740), and CeresAnnot:1509127 (SEQ ID NO:742). Other homologs and/or orthologs of SEQ ID NO:737 include Ceres ANNOT ID no. 6064740 (SEQ ID NO:2294).

The alignment in FIG. 53 provides the amino acid sequences of Ceres Clone 3900 (SEQ ID NO:838), CeresClone:158765 (SEQ ID NO:839), CeresClone:1839717 (SEQ ID NO:841), 1480628 (SEQ ID NO:843), gi|5669656 (SEQ ID NO:844), CeresClone:1329861 (SEQ ID NO:845), CeresClone:537752 (SEQ ID NO:846), CeresClone:1322549 (SEQ ID NO:847), 1533351 (SEQ ID NO:849), and CeresClone:282892 (SEQ ID NO:850). Other homologs and/or orthologs of SEQ ID NO:838 include Ceres ANNOT ID no. 6064763 (SEQ ID NO:2296).

The alignment in FIG. 90 provides the amino acid sequences of Ceres Clone 12997 (SEQ ID NO:1414) and CeresClone:465893 (SEQ ID NO:1415). Other homologs and/or orthologs of SEQ ID NO:1414 include Ceres ANNOT ID no. 1483367 (SEQ ID NO:1417) and Ceres ANNOT ID no. 1474088 (SEQ ID NO:1419).

The alignment in FIG. 92 provides the amino acid sequences of CeresClone:149496 (SEQ ID NO:1436), CeresClone:833872 (SEQ ID NO:1439) and CeresClone:1579587 (SEQ ID NO:1442). Other homologs and/or orthologs of SEQ ID NO:1436 include Public GI no. 5616313 (SEQ ID NO:1437), Ceres CLONE ID no. 751992 (SEQ ID NO:1438), Public GI no. 62901482 (SEQ ID NO:1440), and Public GI no. 34906988 (SEQ ID NO:1441).

Amino acid sequences of homologs and/or orthologs of the polypeptide having the amino acid sequence set forth in SEQ ID NO:1824 include Ceres ANNOT ID no. 1457646 (SEQ ID NO:2101).

Amino acid sequences of homologs and/or orthologs of the polypeptide having the amino acid sequence set forth in SEQ ID NO:1868 include Ceres CLONE ID no. 1881892 (SEQ ID NO:2141).

Amino acid sequences of homologs and/or orthologs of the polypeptide having the amino acid sequence set forth in SEQ ID NO:415 include Ceres ANNOT ID no. 6015893 (SEQ ID NO:2192).

Amino acid sequences of homologs and/or orthologs of the polypeptide having the amino acid sequence set forth in SEQ ID NO:524 include Ceres ANNOT ID no. 6016718 (SEQ ID NO:2206) and Ceres ANNOT ID no. 6041092 (SEQ ID NO:2272).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 98-100, SEQ ID NO:102, SEQ ID NOs:357-359, SEQ ID NO:440, SEQ ID NOs:442-443, SEQ ID NO:521-522, SEQ ID NOs:639-648, SEQ ID NO:650, SEQ ID NOs:731-735, SEQ ID NOs:738-740, SEQ ID NO:742, SEQ ID NO:839, SEQ ID NO:841, SEQ ID NOs:843-847, SEQ ID NOs:849-850, SEQ ID NO:1415, SEQ ID NO:1417, SEQ ID NO:1419, SEQ ID NOs:1437-1442, SEQ ID NO:2101, SEQ ID NO:2141, SEQ ID NO:2151, SEQ ID NO:2164, SEQ ID NO:2192, SEQ ID NO:2206, SEQ ID NO:2272, SEQ ID NO:2294, SEQ ID NO:2296, SEQ ID NO:2298, or SEQ ID NO:2314.

A regulatory protein encoded by a recombinant nucleic acid can be a native regulatory protein, i.e., one or more additional copies of the coding sequence for a regulatory protein that is naturally present in the cell. Alternatively, a regulatory protein can be heterologous to the cell, e.g., a transgenic *Populus* plant can contain the coding sequence for a transcription factor polypeptide from an *Arabidopsis* plant.

A regulatory protein can include additional amino acids that are not involved in modulating gene expression, and thus can be longer than would otherwise be the case. For example, a regulatory protein can include an amino acid sequence that functions as a reporter. Such a regulatory protein can be a fusion protein in which a green fluorescent protein (GFP)

polypeptide is fused to, e.g., SEQ ID NO:865, or in which a yellow fluorescent protein (YFP) polypeptide is fused to, e.g., SEQ ID NO:1785. In some embodiments, a regulatory protein includes a purification tag, a chloroplast transit peptide, a mitochondrial transit peptide, or a leader sequence added to the amino or carboxyl terminus.

Regulatory protein candidates suitable for use in the invention can be identified by analysis of nucleotide and polypeptide sequence alignments. For example, performing a query on a database of nucleotide or polypeptide sequences can identify homologs and/or orthologs of regulatory proteins. Sequence analysis can involve BLAST, Reciprocal BLAST, or PSI-BLAST analysis of nonredundant databases using known regulatory protein amino acid sequences. Those polypeptides in the database that have greater than 40% sequence identity can be identified as candidates for further evaluation for suitability as regulatory proteins. Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have domains suspected of being present in regulatory proteins, e.g., conserved functional domains.

The identification of conserved regions in a template or subject polypeptide can facilitate production of variants of regulatory proteins. Conserved regions can be identified by locating a region within the primary amino acid sequence of a template polypeptide that is a repeated sequence, forms some secondary structure (e.g., helices and beta sheets), establishes positively or negatively charged domains, or represents a protein motif or domain. See, e.g., the Pfam web site describing consensus sequences for a variety of protein motifs and domains at sanger.ac.uk/Pfam and genome.wustl.edu/Pfam. A description of the information included at the Pfam database is described in Sonnhammer et al., *Nucl. Acids Res.*, 26:320-322 (1998); Sonnhammer et al., *Proteins*, 28:405-420 (1997); and Bateman et al., *Nucl. Acids Res.*, 27:260-262 (1999). Amino acid residues corresponding to Pfam domains included in regulatory proteins provided herein are set forth in the Sequence Listing. For example, amino acid residues 115 to 179 of the amino acid sequence set forth in SEQ ID NO:304 correspond to a DHHC zinc finger domain, as indicated in fields <222> and <223> for SEQ ID NO:304 in the Sequence Listing.

Conserved regions also can be determined by aligning sequences of the same or related polypeptides from closely related species. Closely related species preferably are from the same family. In some embodiments, alignment of sequences from two different species is adequate. For example, sequences from *Arabidopsis thaliana* and *Glycine max* can be used to identify one or more conserved regions.

Typically, polypeptides that exhibit at least about 40% amino acid sequence identity are useful to identify conserved regions. Conserved regions of related polypeptides can exhibit at least 45% amino acid sequence identity, e.g., at least 50%, at least 60%, at least 70%, at least 80%, or at least 90% amino acid sequence identity. In some embodiments, a conserved region of target and template polypeptides exhibit at least 92%, 94%, 96%, 98%, or 99% amino acid sequence identity. Amino acid sequence identity can be deduced from amino acid or nucleotide sequences. In certain cases, highly conserved domains have been identified within regulatory proteins. These conserved regions can be useful in identifying functionally similar (orthologous) regulatory proteins.

In some instances, suitable regulatory proteins can be synthesized on the basis of consensus functional domains and/or conserved regions in polypeptides that are homologous regulatory proteins. Domains are groups of substantially contiguous amino acids in a polypeptide that can be used to characterize protein families and/or parts of proteins. Such domains have a "fingerprint" or "signature" that can comprise conserved (1) primary sequence, (2) secondary structure, and/or (3) three-dimensional conformation. Generally, domains are correlated with specific in vitro and/or in vivo activities. A domain can have a length of from 10 amino acids to 400 amino acids, e.g., 10 to 50 amino acids, or 25 to 100 amino acids, or 35 to 65 amino acids, or 35 to 55 amino acids, or 45 to 60 amino acids, or 200 to 300 amino acids, or 300 to 400 amino acids.

Representative homologs and/or orthologs of regulatory proteins are shown in FIGS. 1-51 and FIGS. 53-131. Each Figure represents an alignment of the amino acid sequence of a regulatory protein with the amino acid sequences of corresponding homologs and/or orthologs. Amino acid sequences of regulatory proteins and their corresponding homologs and/or orthologs have been aligned to identify conserved amino acids and to determine consensus sequences that contain frequently occurring amino acid residues at particular positions in the aligned sequences, as shown in FIGS. 1-51 and FIGS. 53-131. A dash in an aligned sequence represents a gap, i.e., a lack of an amino acid at that position. Identical amino acids or conserved amino acid substitutions among aligned sequences are identified by boxes.

Each consensus sequence is comprised of conserved regions. Each conserved region contains a sequence of contiguous amino acid residues. A dash in a consensus sequence indicates that the consensus sequence either lacks an amino acid at that position or includes an amino acid at that position. If an amino acid is present, the residue at that position corresponds to one found in any aligned sequence at that position.

Useful polypeptides can be constructed based on the consensus sequence in any of FIGS. 1-51 or FIGS. 53-131. Such a polypeptide includes the conserved regions in the selected consensus sequence, arranged in the order depicted in the Figure from amino-terminal end to carboxy-terminal end. Such a polypeptide may also include zero, one, or more than one amino acid in positions marked by dashes. When no amino acids are present at positions marked by dashes, the length of such a polypeptide is the sum of the amino acid residues in all conserved regions. When amino acids are present at all positions marked by dashes, such a polypeptide has a length that is the sum of the amino acid residues in all conserved regions and all dashes.

A conserved domain in certain cases may be 1) a localization domain, 2) an activation domain, 3) a repression domain, 4) an oligomerization domain or 5) a DNA binding domain. Consensus domains and conserved regions can be identified by homologous polypeptide sequence analysis as described above. The suitability of polypeptides for use as regulatory proteins can be evaluated by functional complementation studies.

A regulatory protein also can be a fragment of a naturally occurring regulatory protein. In certain cases, such as transcription factor regulatory proteins, a fragment can comprise the DNA-binding and transcription-regulating domains of the naturally occurring regulatory protein. Additional information on regulatory protein domains is provided below.

DNA Binding Domain

A regulatory protein can include a domain, termed a DNA binding domain, which binds to a recognized site on DNA. A DNA binding domain of a regulatory protein can bind to one or more specific cis-responsive promoter motifs described herein. The typical result is modulation of transcription from a transcriptional start site associated with and operably linked to the cis-responsive motif. In some embodiments, binding of a DNA binding domain to a cis-responsive motif in planta involves other cellular components, which can be supplied by the plant.

Transactivation Domain

A regulatory protein can have discrete DNA binding and transactivation domains. Typically, transactivation domains bring proteins of the cellular transcription and translation machinery into contact with the transcription start site to initiate transcription. A transactivation domain of a regulatory protein can be synthetic or can be naturally-occurring. An example of a transactivation domain is the transactivation domain of a maize transcription factor C polypeptide.

Oligomerization Sequences

In some embodiments, a regulatory protein comprises oligomerization sequences. In some instances oligomerization is required for a ligand/regulatory protein complex or protein/ protein complex to bind to a recognized DNA site. Oligomerization sequences can permit a regulatory protein to produce either homo- or heterodimers. Several motifs or domains in the amino acid sequence of a regulatory protein can influence heterodimerization or homodimerization of a given regulatory protein.

In some embodiments, transgenic plants also include a recombinant coactivator polypeptide that can interact with a regulatory protein to mediate the regulatory protein's effect on transcription of an endogenous gene. Such polypeptides include chaperoning. In some embodiments, a recombinant coactivator polypeptide is a chimera of a non-plant coactivator polypeptide and a plant coactivator polypeptide. Thus, in some embodiments, a regulatory protein described herein binds as a heterodimer to a promoter motif. In such embodiments, plants and plant cells contain a coding sequence for a second or other regulatory protein as a dimerization or multimerization partner, in addition to the coding sequence for the first regulatory protein.

The identification of conserved regions in a regulatory protein facilitates production of variants of regulatory proteins. Variants of regulatory proteins typically have 10 or fewer conservative amino acid substitutions within the primary amino acid sequence, e.g., 7 or fewer conservative amino acid substitutions, 5 or fewer conservative amino acid substitutions, or between 1 and 5 conservative substitutions. A useful variant polypeptide can be constructed based on one of the alignments set forth in any one of FIGS. 1-51 and 53-131. Such a polypeptide includes the conserved regions, arranged in the order depicted in the Figure from amino-terminal end to carboxy-terminal end. Such a polypeptide may also include zero, one, or more than one amino acid in positions marked by dashes. When no amino acids are present at positions marked by dashes, the length of such a polypeptide is the sum of the amino acid residues in all conserved regions. When amino acids are present at all positions marked by dashes, such a polypeptide has a length that is the sum of the amino acid residues in all conserved regions and all dashes.

In some embodiments, useful regulatory proteins include those that fit a Hidden Markov Model based on the polypeptides set forth in any one of FIGS. 1-51 or 53-131. A Hidden Markov Model (HMM) is a statistical model of a consensus sequence for a group of functional homologs. See, Durbin et al., *Biological Sequence Analysis: Probabilistic Models of Proteins and Nucleic Acids*, Cambridge University Press, Cambridge, UK (1998). An HMM is generated by the program HMMER 2.3.2 with default program parameters, using the sequences of the group of functional homologs as input. The multiple sequence alignment is generated by ProbCons (Do et al., Genome Res., 15(2):330-40 (2005)) version 1.11 using a set of default parameters: -c, --consistency REPS of 2; -ir, --iterative-refinement REPS of 100; -pre, --pre-training REPS of 0. ProbCons is a public domain software program provided by Stanford University. The alignments provided in the figures were generated using the program MUSCLE version 3.52 based on alignments generated by ProbCons.

The default parameters for building an HMM (hmmbuild) are as follows: the default "architecture prior" (archpri) used by MAP architecture construction is 0.85, and the default cutoff threshold (idlevel) used to determine the effective sequence number is 0.62. HMMER 2.3.2 was released Oct. 3, 2003 under a GNU general public license, and is available from various sources on the World Wide Web such as hmmer.janelia.org; hmmer.wustl.edu; and fr.com/hmmer232/. Hmmbuild outputs the model as a text file.

The HMM for a group of functional homologs can be used to determine the likelihood that a candidate regulatory protein sequence is a better fit to that particular HMM than to a null HMM generated using a group of sequences that are not structurally or functionally related. The likelihood that a candidate polypeptide sequence is a better fit to an HMM than to a null HMM is indicated by the HMM bit score, a number generated when the candidate sequence is fitted to the HMM profile using the HMMER hmmsearch program. The following default parameters are used when running hmmsearch: the default E-value cutoff (E) is 10.0, the default bit score cutoff (T) is negative infinity, the default number of sequences in a database (Z) is the real number of sequences in the database, the default E-value cutoff for the per-domain ranked hit list (domE) is infinity, and the default bit score cutoff for the per-domain ranked hit list (domT) is negative infinity. A high HMM bit score indicates a greater likelihood that the candidate sequence carries out one or more of the biochemical or physiological function(s) of the polypeptides used to generate the HMM. A high HMM bit score is at least about 20, and often is higher. Slight variations in the HMM bit score of a particular sequence can occur due to factors such as the order in which sequences are processed for alignment by multiple sequence alignment algorithms such as the ProbCons program. Nevertheless, such HMM bit score variation is minor.

The regulatory proteins discussed herein fit the indicated HMM with an HMM bit score greater than about 20 (e.g., greater than 30, 40, 50, 60, 70, 80, 90, 100, 200, 300, 400, or 500). In some embodiments, the HMM bit score of a regulatory protein discussed herein is about 50%, 60%, 70%, 80%, 90%, or 95% of the HMM bit score of a functional homolog provided in the Sequence Listing. In some embodiments, a regulatory protein discussed herein fits the indicated HMM with an HMM bit score greater than about 20, and has a domain indicative of a regulatory protein. In some embodiments, a regulatory protein discussed herein fits the indicated HMM with an HMM bit score greater than about 20, and has 30% or greater sequence identity (e.g., 75%, 80%, 85%, 90%, 95%, or 100% sequence identity) to an amino acid sequence shown in any one of FIGS. 1-51 or 53-131.

Polypeptides are shown in the Sequence Listing that have HMM bit scores greater than about 25 when fitted to an HMM generated from the amino acid sequences set forth in FIG. 28. Such polypeptides include Ceres CLONE ID no. 1940689 (SEQ ID NO:581), Public GI no. 34907702 (SEQ ID NO:575), Ceres CLONE ID no. 324760 (SEQ ID NO:579), Ceres CLONE ID no. 474693 (SEQ ID NO:576), Ceres CLONE ID no. 1806146 (SEQ ID NO:2063), Ceres ANNOT ID no. 1525350 (SEQ ID NO:570), Ceres ANNOT ID no. 1445304 (SEQ ID NO:578), Public GI no. 6850309 (SEQ ID NO:568), Ceres ANNOT ID no. 1498288 (SEQ ID NO:572), Ceres CLONE ID no. 21406 (SEQ ID NO:566), Public GI no. 24030386 (SEQ ID NO:567), and Ceres ANNOT ID no. 1471938 (SEQ ID NO:574).

Polypeptides are shown in the Sequence Listing that have HMM bit scores greater than about 55 when fitted to an HMM generated from the amino acid sequences set forth in FIG. 30. Such polypeptides include Ceres ANNOT ID no. 6042920 (SEQ ID NO:2276), Ceres CLONE ID no. 690625 (SEQ ID NO:594), Ceres CLONE ID no. 22671 (SEQ ID NO:590), Ceres ANNOT ID no. 1467420 (SEQ ID NO:596), Ceres ANNOT ID no. 1483277 (SEQ ID NO:593), Ceres CLONE ID no. 1079601 (SEQ ID NO:591), and Public GI no. 15042132 (SEQ ID NO:597).

Polypeptides are shown in the Sequence Listing that have HMM bit scores greater than about 230 when fitted to an HMM generated from the amino acid sequences set forth in FIG. 53. Such polypeptides include Ceres ANNOT ID no. 1533351 (SEQ ID NO:849), Ceres ANNOT ID no. 1480628 (SEQ ID NO:843), Ceres CLONE ID no. 158765 (SEQ ID NO:839), Public GI no. 5669656 (SEQ ID NO:844), Ceres ANNOT ID no. 6064763 (SEQ ID NO:2296), Ceres CLONE ID no. 3900 (SEQ ID NO:838), Ceres CLONE ID no. 282892 (SEQ ID NO:850), Ceres CLONE ID no. 1322549 (SEQ ID NO:847), Ceres CLONE ID no. 1329861 (SEQ ID NO:845), Ceres CLONE ID no. 1839717 (SEQ ID NO:841), and Ceres CLONE ID no. 537752 (SEQ ID NO:846).

Polypeptides are shown in the Sequence Listing that have HMM bit scores greater than about 210 when fitted to an HMM generated from the amino acid sequences set forth in FIG. 75. Such polypeptides include Ceres ANNOT ID no. 1521997 (SEQ ID NO:1254), Ceres CLONE ID no. 272426 (SEQ ID NO:2017), Ceres CLONE ID no. 245683 (SEQ ID NO:2015), Ceres CLONE ID no. 1283552 (SEQ ID NO:2016), Ceres ANNOT ID no. 1468633 (SEQ ID NO:1255), Ceres ANNOT ID no. 1473854 (SEQ ID NO:1251), Ceres CLONE ID no. 659723 (SEQ ID NO:2012), Ceres CLONE ID no. 824827 (SEQ ID NO:2018), Ceres CLONE ID no. 1784110 (SEQ ID NO:1257), Ceres CLONE ID no. 1585988 (SEQ ID NO:2014), Ceres CLONE ID no. 21604 (SEQ ID NO:1249), and Ceres CLONE ID no. 953644 (SEQ ID NO:2013).

Polypeptides are shown in the Sequence Listing that have HMM bit scores greater than about 230 when fitted to an HMM generated from the amino acid sequences set forth in FIG. 81. Such polypeptides include Ceres ANNOT ID no. 1451585 (SEQ ID NO:1327), Ceres CLONE ID no. 1886324 (SEQ ID NO:1331), Public GI No. 1429228 (SEQ ID NO:1945), Public GI No. 57899877 (SEQ ID NO:1942), Ceres ANNOT ID no. 1504670 (SEQ ID NO:1325), Ceres CLONE ID no. 1541168 (SEQ ID NO:1939), Public GI No. 55585039 (SEQ ID NO:1941), Ceres CLONE ID no. 1785734 (SEQ ID NO:1329), Ceres CLONE ID no. 530235 (SEQ ID NO:1943), Ceres CLONE ID no. 225321 (SEQ ID NO:1323), Ceres CLONE ID no. 8364 (SEQ ID NO:1944), and Ceres CLONE ID no. 699465 (SEQ ID NO:1940).

Polypeptides are shown in the Sequence Listing that have HMM bit scores greater than about 145 when fitted to an HMM generated from the amino acid sequences set forth in FIG. 107. Such polypeptides include Ceres ANNOT ID no. 1533409 (SEQ ID NO:1593), Public GI no. 37991859 (SEQ ID NO:2055), Ceres CLONE ID no. 1958407 (SEQ ID NO:2157), Ceres CLONE ID no. 327449 (SEQ ID NO:2054), Ceres ANNOT ID no. 1484716 (SEQ ID NO:1587), Ceres ANNOT ID no. 1499354 (SEQ ID NO:1589), Ceres ANNOT ID no. 1491719 (SEQ ID NO:1591), Ceres CLONE ID no. 397320 (SEQ ID NO:1585), Ceres CLONE ID no. 1066463 (SEQ ID NO:2052), Ceres CLONE ID no. 476445 (SEQ ID NO:2053), Ceres CLONE ID no. 19640 (SEQ ID NO:2049), Public GI no. 19310623 (SEQ ID NO:2050), Ceres CLONE ID no. 1099781 (SEQ ID NO:2051), Public GI no. 8778455 (SEQ ID NO:2048), Ceres CLONE ID no. 1349 (SEQ ID NO:2046), and Public GI no. 62318582 (SEQ ID NO:2047).

Polypeptides are shown in the Sequence Listing that have HMM bit scores greater than about 355 when fitted to an HMM generated from the amino acid sequences set forth in FIG. 119. Such polypeptides include Ceres Annot ID no. 552542 (SEQ ID NO:1722), Ceres ANNOT ID no. 1460742 (SEQ ID NO:1726), Ceres ANNOT ID no. 1514007 (SEQ ID NO:1724), Ceres CLONE ID no. 1548279 (SEQ ID NO:1995), Ceres CLONE ID no. 1044645 (SEQ ID NO:1994), Ceres CLONE ID no. 727056 (SEQ ID NO:1996), and Public GI no. 52077327 (SEQ ID NO:1993).

Nucleic Acids Encoding Regulatory Proteins

Nucleic acids encoding regulatory proteins are described herein. Such nucleic acid can comprise a coding sequence that encodes any of the regulatory proteins as set forth in SEQ ID NO:96, SEQ ID NOs:98-100, SEQ ID NO:102, SEQ ID NO:104, SEQ ID NO:106, SEQ ID NO:108, SEQ ID NOs:110-112, SEQ ID NOs:114-117, SEQ ID NOs:119-122, SEQ ID NO:124, SEQ ID NOs:126-128, SEQ ID NOs:130-132, SEQ ID NOs:134-137, SEQ ID NO:139, SEQ ID NO:141, SEQ ID NO:143, SEQ ID NOs:145-147, SEQ ID NO:149, SEQ ID NOs:151-155, SEQ ID NO:157, SEQ ID NO:159, SEQ ID NO:161, SEQ ID NO:163, SEQ ID NOs:165-168, SEQ ID NO:170, SEQ ID NOs:172-176, SEQ ID NOs:178-194, SEQ ID NO:196, SEQ ID NOs:198-215, SEQ ID NO:217, SEQ ID NO:219, SEQ ID NOs:221-251, SEQ ID NO:253, SEQ ID NOs:255-256, SEQ ID NO:258, SEQ ID NO:260, SEQ ID NOs:262-265, SEQ ID NO:267, SEQ ID NOs:269-270, SEQ ID NOs:272-273, SEQ ID NOs:275-277, SEQ ID NOs:279-280, SEQ ID NO:282, SEQ ID NO:284, SEQ ID NOs:286-287, SEQ ID NOs:289-290, SEQ ID NO:292, SEQ ID NOs:294-298, SEQ ID NO:300, SEQ ID NO:302, SEQ ID NO:304, SEQ ID NO:306, SEQ ID NOs:308-313, SEQ ID NOs:315-316, SEQ ID NOs:318-319, SEQ ID NO:321, SEQ ID NO:323, SEQ ID NOs:325-326, SEQ ID NO:328, SEQ ID NO:330, SEQ ID NO:332, SEQ ID NOs:334-335, SEQ ID NO:337, SEQ ID NOs:339-341, SEQ ID NO:343, SEQ ID NO:345, SEQ ID NOs:347-351, SEQ ID NO:353, SEQ ID NO:355, SEQ ID NOs:357-359, SEQ ID NOs:361-368, SEQ ID NO:370, SEQ ID NO:372, SEQ ID NOs:374-375, SEQ ID NO:377, SEQ ID NO:379, SEQ ID NOs:381-385, SEQ ID NOs:387-389, SEQ ID NOs:391-392, SEQ ID NOs:394-398, SEQ ID NO:400, SEQ ID NOs:402-403, SEQ ID NO:405, SEQ ID NO:407, SEQ ID NO:409, SEQ ID NO:411, SEQ ID NO:413, SEQ ID NO:415, SEQ ID NOs:417-430, SEQ ID NOs:432-434, SEQ ID NO:436, SEQ ID NO:438, SEQ ID NO:440, SEQ ID NOs:442-443, SEQ ID NOs:445-447, SEQ ID NO:449, SEQ ID NOs:451-452, SEQ ID NOs:454-457, SEQ ID NO:459, SEQ ID NOs:461-463, SEQ ID NOs:465-468, SEQ ID NOs:470-471, SEQ ID NO:473, SEQ ID NOs:475-476, SEQ ID NOs:478-481, SEQ ID NOs:483-485, SEQ ID NOs:487-488, SEQ ID NO:490, SEQ ID NO:492, SEQ ID NO:494, SEQ ID NOs:496-499, SEQ ID NOs:501-502, SEQ ID NOs:504-506, SEQ ID NO:508, SEQ ID NOs:510-514, SEQ ID NO:516, SEQ ID NO:518, SEQ ID NOs:520-522, SEQ ID NO:524, SEQ ID NOs:526-527, SEQ ID NOs:529-533, SEQ ID NO:535, SEQ ID NO:537, SEQ ID NO:539, SEQ ID NO:541, SEQ ID NO:543, SEQ ID NOs:545-546, SEQ ID NOs:548-551, SEQ ID NO:553, SEQ ID NOs:555-561, SEQ ID NOs:563-564, SEQ ID NOs:566-568, SEQ ID NO:570, SEQ ID NO:572, SEQ ID NOs:574-576, SEQ ID NOs:578-579, SEQ ID NO:581, SEQ ID NO:583, SEQ ID NOs:585-588, SEQ ID NOs:590-591, SEQ ID NOs:593-594, SEQ ID NOs:596-597, SEQ ID NO:599, SEQ ID NO:601, SEQ ID NOs:603-604, SEQ ID NO:606, SEQ ID NO:608, SEQ ID NO:610, SEQ ID NO:612, SEQ ID NOs:614-617, SEQ ID NO:619, SEQ ID NOs:621-636, SEQ ID NOs:638-648, SEQ ID NO:650, SEQ ID NOs:652-654, SEQ ID NOs:656-657, SEQ ID NO:659, SEQ ID NOs:661-663, SEQ ID NOs:665-669, SEQ ID NOs:671-673, SEQ ID NOs:675-676, SEQ ID NO:678, SEQ ID NO:680, SEQ ID NO:682, SEQ ID NO:684, SEQ ID NOs:686-687, SEQ ID NOs:689-693, SEQ ID NOs:695-696, SEQ ID NO:698, SEQ ID NOs:700-701, SEQ ID NO:703, SEQ ID NO:705, SEQ ID NO:707, SEQ ID NOs:709-711, SEQ ID NO:713, SEQ ID NOs:715-716, SEQ ID NO:718, SEQ ID NO:720, SEQ ID NO:722, SEQ ID NOs:724-728, SEQ ID NOs:730-735, SEQ ID NOs:737-740, SEQ ID NO:742, SEQ ID NOs:744-745, SEQ ID NOs:747-751, SEQ ID NO:753, SEQ ID NOs:755-758, SEQ ID NOs:760-763, SEQ ID NOs:765-777, SEQ ID NO:779, SEQ ID NOs:781-784, SEQ ID NOs:786-788, SEQ ID NOs:790-791, SEQ ID NOs:793-794, SEQ ID NO:796, SEQ ID NO:798, SEQ ID NO:800, SEQ ID NOs:802-806, SEQ ID NOs:808-809, SEQ ID NOs:811-812, SEQ ID NO:814, SEQ ID NOs:816-818, SEQ ID NO:820, SEQ ID NO:822, SEQ ID NOs:824-826, SEQ ID NO:828, SEQ ID NOs:830-831, SEQ ID NO:833, SEQ ID NOs:835-836, SEQ ID NOs:838-839, SEQ ID NO:841, SEQ ID NOs:843-847, SEQ ID NOs:849-850, SEQ ID NOs:852-853, SEQ ID NOs:855-857, SEQ ID NO:859, SEQ ID NOs:861-863, SEQ ID NOs:865-866, SEQ ID NOs:868-883, SEQ ID NOs:885-888, SEQ ID NO:890, SEQ ID NO:892, SEQ ID NO:894, SEQ ID NO:896, SEQ ID NO:898, SEQ ID NOs:900-902, SEQ ID NOs:904-905, SEQ ID NOs:907-910, SEQ ID NO:912, SEQ ID NOs:914-915, SEQ ID NO:917, SEQ ID NO:919, SEQ ID NOs:921-925, SEQ ID NO:927, SEQ ID NOs:929-932, SEQ ID NO:934, SEQ ID NO:936, SEQ ID NOs:938-941, SEQ ID NO:943 SEQ ID NOs:945-957, SEQ ID NOs:959-962, SEQ ID NO:964, SEQ ID NO:966, SEQ ID NOs:968-971, SEQ ID NO:973, SEQ ID NOs:975-978, SEQ ID NO:980, SEQ ID NOs:982-992, SEQ ID NOs:994-1005, SEQ ID NOs:1007-1009, SEQ ID NOs:1011-1014, SEQ ID NOs:1016-1026, SEQ ID NOs:1028-1029, SEQ ID NOs:1031-1033, SEQ ID NOs:1035-1048, SEQ ID NO:1050, SEQ ID NOs:1052-1053, SEQ ID NOs:1055-1056, SEQ ID NO:1058, SEQ ID NO:1060, SEQ ID NO:1062, SEQ ID NOs:1064-1066, SEQ ID NOs:1068-1069, SEQ ID NOs:1071-1076, SEQ ID NOs:1078-1079, SEQ ID NO:1081, SEQ ID NO:1083, SEQ ID NO:1085, SEQ ID NOs:1087-1089, SEQ ID NOs:1091-1092, SEQ ID NO:1094, SEQ ID NO:1096, SEQ ID NOs:1098-1102, SEQ ID NOs:1104-1107, SEQ ID NOs:1109-1115, SEQ ID NOs:1117-1120, SEQ ID NOs:1122-1123, SEQ ID NOs:1125-1127, SEQ ID NO:1129, SEQ ID NOs:1131-1132, SEQ ID NO:1134, SEQ ID NOs:1136-1137, SEQ ID NOs:1139-1141, SEQ ID NOs:1143-1147, SEQ ID NOs:1149-1154, SEQ ID NOs:1156-1157, SEQ ID NO:1159, SEQ ID NO:1161, SEQ ID NO:1163, SEQ ID NOs:1165-1169, SEQ ID NO:1171, SEQ ID NOs:1173-1174, SEQ ID NOs:1176-1181, SEQ ID NO:1183, SEQ ID NOs:1185-1207, SEQ ID NO:1209, SEQ ID NO:1211, SEQ ID NO:1213, SEQ ID NO:1215, SEQ ID NO:1217, SEQ ID NO:1219, SEQ ID NO:1221, SEQ ID NO:1223, SEQ ID NOs:1225-1235, SEQ ID NO:1237, SEQ ID NO:1239, SEQ ID NO:1241, SEQ ID NO:1243, SEQ ID NO:1245, SEQ ID NO:1247, SEQ ID NO:1249, SEQ ID NO:1251, SEQ ID NO:1253, SEQ ID NO:1255, SEQ ID NO:1257, SEQ ID NO:1259, SEQ ID NO:1261, SEQ ID NO:1263, SEQ ID NO:1265, SEQ ID NO:1267, SEQ ID NO:1269, SEQ ID NO:1271, SEQ ID NO:1273, SEQ ID NO:1275, SEQ ID NO:1277, SEQ ID NO:1279, SEQ ID NO:1281, SEQ ID NO:1283, SEQ ID NOs:1285-1290, SEQ ID NO:1292, SEQ ID NO:1294, SEQ ID NO:1296, SEQ ID NO:1298, SEQ ID NO:1300, SEQ ID NOs:1302-1309, SEQ ID NO:1311, SEQ ID NO:1313, SEQ ID NO:1315, SEQ ID NO:1317, SEQ ID NO:1319, SEQ ID NO:1321, SEQ ID NO:1323, SEQ ID NO:1325, SEQ ID NO:1327, SEQ ID NO:1329, SEQ ID NO:1331, SEQ ID NO:1333, SEQ ID NO:1335, SEQ ID NO:1337, SEQ ID NO:1339, SEQ ID NO:1341, SEQ ID NO:1343, SEQ ID NO:1345, SEQ ID NO:1347, SEQ ID NO:1349, SEQ ID NO:1351, SEQ ID NO:1353, SEQ ID NO:1355, SEQ ID NO:1357, SEQ ID NO:1359, SEQ ID NOs:1361-1367, SEQ ID NO:1369, SEQ ID NO:1371, SEQ ID NO:1373, SEQ ID NO:1375, SEQ ID NO:1377, SEQ ID NO:1379, SEQ ID NO:1381, SEQ ID NO:1383, SEQ ID NO:1385, SEQ ID NO:1387, SEQ ID NO:1389, SEQ ID NO:1391, SEQ ID NO:1393, SEQ ID NO:1395, SEQ ID NO:1397, SEQ ID NO:1399, SEQ ID NO:1401, SEQ ID NO:1403, SEQ ID NOs:1405-1410, SEQ ID NO:1412, SEQ ID NOs:1414-1415, SEQ ID NO:1417, SEQ ID NO:1419, SEQ ID NO:1421, SEQ ID NOs:1423-1429, SEQ ID NO:1431, SEQ ID NO:1433, SEQ ID NOs:1436-1442, SEQ ID NOs:1444-1463, SEQ ID NO:1465, SEQ ID NO:1467, SEQ ID NO:1469, SEQ ID NO:1471, SEQ ID NO:1473, SEQ ID NO:1475, SEQ ID NO:1477, SEQ ID NO:1479, SEQ ID NO:1481, SEQ ID NO:1483, SEQ ID NO:1485, SEQ ID NOs:1487-1491, SEQ ID NOs:1493-1500, SEQ ID NO:1502, SEQ ID NOs:1504-1516, SEQ ID NO:1518, SEQ ID NO:1520, SEQ ID NO:1522, SEQ ID NO:1524, SEQ ID NO:1526, SEQ ID NOs:1528-1534, SEQ ID NO:1536, SEQ ID NO:1538, SEQ ID NO:1540, SEQ ID NO:1542, SEQ ID NO:1544, SEQ ID NO:1546, SEQ ID NO:1548, SEQ ID NO:1550, SEQ ID NO:1552, SEQ ID NO:1554, SEQ ID NO:1556, SEQ ID NO:1558, SEQ ID NO:1560, SEQ ID NO:1562, SEQ ID NO:1564, SEQ ID NO:1566, SEQ ID NO:1568, SEQ ID NOs:1570-1571, SEQ ID NO:1573, SEQ ID NO:1575, SEQ ID NO:1577, SEQ ID NO:1579, SEQ ID NO:1581, SEQ ID NO:1583, SEQ ID NO:1585, SEQ ID NO:1587, SEQ ID NO:1589, SEQ ID NO:1591, SEQ ID NO:1593, SEQ ID NOs:1595-1608, SEQ ID NO:1610, SEQ ID NO:1612, SEQ ID NO:1614, SEQ ID NO:1616, SEQ ID NO:1618, SEQ ID NOs:1620-1622, SEQ ID NO:1624, SEQ ID NO:1626, SEQ ID NO:1628, SEQ ID NO:1630, SEQ ID NOs:1632-1635, SEQ ID NOs:1637-1651, SEQ ID NOs:1653-1655, SEQ ID NO:1657, SEQ ID NO:1659, SEQ ID NO:1661, SEQ ID NO:1663, SEQ ID NO:1665, SEQ ID NO:1667, SEQ ID NO:1669, SEQ ID NO:1671, SEQ ID NO:1673, SEQ ID NOs:1675-1679, SEQ ID NO:1681, SEQ ID NOs:1683-1690, SEQ ID NO:1692, SEQ ID NO:1694, SEQ ID NO:1696, SEQ ID NO:1698, SEQ ID NO:1700, SEQ ID NO:1702, SEQ ID NO:1704, SEQ ID NO:1706, SEQ ID NO:1708, SEQ ID NO:1710; SEQ ID NO:1712, SEQ ID NO:1714, SEQ ID NO:1716, SEQ ID NO:1718, SEQ ID NO:1720, SEQ ID NO:1722, SEQ ID NO:1724, SEQ ID NO:1726, SEQ ID NOs:1728-1731, SEQ ID NO:1733, SEQ ID NOs:1735-1747, SEQ ID NOs:1749-1750, SEQ ID NOs:1752-1765, SEQ ID NOs:1767-1775, SEQ ID NO:1777, SEQ ID NO:1779, SEQ ID NO:1781, SEQ ID NO:1783, SEQ ID NOs:1785-1804, SEQ ID NOs:1806-1820, SEQ ID NO:1822, SEQ ID NO:1824, SEQ ID NO:1826, SEQ ID NO:1828, SEQ ID NO:1830, SEQ ID NO:1832, SEQ ID NO:1834, SEQ ID NO:1836, SEQ ID NO:1838, SEQ ID NO:1840, SEQ ID NO:1842, SEQ ID NO:1844, SEQ ID NO:1846, SEQ ID NO:1848, SEQ ID NO:1850, SEQ ID NO:1852, SEQ ID NO:1854, SEQ ID NO:1856, SEQ ID NO:1858, SEQ ID NO:1860, SEQ ID NO:1862, SEQ ID NO:1864, SEQ ID NO:1866, SEQ ID NO:1868, SEQ ID NO:1870, SEQ ID NO:1872, SEQ ID NO:1874, SEQ ID NO:1876, SEQ ID NO:1878, SEQ ID NO:1880, SEQ ID NO:1882, SEQ ID NO:1884, SEQ ID NO:1886, SEQ ID NO:1888, SEQ ID NO:1890, SEQ ID NOs:1892-1895, SEQ ID NO:1897, SEQ ID NO:1899, SEQ ID NOs:1901-1902, SEQ ID NO:1904, SEQ ID NO:1906, SEQ ID NO:1908, SEQ ID NOs:1921-2059, SEQ ID NO:2061, SEQ ID NO:2063, SEQ ID NOs:2065-2083, SEQ ID NO:2085, SEQ ID NO:2087, SEQ ID NO:2089, SEQ ID NO:2091, SEQ ID NO:2093, SEQ ID NO:2095, SEQ ID NO:2097, SEQ ID NO:2099, SEQ ID NO:2101, SEQ ID NO:2103, SEQ ID NO:2105, SEQ ID NO:2107, SEQ ID NO:2109, SEQ ID NO:2111, SEQ ID NO:2113, SEQ ID NO:2115, SEQ ID NO:2117, SEQ ID NO:2119, SEQ ID NO:2121, SEQ ID NO:2123, SEQ ID NO:2125, SEQ ID NO:2127, SEQ ID NO:2129, SEQ ID NO:2131, SEQ ID NO:2133, SEQ ID NO:2135, SEQ ID NO:2137, SEQ ID NO:2139, SEQ ID NO:2141, SEQ ID NO:2143, SEQ ID NO:2145, SEQ ID NO:2147, SEQ ID NO:2149, SEQ ID NO:2151, SEQ ID NO:2153, SEQ ID NO:2155, SEQ ID NO:2157, SEQ ID NO:2159, SEQ ID NO:2161, SEQ ID NO:2162, SEQ ID NO:2164, SEQ ID NO:2166, SEQ ID NO:6168, SEQ ID NO:2170, SEQ ID NO:2172, SEQ ID NO:2174, SEQ ID NO:2176, SEQ ID NO:2178, SEQ ID NO:2180, SEQ ID NO:2182, SEQ ID NO:2184, SEQ ID NO:2186, SEQ ID NO:2188, SEQ ID NO:2190, SEQ ID NO:2192, SEQ ID NO:2194, SEQ ID NO:2196, SEQ ID NO:2198, SEQ ID NO:2200, SEQ ID NO:2202, SEQ ID NO:2204, SEQ ID NO:2206, SEQ ID NO:2208, SEQ ID NO:2210, SEQ ID NO:2212, SEQ ID NO:2214, SEQ ID NO:2216, SEQ ID NO:2218, SEQ ID NO:2220, SEQ ID NO:2222, SEQ ID NO:2224, SEQ ID NO:2226, SEQ ID NO:2228, SEQ ID NO:2230, SEQ ID NO:2232, SEQ ID NO:2234, SEQ ID NO:2236, SEQ ID NO:2238, SEQ ID NO:2240, SEQ ID NO:2242, SEQ ID NO:2244, SEQ ID NO:2246, SEQ ID NO:2248, SEQ ID NO:2250, SEQ ID NO:2252, SEQ ID NO:2254, SEQ ID NO:2256, SEQ ID NO:2258, SEQ ID NO:2260, SEQ ID NO:2262, SEQ ID NO:2264, SEQ ID NO:2266, SEQ ID NO:2268, SEQ ID NO:2270, SEQ ID NO:2272, SEQ ID NO:2274, SEQ ID NO:2276, SEQ ID NO:2278, SEQ ID NO:2280, SEQ ID NO:2282, SEQ ID NO:2284, SEQ ID NO:2286, SEQ ID NO:2288, SEQ ID NO:2290, SEQ ID NO:2292, SEQ ID NO:2294, SEQ ID NO:2296, SEQ ID NO:2298, SEQ ID NO:2300, SEQ ID NO:2302, SEQ ID NO:2304, SEQ ID NO:2306, SEQ ID NO:2308, SEQ ID NO:2310, SEQ ID NO:2312, SEQ ID NO:2314, SEQ ID NO:2316, SEQ ID NO:2318, SEQ ID NO:2320, SEQ ID NO:2322, SEQ ID NO:2324, SEQ ID NO:2326, SEQ ID NO:2328, SEQ ID NO:2330, SEQ ID NO:2332, SEQ ID NO:2334, SEQ ID NO:2336, SEQ ID NO:2338, SEQ ID NO:2340, SEQ ID NO:2342, SEQ ID NO:2344, SEQ ID NO:2346, or SEQ ID NO:2348.

Examples of nucleic acids encoding regulatory proteins are set forth in SEQ ID NO:95, SEQ ID NO:97, SEQ ID NO:101, SEQ ID NO:103, SEQ ID NO:105, SEQ ID NO:107, SEQ ID NO:109, SEQ ID NO:113, SEQ ID NO:118, SEQ ID NO:123, SEQ ID NO:125, SEQ ID NO:129, SEQ ID NO:133, SEQ ID NO:138, SEQ ID NO:140, SEQ ID NO:142, SEQ ID NO:144, SEQ ID NO:148, SEQ ID NO:150, SEQ ID NO:156, SEQ ID NO:158, SEQ ID NO:160, SEQ ID NO:162, SEQ ID NO:164, SEQ ID NO:169, SEQ ID NO:171, SEQ ID NO:177, SEQ ID NO:195, SEQ ID NO:197, SEQ ID NO:216, SEQ ID NO:218, SEQ ID NO:220, SEQ ID NO:252, SEQ ID NO:254, SEQ ID NO:257, SEQ ID NO:259, SEQ ID NO:261, SEQ ID NO:266, SEQ ID NO:268, SEQ ID NO:271, SEQ ID NO:274, SEQ ID NO:278, SEQ ID NO:281, SEQ ID NO:283, SEQ ID NO:285, SEQ ID NO:288, SEQ ID NO:291, SEQ ID NO:293, SEQ ID NO:299, SEQ ID NO:301, SEQ ID NO:303, SEQ ID NO:305, SEQ ID NO:307, SEQ ID NO:314, SEQ ID NO:317, SEQ ID NO:320, SEQ ID NO:322, SEQ ID NO:324, SEQ ID NO:327, SEQ ID NO:329, SEQ ID NO:331, SEQ ID NO:333, SEQ ID NO:336, SEQ ID NO:338, SEQ ID NO:342, SEQ ID NO:344, SEQ ID NO:346, SEQ ID NO:352, SEQ ID NO:354, SEQ ID NO:356, SEQ ID NO:360, SEQ ID NO:369, SEQ ID NO:371, SEQ ID NO:373, SEQ ID NO:376, SEQ ID NO:378, SEQ ID NO:380, SEQ ID NO:386, SEQ ID NO:390, SEQ ID NO:393, SEQ ID NO:399, SEQ ID NO:401, SEQ ID NO:404, SEQ ID NO:406, SEQ ID NO:408, SEQ ID NO:410, SEQ ID NO:412, SEQ ID NO:414, SEQ ID NO:416, SEQ ID NO:431, SEQ ID NO:435, SEQ ID NO:437, SEQ ID NO:439, SEQ ID NO:441, SEQ ID NO:444, SEQ ID NO:448, SEQ ID NO:450, SEQ ID NO:453, SEQ ID NO:458, SEQ ID NO:460, SEQ ID NO:464, SEQ ID NO:469, SEQ ID NO:472, SEQ ID NO:474, SEQ ID NO:477, SEQ ID NO:482, SEQ ID NO:486, SEQ ID NO:489, SEQ ID NO:491, SEQ ID NO:493, SEQ ID NO:495, SEQ ID NO:500, SEQ ID NO:503, SEQ ID NO:507, SEQ ID NO:509, SEQ ID NO:515, SEQ ID NO:517, SEQ ID NO:519, SEQ ID NO:523, SEQ ID NO:525, SEQ ID NO:528, SEQ ID NO:534, SEQ ID NO:536, SEQ ID NO:538, SEQ ID NO:540, SEQ ID NO:542, SEQ ID NO:544, SEQ ID NO:547, SEQ ID NO:552, SEQ ID NO:554, SEQ ID NO:562, SEQ ID NO:565, SEQ ID NO:569, SEQ ID NO:571, SEQ ID NO:573, SEQ ID NO:577, SEQ ID NO:580, SEQ ID NO:582, SEQ ID NO:584, SEQ ID NO:589, SEQ ID NO:592, SEQ ID NO:595, SEQ ID NO:598, SEQ ID NO:600, SEQ ID NO:602, SEQ ID NO:605, SEQ ID NO:607, SEQ ID NO:609, SEQ ID NO:611, SEQ ID NO:613, SEQ ID NO:618, SEQ ID NO:620, SEQ ID NO:637, SEQ ID NO:649, SEQ ID NO:651, SEQ ID NO:655, SEQ ID NO:658, SEQ ID NO:660, SEQ ID NO:664, SEQ ID NO:670, SEQ ID NO:674, SEQ ID NO:677, SEQ ID NO:679, SEQ ID NO:681, SEQ ID NO:683, SEQ ID NO:685, SEQ ID NO:688, SEQ ID NO:694, SEQ ID NO:697, SEQ ID NO:699, SEQ ID NO:702, SEQ ID NO:704, SEQ ID NO:706, SEQ ID NO:708, SEQ ID NO:712, SEQ ID NO:714, SEQ ID NO:717, SEQ ID NO:719, SEQ ID NO:721, SEQ ID NO:723, SEQ ID NO:729, SEQ ID NO:736, SEQ ID NO:741, SEQ ID NO:743, SEQ ID NO:746, SEQ ID NO:752, SEQ ID NO:754, SEQ ID NO:759, SEQ ID NO:764, SEQ ID NO:778, SEQ ID NO:780, SEQ ID NO:785, SEQ ID NO:789, SEQ ID NO:792, SEQ ID NO:795, SEQ ID NO:797, SEQ ID NO:799, SEQ ID NO:801, SEQ ID NO:807, SEQ ID NO:810, SEQ ID NO:813, SEQ ID NO:815, SEQ ID NO:819, SEQ ID NO:821, SEQ ID NO:823, SEQ ID NO:827, SEQ ID NO:829, SEQ ID NO:832, SEQ ID NO:834, SEQ ID NO:837, SEQ ID NO:840, SEQ ID NO:842, SEQ ID NO:848, SEQ ID NO:851, SEQ ID NO:854, SEQ ID NO:858, SEQ ID NO:860, SEQ ID NO:864, SEQ ID NO:867, SEQ ID NO:884, SEQ ID NO:889, SEQ ID NO:891, SEQ ID NO:893, SEQ ID NO:895, SEQ ID NO:897, SEQ ID NO:899, SEQ ID NO:903, SEQ ID NO:906, SEQ ID NO:911, SEQ ID NO:913, SEQ ID NO:916, SEQ ID NO:918, SEQ ID NO:920, SEQ ID NO:926, SEQ ID NO:928, SEQ ID NO:933, SEQ ID NO:935, SEQ ID NO:937, SEQ ID NO:942, SEQ ID NO:944, SEQ ID NO:958, SEQ ID NO:963, SEQ ID NO:965, SEQ ID NO:967, SEQ ID NO:972, SEQ ID NO:974, SEQ ID NO:979, SEQ ID NO:981, SEQ ID NO:993, SEQ ID NO:1006, SEQ ID NO:1010, SEQ ID NO:1015, SEQ ID NO:1027, SEQ ID NO:1030, SEQ ID NO:1034, SEQ ID NO:1049, SEQ ID NO:1051, SEQ ID NO:1054, SEQ ID NO:1057, SEQ ID NO:1059, SEQ ID NO:1061, SEQ ID NO:1063, SEQ ID NO:1067, SEQ ID NO:1070, SEQ ID NO:1077, SEQ ID NO:1080, SEQ ID NO:1082, SEQ ID NO:1084, SEQ ID NO:1086, SEQ ID NO:1090, SEQ ID NO:1093, SEQ ID NO:1095, SEQ ID NO:1097, SEQ ID NO:1103, SEQ ID NO:1108, SEQ ID NO:1116, SEQ ID NO:1121, SEQ ID NO:1124, SEQ ID NO:1128, SEQ ID NO:1130, SEQ ID NO:1133, SEQ ID NO:1135, SEQ ID NO:1138, SEQ ID NO:1142, SEQ ID NO:1148, SEQ ID NO:1155, SEQ ID NO:1158, SEQ ID NO:1160, SEQ ID NO:1162, SEQ ID NO:1164, SEQ ID NO:1170, SEQ ID NO:1172, SEQ ID NO:1175, SEQ ID NO:1182, SEQ ID NO:1184, SEQ ID NO:1208, SEQ ID NO:1210, SEQ ID NO:1212, SEQ ID NO:1214, SEQ ID NO:1216, SEQ ID NO:1218, SEQ ID NO:1220, SEQ ID NO:1222, SEQ ID NO:1224, SEQ ID NO:1236, SEQ ID NO:1238, SEQ ID NO:1240, SEQ ID NO:1242, SEQ ID NO:1244, SEQ ID NO:1246, SEQ ID NO:1248, SEQ ID NO:1250, SEQ ID NO:1252, SEQ ID NO:1254, SEQ ID NO:1256, SEQ ID NO:1258, SEQ ID NO:1260, SEQ ID NO:1262, SEQ ID NO:1264, SEQ ID NO:1266, SEQ ID NO:1268, SEQ ID NO:1270, SEQ ID NO:1272, SEQ ID NO:1274, SEQ ID NO:1276, SEQ ID NO:1278, SEQ ID NO:1280, SEQ ID NO:1282, SEQ ID NO:1284, SEQ ID NO:1291, SEQ ID NO:1293, SEQ ID NO:1295, SEQ ID NO:1297, SEQ ID NO:1299, SEQ ID NO:1301, SEQ ID NO:1310, SEQ ID NO:1312, SEQ ID NO:1314, SEQ ID NO:1316, SEQ ID NO:1318, SEQ ID NO:1320, SEQ ID NO:1322, SEQ ID NO:1324, SEQ ID NO:1326, SEQ ID NO:1328, SEQ ID NO:1330, SEQ ID NO:1332, SEQ ID NO:1334, SEQ ID NO:1336, SEQ ID NO:1338, SEQ ID NO:1340, SEQ ID NO:1342, SEQ ID NO:1344, SEQ ID NO:1346, SEQ ID NO:1348, SEQ ID NO:1350, SEQ ID NO:1352, SEQ ID NO:1354, SEQ ID NO:1356, SEQ ID NO:1358, SEQ ID NO:1360, SEQ ID NO:1368, SEQ ID NO:1370, SEQ ID NO:1372, SEQ ID NO:1374, SEQ ID NO:1376, SEQ ID NO:1378, SEQ ID NO:1380, SEQ ID NO:1382, SEQ ID NO:1384, SEQ ID NO:1386, SEQ ID NO:1388, SEQ ID NO:1390, SEQ ID NO:1392, SEQ ID NO:1394, SEQ ID NO:1396, SEQ ID NO:1398, SEQ ID NO:1400, SEQ ID NO:1402, SEQ ID NO:1404, SEQ ID NO:1411, SEQ ID NO:1413, SEQ ID NO:1416, SEQ ID NO:1418, SEQ ID NO:1420, SEQ ID NO:1422, SEQ ID NO:1430, SEQ ID NO:1432, SEQ ID NO:1434, SEQ ID NO:1435, SEQ ID NO:1443, SEQ ID NO:1464, SEQ ID NO:1466, SEQ ID NO:1468, SEQ ID NO:1470, SEQ ID NO:1472, SEQ ID NO:1474, SEQ ID NO:1476, SEQ ID NO:1478, SEQ ID NO:1480, SEQ ID NO:1482, SEQ ID NO:1484, SEQ ID NO:1486, SEQ ID NO:1492, SEQ ID NO:1501, SEQ ID NO:1503, SEQ ID NO:1517, SEQ ID NO:1519, SEQ ID NO:1521, SEQ ID NO:1523, SEQ ID NO:1525, SEQ ID NO:1527, SEQ ID NO:1535, SEQ ID NO:1537, SEQ ID NO:1539, SEQ ID NO:1541, SEQ ID NO:1543, SEQ ID NO:1545, SEQ ID NO:1547, SEQ ID NO:1549, SEQ ID NO:1551, SEQ ID NO:1553, SEQ ID NO:1555, SEQ ID NO:1557, SEQ ID NO:1559, SEQ ID NO:1561, SEQ ID NO:1563, SEQ ID NO:1565, SEQ ID NO:1567, SEQ ID NO:1569, SEQ ID NO:1572, SEQ ID NO:1574, SEQ ID NO:1576, SEQ ID NO:1578, SEQ ID NO:1580, SEQ ID NO:1582, SEQ ID NO:1584, SEQ ID NO:1586, SEQ ID NO:1588, SEQ ID NO:1590, SEQ ID NO:1592, SEQ ID NO:1594, SEQ ID NO:1609, SEQ ID NO:1611, SEQ ID NO:1613, SEQ ID NO:1615, SEQ ID NO:1617, SEQ ID NO:1619, SEQ ID NO:1623, SEQ ID NO:1625, SEQ ID NO:1627, SEQ ID NO:1629, SEQ ID NO:1631, SEQ ID NO:1636, SEQ ID NO:1652, SEQ ID NO:1656, SEQ ID NO:1658, SEQ ID NO:1660, SEQ ID NO:1662, SEQ ID NO:1664, SEQ ID NO:1666, SEQ ID NO:1668, SEQ ID NO:1670, SEQ ID NO:1672, SEQ ID NO:1674, SEQ ID NO:1680, SEQ ID NO:1682, SEQ ID NO:1691, SEQ ID NO:1693, SEQ ID NO:1695, SEQ ID NO:1697, SEQ ID NO:1699, SEQ ID NO:1701, SEQ ID NO:1703, SEQ ID NO:1705, SEQ ID NO:1707, SEQ ID NO:1709, SEQ ID NO:1711, SEQ ID NO:1713, SEQ ID NO:1715, SEQ ID NO:1717, SEQ ID NO:1719, SEQ ID NO:1721, SEQ ID NO:1723, SEQ ID NO:1725, SEQ ID NO:1727, SEQ ID NO:1732, SEQ ID NO:1734, SEQ ID NO:1748, SEQ ID NO:1751, SEQ ID NO:1766, SEQ ID NO:1776, SEQ ID NO:1778, SEQ ID NO:1780, SEQ ID NO:1782, SEQ ID NO:1784, SEQ ID NO:1805, SEQ ID NO:1821, SEQ ID NO:1823, SEQ ID NO:1825, SEQ ID NO:1827, SEQ ID NO:1829, SEQ ID NO:1831, SEQ ID NO:1833, SEQ ID NO:1835, SEQ ID NO:1837, SEQ ID NO:1839, SEQ ID NO:1841, SEQ ID NO:1843, SEQ ID NO:1845, SEQ ID NO:1847, SEQ ID NO:1849, SEQ ID NO:1851, SEQ ID NO:1853, SEQ ID NO:1855, SEQ ID NO:1857, SEQ ID NO:1859, SEQ ID NO:1861, SEQ ID NO:1863, SEQ ID NO:1865, SEQ ID NO:1867, SEQ ID NO:1869, SEQ ID NO:1871, SEQ ID NO:1873, SEQ ID NO:1875, SEQ ID NO:1877, SEQ ID NO:1879, SEQ ID NO:1881, SEQ ID NO:1883, SEQ ID NO:1885, SEQ ID NO:1887, SEQ ID NO:1889, SEQ ID NO:1891, SEQ ID NO:1896, SEQ ID NO:1898, SEQ ID NO:1900, SEQ ID NO:1903, SEQ ID NO:1905, SEQ ID NO:1907, SEQ ID NO:1919, SEQ ID NO:1920, SEQ ID NO:2060, SEQ ID NO:2062, SEQ ID NO:2064, SEQ ID NO:2084, SEQ ID NO:2088, SEQ ID NO:2090, SEQ ID NO:2092, SEQ ID NO:2094, SEQ ID NO:2096, SEQ ID NO:2098, SEQ ID NO:2100, SEQ ID NO:2102, SEQ ID NO:2104, SEQ ID NO:2106, SEQ ID NO:2108, SEQ ID NO:2110, SEQ ID NO:2112, SEQ ID NO:2114, SEQ ID NO:2116, SEQ ID NO:2118, SEQ ID NO:2120, SEQ ID NO:2122, SEQ ID NO:2124, SEQ ID NO:2126, SEQ ID NO:2128, SEQ ID NO:2130, SEQ ID NO:2132, SEQ ID NO:2134, SEQ ID NO:2136, SEQ ID NO:2138, SEQ ID NO:2140, SEQ ID NO:2142, SEQ ID NO:2144, SEQ ID NO:2146, SEQ ID NO:2148, SEQ ID NO:2150, SEQ ID NO:2152, SEQ ID NO:2154, SEQ ID NO:2156, SEQ ID NO:2158, SEQ ID NO:2160, SEQ ID NO:2161, SEQ ID NO:2163, SEQ ID NO:2165, SEQ ID NO:6167, SEQ ID NO:2169, SEQ ID NO:2171, SEQ ID NO:2173, SEQ ID NO:2175, SEQ ID NO:2177, SEQ ID NO:2179, SEQ ID NO:2181, SEQ ID NO:2183, SEQ ID NO:2185, SEQ ID NO:2187, SEQ ID NO:2189, SEQ ID NO:2191, SEQ ID NO:2193, SEQ ID NO:2195, SEQ ID NO:2197, SEQ ID NO:2199, SEQ ID NO:2201, SEQ ID NO:2203, SEQ ID NO:2205, SEQ ID NO:2207, SEQ ID NO:2209, SEQ ID NO:2211, SEQ ID NO:2213, SEQ ID NO:2215, SEQ ID NO:2217, SEQ ID NO:2219, SEQ ID NO:2221, SEQ ID NO:2223, SEQ ID NO:2225, SEQ ID NO:2227, SEQ ID NO:2229, SEQ ID NO:2231, SEQ ID NO:2233, SEQ ID NO:2235, SEQ ID NO:2237, SEQ ID NO:2239, SEQ ID NO:2241, SEQ ID NO:2243, SEQ ID NO:2245, SEQ ID NO:2247, SEQ ID NO:2249, SEQ ID NO:2251, SEQ ID NO:2253, SEQ ID NO:2255, SEQ ID NO:2257, SEQ ID NO:2259, SEQ ID NO:2261, SEQ ID NO:2263, SEQ ID NO:2265, SEQ ID NO:2267, SEQ ID NO:2269, SEQ ID NO:2271, SEQ ID NO:2273, SEQ ID NO:2275, SEQ ID NO:2277, SEQ ID NO:2279, SEQ ID NO:2281, SEQ ID NO:2283, SEQ ID NO:2285, SEQ ID NO:2287, SEQ ID NO:2289, SEQ ID NO:2291, SEQ ID NO:2293, SEQ ID NO:2295, SEQ ID NO:2297, SEQ ID NO:2299, SEQ ID NO:2301, SEQ ID NO:2303, SEQ ID NO:2305, SEQ ID NO:2307, SEQ ID NO:2309, SEQ ID NO:2311, SEQ ID NO:2313, SEQ ID NO:2315, SEQ ID NO:2317, SEQ ID NO:2319, SEQ ID NO:2321, SEQ ID NO:2323, SEQ ID NO:2325, SEQ ID NO:2327, SEQ ID NO:2329, SEQ ID NO:2331, SEQ ID NO:2333, SEQ ID NO:2335, SEQ ID NO:2337, SEQ ID NO:2339, SEQ ID NO:2341, SEQ ID NO:2343, SEQ ID NO:2345, SEQ ID NO:2347, and SEQ ID NO:2349-2690.

SEQ ID NO:97, SEQ ID NO:101, SEQ ID NO:107, SEQ ID NO:109, SEQ ID NO:113, SEQ ID NO:123, SEQ ID NO:125, SEQ ID NO:129, SEQ ID NO:138, SEQ ID NO:140, SEQ ID NO:142, SEQ ID NO:144, SEQ ID NO:150, SEQ ID NO:195, SEQ ID NO:197, SEQ ID NO:216, SEQ ID NO:218, SEQ ID NO:252, SEQ ID NO:254, SEQ ID NO:257, SEQ ID NO:259, SEQ ID NO:261, SEQ ID NO:266, SEQ ID NO:268, SEQ ID NO:271, SEQ ID NO:274, SEQ ID NO:278, SEQ ID NO:281, SEQ ID NO:283, SEQ ID NO:285, SEQ ID NO:288, SEQ ID NO:291, SEQ ID NO:293, SEQ ID NO:299, SEQ ID NO:301, SEQ ID NO:303, SEQ ID NO:305, SEQ ID NO:307, SEQ ID NO:314, SEQ ID NO:317, SEQ ID NO:320, SEQ ID NO:322, SEQ ID NO:324, SEQ ID NO:327, SEQ ID NO:329, SEQ ID NO:331, SEQ ID NO:333, SEQ ID NO:342, SEQ ID NO:344, SEQ ID NO:346, SEQ ID NO:352, SEQ ID NO:376, SEQ ID NO:386, SEQ ID NO:390, SEQ ID NO:393, SEQ ID NO:399, SEQ ID NO:401, SEQ ID NO:439, SEQ ID NO:441, SEQ ID NO:448, SEQ ID NO:450, SEQ ID NO:453, SEQ ID NO:458, SEQ ID NO:469, SEQ ID NO:472, SEQ ID NO:474, SEQ ID NO:477, SEQ ID NO:482, SEQ ID NO:486, SEQ ID NO:491, SEQ ID NO:493, SEQ ID NO:495, SEQ ID NO:500, SEQ ID NO:507, SEQ ID NO:509, SEQ ID NO:515, SEQ ID NO:534, SEQ ID NO:536, SEQ ID NO:538, SEQ ID NO:540, SEQ ID NO:542, SEQ ID NO:544, SEQ ID NO:552, SEQ ID NO:562, SEQ ID NO:569, SEQ ID NO:571, SEQ ID NO:573, SEQ ID NO:577, SEQ ID NO:580, SEQ ID NO:592, SEQ ID NO:595, SEQ ID NO:602, SEQ ID NO:618, SEQ ID NO:620, SEQ ID NO:649, SEQ ID NO:655, SEQ ID NO:658, SEQ ID NO:664, SEQ ID NO:674, SEQ ID NO:681, SEQ ID NO:683, SEQ ID NO:699, SEQ ID NO:704, SEQ ID NO:708, SEQ ID NO:712, SEQ ID NO:714, SEQ ID NO:717, SEQ ID NO:719, SEQ ID NO:721, SEQ ID NO:723, SEQ ID NO:741, and SEQ ID NO:746 are predicted to encode polypeptides having the amino acid sequences set forth in SEQ ID NO:98, SEQ ID NO:102, SEQ ID NO:108, SEQ ID NO:110, SEQ ID NO:114, SEQ ID NO:124, SEQ ID NO:126, SEQ ID NO:130, SEQ ID NO:139, SEQ ID NO:141, SEQ ID NO:143, SEQ ID NO:145, SEQ ID NO:151, SEQ ID NO:196, SEQ ID NO:198, SEQ ID NO:217, SEQ ID NO:219, SEQ ID NO:253, SEQ ID NO:255, SEQ ID NO:258, SEQ ID NO:260, SEQ ID NO:262, SEQ ID NO:267, SEQ ID NO:269, SEQ ID NO:272, SEQ ID NO:275, SEQ ID NO:279, SEQ ID NO:282, SEQ ID NO:284, SEQ ID NO:286, SEQ ID NO:289, SEQ ID NO:300, SEQ ID NO:292, SEQ ID NO:294, SEQ ID NO:300, SEQ ID NO:302, SEQ ID NO:304, SEQ ID NO:306, SEQ ID NO:308, SEQ ID NO:315, SEQ ID NO:318, SEQ ID NO:321, SEQ ID NO:323, SEQ ID NO:325, SEQ ID NO:328, SEQ ID NO:330, SEQ ID NO:332, SEQ ID NO:334, SEQ ID NO:343, SEQ ID NO:345, SEQ ID NO:347, SEQ ID NO:353, SEQ ID NO:377, SEQ ID NO:387, SEQ ID NO:391, SEQ ID NO:394, SEQ ID NO:400, SEQ ID NO:402, SEQ ID NO:440, SEQ ID NO:442, SEQ ID NO:449, SEQ ID NO:451, SEQ ID NO:454, SEQ ID NO:459, SEQ ID NO:470, SEQ ID NO:473, SEQ ID NO:475, SEQ ID NO:478, SEQ ID NO:483, SEQ ID NO:487, SEQ ID NO:492, SEQ ID NO:494, SEQ ID NO:496, SEQ ID NO:501, SEQ ID NO:508, SEQ ID NO:510, SEQ ID NO:516, SEQ ID NO:535, SEQ ID NO:537, SEQ ID NO:539, SEQ ID NO:541, SEQ ID NO:543, SEQ ID NO:545, SEQ ID NO:553, SEQ ID NO:563, SEQ ID NO:570, SEQ ID NO:572, SEQ ID NO:574, SEQ ID NO:578, SEQ ID NO:581, SEQ ID NO:593, SEQ ID NO:596, SEQ ID NO:603, SEQ ID NO:619, SEQ ID NO:621, SEQ ID NO:650, SEQ ID NO:656, SEQ ID NO:659, SEQ ID NO:665, SEQ ID NO:675, SEQ ID NO:682, SEQ ID NO:684, SEQ ID NO:700, SEQ ID NO:705, SEQ ID NO:709, SEQ ID NO:713, SEQ ID NO:715, SEQ ID NO:718, SEQ ID NO:720, SEQ ID NO:722, SEQ ID NO:724, and SEQ ID NO:747, respectively.

SEQ ID NO:752, SEQ ID NO:754, SEQ ID NO:764, SEQ ID NO:785, SEQ ID NO:789, SEQ ID NO:795, SEQ ID NO:797, SEQ ID NO:799, SEQ ID NO:801, SEQ ID NO:810, SEQ ID NO:819, SEQ ID NO:821, SEQ ID NO:823, SEQ ID NO:827, SEQ ID NO:829, SEQ ID NO:840, SEQ ID NO:842, SEQ ID NO:848, SEQ ID NO:854, SEQ ID NO:858, SEQ ID NO:860, SEQ ID NO:867, SEQ ID NO:889, SEQ ID NO:891, SEQ ID NO:893, SEQ ID NO:895, SEQ ID NO:903, SEQ ID NO:906, SEQ ID NO:911, SEQ ID NO:916, SEQ ID NO:918, SEQ ID NO:920, SEQ ID NO:926, SEQ ID NO:928, SEQ ID NO:942, SEQ ID NO:944, SEQ ID NO:958, SEQ ID NO:965, SEQ ID NO:967, SEQ ID NO:972, SEQ ID NO:974, SEQ ID NO:981, SEQ ID NO:1006, SEQ ID NO:1010, SEQ ID NO:1015, SEQ ID NO:1027, SEQ ID NO:1030, SEQ ID NO:1034, SEQ ID NO:1054, SEQ ID NO:1067, SEQ ID NO:1070, SEQ ID NO:1077, SEQ ID NO:1084, SEQ ID NO:1086, SEQ ID NO:1090, SEQ ID NO:1093, SEQ ID NO:1097, SEQ ID NO:1108, SEQ ID NO:1116, SEQ ID NO:1121, SEQ ID NO:1124, SEQ ID NO:1138, SEQ ID NO:1142, SEQ ID NO:1148, SEQ ID NO:1155, SEQ ID NO:1158, SEQ ID NO:1160, SEQ ID NO:1170, SEQ ID NO:1172, SEQ ID NO:1175, SEQ ID NO:1208, SEQ ID NO:1212, SEQ ID NO:1214, SEQ ID NO:1216, SEQ ID NO:1218, SEQ ID NO:1220, SEQ ID NO:1222, SEQ ID NO:1224, SEQ ID NO:1236, SEQ ID NO:1240, SEQ ID NO:1242, SEQ ID NO:1244, SEQ ID NO:1246, SEQ ID NO:1250, SEQ ID NO:1252, SEQ ID NO:1254, SEQ ID NO:1256, SEQ ID NO:1260, SEQ ID NO:1262, SEQ ID NO:1264, SEQ ID NO:1268, SEQ ID NO:1270, SEQ ID NO:1272, SEQ ID NO:1274, SEQ ID NO:1276, SEQ ID NO:1278, SEQ ID NO:1280, SEQ ID NO:1282, SEQ ID NO:1291, SEQ ID NO:1295, SEQ ID NO:1297, SEQ ID NO:1299, SEQ ID NO:1310, SEQ ID NO:1312, SEQ ID NO:1316, SEQ ID NO:1318, SEQ ID NO:1320, SEQ ID NO:1324, SEQ ID NO:1326, SEQ ID NO:1328, SEQ ID NO:1330, SEQ ID NO:1334, SEQ ID NO:1336, and SEQ ID NO:1338 are predicted to encode polypeptides having the amino acid sequences set forth in SEQ ID NO:753, SEQ ID NO:755, SEQ ID NO:765, SEQ ID NO:786, SEQ ID NO:780, SEQ ID NO:796, SEQ ID NO:798, SEQ ID NO:800, SEQ ID NO:802, SEQ ID NO:811, SEQ ID NO:820, SEQ ID NO:822, SEQ ID NO:824, SEQ ID NO:828, SEQ ID NO:830, SEQ ID NO:841, SEQ ID NO:843, SEQ ID NO:849, SEQ ID NO:855, SEQ ID NO:859, SEQ ID NO:861, SEQ ID NO:868, SEQ ID NO:890, SEQ ID NO:892, SEQ ID NO:894, SEQ ID NO:896, SEQ ID NO:904, SEQ ID NO:907, SEQ ID NO:912, SEQ ID NO:917, SEQ ID NO:919, SEQ ID NO:921, SEQ ID NO:927, SEQ ID NO:929, SEQ ID NO:943, SEQ ID NO:945, SEQ ID NO:959, SEQ ID NO:966, SEQ ID NO:968, SEQ ID NO:973, SEQ ID NO:975, SEQ ID NO:982, SEQ ID NO:1007, SEQ ID NO:1011, SEQ ID NO:1016, SEQ ID NO:1028, SEQ ID NO:1031, SEQ ID NO:1035, SEQ ID NO:1055, SEQ ID NO:1068, SEQ ID NO:1071, SEQ ID NO:1078, SEQ ID NO:1085, SEQ ID NO:1087, SEQ ID NO:1091, SEQ ID NO:1094, SEQ ID NO:1098, SEQ ID NO:1109, SEQ ID NO:1117, SEQ ID NO:1122, SEQ ID NO:1125, SEQ ID NO:1139, SEQ ID NO:1143, SEQ ID NO:1149, SEQ ID NO:1156, SEQ ID NO:1159, SEQ ID NO:1161, SEQ ID NO:1171, SEQ ID NO:1173, SEQ ID NO:1176, SEQ ID NO:1209, SEQ ID NO:1213, SEQ ID NO:1215, SEQ ID NO:1217, SEQ ID NO:1219, SEQ ID NO:1221, SEQ ID NO:1223, SEQ ID NO:1225, SEQ ID NO:1237, SEQ ID NO:1241, SEQ ID NO:1243, SEQ ID NO:1245, SEQ ID NO:1247, SEQ ID NO:1251, SEQ ID NO:1253, SEQ ID NO:1255, SEQ ID NO:1257, SEQ ID NO:1261, SEQ ID NO:1263, SEQ ID NO:1265, SEQ ID NO:1269, SEQ ID NO:1271, SEQ ID NO:1273, SEQ ID NO:1275, SEQ ID NO:1277, SEQ ID NO:1279, SEQ ID NO:1281, SEQ ID NO:1283, SEQ ID NO:1292, SEQ ID NO:1296, SEQ ID NO:1298, SEQ ID NO:1300, SEQ ID NO:1311, SEQ ID NO:1313, SEQ ID NO:1317, SEQ ID NO:1319, SEQ ID NO:1321, SEQ ID NO:1325, SEQ ID NO:1327, SEQ ID NO:1329, SEQ ID NO:1331, SEQ ID NO:1335, SEQ ID NO:1337, and SEQ ID NO:1339, respectively.

SEQ ID NO:1340, SEQ ID NO:1342, SEQ ID NO:1346, SEQ ID NO:1348, SEQ ID NO:1350, SEQ ID NO:1352, SEQ ID NO:1354, SEQ ID NO:1356, SEQ ID NO:1358, SEQ ID NO:1368, SEQ ID NO:1372, SEQ ID NO:1374, SEQ ID NO:1378, SEQ ID NO:1380, SEQ ID NO:1384, SEQ ID NO:1386, SEQ ID NO:1388, SEQ ID NO:1390, SEQ ID NO:1396, SEQ ID NO:1398, SEQ ID NO:1400, SEQ ID NO:1402, SEQ ID NO:1411, SEQ ID NO:1416, SEQ ID NO:1418, SEQ ID NO:1430, SEQ ID NO:1432, SEQ ID NO:1466, SEQ ID NO:1470, SEQ ID NO:1476, SEQ ID NO:1478, SEQ ID NO:1482, SEQ ID NO:1484, SEQ ID NO:1486, SEQ ID NO:1501, SEQ ID NO:1519, SEQ ID NO:1521, SEQ ID NO:1523, SEQ ID NO:1527, SEQ ID NO:1535, SEQ ID NO:1537, SEQ ID NO:1541, SEQ ID NO:1543, SEQ ID NO:1545, SEQ ID NO:1547, SEQ ID NO:1549, SEQ ID NO:1553, SEQ ID NO:1555, SEQ ID NO:1557, SEQ ID NO:1559, SEQ ID NO:1561, SEQ ID NO:1565, SEQ ID NO:1567, SEQ ID NO:1574, SEQ ID NO:1576, SEQ ID NO:1578, SEQ ID NO:1582, SEQ ID NO:1586, SEQ ID NO:1588, SEQ ID NO:1590, SEQ ID NO:1592, SEQ ID NO:1611, SEQ ID NO:1613, SEQ ID NO:1615, SEQ ID NO:1617, SEQ ID NO:1623, SEQ ID NO:1625, SEQ ID NO:1629, SEQ ID NO:1631, SEQ ID NO:1656, SEQ ID NO:1658, SEQ ID NO:1662, SEQ ID NO:1664, SEQ ID NO:1666, SEQ ID NO:1668, SEQ ID NO:1670, SEQ ID NO:1672, SEQ ID NO:1682, SEQ ID NO:1693, SEQ ID NO:1695, SEQ ID NO:1699, SEQ ID NO:1701, SEQ ID NO:1703, SEQ ID NO:1705, SEQ ID NO:1707, SEQ ID NO:1709, SEQ ID NO:1711, SEQ ID NO:1713, SEQ ID NO:1715, SEQ ID NO:1717, SEQ ID NO:1719, SEQ ID NO:1723, SEQ ID NO:1725, SEQ ID NO:1732, SEQ ID NO:1748, SEQ ID NO:1776, SEQ ID NO:1780, SEQ ID NO:1782, SEQ ID NO:1833, SEQ ID NO:1855, SEQ ID NO:1891, SEQ ID NO:1898, SEQ ID NO:1900, SEQ ID NO:1907, SEQ ID NO:2060, SEQ ID NO:2062, and SEQ ID NO:2064 are predicted to encode polypeptides having the amino acid sequences set forth in SEQ ID NO:1341, SEQ ID NO:1343, SEQ ID NO:1347, SEQ ID NO:1349, SEQ ID NO:1351, SEQ ID NO:1353, SEQ ID NO:1355, SEQ ID NO:1357, SEQ ID NO:1359, SEQ ID NO:1369, SEQ ID NO:1373, SEQ ID NO:1375, SEQ ID NO:1379, SEQ ID NO:1381, SEQ ID NO:1385, SEQ ID NO:1387, SEQ ID NO:1389, SEQ ID NO:1391, SEQ ID NO:1397, SEQ ID NO:1399, SEQ ID NO:1401, SEQ ID NO:1403, SEQ ID NO:1412, SEQ ID NO:1417, SEQ ID NO:1419, SEQ ID NO:1431, SEQ ID NO:1433, SEQ ID NO:1467, SEQ ID NO:1471, SEQ ID NO:1477, SEQ ID NO:1479, SEQ ID NO:1483, SEQ ID NO:1485, SEQ ID NO:1487, SEQ ID NO:1502, SEQ ID NO:1520, SEQ ID NO:1522, SEQ ID NO:1524, SEQ ID NO:1528, SEQ ID NO:1536, SEQ ID NO:1538, SEQ ID NO:1542, SEQ ID NO:1544, SEQ ID NO:1546, SEQ ID NO:1548, SEQ ID NO:1550, SEQ ID NO:1554, SEQ ID NO:1556, SEQ ID NO:1558, SEQ ID NO:1560, SEQ ID NO:1562, SEQ ID NO:1566, SEQ ID NO:1568, SEQ ID NO:1575, SEQ ID NO:1577, SEQ ID NO:1579, SEQ ID NO:1583, SEQ ID NO:1587, SEQ ID NO:1589, SEQ ID NO:1591, SEQ ID NO:1593, SEQ ID NO:1612, SEQ ID NO:1614, SEQ ID NO:1616, SEQ ID NO:1618, SEQ ID NO:1624, SEQ ID NO:1626, SEQ ID NO:1630, SEQ ID NO:1632, SEQ ID NO:1657, SEQ ID NO:1659, SEQ ID NO:1663, SEQ ID NO:1665, SEQ ID NO:1667, SEQ ID NO:1669, SEQ ID NO:1671, SEQ ID NO:1673, SEQ ID NO:1683, SEQ ID NO:1694, SEQ ID NO:1696, SEQ ID NO:1700, SEQ ID NO:1702, SEQ ID NO:1704, SEQ ID NO:1706, SEQ ID NO:1708, SEQ ID NO:1710, SEQ ID NO:1712, SEQ ID NO:1714, SEQ ID NO:1716, SEQ ID NO:1718, SEQ ID NO:1720, SEQ ID NO:1724, SEQ ID NO:1726, SEQ ID NO:1733, SEQ ID NO:1749, SEQ ID NO:1777, SEQ ID NO:1781, SEQ ID NO:1783, SEQ ID NO:1834, SEQ ID NO:1856, SEQ ID NO:1892, SEQ ID NO:1899, SEQ ID NO:1901, SEQ ID NO:1908, SEQ ID NO:2061, SEQ ID NO:2063, and SEQ ID NO:2065, respectively.

SEQ ID NO:2088, SEQ ID NO:2090, SEQ ID NO:2092, SEQ ID NO:2094, SEQ ID NO:2096, SEQ ID NO:2098, SEQ ID NO:2100, SEQ ID NO:2102, SEQ ID NO:2104, SEQ ID NO:2106, SEQ ID NO:2108, SEQ ID NO:2110, SEQ ID NO:2112, SEQ ID NO:2114, SEQ ID NO:2116, SEQ ID NO:2118, SEQ ID NO:2120, SEQ ID NO:2122, SEQ ID NO:2124, SEQ ID NO:2126, SEQ ID NO:2128, SEQ ID NO:2130, SEQ ID NO:2132, SEQ ID NO:2134, SEQ ID NO:2136, SEQ ID NO:2138, SEQ ID NO:2140, SEQ ID NO:2142, SEQ ID NO:2144, SEQ ID NO:2146, SEQ ID NO:2148, SEQ ID NO:2150, SEQ ID NO:2152, SEQ ID NO:2154, SEQ ID NO:2156, SEQ ID NO:2158, SEQ ID NO:2160, SEQ ID NO:2161, SEQ ID NO:2163, SEQ ID NO:2165, SEQ ID NO:6167, SEQ ID NO:2169, SEQ ID NO:2171, SEQ ID NO:2173, SEQ ID NO:2175, SEQ ID NO:2177, SEQ ID NO:2179, SEQ ID NO:2181, SEQ ID NO:2183, SEQ ID NO:2185, SEQ ID NO:2187, SEQ ID NO:2189, SEQ ID NO:2191, SEQ ID NO:2193, SEQ ID NO:2195, SEQ ID NO:2197, SEQ ID NO:2199, SEQ ID NO:2201, SEQ ID NO:2203, SEQ ID NO:2205, SEQ ID NO:2207, SEQ ID NO:2209, SEQ ID NO:2211, SEQ ID NO:2213, SEQ ID NO:2215, SEQ ID NO:2217, SEQ ID NO:2219, SEQ ID NO:2221, SEQ ID NO:2223, SEQ ID NO:2225, SEQ ID NO:2227, SEQ ID NO:2229, SEQ ID NO:2231, SEQ ID NO:2233, SEQ ID NO:2235, SEQ ID NO:2237, SEQ ID NO:2239, SEQ ID NO:2241, SEQ ID

NO:2243, SEQ ID NO:2245, SEQ ID NO:2247, SEQ ID NO:2249, SEQ ID NO:2251, SEQ ID NO:2253, SEQ ID NO:2255, SEQ ID NO:2257, SEQ ID NO:2259, SEQ ID NO:2261, SEQ ID NO:2263, SEQ ID NO:2265, SEQ ID NO:2267, SEQ ID NO:2269, SEQ ID NO:2271, SEQ ID NO:2273, SEQ ID NO:2275, SEQ ID NO:2277, SEQ ID NO:2279, SEQ ID NO:2281, SEQ ID NO:2283, SEQ ID NO:2285, SEQ ID NO:2287, SEQ ID NO:2289, SEQ ID NO:2291, SEQ ID NO:2293, SEQ ID NO:2295, SEQ ID NO:2297, SEQ ID NO:2299, SEQ ID NO:2301, SEQ ID NO:2303, SEQ ID NO:2305, SEQ ID NO:2307, SEQ ID NO:2309, SEQ ID NO:2311, SEQ ID NO:2313, SEQ ID NO:2315, SEQ ID NO:2317, SEQ ID NO:2319, SEQ ID NO:2321, SEQ ID NO:2323, SEQ ID NO:2325, SEQ ID NO:2327, SEQ ID NO:2329, SEQ ID NO:2331, SEQ ID NO:2333, SEQ ID NO:2335, SEQ ID NO:2337, SEQ ID NO:2339, SEQ ID NO:2341, SEQ ID NO:2343, SEQ ID NO:2345, SEQ ID NO:2347, and SEQ ID NO:2690 are predicted to encode polypeptides having the amino acid sequences set forth in SEQ ID NO:2089, SEQ ID NO:2091, SEQ ID NO:2093, SEQ ID NO:2095, SEQ ID NO:2097, SEQ ID NO:2099, SEQ ID NO:2101, SEQ ID NO:2103, SEQ ID NO:2105, SEQ ID NO:2107, SEQ ID NO:2109, SEQ ID NO:2111, SEQ ID NO:2113, SEQ ID NO:2115, SEQ ID NO:2117, SEQ ID NO:2119, SEQ ID NO:2121, SEQ ID NO:2123, SEQ ID NO:2125, SEQ ID NO:2127, SEQ ID NO:2129, SEQ ID NO:2131, SEQ ID NO:2133, SEQ ID NO:2135, SEQ ID NO:2137, SEQ ID NO:2139, SEQ ID NO:2141, SEQ ID NO:2143, SEQ ID NO:2145, SEQ ID NO:2147, SEQ ID NO:2149, SEQ ID NO:2151, SEQ ID NO:2153, SEQ ID NO:2155, SEQ ID NO:2157, SEQ ID NO:2159, SEQ ID NO:2161, SEQ ID NO:2162, SEQ ID NO:2164, SEQ ID NO:2166, SEQ ID NO:6168, SEQ ID NO:2170, SEQ ID NO:2172, SEQ ID NO:2174, SEQ ID NO:2176, SEQ ID NO:2178, SEQ ID NO:2180, SEQ ID NO:2182, SEQ ID NO:2184, SEQ ID NO:2186, SEQ ID NO:2188, SEQ ID NO:2190, SEQ ID NO:2192, SEQ ID NO:2194, SEQ ID NO:2196, SEQ ID NO:2198, SEQ ID NO:2200, SEQ ID NO:2202, SEQ ID NO:2204, SEQ ID NO:2206, SEQ ID NO:2208, SEQ ID NO:2210, SEQ ID NO:2212, SEQ ID NO:2214, SEQ ID NO:2216, SEQ ID NO:2218, SEQ ID NO:2220, SEQ ID NO:2222, SEQ ID NO:2224, SEQ ID NO:2226, SEQ ID NO:2228, SEQ ID NO:2230, SEQ ID NO:2232, SEQ ID NO:2234, SEQ ID NO:2236, SEQ ID NO:2238, SEQ ID NO:2240, SEQ ID NO:2242, SEQ ID NO:2244, SEQ ID NO:2246, SEQ ID NO:2248, SEQ ID NO:2250, SEQ ID NO:2252, SEQ ID NO:2254, SEQ ID NO:2256, SEQ ID NO:2258, SEQ ID NO:2260, SEQ ID NO:2262, SEQ ID NO:2264, SEQ ID NO:2266, SEQ ID NO:2268, SEQ ID NO:2270, SEQ ID NO:2272, SEQ ID NO:2274, SEQ ID NO:2276, SEQ ID NO:2278, SEQ ID NO:2280, SEQ ID NO:2282, SEQ ID NO:2284, SEQ ID NO:2286, SEQ ID NO:2288, SEQ ID NO:2290, SEQ ID NO:2292, SEQ ID NO:2294, SEQ ID NO:2296, SEQ ID NO:2298, SEQ ID NO:2300, SEQ ID NO:2302, SEQ ID NO:2304, SEQ ID NO:2306, SEQ ID NO:2308, SEQ ID NO:2310, SEQ ID NO:2312, SEQ ID NO:2314, SEQ ID NO:2316, SEQ ID NO:2318, SEQ ID NO:2320, SEQ ID NO:2322, SEQ ID NO:2324, SEQ ID NO:2326, SEQ ID NO:2328, SEQ ID NO:2330, SEQ ID NO:2332, SEQ ID NO:2334, SEQ ID NO:2336, SEQ ID NO:2338, SEQ ID NO:2340, SEQ ID NO:2342, SEQ ID NO:2344, SEQ ID NO:2346, SEQ ID NO:2348, and SEQ ID NO:1747, respectively.

In some cases, a recombinant nucleic acid construct can include a nucleic acid comprising less than the full-length coding sequence of a regulatory protein. A nucleic acid can be a fragment that is at least 40% (e.g., at least 45, 50, 55, 60, 65, 70, 75, 80, 85, 90, 95, or 99%) of the length of the full-length nucleic acid set forth in SEQ ID NO:95, SEQ ID NO:97, SEQ ID NO:101, SEQ ID NO:103, SEQ ID NO:105, SEQ ID NO:107, SEQ ID NO:109, SEQ ID NO:113, SEQ ID NO:118, SEQ ID NO:123, SEQ ID NO:125, SEQ ID NO:129, SEQ ID NO:133, SEQ ID NO:138, SEQ ID NO:140, SEQ ID NO:142, SEQ ID NO:144, SEQ ID NO:148, SEQ ID NO:150, SEQ ID NO:156, SEQ ID NO:158, SEQ ID NO:160, SEQ ID NO:162, SEQ ID NO:164, SEQ ID NO:169, SEQ ID NO:171, SEQ ID NO:177, SEQ ID NO:195, SEQ ID NO:197, SEQ ID NO:216, SEQ ID NO:218, SEQ ID NO:220, SEQ ID NO:252, SEQ ID NO:254, SEQ ID NO:257, SEQ ID NO:259, SEQ ID NO:261, SEQ ID NO:266, SEQ ID NO:268, SEQ ID NO:271, SEQ ID NO:274, SEQ ID NO:278, SEQ ID NO:281, SEQ ID NO:283, SEQ ID NO:285, SEQ ID NO:288, SEQ ID NO:291, SEQ ID NO:293, SEQ ID NO:299, SEQ ID NO:301, SEQ ID NO:303, SEQ ID NO:305, SEQ ID NO:307, SEQ ID NO:314, SEQ ID NO:317, SEQ ID NO:320, SEQ ID NO:322, SEQ ID NO:324, SEQ ID NO:327, SEQ ID NO:329, SEQ ID NO:331, SEQ ID NO:333, SEQ ID NO:336, SEQ ID NO:338, SEQ ID NO:342, SEQ ID NO:344, SEQ ID NO:346, SEQ ID NO:352, SEQ ID NO:354, SEQ ID NO:356, SEQ ID NO:360, SEQ ID NO:369, SEQ ID NO:371, SEQ ID NO:373, SEQ ID NO:376, SEQ ID NO:378, SEQ ID NO:380, SEQ ID NO:386, SEQ ID NO:390, SEQ ID NO:393, SEQ ID NO:399, SEQ ID NO:401, SEQ ID NO:404, SEQ ID NO:406, SEQ ID NO:408, SEQ ID NO:410, SEQ ID NO:412, SEQ ID NO:414, SEQ ID NO:416, SEQ ID NO:431, SEQ ID NO:435, SEQ ID NO:437, SEQ ID NO:439, SEQ ID NO:441, SEQ ID NO:444, SEQ ID NO:448, SEQ ID NO:450, SEQ ID NO:453, SEQ ID NO:458, SEQ ID NO:460, SEQ ID NO:464, SEQ ID NO:469, SEQ ID NO:472, SEQ ID NO:474, SEQ ID NO:477, SEQ ID NO:482, SEQ ID NO:486, SEQ ID NO:489, SEQ ID NO:491, SEQ ID NO:493, SEQ ID NO:495, SEQ ID NO:500, SEQ ID NO:503, SEQ ID NO:507, SEQ ID NO:509, SEQ ID NO:515, SEQ ID NO:517, SEQ ID NO:519, SEQ ID NO:523, SEQ ID NO:525, SEQ ID NO:528, SEQ ID NO:534, SEQ ID NO:536, SEQ ID NO:538, SEQ ID NO:540, SEQ ID NO:542, SEQ ID NO:544, SEQ ID NO:547, SEQ ID NO:552, SEQ ID NO:554, SEQ ID NO:562, SEQ ID NO:565, SEQ ID NO:569, SEQ ID NO:571, SEQ ID NO:573, SEQ ID NO:577, SEQ ID NO:580, SEQ ID NO:582, SEQ ID NO:584, SEQ ID NO:589, SEQ ID NO:592, SEQ ID NO:595, SEQ ID NO:598, SEQ ID NO:600, SEQ ID NO:602, SEQ ID NO:605, SEQ ID NO:607, SEQ ID NO:609, SEQ ID NO:611, SEQ ID NO:613, SEQ ID NO:618, SEQ ID NO:620, SEQ ID NO:637, SEQ ID NO:649, SEQ ID NO:651, SEQ ID NO:655, SEQ ID NO:658, SEQ ID NO:660, SEQ ID NO:664, SEQ ID NO:670, SEQ ID NO:674, SEQ ID NO:677, SEQ ID NO:679, SEQ ID NO:681, SEQ ID NO:683, SEQ ID NO:685, SEQ ID NO:688, SEQ ID NO:694, SEQ ID NO:697, SEQ ID NO:699, SEQ ID NO:702, SEQ ID NO:704, SEQ ID NO:706, SEQ ID NO:708, SEQ ID NO:712, SEQ ID NO:714, SEQ ID NO:717, SEQ ID NO:719, SEQ ID NO:721, SEQ ID NO:723, SEQ ID NO:729, SEQ ID NO:736, SEQ ID NO:741, SEQ ID NO:743, SEQ ID NO:746, SEQ ID NO:752, SEQ ID NO:754, SEQ ID NO:759, SEQ ID NO:764, SEQ ID NO:778, SEQ ID NO:780, SEQ ID NO:785, SEQ ID NO:789, SEQ ID NO:792, SEQ ID NO:795, SEQ ID NO:797, SEQ ID NO:799, SEQ ID NO:801, SEQ ID NO:807, SEQ ID NO:810, SEQ ID NO:813, SEQ ID NO:815, SEQ ID NO:819, SEQ ID NO:821, SEQ ID NO:823, SEQ ID NO:827, SEQ ID NO:829, SEQ ID NO:832, SEQ ID NO:834, SEQ ID NO:837, SEQ ID NO:840, SEQ ID NO:842, SEQ ID NO:848, SEQ ID NO:851, SEQ ID NO:854, SEQ ID NO:858, SEQ ID NO:860, SEQ ID NO:864, SEQ ID NO:867, SEQ ID NO:884, SEQ ID NO:889, SEQ ID NO:891, SEQ ID NO:893, SEQ ID NO:895, SEQ ID NO:897, SEQ ID NO:899, SEQ ID NO:903, SEQ ID NO:906, SEQ ID NO:911, SEQ ID NO:913, SEQ ID NO:916, SEQ ID NO:918, SEQ ID NO:920, SEQ ID NO:926, SEQ ID NO:928, SEQ ID NO:933, SEQ ID NO:935, SEQ ID NO:937, SEQ ID NO:942, SEQ ID NO:944, SEQ ID NO:958, SEQ ID NO:963, SEQ ID NO:965, SEQ ID NO:967, SEQ ID NO:972, SEQ ID NO:974, SEQ ID NO:979, SEQ ID NO:981, SEQ ID NO:993, SEQ ID NO:1006, SEQ ID NO:1010, SEQ ID NO:1015, SEQ ID NO:1027, SEQ ID NO:1030, SEQ ID NO:1034, SEQ ID NO:1049, SEQ ID NO:1051, SEQ ID NO:1054, SEQ ID NO:1057, SEQ ID NO:1059, SEQ ID NO:1061, SEQ ID NO:1063, SEQ ID NO:1067, SEQ ID NO:1070, SEQ ID NO:1077, SEQ ID NO:1080, SEQ ID NO:1082, SEQ ID NO:1084, SEQ ID NO:1086, SEQ ID NO:1090, SEQ ID NO:1093, SEQ ID NO:1095, SEQ ID NO:1097, SEQ ID NO:1103, SEQ ID NO:1108, SEQ ID NO:1116, SEQ ID NO:1121, SEQ ID NO:1124, SEQ ID NO:1128, SEQ ID NO:1130, SEQ ID NO:1133, SEQ ID NO:1135, SEQ ID NO:1138, SEQ ID NO:1142, SEQ ID NO:1148, SEQ ID NO:1155, SEQ ID NO:1158, SEQ ID NO:1160, SEQ ID NO:1162, SEQ ID NO:1164, SEQ ID NO:1170, SEQ ID NO:1172, SEQ ID NO:1175, SEQ ID NO:1182, SEQ ID NO:1184, SEQ ID NO:1208, SEQ ID NO:1210, SEQ ID NO:1212, SEQ ID NO:1214, SEQ ID NO:1216, SEQ ID NO:1218, SEQ ID NO:1220, SEQ ID NO:1222, SEQ ID NO:1224, SEQ ID NO:1236, SEQ ID NO:1238, SEQ ID NO:1240, SEQ ID NO:1242, SEQ ID NO:1244, SEQ ID NO:1246, SEQ ID NO:1248, SEQ ID NO:1250, SEQ ID NO:1252, SEQ ID NO:1254, SEQ ID NO:1256, SEQ ID NO:1258, SEQ ID NO:1260, SEQ ID NO:1262, SEQ ID NO:1264, SEQ ID NO:1266, SEQ ID NO:1268, SEQ ID NO:1270, SEQ ID NO:1272, SEQ ID NO:1274, SEQ ID NO:1276, SEQ ID NO:1278, SEQ ID NO:1280, SEQ ID NO:1282, SEQ ID NO:1284, SEQ ID NO:1291, SEQ ID NO:1293, SEQ ID NO:1295, SEQ ID NO:1297, SEQ ID NO:1299, SEQ ID NO:1301, SEQ ID NO:1310, SEQ ID NO:1312, SEQ ID NO:1314, SEQ ID NO:1316, SEQ ID NO:1318, SEQ ID NO:1320, SEQ ID NO:1322, SEQ ID NO:1324, SEQ ID NO:1326, SEQ ID NO:1328, SEQ ID NO:1330, SEQ ID NO:1332, SEQ ID NO:1334, SEQ ID NO:1336, SEQ ID NO:1338, SEQ ID NO:1340, SEQ ID NO:1342, SEQ ID NO:1344, SEQ ID NO:1346, SEQ ID NO:1348, SEQ ID NO:1350, SEQ ID NO:1352, SEQ ID NO:1354, SEQ ID NO:1356, SEQ ID NO:1358, SEQ ID NO:1360, SEQ ID NO:1368, SEQ ID NO:1370, SEQ ID NO:1372, SEQ ID NO:1374, SEQ ID NO:1376, SEQ ID NO:1378, SEQ ID NO:1380, SEQ ID NO:1382, SEQ ID NO:1384, SEQ ID NO:1386, SEQ ID NO:1388, SEQ ID NO:1390, SEQ ID NO:1392, SEQ ID NO:1394, SEQ ID NO:1396, SEQ ID NO:1398, SEQ ID NO:1400, SEQ ID NO:1402, SEQ ID NO:1404, SEQ ID NO:1411, SEQ ID NO:1413, SEQ ID NO:1416, SEQ ID NO:1418, SEQ ID NO:1420, SEQ ID NO:1422, SEQ ID NO:1430, SEQ ID NO:1432, SEQ ID NO:1434, SEQ ID NO:1435, SEQ ID NO:1443, SEQ ID NO:1464, SEQ ID NO:1466, SEQ ID NO:1468, SEQ ID NO:1470, SEQ ID NO:1472, SEQ ID NO:1474, SEQ ID NO:1476, SEQ ID NO:1478, SEQ ID NO:1480, SEQ ID NO:1482, SEQ ID NO:1484, SEQ ID NO:1486, SEQ ID NO:1492, SEQ ID NO:1501, SEQ ID NO:1503, SEQ ID NO:1517, SEQ ID NO:1519, SEQ ID NO:1521, SEQ ID NO:1523, SEQ ID NO:1525, SEQ ID NO:1527, SEQ ID NO:1535, SEQ ID NO:1537, SEQ ID NO:1539, SEQ ID NO:1541, SEQ ID NO:1543, SEQ ID NO:1545, SEQ ID NO:1547, SEQ ID NO:1549, SEQ ID NO:1551, SEQ ID NO:1553, SEQ ID NO:1555, SEQ ID NO:1557, SEQ ID NO:1559, SEQ ID NO:1561, SEQ ID NO:1563, SEQ ID NO:1565, SEQ ID NO:1567, SEQ ID NO:1569, SEQ ID NO:1572, SEQ ID NO:1574, SEQ ID NO:1576, SEQ ID NO:1578, SEQ ID NO:1580, SEQ ID NO:1582, SEQ ID NO:1584, SEQ ID NO:1586, SEQ ID NO:1588, SEQ ID NO:1590, SEQ ID NO:1592, SEQ ID NO:1594, SEQ ID NO:1609, SEQ ID NO:1611, SEQ ID NO:1613, SEQ ID NO:1615, SEQ ID NO:1617, SEQ ID NO:1619, SEQ ID NO:1623, SEQ ID NO:1625, SEQ ID NO:1627, SEQ ID NO:1629, SEQ ID NO:1631, SEQ ID NO:1636, SEQ ID NO:1652, SEQ ID NO:1656, SEQ ID NO:1658, SEQ ID NO:1660, SEQ ID NO:1662, SEQ ID NO:1664, SEQ ID NO:1666, SEQ ID NO:1668, SEQ ID NO:1670, SEQ ID NO:1672, SEQ ID NO:1674, SEQ ID NO:1680, SEQ ID NO:1682, SEQ ID NO:1691, SEQ ID NO:1693, SEQ ID NO:1695, SEQ ID NO:1697, SEQ ID NO:1699, SEQ ID NO:1701, SEQ ID NO:1703, SEQ ID NO:1705, SEQ ID NO:1707, SEQ ID NO:1709, SEQ ID NO:1711, SEQ ID NO:1713, SEQ ID NO:1715, SEQ ID NO:1717, SEQ ID NO:1719, SEQ ID NO:1721, SEQ ID NO:1723, SEQ ID NO:1725, SEQ ID NO:1727, SEQ ID NO:1732, SEQ ID NO:1734, SEQ ID NO:1748, SEQ ID NO:1751, SEQ ID NO:1766, SEQ ID NO:1776, SEQ ID NO:1778, SEQ ID NO:1780, SEQ ID NO:1782, SEQ ID NO:1784, SEQ ID NO:1805, SEQ ID NO:1821, SEQ ID NO:1823, SEQ ID NO:1825, SEQ ID NO:1827, SEQ ID NO:1829, SEQ ID NO:1831, SEQ ID NO:1833, SEQ ID NO:1835, SEQ ID NO:1837, SEQ ID NO:1839, SEQ ID NO:1841, SEQ ID NO:1843, SEQ ID NO:1845, SEQ ID NO:1847, SEQ ID NO:1849, SEQ ID NO:1851, SEQ ID NO:1853, SEQ ID NO:1855, SEQ ID NO:1857, SEQ ID NO:1859, SEQ ID NO:1861, SEQ ID NO:1863, SEQ ID NO:1865, SEQ ID NO:1867, SEQ ID NO:1869, SEQ ID NO:1871, SEQ ID NO:1873, SEQ ID NO:1875, SEQ ID NO:1877, SEQ ID NO:1879, SEQ ID NO:1881, SEQ ID NO:1883, SEQ ID NO:1885, SEQ ID NO:1887, SEQ ID NO:1889, SEQ ID NO:1891, SEQ ID NO:1896, SEQ ID NO:1898, SEQ ID NO:1900, SEQ ID NO:1903, SEQ ID NO:1905, SEQ ID NO:1907, SEQ ID NO:1919, SEQ ID NO:1920, SEQ ID NO:2060, SEQ ID NO:2062, SEQ ID NO:2064, SEQ ID NO:2084, SEQ ID NO:2088, SEQ ID NO:2090, SEQ ID NO:2092, SEQ ID NO:2094, SEQ ID NO:2096, SEQ ID NO:2098, SEQ ID NO:2100, SEQ ID NO:2102, SEQ ID NO:2104, SEQ ID NO:2106, SEQ ID NO:2108, SEQ ID NO:2110, SEQ ID NO:2112, SEQ ID NO:2114, SEQ ID NO:2116, SEQ ID NO:2118, SEQ ID NO:2120, SEQ ID NO:2122, SEQ ID NO:2124, SEQ ID NO:2126, SEQ ID NO:2128, SEQ ID NO:2130, SEQ ID NO:2132, SEQ ID NO:2134, SEQ ID NO:2136, SEQ ID NO:2138, SEQ ID NO:2140, SEQ ID NO:2142, SEQ ID NO:2144, SEQ ID NO:2146, SEQ ID NO:2148, SEQ ID NO:2150, SEQ ID NO:2152, SEQ ID NO:2154, SEQ ID NO:2156, SEQ ID NO:2158, SEQ ID NO:2160, SEQ ID NO:2161, SEQ ID NO:2163, SEQ ID NO:2165, SEQ ID NO:6167, SEQ ID NO:2169, SEQ ID NO:2171, SEQ ID NO:2173, SEQ ID NO:2175, SEQ ID NO:2177, SEQ ID NO:2179, SEQ ID NO:2181, SEQ ID NO:2183, SEQ ID NO:2185, SEQ ID NO:2187, SEQ ID NO:2189, SEQ ID NO:2191, SEQ ID NO:2193, SEQ ID NO:2195, SEQ ID NO:2197, SEQ ID NO:2199, SEQ ID NO:2201, SEQ ID NO:2203, SEQ ID NO:2205, SEQ ID NO:2207, SEQ ID NO:2209, SEQ ID NO:2211, SEQ ID NO:2213, SEQ ID NO:2215, SEQ ID NO:2217, SEQ ID NO:2219, SEQ ID NO:2221, SEQ ID NO:2223, SEQ ID NO:2225, SEQ ID NO:2227, SEQ ID NO:2229, SEQ ID NO:2231, SEQ ID NO:2233, SEQ ID NO:2235, SEQ ID NO:2237, SEQ ID NO:2239, SEQ ID NO:2241, SEQ ID NO:2243, SEQ ID NO:2245, SEQ ID NO:2247, SEQ ID NO:2249, SEQ ID NO:2251, SEQ ID NO:2253, SEQ ID NO:2255, SEQ ID NO:2257, SEQ ID NO:2259, SEQ ID NO:2261, SEQ ID NO:2263, SEQ ID NO:2265, SEQ ID NO:2267, SEQ ID NO:2269, SEQ ID NO:2271, SEQ ID NO:2273, SEQ ID NO:2275, SEQ ID NO:2277, SEQ ID NO:2279, SEQ ID NO:2281, SEQ ID NO:2283, SEQ ID NO:2285, SEQ ID NO:2287, SEQ ID NO:2289, SEQ ID NO:2291, SEQ ID NO:2293, SEQ ID NO:2295, SEQ ID NO:2297, SEQ ID NO:2299, SEQ ID NO:2301, SEQ ID NO:2303, SEQ ID NO:2305, SEQ ID NO:2307, SEQ ID NO:2309, SEQ ID NO:2311, SEQ ID NO:2313, SEQ ID NO:2315, SEQ ID NO:2317, SEQ ID NO:2319, SEQ ID NO:2321, SEQ ID NO:2323, SEQ ID NO:2325, SEQ ID NO:2327, SEQ ID NO:2329, SEQ ID NO:2331, SEQ ID NO:2333, SEQ ID NO:2335, SEQ ID NO:2337, SEQ ID NO:2339, SEQ ID NO:2341, SEQ ID NO:2343, SEQ ID NO:2345, SEQ ID NO:2347, and SEQ ID NO:2349-2690. In some cases, a recombinant nucleic acid construct can include a nucleic acid comprising a coding sequence, a gene, or a fragment of a coding sequence or gene in an antisense orientation so that the antisense strand of RNA is transcribed.

It will be appreciated that a number of nucleic acids can encode a polypeptide having a particular amino acid sequence. The degeneracy of the genetic code is well known to the art; i.e., for many amino acids, there is more than one nucleotide triplet that serves as the codon for the amino acid. For example, codons in the coding sequence for a given regulatory protein can be modified such that optimal expression in a particular plant species is obtained, using appropriate codon bias tables for that species.

A nucleic acid also can comprise a nucleotide sequence corresponding to any of the regulatory regions as set forth in SEQ ID NOs:1-94 or SEQ ID NOs:1909-1918. In some cases, a nucleic acid can comprise a nucleotide sequence corresponding to any of the regulatory regions set forth in SEQ ID NOs:1-94 or SEQ ID NOs:1909-1918, and a coding sequence that encodes any of the regulatory proteins set forth in SEQ ID NO:96, SEQ ID NOs:98-100, SEQ ID NO:102, SEQ ID NO:104, SEQ ID NO:106, SEQ ID NO:108, SEQ ID NOs:110-112, SEQ ID NOs:114-117, SEQ ID NOs:119-122, SEQ ID NO:124, SEQ ID NOs:126-128, SEQ ID NOs:130-132, SEQ ID NOs:134-137, SEQ ID NO:139, SEQ ID NO:141, SEQ ID NO:143, SEQ ID NOs:145-147, SEQ ID NO:149, SEQ ID NOs:151-155, SEQ ID NO:157, SEQ ID NO:159, SEQ ID NO:161, SEQ ID NO:163, SEQ ID NOs:165-168, SEQ ID NO:170, SEQ ID NOs:172-176, SEQ ID NOs:178-194, SEQ ID NO:196, SEQ ID NOs:198-215, SEQ ID NO:217, SEQ ID NO:219, SEQ ID NOs:221-251, SEQ ID NO:253, SEQ ID NOs:255-256, SEQ ID NO:258, SEQ ID NO:260, SEQ ID NOs:262-265, SEQ ID NO:267, SEQ ID NOs:269-270, SEQ ID NOs:272-273, SEQ ID NOs:275-277, SEQ ID NOs:279-280, SEQ ID NO:282, SEQ ID NO:284, SEQ ID NOs:286-287, SEQ ID NOs:289-290, SEQ ID NO:292, SEQ ID NOs:294-298, SEQ ID NO:300, SEQ ID NO:302, SEQ ID NO:304, SEQ ID NO:306, SEQ ID NOs:308-313, SEQ ID NOs:315-316, SEQ ID NOs:318-319, SEQ ID NO:321, SEQ ID NO:323, SEQ ID NOs:325-326, SEQ ID NO:328, SEQ ID NO:330, SEQ ID NO:332, SEQ ID NOs:334-335, SEQ ID NO:337, SEQ ID NO:339-341, SEQ ID NO:343, SEQ ID NO:345, SEQ ID NO:347-351, SEQ ID NO:353, SEQ ID NO:355, SEQ ID NO:357-359, SEQ ID NOs:361-368, SEQ ID NO:370, SEQ ID NO:372, SEQ ID NOs:374-375, SEQ ID NO:377, SEQ ID NO:379, SEQ ID NOs:381-385, SEQ ID NOs:387-389, SEQ ID NOs:391-392, SEQ ID NOs:394-398, SEQ ID NO:400, SEQ ID NOs:402-403, SEQ ID NO:405, SEQ ID NO:407, SEQ ID NO:409, SEQ ID NO:411, SEQ ID NO:413, SEQ ID NO:415, SEQ ID NOs:417-430, SEQ ID NOs:432-434, SEQ ID NO:436, SEQ ID NO:438, SEQ ID NO:440, SEQ ID NOs:442-443, SEQ ID NOs:445-447, SEQ ID NO:449, SEQ ID NOs:451-452, SEQ ID NOs:454-457, SEQ ID NO:459, SEQ ID NOs:461-463, SEQ ID NOs:465-468, SEQ ID NOs:470-471, SEQ ID NO:473, SEQ ID NOs:475-476, SEQ ID NOs:478-481, SEQ ID NOs:483-485, SEQ ID NOs:487-488, SEQ ID NO:490, SEQ ID NO:492, SEQ ID NO:494, SEQ ID NOs:496-499, SEQ ID NOs:501-502, SEQ ID NOs:504-506, SEQ ID NO:508, SEQ ID NOs:510-514, SEQ ID NO:516, SEQ ID NO:518, SEQ ID NOs:520-522, SEQ ID NO:524, SEQ ID NOs:526-527, SEQ ID NOs:529-533, SEQ ID NO:535, SEQ ID NO:537, SEQ ID NO:539, SEQ ID NO:541, SEQ ID NO:543, SEQ ID NOs:545-546, SEQ ID NOs:548-551, SEQ ID NO:553, SEQ ID NOs:555-561, SEQ ID NOs:563-564, SEQ ID NOs:566-568, SEQ ID NO:570, SEQ ID NO:572, SEQ ID NOs:574-576, SEQ ID NOs:578-579, SEQ ID NO:581, SEQ ID NO:583, SEQ ID NOs:585-588, SEQ ID NOs:590-591, SEQ ID NOs:593-594, SEQ ID NOs:596-597, SEQ ID NO:599, SEQ ID NO:601, SEQ ID NOs:603-604, SEQ ID NO:606, SEQ ID NO:608, SEQ ID NO:610, SEQ ID NO:612, SEQ ID NOs:614-617, SEQ ID NO:619, SEQ ID NOs:621-636, SEQ ID NOs:638-648, SEQ ID NO:650, SEQ ID NOs:652-654, SEQ ID NOs:656-657, SEQ ID NO:659, SEQ ID NOs:661-663, SEQ ID NOs:665-669, SEQ ID NOs:671-673, SEQ ID NOs:675-676, SEQ ID NO:678, SEQ ID NO:680, SEQ ID NO:682, SEQ ID NO:684, SEQ ID NOs:686-687, SEQ ID NOs:689-693, SEQ ID NOs:695-696, SEQ ID NO:698, SEQ ID NOs:700-701, SEQ ID NO:703, SEQ ID NO:705, SEQ ID NO:707, SEQ ID NOs:709-711, SEQ ID NO:713, SEQ ID NOs:715-716, SEQ ID NO:718, SEQ ID NO:720, SEQ ID NO:722, SEQ ID NOs:724-728, SEQ ID NOs:730-735, SEQ ID NOs:737-740, SEQ ID NO:742, SEQ ID NOs:744-745, SEQ ID NOs:747-751, SEQ ID NO:753, SEQ ID NOs:755-758, SEQ ID NOs:760-763, SEQ ID NOs:765-777, SEQ ID NO:779, SEQ ID NOs:781-784, SEQ ID NOs:786-788, SEQ ID NOs:790-791, SEQ ID NOs:793-794, SEQ ID NO:796, SEQ ID NO:798, SEQ ID NO:800, SEQ ID NOs:802-806, SEQ ID NOs:808-809, SEQ ID NOs:811-812, SEQ ID NO:814, SEQ ID NOs:816-818, SEQ ID NO:820, SEQ ID NO:822, SEQ ID NOs:824-826, SEQ ID NO:828, SEQ ID NOs:830-831, SEQ ID NO:833, SEQ ID NOs:835-836, SEQ ID NOs:838-839, SEQ ID NO:841, SEQ ID NOs:843-847, SEQ ID NOs:849-850, SEQ ID NOs:852-853, SEQ ID NOs:855-857, SEQ ID NO:859, SEQ ID NOs:861-863, SEQ ID NOs:865-866, SEQ ID NOs:868-883, SEQ ID NOs:885-888, SEQ ID NO:890, SEQ ID NO:892, SEQ ID NO:894, SEQ ID NO:896, SEQ ID NO:898, SEQ ID NOs:900-902, SEQ ID NOs:904-905, SEQ ID NOs:907-910, SEQ ID NO:912, SEQ ID NOs:914-915, SEQ ID NO:917, SEQ ID NO:919, SEQ ID NOs:921-925, SEQ ID NO:927, SEQ ID NOs:929-932, SEQ ID NO:934, SEQ ID NO:936, SEQ ID NOs:938-941, SEQ ID NO:943 SEQ ID NOs:945-957, SEQ ID NOs:959-962, SEQ ID NO:964, SEQ ID NO:966, SEQ ID NOs:968-971, SEQ ID NO:973, SEQ ID NOs:975-978, SEQ ID NO:980, SEQ ID NOs:982-992, SEQ ID NOs:994-1005, SEQ ID NOs:1007-1009, SEQ ID NOs:1011-1014, SEQ ID NOs:1016-1026, SEQ ID NOs:1028-1029, SEQ ID NOs: 1031-1033, SEQ ID NOs:1035-1048, SEQ ID NO:1050, SEQ ID NOs:1052-1053, SEQ ID NOs:1055-1056, SEQ ID NO:1058, SEQ ID NO:1060, SEQ ID NO:1062, SEQ ID NOs:1064-1066, SEQ ID NOs:1068-1069, SEQ ID NOs: 1071-1076, SEQ ID NOs:1078-1079, SEQ ID NO:1081, SEQ ID NO:1083, SEQ ID NO:1085, SEQ ID NOs:1087-1089, SEQ ID NOs:1091-1092, SEQ ID NO:1094, SEQ ID NO:1096, SEQ ID NOs:1098-1102, SEQ ID NOs:1104-1107, SEQ ID NOs:1109-1115, SEQ ID NOs:1117-1120, SEQ ID NOs:1122-1123, SEQ ID NOs:1125-1127, SEQ ID NO:1129, SEQ ID NOs:1131-1132, SEQ ID NO:1134, SEQ ID NOs:1136-1137, SEQ ID NOs:1139-1141, SEQ ID NOs:1143-1147, SEQ ID NOs:1149-1154, SEQ ID NOs:1156-1157, SEQ ID NO:1159, SEQ ID NO:1161, SEQ ID NO:1163, SEQ ID NOs:1165-1169, SEQ ID NO:1171, SEQ ID NOs:1173-1174, SEQ ID NOs:1176-1181, SEQ ID NO:1183, SEQ ID NOs:1185-1207, SEQ ID NO:1209, SEQ ID NO:1211, SEQ ID NO:1213, SEQ ID NO:1215, SEQ ID NO:1217, SEQ ID NO:1219, SEQ ID NO:1221, SEQ ID NO:1223, SEQ ID NOs:1225-1235, SEQ ID NO:1237, SEQ ID NO:1239, SEQ ID NO:1241, SEQ ID NO:1243, SEQ ID NO:1245, SEQ ID NO:1247, SEQ ID NO:1249, SEQ ID NO:1251, SEQ ID NO:1253, SEQ ID NO:1255, SEQ ID NO:1257, SEQ ID NO:1259, SEQ ID NO:1261, SEQ ID NO:1263, SEQ ID NO:1265, SEQ ID NO:1267, SEQ ID NO:1269, SEQ ID NO:1271, SEQ ID NO:1273, SEQ ID NO:1275, SEQ ID NO:1277, SEQ ID NO:1279, SEQ ID NO:1281, SEQ ID NO:1283, SEQ ID NOs:1285-1290, SEQ ID NO:1292, SEQ ID NO:1294, SEQ ID NO:1296, SEQ ID NO:1298, SEQ ID NO:1300, SEQ ID NOs:1302-1309, SEQ ID NO:1311, SEQ ID NO:1313, SEQ ID NO:1315, SEQ ID NO:1317, SEQ ID NO:1319, SEQ ID NO:1321, SEQ ID NO:1323, SEQ ID NO:1325, SEQ ID NO:1327, SEQ ID NO:1329, SEQ ID NO:1331, SEQ ID NO:1333, SEQ ID NO:1335, SEQ ID NO:1337, SEQ ID NO:1339, SEQ ID NO:1341, SEQ ID NO:1343, SEQ ID NO:1345, SEQ ID NO:1347, SEQ ID NO:1349, SEQ ID NO:1351, SEQ ID NO:1353, SEQ ID NO:1355, SEQ ID NO:1357, SEQ ID NO:1359, SEQ ID NOs:1361-1367, SEQ ID NO:1369, SEQ ID NO:1371, SEQ ID NO:1373, SEQ ID NO:1375, SEQ ID NO:1377, SEQ ID NO:1379, SEQ ID NO:1381, SEQ ID NO:1383, SEQ ID NO:1385, SEQ ID NO:1387, SEQ ID NO:1389, SEQ ID NO:1391, SEQ ID NO:1393, SEQ ID NO:1395, SEQ ID NO:1397, SEQ ID NO:1399, SEQ ID NO:1401, SEQ ID NO:1403, SEQ ID NOs:1405-1410, SEQ ID NO:1412, SEQ ID NOs:1414-1415, SEQ ID NO:1417, SEQ ID NO:1419, SEQ ID NO:1421, SEQ ID NOs:1423-1429, SEQ ID NO:1431, SEQ ID NO:1433, SEQ ID NOs:1436-1442, SEQ ID NOs:1444-1463, SEQ ID NO:1465, SEQ ID NO:1467, SEQ ID NO:1469, SEQ ID NO:1471, SEQ ID NO:1473, SEQ ID NO:1475, SEQ ID NO:1477, SEQ ID NO:1479, SEQ ID NO:1481, SEQ ID NO:1483, SEQ ID NO:1485, SEQ ID NOs:1487-1491, SEQ ID NOs:1493-1500, SEQ ID NO:1502, SEQ ID NOs:1504-1516, SEQ ID NO:1518, SEQ ID NO:1520, SEQ ID NO:1522, SEQ ID NO:1524, SEQ ID NO:1526, SEQ ID NOs:1528-1534, SEQ ID NO:1536, SEQ ID NO:1538, SEQ ID NO:1540, SEQ ID NO:1542, SEQ ID NO:1544, SEQ ID NO:1546, SEQ ID NO:1548, SEQ ID NO:1550, SEQ ID NO:1552, SEQ ID NO:1554, SEQ ID NO:1556, SEQ ID NO:1558, SEQ ID NO:1560, SEQ ID NO:1562, SEQ ID NO:1564, SEQ ID NO:1566, SEQ ID NO:1568, SEQ ID NOs:1570-1571, SEQ ID NO:1573, SEQ ID NO:1575, SEQ ID NO:1577, SEQ ID NO:1579, SEQ ID NO:1581, SEQ ID NO:1583, SEQ ID NO:1585, SEQ ID NO:1587, SEQ ID NO:1589, SEQ ID NO:1591, SEQ ID NO:1593, SEQ ID NOs:1595-1608, SEQ ID NO:1610, SEQ ID NO:1612, SEQ ID NO:1614, SEQ ID NO:1616, SEQ ID NO:1618, SEQ ID NOs:1620-1622, SEQ ID NO:1624, SEQ ID NO:1626, SEQ ID NO:1628, SEQ ID NO:1630, SEQ ID NOs:1632-1635, SEQ ID NOs:1637-1651, SEQ ID NOs:1653-1655, SEQ ID NO:1657, SEQ ID NO:1659, SEQ ID NO:1661, SEQ ID NO:1663, SEQ ID NO:1665, SEQ ID NO:1667, SEQ ID NO:1669, SEQ ID NO:1671, SEQ ID NO:1673, SEQ ID NOs:1675-1679, SEQ ID NO:1681, SEQ ID NOs:1683-1690, SEQ ID NO:1692, SEQ ID NO:1694, SEQ ID NO:1696, SEQ ID NO:1698, SEQ ID NO:1700, SEQ ID NO:1702, SEQ ID NO:1704, SEQ ID NO:1706, SEQ ID NO:1708, SEQ ID NO:1710; SEQ ID NO:1712, SEQ ID NO:1714, SEQ ID NO:1716, SEQ ID NO:1718, SEQ ID NO:1720, SEQ ID NO:1722, SEQ ID NO:1724, SEQ ID NO:1726, SEQ ID NOs:1728-1731, SEQ ID NO:1733, SEQ ID NOs:1735-1747, SEQ ID NOs:1749-1750, SEQ ID NOs:1752-1765, SEQ ID NOs:1767-1775, SEQ ID NO:1777, SEQ ID NO:1779, SEQ ID NO:1781, SEQ ID NO:1783, SEQ ID NOs:1785-1804, SEQ ID NOs:1806-1820, SEQ ID NO:1822, SEQ ID NO:1824, SEQ ID NO:1826, SEQ ID NO:1828, SEQ ID NO:1830, SEQ ID NO:1832, SEQ ID NO:1834, SEQ ID NO:1836, SEQ ID NO:1838, SEQ ID NO:1840, SEQ ID NO:1842, SEQ ID NO:1844, SEQ ID NO:1846, SEQ ID NO:1848, SEQ ID NO:1850, SEQ ID NO:1852, SEQ ID NO:1854, SEQ ID NO:1856, SEQ ID NO:1858, SEQ ID NO:1860, SEQ ID NO:1862, SEQ ID NO:1864, SEQ ID NO:1866, SEQ ID NO:1868, SEQ ID NO:1870, SEQ ID NO:1872, SEQ ID NO:1874, SEQ ID NO:1876, SEQ ID NO:1878, SEQ ID NO:1880, SEQ ID NO:1882, SEQ ID NO:1884, SEQ ID NO:1886, SEQ ID NO:1888, SEQ ID NO:1890, SEQ ID NOs:1892-1895, SEQ ID NO:1897, SEQ ID NO:1899, SEQ ID NOs:1901-1902, SEQ ID NO:1904, SEQ ID NO:1906, SEQ ID NO:1908, SEQ ID NOs:1921-2059, SEQ ID NO:2061, SEQ ID NO:2063, SEQ ID NOs:2065-2083, SEQ ID NO:2085, or SEQ ID NO:2087.

The terms "nucleic acid" and "polynucleotide" are used interchangeably herein, and refer both to RNA and DNA, including cDNA, genomic DNA, synthetic DNA, and DNA (or RNA) containing nucleic acid analogs. Polynucleotides can have any three-dimensional structure. A nucleic acid can be double-stranded or single-stranded (i.e., a sense strand or an antisense strand). Non-limiting examples of polynucleotides include genes, gene fragments, exons, introns, messenger RNA (mRNA), transfer RNA, ribosomal RNA, siRNA, micro-RNA, ribozymes, cDNA, recombinant polynucleotides, branched polynucleotides, plasmids, vectors, isolated DNA of any sequence, isolated RNA of any sequence, nucleic acid probes, and primers, as well as nucleic acid analogs.

An isolated nucleic acid can be, for example, a naturally-occurring DNA molecule, provided one of the nucleic acid sequences normally found immediately flanking that DNA molecule in a naturally-occurring genome is removed or absent. Thus, an isolated nucleic acid includes, without limitation, a DNA molecule that exists as a separate molecule, independent of other sequences (e.g., a chemically synthesized nucleic acid, or a cDNA or genomic DNA fragment produced by the polymerase chain reaction (PCR) or restriction endonuclease treatment). An isolated nucleic acid also refers to a DNA molecule that is incorporated into a vector, an autonomously replicating plasmid, a virus, or into the genomic DNA of a prokaryote or eukaryote. In addition, an isolated nucleic acid can include an engineered nucleic acid such as a DNA molecule that is part of a hybrid or fusion nucleic acid. A nucleic acid existing among hundreds to millions of other nucleic acids within, for example, cDNA libraries or genomic libraries, or gel slices containing a genomic DNA restriction digest, is not to be considered an isolated nucleic acid.

Isolated nucleic acid molecules can be produced by standard techniques. For example, polymerase chain reaction (PCR) techniques can be used to obtain an isolated nucleic acid containing a nucleotide sequence described herein. PCR can be used to amplify specific sequences from DNA as well as RNA, including sequences from total genomic DNA or total cellular RNA. Various PCR methods are described, for example, in *PCR Primer: A Laboratory Manual*, Dieffenbach and Dveksler, eds., Cold Spring Harbor Laboratory Press, 1995. Generally, sequence information from the ends of the region of interest or beyond is employed to design oligonucleotide primers that are identical or similar in sequence to opposite strands of the template to be amplified. Various PCR strategies also are available by which site-specific nucleotide sequence modifications can be introduced into a template nucleic acid. Isolated nucleic acids also can be chemically synthesized, either as a single nucleic acid molecule (e.g., using automated DNA synthesis in the 3' to 5' direction using phosphoramidite technology) or as a series of oligonucleotides. For example, one or more pairs of long oligonucleotides (e.g., >100 nucleotides) can be synthesized that contain the desired sequence, with each pair containing a short segment of complementarity (e.g., about 15 nucleotides) such that a duplex is formed when the oligonucleotide pair is annealed. DNA polymerase is used to extend the oligonucleotides, resulting in a single, double-stranded nucleic acid molecule per oligonucleotide pair, which then can be ligated into a vector. Isolated nucleic acids of the invention also can be obtained by mutagenesis of, e.g., a naturally occurring DNA.

As used herein, the term "percent sequence identity" refers to the degree of identity between any given reference sequence and a subject sequence. A subject sequence typically has a length that is more than 80%, e.g., more than 82%, 85%, 87%, 89%, 90%, 93%, 95%, 97%, 99%, 100%, 105%, 110%, 115%, or 120%, of the length of the reference sequence. A reference nucleic acid or amino acid sequence is aligned to one or more subject nucleic acid or amino acid sequences using the computer program ClustalW (version 1.83, default parameters), which allows alignments of nucleic acid or protein sequences to be carried out across their entire length (global alignment). Chenna et al., *Nucleic Acids Res.*, 31(13):3497-500 (2003).

ClustalW calculates the best match between a reference and one or more subject sequences, and aligns them so that identities, similarities and differences can be determined. Gaps of one or more residues can be inserted into a reference sequence, a subject sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For multiple alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The output is a sequence alignment that reflects the relationship between sequences. ClustalW can be run, for example, at the Baylor College of Medicine Search Launcher site (searchlauncher.bcm.tmc.edu/multi-align/multi-align.html) and at the European Bioinformatics Institute site on the World Wide Web (ebi.ac.uk/clustalw).

To determine a percent identity between a reference sequence and a subject sequence, ClustalW divides the number of identities in the best alignment by the number of residues compared (gap positions are excluded), and multiplies the result by 100. The output is the percent identity of the subject sequence with respect to the reference sequence. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

The term "exogenous" with respect to a nucleic acid indicates that the nucleic acid is part of a recombinant nucleic acid construct, or is not in its natural environment. For example, an exogenous nucleic acid can be a sequence from one species introduced into another species, i.e., a heterologous nucleic acid. Typically, such an exogenous nucleic acid is introduced into the other species via a recombinant nucleic acid construct. An exogenous nucleic acid can also be a sequence that is native to an organism and that has been reintroduced into cells of that organism. An exogenous nucleic acid that includes a native sequence can often be distinguished from the naturally occurring sequence by the presence of non-natural sequences linked to the exogenous nucleic acid, e.g., non-native nucleic acid sequences flanking a native sequence in a recombinant nucleic acid construct. In addition, stably transformed exogenous nucleic acids typically are integrated at positions other than the position where the native sequence is found. It will be appreciated that an exogenous nucleic acid may have been introduced into a progenitor and not into the cell under consideration. For example, a transgenic plant containing an exogenous nucleic acid can be the progeny of a cross between a stably transformed plant and a non-transgenic plant. Such progeny are considered to contain the exogenous nucleic acid.

Similarly, a regulatory protein can be endogenous or exogenous to a particular plant or plant cell. Exogenous regulatory proteins, therefore, can include proteins that are native to a plant or plant cell, but that are expressed in a plant cell via a recombinant nucleic acid construct, e.g., a *Panicum* plant transformed with a recombinant nucleic acid construct encoding a *Panicum* transcription factor.

Likewise, a regulatory region can be exogenous or endogenous to a plant or plant cell. An exogenous regulatory region is a regulatory region that is part of a recombinant nucleic acid construct, or is not in its natural environment. For example, a *Nicotiana* promoter present on a recombinant nucleic acid construct is an exogenous regulatory region when a *Nicotiana* plant cell is transformed with the construct.

A transgenic plant or plant cell in which the amount and/or rate of biosynthesis of one or more sequences of interest is modulated includes at least one recombinant nucleic acid construct, e.g., a nucleic acid construct comprising a nucleic acid encoding a regulatory protein or a nucleic acid construct comprising a regulatory region as described herein. In certain cases, more than one recombinant nucleic acid construct can be included (e.g., two, three, four, five, six, or more recombinant nucleic acid constructs). For example, two recombinant nucleic acid constructs can be included, where one construct includes a nucleic acid encoding one regulatory protein, and another construct includes a nucleic acid encoding a second regulatory protein. In some cases, one construct can include a nucleic acid encoding one regulatory protein, while another includes a regulatory region. In some cases, a plant cell can include a recombinant nucleic acid construct comprising a nucleic acid encoding a regulatory protein and further comprising a regulatory region that associates with the regulatory protein. In such cases, additional recombinant nucleic acid constructs can also be included in the plant cell, e.g., containing additional regulatory proteins and/or regulatory regions.

Vectors containing nucleic acids such as those described herein also are provided. A "vector" is a replicon, such as a plasmid, phage, or cosmid, into which another DNA segment may be inserted so as to bring about the replication of the inserted segment. Generally, a vector is capable of replication when associated with the proper control elements. Suitable vector backbones include, for example, those routinely used in the art such as plasmids, viruses, artificial chromosomes, BACs, YACs, or PACs. The term "vector" includes cloning and expression vectors, as well as viral vectors and integrating vectors. An "expression vector" is a vector that includes a regulatory region. Suitable expression vectors include, without limitation, plasmids and viral vectors derived from, for example, bacteriophage, baculoviruses, and retroviruses. Numerous vectors and expression systems are commercially available from such corporations as Novagen (Madison, Wis.), Clontech (Mountain View, Calif.), Stratagene (La Jolla, Calif.), and Invitrogen/Life Technologies (Carlsbad, Calif.).

The vectors provided herein also can include, for example, origins of replication, scaffold attachment regions (SARs), and/or markers. A marker gene can confer a selectable phenotype on a plant cell. For example, a marker can confer biocide resistance, such as resistance to an antibiotic (e.g., kanamycin, G418, bleomycin, or hygromycin), or an herbicide (e.g., chlorosulfuron or phosphinothricin). In addition, an expression vector can include a tag sequence designed to facilitate manipulation or detection (e.g., purification or localization) of the expressed polypeptide. Tag sequences, such as green fluorescent protein (GFP), glutathione S-transferase (GST), polyhistidine, c-myc, hemagglutinin, or Flag™ tag (Kodak, New Haven, Conn.) sequences typically are expressed as a fusion with the encoded polypeptide. Such tags can be inserted anywhere within the polypeptide, including at either the carboxyl or amino terminus.

As described herein, plant cells can be transformed with a recombinant nucleic acid construct to express a polypeptide of interest. The polypeptide can then be extracted and purified using techniques known to those having ordinary skill in the art.

Regulatory Regions

The term "regulatory region" refers to a nucleic acid having nucleotide sequences that influence transcription or translation initiation and rate, and stability and/or mobility of a transcription or translation product. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, introns, and combinations thereof.

When a regulatory region is operably linked to a sequence of interest, the regulatory region is selected from among those that are associated with a regulatory protein described herein. Such a regulatory region is referred to herein as an "associated regulatory region." For example, a recombinant nucleic acid construct can comprise a regulatory region from Table 2 (SEQ ID NOs:1909-1918) operably linked to a sequence of interest. Expression of the sequence of interest is thereby dependent on expression of a regulatory protein(s) that is associated with that regulatory region. Associations between regulatory proteins and regulatory regions are set forth in Table 4. In some embodiments, a regulatory region useful in the compositions and methods described herein has 80% or greater, e.g., 85%, 90%, 95%, 97%, 98%, 99%, or 100%, sequence identity to a regulatory region set forth in SEQ ID NOs:1909-1918.

To control the expression pattern of an associated regulatory protein itself, and thereby indirectly modulate expression of a sequence of interest, another regulatory region, which can be the same as or different from the associated regulatory region, is operably linked to a coding sequence for that regulatory protein. The choice of regulatory regions is influenced by the tissues and developmental stages in which one desires expression of the regulatory protein and/or sequence of interest to occur, but is otherwise not limited in any substantial way. For example, if one desires expression of the sequence of interest to occur in vegetative tissues, the associated regulatory protein can be broadly expressed, e.g., under the direction of a p326 promoter, or more precisely expressed, e.g., under the direction of a YP0144 photosynthetic tissue promoter. In either case, the regulatory protein can directly or indirectly affect expression of a sequence of interest operably linked to an associated regulatory region. In some cases, a regulatory protein can be expressed under the direction of a cell type- or tissue-preferential promoter, such as a cell type- or tissue-preferential promoter described below.

As used herein, the term "operably linked" refers to positioning of a regulatory region and a sequence to be transcribed in a nucleic acid so as to influence transcription or translation of such a sequence. For example, to bring a coding sequence under the control of a regulatory region, the translation initiation site of the translational reading frame of the polypeptide is typically positioned between one and about fifty nucleotides downstream of the regulatory region. A regulatory region can, however, be positioned as much as about 5,000 nucleotides upstream of the translation initiation site, or about 2,000 nucleotides upstream of the transcription start site. A regulatory region typically comprises at least a core (basal) promoter. A regulatory region also may include at least one control element, such as an enhancer sequence, an upstream element or an upstream activation region (UAR). For example, a suitable enhancer is a cis-regulatory element (−212 to −154) from the upstream region of the octopine synthase (ocs) gene. Fromm et al., *The Plant Cell*, 1:977-984 (1989). The choice of regulatory regions to be included depends upon several factors, including, but not limited to, efficiency, selectability, inducibility, desired expression level, and cell- or tissue-preferential expression. It is a routine matter for one of skill in the art to modulate the expression of a coding sequence by appropriately selecting and positioning regulatory regions relative to the coding sequence.

Some suitable regulatory regions initiate transcription only, or predominantly, in certain cell types. For example, a promoter that is active predominantly in a reproductive tissue (e.g., fruit, ovule, or inflorescence) can be used. Thus, as used herein a cell type- or tissue-preferential promoter is one that drives expression preferentially in the target tissue, but may also lead to some expression in other cell types or tissues as well. Methods for identifying and characterizing regulatory regions in plant genomic DNA include, for example, those described in the following references: Jordano et al., *Plant Cell*, 1:855-866 (1989); Bustos et al., *Plant Cell*, 1:839-854 (1989); Green et al., *EMBO J.*, 7:4035-4044 (1988); Meier et al., *Plant Cell*, 3:309-316 (1991); and Zhang et al., *Plant Physiology*, 110:1069-1079 (1996).

Examples of various classes of regulatory regions are described below. Some of the regulatory regions indicated below as well as additional regulatory regions are described in more detail in U.S. Patent Application Ser. Nos. 60/505,689; 60/518,075; 60/544,771; 60/558,869; 60/583,691; 60/619,181; 60/637,140; 60/757,544; 60/776,307; 10/957,569; 11/058,689; 11/172,703; 11/208,308; 11/274,890; 60/583,609; 60/612,891; 11/097,589; 11/233,726; 11/408,791; 11/414,142; 10/950,321; 11/360,017; PCT/US05/011105; PCT/US05/034308; and PCT/US05/23639. Nucleotide sequences of regulatory regions are set forth in SEQ ID NOs:1-94 and SEQ ID NOs:1909-1918. It will be appreciated that a regulatory region may meet criteria for one classification based on its activity in one plant species, and yet meet criteria for a different classification based on its activity in another plant species.

Broadly Expressing Promoters

A promoter can be said to be "broadly expressing" when it promotes transcription in many, but not necessarily all, plant tissues. For example, a broadly expressing promoter can promote transcription of an operably linked sequence in one or more of the shoot, shoot tip (apex), and leaves, but weakly or not at all in tissues such as roots or stems. As another example, a broadly expressing promoter can promote transcription of an operably linked sequence in one or more of the stem, shoot, shoot tip (apex), and leaves, but can promote transcription weakly or not at all in tissues such as reproductive tissues of flowers and developing seeds. Non-limiting examples of broadly expressing promoters that can be included in the nucleic acid constructs provided herein include the p326 (SEQ ID NO:76), YP0144 (SEQ ID NO:55), YP0190 (SEQ ID NO:59), p13879 (SEQ ID NO:75), YP0050 (SEQ ID NO:35), p32449 (SEQ ID NO:77), 21876 (SEQ ID NO:1), YP0158 (SEQ ID NO:57), YP0214 (SEQ ID NO:61), YP0380 (SEQ ID NO:70), PT0848 (SEQ ID NO:26), and PT0633 (SEQ ID NO:7) promoters. Additional examples include the cauliflower mosaic virus (CaMV) 35S promoter, the mannopine synthase (MAS) promoter, the 1' or 2' promoters derived from T-DNA of *Agrobacterium tumefaciens*, the figwort mosaic virus 34S promoter, actin promoters such as the rice actin promoter, and ubiquitin promoters such as the maize ubiquitin-1 promoter. In some cases, the CaMV 35S promoter is excluded from the category of broadly expressing promoters.

Root Promoters

Root-active promoters confer transcription in root tissue, e.g., root endodermis, root epidermis, or root vascular tissues. In some embodiments, root-active promoters are root-preferential promoters, i.e., confer transcription only or predominantly in root tissue. Root-preferential promoters include the YP0128 (SEQ ID NO:52), YP0275 (SEQ ID NO:63), PT0625 (SEQ ID NO:6), PT0660 (SEQ ID NO:9), PT0683 (SEQ ID NO:14), and PT0758 (SEQ ID NO:22) promoters. Other root-preferential promoters include the PT0613 (SEQ ID NO:5), PT0672 (SEQ ID NO:11), PT0688 (SEQ ID NO:15), and PT0837 (SEQ ID NO:24) promoters, which drive transcription primarily in root tissue and to a lesser extent in ovules and/or seeds. Other examples of root-preferential promoters include the root-specific subdomains of the CaMV 35S promoter (Lam et al., *Proc. Natl. Acad. Sci. USA*, 86:7890-7894 (1989)), root cell specific promoters reported by Conkling et al., *Plant Physiol.*, 93:1203-1211 (1990), and the tobacco RD2 promoter.

Maturing Endosperm Promoters

In some embodiments, promoters that drive transcription in maturing endosperm can be useful. Transcription from a maturing endosperm promoter typically begins after fertilization and occurs primarily in endosperm tissue during seed development and is typically highest during the cellularization phase. Most suitable are promoters that are active predominantly in maturing endosperm, although promoters that are also active in other tissues can sometimes be used. Non-limiting examples of maturing endosperm promoters that can be included in the nucleic acid constructs provided herein include the napin promoter, the Arcelin-5 promoter, the phaseolin promoter (Bustos et al., *Plant Cell*, 1(9):839-853 (1989)), the soybean trypsin inhibitor promoter (Riggs et al., *Plant Cell*, 1(6):609-621 (1989)), the ACP promoter (Baerson et al., *Plant Mol. Biol.*, 22(2):255-267 (1993)), the stearoyl-ACP desaturase promoter (Slocombe et al., *Plant Physiol.*, 104(4):167-176 (1994)), the soybean α' subunit of β-conglycinin promoter (Chen et al., *Proc. Natl. Acad. Sci. USA*, 83:8560-8564 (1986)), the oleosin promoter (Hong et al., *Plant Mol. Biol.*, 34(3):549-555 (1997)), and zein promoters, such as the 15 kD zein promoter, the 16 kD zein promoter, 19 kD zein promoter, 22 kD zein promoter and 27 kD zein promoter. Also suitable are the Osgt-1 promoter from the rice glutelin-1 gene (Zheng et al., *Mol. Cell. Biol.*, 13:5829-5842 (1993)), the beta-amylase promoter, and the barley hordein promoter. Other maturing endosperm promoters include the YP0092 (SEQ ID NO:38), PT0676 (SEQ ID NO:12), and PT0708 (SEQ ID NO:17) promoters.

Ovary Tissue Promoters

Promoters that are active in ovary tissues such as the ovule wall and mesocarp can also be useful, e.g., a polygalacturonidase promoter, the banana TRX promoter, the melon actin promoter, YP0396 (SEQ ID NO:74), and PT0623 (SEQ ID NO:94). Examples of promoters that are active primarily in ovules include YP0007 (SEQ ID NO:30), Y0111 (SEQ ID NO:46), YP0092 (SEQ ID NO:38), YP0103 (SEQ ID NO:43), YP0028 (SEQ ID NO:33), YP0121 (SEQ ID NO:51), YP0008 (SEQ ID NO:31), YP0039 (SEQ ID NO:34), YP0115 (SEQ ID NO:47), YP0119 (SEQ ID NO:49), YP0120 (SEQ ID NO:50), and YP0374 (SEQ ID NO:68).

Embryo Sac/Early Endosperm Promoters

To achieve expression in embryo sac/early endosperm, regulatory regions can be used that are active in polar nuclei and/or the central cell, or in precursors to polar nuclei, but not in egg cells or precursors to egg cells. Most suitable are promoters that drive expression only or predominantly in polar nuclei or precursors thereto and/or the central cell. A pattern of transcription that extends from polar nuclei into early endosperm development can also be found with embryo sac/early endosperm-preferential promoters, although transcription typically decreases significantly in later endosperm development during and after the cellularization phase. Expression in the zygote or developing embryo typically is not present with embryo sac/early endosperm promoters.

Promoters that may be suitable include those derived from the following genes: *Arabidopsis* viviparous-1 (see, GenBank No. U93215); *Arabidopsis* atmyc1 (see, Urao (1996) *Plant Mol. Biol.*, 32:571-57; Conceicao (1994) Plant, 5:493-505); *Arabidopsis* FIE (GenBank No. AF129516); *Arabidopsis* MEA; *Arabidopsis* FIS2 (GenBank No. AF096096); and FIE 1.1 (U.S. Pat. No. 6,906,244). Other promoters that may be suitable include those derived from the following genes: maize MAC1 (see, Sheridan (1996) *Genetics*, 142:1009-1020); maize Cat3 (see, GenBank No. L05934; Abler (1993) *Plant Mol. Biol.*, 22:10131-1038). Other promoters include the following *Arabidopsis* promoters: YP0039 (SEQ ID NO:34), YP0101 (SEQ ID NO:41), YP0102 (SEQ ID NO:42), YP0110 (SEQ ID NO:45), YP0117 (SEQ ID NO:48), YP0119 (SEQ ID NO:49), YP0137 (SEQ ID NO:53), DME, YP0285 (SEQ ID NO:64), and YP0212 (SEQ ID NO:60). Other promoters that may be useful include the following rice promoters: p530c10 (SEQ ID NO:79), pOsFIE2-2 (SEQ ID NO:80), pOsMEA (SEQ ID NO:81), pOsYp102 (SEQ ID NO:82), and pOsYp285 (SEQ ID NO:83).

Embryo Promoters

Regulatory regions that preferentially drive transcription in zygotic cells following fertilization can provide embryo-preferential expression. Most suitable are promoters that preferentially drive transcription in early stage embryos prior to the heart stage, but expression in late stage and maturing embryos is also suitable. Embryo-preferential promoters include the barley lipid transfer protein (Ltp1) promoter (*Plant Cell Rep* (2001) 20:647-654), YP0097 (SEQ ID NO:40), YP0107 (SEQ ID NO:44), YP0088 (SEQ ID NO:37), YP0143 (SEQ ID NO:54), YP0156 (SEQ ID NO:56), PT0650 (SEQ ID NO:8), PT0695 (SEQ ID NO:16), PT0723 (SEQ ID NO:19), PT0838 (SEQ ID NO:25), PT0879 (SEQ ID NO:28), and PT0740 (SEQ ID NO:20).

Photosynthetic Tissue Promoters

Promoters active in photosynthetic tissue confer transcription in green tissues such as leaves and stems. Most suitable are promoters that drive expression only or predominantly in such tissues. Examples of such promoters include the ribulose-1,5-bisphosphate carboxylase (RbcS) promoters such as the RbcS promoter from eastern larch (*Larix laricina*), the pine cab6 promoter (Yamamoto et al., *Plant Cell Physiol.*, 35:773-778 (1994)), the Cab-1 promoter from wheat (Fejes et al., *Plant Mol. Biol.*, 15:921-932 (1990)), the CAB-1 promoter from spinach (Lubberstedt et al., *Plant Physiol.*, 104:997-1006 (1994)), the cab1R promoter from rice (Luan et al., *Plant Cell*, 4:971-981 (1992)), the pyruvate orthophosphate dikinase (PPDK) promoter from corn (Matsuoka et al., *Proc. Natl. Acad. Sci. USA,* 90:9586-9590 (1993)), the tobacco Lhcb1*2 promoter (Cerdan et al., *Plant Mol. Biol.*, 33:245-255 (1997)), the *Arabidopsis thaliana* SUC2 sucrose-H+ symporter promoter (Truernit et al., *Planta*, 196:564-570 (1995)), and thylakoid membrane protein promoters from spinach (psaD, psaF, psaE, PC, FNR, atpC, atpD, cab, rbcS). Other photosynthetic tissue promoters include PT0535 (SEQ ID NO:3), PT0668 (SEQ ID NO:2), PT0886 (SEQ ID NO:29), YP0144 (SEQ ID NO:55), YP0380 (SEQ ID NO:70) and PT0585 (SEQ ID NO:4).

Lignin Biosynthesis Promoters

Lignin biosynthesis promoters are promoters that drive transcription of nucleic acids encoding enzymes involved in lignin biosynthesis. Such enzymes include, without limitation, 4-(hydroxy)cinnamoyl CoA ligase (EC 6.2.1.12), ferulate 5-hydroxylase, cinnamoyl CoA reductase (EC 1.2.1.44), cinnamate 4-hydroxylase (EC 1.14.13.11), and cinnamyl alcohol dehydrogenase (EC 1.1.1.195). Examples of lignin biosynthesis promoters from *Populus* are set forth in SEQ ID NOs:1909-1918. Other examples of lignin biosynthesis promoters include promoters of the switchgrass (*Panicum virgatum*), rice (*Oryza sativa*), corn (*Zea mays*), and wheat (*Triticum aestivum*) homologs of the *Populus* cinnamate 4-hydroxylase, caffeoyl-CoA O-methyltransferase, and caffeic acid O-methyltransferase genes. Also suitable are promoters of *Arabidopsis* genes encoding phenylalanin ammonia lyase (genomic locus At3g10340), trans-cinnamate 4-hydroxylase (genomic locus At2g30490), 4-coumarate:CoA ligase (genomic locus At1g51680), hydroxycinnamoyl-CoA:shikimate/quinate hydroxycinnamoyltransferase (genomic locus At5g48930), p-Coumarate 3-hydroxylase (genomic locus At2g40890), caffeoyl-CoA 3-O-methyltransferase (genomic locus At4g34050), cinnamoyl CoA reductase (genomic locus At1g15950), ferulate 5-hydroxylase (genomic locus At4g36220), caffeic acid O-methyltransferase (genomic locus At5g54160), and cinnamyl alcohol dehydrogenase (genomic locus At4g34230).

Cell Wall Related Promoters

Useful promoters also include cell wall related promoters, such as cellulose biosynthesis promoters. Cellulose biosynthesis promoters are promoters that drive transcription of nucleic acids encoding enzymes involved in cellulose biosynthesis. Examples of cellulose biosynthesis promoters include the promoter of the rice cellulose synthase gene (genomic locus Os08g25710), the promoter of the rice cellulose synthase gene (genomic locus Os08g06380), and the promoter of the rice cellulose synthase-like A2 gene (genomic locus Os10g26630).

Vascular Tissue Promoters

Examples of promoters that have high or preferential activity in vascular bundles include YP0087 (SEQ ID NO:86), YP0093 (SEQ ID NO:87), YP0108 (SEQ ID NO:88), YP0022 (SEQ ID NO:89), and YP0080 (SEQ ID NO:90). Other vascular tissue-preferential promoters include the glycine-rich cell wall protein GRP 1.8 promoter (Keller and Baumgartner, *Plant Cell*, 3(10):1051-1061 (1991)), the Commelina yellow mottle virus (COYMV) promoter (Medberry et al., *Plant Cell*, 4(2):185-192 (1992)), and the rice tungro bacilliform virus (RTBV) promoter (Dai et al., *Proc. Natl. Acad. Sci. USA,* 101(2):687-692 (2004)). Promoters having preferential activity in the phloem region (e.g., primary phloem cells, companion cells, and sieve cells), the xylem region (e.g., tracheids and vessels), the bundle sheath layer and/or the endodermis are also considered vascular tissue promoters.

Stem Promoters

Promoters that have preferential activity in the pith, cortex, epidermis, and/or in the vascular bundles or vascular layers of the stem are considered stem promoters. Examples of these promoters are YP0356 (SEQ ID NO:67), YP0108 (SEQ ID NO:88), PT0684, PT0565 (SEQ ID NO:84), PT0710 (SEQ ID NO:18), and YP0080 (SEQ ID NO:90). In some cases, the stem promoters can also be induced by stress like drought (e.g., YP0356 and PT0710).

Inducible Promoters

Inducible promoters confer transcription in response to external stimuli such as chemical agents or environmental stimuli. For example, inducible promoters can confer transcription in response to hormones such as giberellic acid or ethylene, or in response to light or drought. Examples of drought-inducible promoters include YP0380 (SEQ ID NO:70), PT0848 (SEQ ID NO:26), YP0381 (SEQ ID NO:71), YP0337 (SEQ ID NO:66), PT0633 (SEQ ID NO:7), YP0374 (SEQ ID NO:68), PT0710 (SEQ ID NO:18), YP0356 (SEQ ID NO:67), YP0385 (SEQ ID NO:73), YP0396 (SEQ ID NO:74), YP0388 (SEQ ID NO:92), YP0384 (SEQ ID NO:72), PT0688 (SEQ ID NO:15), YP0286 (SEQ ID NO:65), YP0377 (SEQ ID NO:69), PD1367 (SEQ ID NO:78), and PD0901 (SEQ ID NO:93). Examples of nitrogen-inducible promoters include PT0863 (SEQ ID NO:27), PT0829 (SEQ ID NO:23), PT0665 (SEQ ID NO:10), and PT0886 (SEQ ID NO:29). Examples of shade-inducible promoters include PR0924 (SEQ ID NO:91) and PT0678 (SEQ ID NO:13).

Basal Promoters

A basal promoter is the minimal sequence necessary for assembly of a transcription complex required for transcription initiation. Basal promoters frequently include a "TATA box" element that may be located between about 15 and about 35 nucleotides upstream from the site of transcription initiation. Basal promoters also may include a "CCAAT box" element (typically the sequence CCAAT) and/or a GGGCG sequence, which can be located between about 40 and about 200 nucleotides, typically about 60 to about 120 nucleotides, upstream from the transcription start site.

Other Promoters

Other classes of promoters include, but are not limited to, shoot-preferential, callus-preferential, trichome cell-preferential, guard cell-preferential such as PT0678 (SEQ ID NO:13), tuber-preferential, parenchyma cell-preferential, and senescence-preferential promoters. Promoters designated YP0086 (SEQ ID NO:36), YP0188 (SEQ ID NO:58), YP0263 (SEQ ID NO:62), PT0758 (SEQ ID NO:22), PT0743 (SEQ ID NO:21), PT0829 (SEQ ID NO:23), YP0119 (SEQ ID NO:49), and YP0096 (SEQ ID NO:39), as described in the above-referenced patent applications, may also be useful.

Other Regulatory Regions

A 5' untranslated region (UTR) can be included in nucleic acid constructs described herein. A 5' UTR is transcribed, but is not translated, and lies between the start site of the transcript and the translation initiation codon and may include the +1 nucleotide. A 3' UTR can be positioned between the translation termination codon and the end of the transcript. UTRs can have particular functions such as increasing mRNA stability or attenuating translation. Examples of 3' UTRs include, but are not limited to, polyadenylation signals and transcription termination sequences, e.g., a nopaline synthase termination sequence.

It will be understood that more than one regulatory region may be present in a recombinant polynucleotide, e.g., introns, enhancers, upstream activation regions, transcription terminators, and inducible elements. Thus, for example, more than one regulatory region can be operably linked to the sequence of a polynucleotide encoding a regulatory protein.

Regulatory regions, such as promoters for endogenous genes, can be obtained by chemical synthesis or by subcloning from a genomic DNA that includes such a regulatory region. A nucleic acid comprising such a regulatory region can also include flanking sequences that contain restriction enzyme sites that facilitate subsequent manipulation.

Sequences of Interest and Plants and Plant Cells Containing the Same

Plant cells and plants described herein are useful because expression of a sequence of interest can be modulated to achieve a desired amount and/or specificity of expression by selecting an appropriate association of regulatory region and regulatory protein. A sequence of interest operably linked to a regulatory region can encode a polypeptide or can regulate the expression of a polypeptide. A sequence of interest that encodes a polypeptide can encode a plant polypeptide, a non-plant polypeptide, e.g., a mammalian polypeptide, a modified polypeptide, a synthetic polypeptide, or a portion of a polypeptide. A sequence of interest can be endogenous, i.e., unmodified by recombinant DNA technology from the sequence and structural relationships that occur in nature and operably linked to the unmodified regulatory region. Alternatively, a sequence of interest can be an exogenous nucleic acid. In some embodiments, a sequence of interest is transcribed into an anti-sense or interfering RNA molecule.

More than one sequence of interest can be present in a plant, e.g., two, three, four, five, six, seven, eight, nine, or ten sequences of interest can be present in a plant. If such sequences are exogenous nucleic acids, each sequence of interest can be present on the same nucleic acid construct in such embodiments. Alternatively, each exogenous sequence of interest can be present on separate nucleic acid constructs. The regulatory region operably linked to each sequence of interest can be the same or can be different. In addition, one or more nucleotide sequences encoding a regulatory protein can be included on a nucleic acid construct that is the same as or separate from that containing an associated regulatory region(s) operably linked to a sequence(s) of interest. The regulatory region operably linked to each sequence encoding a regulatory protein can be the same or different.

Lignin Biosynthesis Sequences

In certain cases, a sequence of interest can be an endogenous or exogenous sequence associated with lignin biosynthesis. For example, a transgenic plant cell containing a recombinant nucleic acid encoding a regulatory protein can be effective for modulating the amount and/or rate of lignin biosynthesis. Such effects on lignin biosynthesis typically occur via modulation of transcription of one or more endogenous or exogenous sequences of interest operably linked to an associated regulatory region, e.g., endogenous genes involved in lignin biosynthesis, such as native enzymes or regulatory proteins in lignin biosynthesis pathways, or exogenous sequences involved in lignin biosynthesis pathways introduced via a recombinant nucleic acid construct into a plant cell.

In some embodiments, the coding sequence can encode a polypeptide involved in lignin biosynthesis, e.g., an enzyme or a regulatory protein (such as a transcription factor) involved in lignin biosynthesis described herein. Other components that may be present in a sequence of interest include introns, enhancers, upstream activation regions, and inducible elements.

A suitable sequence of interest can encode an enzyme involved in lignin biosynthesis, such as 4-(hydroxy)cinnamoyl CoA ligase (4CL; EC 6.2.1.12), p-coumarate 3-hydroxylase (C3H), cinnamate 4-hydroxylase (C4H; EC 1.14.13.11), cinnamyl alcohol dehydrogenase (CAD; EC 1.1.1.195), caffeoyl CoA O-methyltransferase (CCoAOMT; EC 2.1.1.104), cinnamoyl CoA reductase (CCR; EC 1.2.1.44), caffeic acid/5-hydroxyferulic acid O-methyltransferase (COMT; EC 2.1.1.68), hydroxycinnamoyl CoA: quinate hydroxycinnamoyltransferase (CQT; EC 2.3.1.99), hydroxycinnamoyl CoA:shikimate hydroxycinnamoyltransferase (CST; EC 2.3.1.133), ferulate 5-hydroxylase (F5H), phenylalanine ammonia-lyase (PAL; EC 4.3.1.5), p-coumaryl CoA 3-hydroxylase (pCCoA3H), or sinapyl alcohol dehydrogenase (SAD).

In some embodiments, a suitable sequence of interest can encode an enzyme involved in polymerization of lignin monomers to form lignin, such as a peroxidase (EC 1.11.1.x) or a laccase (EC 1.10.3.2) enzyme. In some cases, a suitable sequence of interest can encode an enzyme involved in glycosylation of lignin monomers, such as a coniferyl-alcohol glucosyltransferase (EC 2.4.1.111) enzyme, or an enzyme involved in regenerating a monolignol from a monolignol glucoside, such as a coniferin β-glucosidase (EC 3.2.1.126) enzyme. As mentioned above, such a suitable sequence of interest can be transcribed into an anti-sense or interfering RNA molecule.

Phenylpropanoid Sequences of Interest

In some embodiments, a sequence of interest can encode an enzyme involved in flavonoid biosynthesis, such as naringenin-chalcone synthase (EC 2.3.1.74), polyketide reductase, chalcone isomerase (EC 5.5.1.6), flavanone 4-reductase (EC 1.1.1.234), dihydrokaempferol 4-reductase (EC 1.1.1.219), flavone synthase (EC 1.14.11.22), flavone 7-O-beta-glucosyltransferase (EC 2.4.1.81), flavone apiosyltransferase (EC 2.4.2.25), isoflavone-7-O-beta-glucoside 6"-O-malonyltransferase (EC 2.3.1.115), apigenin 4'-O-methyltransferase (EC 2.1.1.75), flavonoid 3'-monooxygenase (EC 1.14.13.21), luteolin O-methyltransferase (EC 2.1.1.42), flavonoid 3',5'-hydroxylase (EC 1.14.13.88), 4'-methoxyisoflavone 2'-hydroxylase (EC 1.14.13.53), isoflavone 4'-O-methyltransferase (EC 2.1.1.46), flavanone 3-dioxygenase (EC 1.14.11.9), leucocyanidin oxygenase (EC 1.14.11.19), flavonol synthase (EC 1.14.11.23), 2'-hydroxyisoflavone reductase (EC 1.3.1.45), leucoanthocyanidin reductase (EC 1.17.1.3), anthocyanidin reductase (EC 1.3.1.77), flavonol 3-O-glucosyltransferase (EC 2.4.1.91), quercetin 3-O-methyltransferase (EC 2.1.1.76), anthocyanidin 3-O-glucosyltransferase (EC 2.4.1.115), flavonol-3-O-glucoside L-rhamnosyltransferase (EC 2.4.1.159), UDP-glucose:anthocyanin 5-O-glucosyltransferase (2.4.1.-), or anthocyanin acyltransferase (2.3.1.-).

In some embodiments, a sequence of interest can encode an enzyme involved in stilbene synthesis such as trihydroxystilbene synthase (EC 2.3.1.95) or an oxidoreductase (EC 1.14.-.-).

In some embodiments, a sequence of interest can encode an enzyme involved in coumarin synthesis such as trans-cinnamate 2-monooxygenase (EC 1.14.13.14), 2-coumarate O-beta-glucosyltransferase (EC 2.4.1.114), a cis-trans-isomerase (EC 5.2.1.-), or a beta-glucosidase (EC 3.2.1.21).

Other Sequences of Interest

Other sequences of interest can encode a therapeutic polypeptide for use with mammals such as humans, e.g., as set forth in Table 1. In certain cases, a sequence of interest can encode an antibody or antibody fragment. An antibody or antibody fragment includes a humanized or chimeric antibody, a single chain Fv antibody fragment, an Fab fragment, and an F(ab)$_2$ fragment. A chimeric antibody is a molecule in which different portions are derived from different animal species, such as those having a variable region derived from a mouse monoclonal antibody and a human immunoglobulin constant region. Antibody fragments that have a specific binding affinity can be generated by known techniques. Such antibody fragments include, but are not limited to F(ab')$_2$ fragments that can be produced by pepsin digestion of an antibody molecule and Fab fragments that can be generated by reducing the disulfide bridges of F(ab')$_2$ fragments. Single chain Fv antibody fragments are formed by linking the heavy and light chain fragments of the Fv region via an amino acid bridge (e.g., 15 to 18 amino acids), resulting in a single chain polypeptide. Single chain Fv antibody fragments can be produced through standard techniques, such as those disclosed in U.S. Pat. No. 4,946,778. U.S. Pat. No. 6,303,341 discloses immunoglobulin receptors. U.S. Pat. No. 6,417,429 discloses immunoglobulin heavy- and light-chain polypeptides.

TABLE 1

Human therapeutic proteins

| | | |
|---|---|---|
| Bromelain | Humatrope ® | Proleukin ® |
| Chymopapain | Humulin ® (insulin) | Protropin ® |
| Papain ® | Infergen ® | Recombivax-HB ® |
| Activase ® | Interferon-gamma-1a | Recormon ® |
| Albutein ® | Interleukin-2 | Remicade ® (s-TNF-r) |
| Angiotensin II | Intron ® | ReoPro ® |
| Asparaginase | Leukine ® (GM-CSF) | Retavase ® (TPA) |
| Avonex ® | Nartogastrim ® | Roferon-A ® |
| Betaseron ® | Neumega ® | Pegaspargas |
| BioTropin ® | Neupogen ® | Prandin ® |
| Cerezyme ® | Norditropin ® | Procrit ® |
| Enbrel ® (s-TNF-r) | Novolin ® (insulin) | Filgastrim ® |
| Engerix-B ® | Nutropin ® | Genotropin ® |
| Epogen ® | Oncaspar ® | Geref ® |
| Sargramostrim | Tripedia ® | Trichosanthin |
| TriHIBit ® | Venoglobin-S ® (HIG) | |

A sequence of interest can encode a polypeptide or result in a transcription product anti-sense molecule that confers insect resistance, bacterial disease resistance, fungal disease resistance, viral disease resistance, nematode disease resistance, herbicide resistance, enhanced grain composition or quality, enhanced nutrient composition, nutrient transporter functions, enhanced nutrient utilization, enhanced environmental stress tolerance, reduced mycotoxin contamination, female sterility, a selectable marker phenotype, a screenable marker phenotype, a negative selectable marker phenotype, or altered plant agronomic characteristics. Specific examples include, without limitation, a chitinase coding sequence and a glucan endo-1,3-β-glucosidase coding sequence. In some embodiments, a sequence of interest encodes a bacterial ESPS synthase that confers resistance to glyphosate herbicide or a phosphinothricin acetyl transferase coding sequence that confers resistance to phosphinothricin herbicide.

A sequence of interest can encode a polypeptide involved in the production of industrial or pharmaceutical chemicals, modified and specialty oils, enzymes, or renewable non-foods such as fuels and plastics, vaccines and antibodies. U.S. Pat. No. 5,824,779 discloses phytase-protein-pigmenting concentrate derived from green plant juice. U.S. Pat. No. 5,900,525 discloses animal feed compositions containing phytase derived from transgenic alfalfa. U.S. Pat. No. 6,136,320 discloses vaccines produced in transgenic plants. U.S. Pat. No. 6,255,562 discloses insulin. U.S. Pat. No. 5,958,745 discloses the formation of copolymers of 3-hydroxy butyrate and 3-hydroxy valerate. U.S. Pat. No. 5,824,798 discloses starch synthases. U.S. Pat. No. 6,087,558 discloses the production of proteases in plants. U.S. Pat. No. 6,271,016 discloses an anthranilate synthase gene for tryptophan overproduction in plants.

Methods of Inhibiting Expression of a Sequence of Interest

The polynucleotides and recombinant vectors described herein can be used to express or inhibit expression of a gene, such as an endogenous gene involved in lignin biosynthesis, e.g., to alter a lignin biosynthetic pathway in a plant species of interest. The term "expression" refers to the process of converting genetic information of a polynucleotide into RNA through transcription, which is catalyzed by an enzyme, RNA polymerase, and into protein, through translation of mRNA on ribosomes. "Up-regulation" or "activation" refers to regulation that increases the production of expression products (mRNA, polypeptide, or both) relative to basal or native states, while "down-regulation" or "repression" refers to regulation that decreases production of expression products (mRNA, polypeptide, or both) relative to basal or native states.

"Modulated level of gene expression" as used herein refers to a comparison of the level of expression of a transcript of a gene or the amount of its corresponding polypeptide in the presence and absence of a lignin-modulating polypeptide described herein, and refers to a measurable or observable change in the level of expression of a transcript of a gene or the amount of its corresponding polypeptide relative to a control plant or plant cell under the same conditions (e.g., as measured through a suitable assay such as quantitative RT-PCR, a Northern blot, a Western blot, or through an observable change in phenotype, chemical profile, or metabolic profile). A modulated level of gene expression can include up-regulated or down-regulated expression of a transcript of a gene or polypeptide relative to a control plant or plant cell under the same conditions. Modulated expression levels can occur under different environmental or developmental conditions or in different locations than those exhibited by a plant or plant cell in its native state.

A number of nucleic acid based methods, including antisense RNA, ribozyme directed RNA cleavage, post-transcriptional gene silencing (PTGS), e.g., RNA interference (RNAi), and transcriptional gene silencing (TGS) can be used to inhibit gene expression in plants. Suitable polynucleotides include full-length nucleic acids encoding regulatory proteins or fragments of such full-length nucleic acids. In some embodiments, a complement of the full-length nucleic acid or a fragment thereof can be used. Typically, a fragment is at least 10 nucleotides, e.g., at least 12, 13, 14, 15, 16, 17, 18, 19, 20, 21, 22, 23, 24, 25, 26, 27, 30, 35, 40, 50, 80, 100, 200, 500 nucleotides or more. Generally, higher homology can be used to compensate for the use of a shorter sequence.

Antisense technology is one well-known method. In this method, a nucleic acid segment from a gene to be repressed is cloned and operably linked to a regulatory region and a transcription termination sequence so that the antisense strand of RNA is transcribed. The recombinant vector is then transformed into plants, as described below, and the antisense strand of RNA is produced. The nucleic acid segment need not be the entire sequence of the gene to be repressed, but typically will be substantially complementary to at least a portion of the sense strand of the gene to be repressed.

In another method, a nucleic acid can be transcribed into a ribozyme, or catalytic RNA, that affects expression of an mRNA. See, U.S. Pat. No. 6,423,885. Ribozymes can be designed to specifically pair with virtually any target RNA and cleave the phosphodiester backbone at a specific location, thereby functionally inactivating the target RNA. Heterologous nucleic acids can encode ribozymes designed to cleave particular mRNA transcripts, thus preventing expression of a polypeptide. Hammerhead ribozymes are useful for destroying particular mRNAs, although various ribozymes that cleave mRNA at site-specific recognition sequences can be used. Hammerhead ribozymes cleave mRNAs at locations dictated by flanking regions that form complementary base pairs with the target mRNA. The sole requirement is that the target RNA contain a 5'-UG-3' nucleotide sequence. The construction and production of hammerhead ribozymes is known in the art. See, for example, U.S. Pat. No. 5,254,678 and WO 02/46449 and references cited therein. Hammerhead ribozyme sequences can be embedded in a stable RNA such as a transfer RNA (tRNA) to increase cleavage efficiency in vivo. Perriman et al., *Proc. Natl. Acad. Sci. USA*, 92(13): 6175-6179 (1995); de Feyter and Gaudron, Methods in Molecular Biology, Vol. 74, Chapter 43, "Expressing Ribozymes in Plants", Edited by Turner, P. C., Humana Press Inc., Totowa, N.J. RNA endoribonucleases which have been described, such as the one that occurs naturally in *Tetrahymena thermophila*, can be useful. See, for example, U.S. Pat. Nos. 4,987,071 and 6,423,885.

PTGS, e.g., RNAi, can also be used to inhibit the expression of a gene. For example, a construct can be prepared that includes a sequence that is transcribed into an RNA that can anneal to itself, e.g., a double stranded RNA having a stem-loop structure. In some embodiments, one strand of the stem portion of a double stranded RNA comprises a sequence that is similar or identical to the sense coding sequence of the polypeptide of interest, or a fragment thereof, and that is from about 10 nucleotides to about 2,500 nucleotides in length. For example, the length of the sequence that is similar or identical to the sense coding sequence can be from 10 nucleotides to 500 nucleotides, from 15 nucleotides to 300 nucleotides, from 20 nucleotides to 100 nucleotides, or from 25 nucleotides to 100 nucleotides. The other strand of the stem portion of a double stranded RNA comprises a sequence that is similar or identical to the antisense strand, or a fragment thereof, of the coding sequence of the polypeptide of interest, and can have a length that is shorter, the same as, or longer than the corresponding length of the sense sequence. In some cases, one strand of the stem portion of a double stranded RNA comprises a sequence that is similar or identical to the 3' or 5' untranslated region, or a fragment thereof, of the mRNA encoding the polypeptide of interest, and the other strand of the stem portion of the double stranded RNA comprises a sequence that is similar or identical to the sequence that is complementary to the 3' or 5' untranslated region, respectively, of the mRNA encoding the polypeptide of interest. In other embodiments, one strand of the stem portion of a double stranded RNA comprises a sequence that is similar or identical to the sequence of an intron, or a fragment thereof, in the pre-mRNA encoding the polypeptide of interest, and the other strand of the stem portion comprises a sequence that is similar or identical to the sequence that is complementary to the sequence of the intron, or a fragment thereof, in the pre-mRNA.

The loop portion of a double stranded RNA can be from 3 nucleotides to 5,000 nucleotides, e.g., from 3 nucleotides to 25 nucleotides, from 15 nucleotides to 1,000 nucleotides, from 20 nucleotides to 500 nucleotides, or from 25 nucleotides to 200 nucleotides. The loop portion of the RNA can include an intron, or a fragment thereof. A double stranded RNA can have zero, one, two, three, four, five, six, seven, eight, nine, ten, or more stem-loop structures.

A construct including a sequence that is operably linked to a regulatory region and a transcription termination sequence, and that is transcribed into an RNA that can form a double stranded RNA, is transformed into plants as described herein. Methods for using RNAi to inhibit the expression of a gene are known to those of skill in the art. See, e.g., U.S. Pat. Nos. 5,034,323; 6,326,527; 6,452,067; 6,573,099; 6,753,139; and 6,777,588. See also WO 97/01952; WO 98/53083; WO 99/32619; WO 98/36083; and U.S. Patent Publications 20030175965, 20030175783, 20040214330, and 20030180945.

Constructs containing regulatory regions operably linked to nucleic acid molecules in sense orientation can also be used to inhibit the expression of a gene. The transcription product can be similar or identical to the sense coding sequence, or a fragment thereof, of a polypeptide of interest. The transcription product can also be unpolyadenylated, lack a 5' cap structure, or contain an unsplicable intron. Methods of inhibiting gene expression using a full-length cDNA as well as a partial cDNA sequence are known in the art. See, e.g., U.S. Pat. No. 5,231,020.

In some embodiments, a construct containing a nucleic acid having at least one strand that is a template for both sense and antisense sequences that are complementary to each other is used to inhibit the expression of a gene. The sense and antisense sequences can be part of a larger nucleic acid molecule or can be part of separate nucleic acid molecules having sequences that are not complementary. The sense or antisense sequence can be a sequence that is identical or complementary to the full-length sequence, or a fragment thereof, of an mRNA, the 3' or 5' untranslated region of an mRNA, or an intron in a pre-mRNA encoding a polypeptide of interest. In some embodiments, the sense or antisense sequence is identical or complementary to a sequence of the regulatory region, or a fragment thereof, that drives transcription of the gene encoding a polypeptide of interest. In each case, the sense sequence is the sequence that is complementary to the antisense sequence.

The sense and antisense sequences can be any length greater than about 12 nucleotides (e.g., 13, 14, 15, 16, 17, 18, 19, 20, 21, 22, 23, 24, 25, 26, 27, 28, 29, 30, or more nucleotides). For example, an antisense sequence can be 21 or 22 nucleotides in length. Typically, the sense and antisense sequences range in length from about 15 nucleotides to about 30 nucleotides, e.g., from about 18 nucleotides to about 28 nucleotides, or from about 21 nucleotides to about 25 nucleotides.

In some embodiments, an antisense sequence is a sequence complementary to an mRNA sequence encoding a lignin-modulating polypeptide described herein. The sense sequence complementary to the antisense sequence can be a sequence present within the mRNA of a lignin-modulating polypeptide. Typically, sense and antisense sequences are designed to correspond to a 15-30 nucleotide sequence of a target mRNA such that the level of that target mRNA is reduced.

In some embodiments, a construct containing a nucleic acid having at least one strand that is a template for more than one sense sequence (e.g., 2, 3, 4, 5, 6, 7, 8, 9, 10 or more sense sequences) can be used to inhibit the expression of a gene. Likewise, a construct containing a nucleic acid having at least one strand that is a template for more than one antisense sequence (e.g., 2, 3, 4, 5, 6, 7, 8, 9, 10 or more antisense sequences) can be used to inhibit the expression of a gene. For example, a construct can contain a nucleic acid having at least one strand that is a template for two sense sequences and two antisense sequences. The multiple sense sequences can be identical or different, and the multiple antisense sequences can be identical or different. For example, a construct can have a nucleic acid having one strand that is a template for two identical sense sequences and two identical antisense sequences that are complementary to the two identical sense sequences. Alternatively, an isolated nucleic acid can have one strand that is a template for (1) two identical sense sequences 20 nucleotides in length, (2) one antisense sequence that is complementary to the two identical sense sequences 20 nucleotides in length, (3) a sense sequence 30 nucleotides in length, and (4) three identical antisense sequences that are complementary to the sense sequence 30 nucleotides in length. The constructs provided herein can be designed to have any arrangement of sense and antisense sequences. For example, two identical sense sequences can be followed by two identical antisense sequences or can be positioned between two identical antisense sequences.

A nucleic acid having at least one strand that is a template for one or more sense and/or antisense sequences can be operably linked to a regulatory region to drive transcription of an RNA molecule containing the sense and/or antisense sequence(s). In addition, such a nucleic acid can be operably linked to a transcription terminator sequence, such as the terminator of the nopaline synthase (nos) gene. In some cases, two regulatory regions can direct transcription of two transcripts: one from the top strand, and one from the bottom strand. See, for example, Yan et al., *Plant Physiol.*, 141:1508-1518 (2006). The two regulatory regions can be the same or different. The two transcripts can form double-stranded RNA molecules that induce degradation of the target RNA. In some cases, a nucleic acid can be positioned within a T-DNA or P-DNA such that the left and right T-DNA border sequences, or the left and right border-like sequences of the P-DNA, flank or are on either side of the nucleic acid. The nucleic acid sequence between the two regulatory regions can be from about 15 to about 300 nucleotides in length. In some embodiments, the nucleic acid sequence between the two regulatory regions is from about 15 to about 200 nucleotides in length, from about 15 to about 100 nucleotides in length, from about 15 to about 50 nucleotides in length, from about 18 to about 50 nucleotides in length, from about 18 to about 40 nucleotides in length, from about 18 to about 30 nucleotides in length, or from about 18 to about 25 nucleotides in length.

In some nucleic-acid based methods for inhibition of gene expression in plants, a suitable nucleic acid can be a nucleic acid analog. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine, and 5-methyl-2'-deoxycytidine and 5-bromo-2'-deoxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six-membered morpholino ring, or peptide nucleic acids, in which the deoxyphosphate backbone is replaced by a pseudopeptide backbone and the four bases are retained. See, for example, Summerton and Weller, 1997, *Antisense Nucleic Acid Drug Dev.*, 7:187-195; Hyrup et al., *Bioorgan. Med. Chem.*, 4:5-23 (1996). In addition, the deoxyphosphate backbone can be replaced with, for example, a phosphorothioate or phosphorodithioate backbone, a phosphoroamidite, or an alkyl phosphotriester backbone.

Transgenic Plant Cells and Plants

Provided herein are transgenic plant cells and plants comprising at least one recombinant nucleic acid construct or exogenous nucleic acid. A recombinant nucleic acid construct or exogenous nucleic acid can include a regulatory region as described herein, a nucleic acid encoding a regulatory protein as described herein, or both. In certain cases, a transgenic plant cell or plant comprises at least two recombinant nucleic acid constructs or exogenous nucleic acids, one including a regulatory region, and one including a nucleic acid encoding the associated regulatory protein.

A plant or plant cell used in methods of the invention contains a recombinant nucleic acid construct as described herein. A plant or plant cell can be transformed by having a construct integrated into its genome, i.e., can be stably transformed. Stably transformed cells typically retain the introduced nucleic acid with each cell division. A plant or plant cell can also be transiently transformed such that the construct is not integrated into its genome. Transiently transformed cells typically lose all or some portion of the introduced nucleic acid construct with each cell division such that the introduced nucleic acid cannot be detected in daughter cells after a sufficient number of cell divisions. Both transiently transformed and stably transformed transgenic plants and plant cells can be useful in the methods described herein.

Typically, transgenic plant cells used in methods described herein constitute part or all of a whole plant. Such plants can be grown in a manner suitable for the species under consideration, either in a growth chamber, a greenhouse, or in a field. Transgenic plants can be bred as desired for a particular purpose, e.g., to introduce a recombinant nucleic acid into other lines, to transfer a recombinant nucleic acid to other species or for further selection of other desirable traits. Alternatively, transgenic plants can be propagated vegetatively for those species amenable to such techniques. As used herein, a transgenic plant also refers to progeny of an initial transgenic plant provided the progeny inherits the transgene. Progeny includes descendants of a particular plant or plant line. Progeny of an instant plant include seeds formed on $F_1, F_2, F_3, F_4, F_5, F_6$ and subsequent generation plants, or seeds formed on $BC_1, BC_2, BC_3$, and subsequent generation plants, or seeds formed on $F_1BC_1, F_1BC_2, F_1BC_3$, and subsequent generation plants. Seeds produced by a transgenic plant can be grown and then selfed (or outcrossed and selfed) to obtain seeds homozygous for the nucleic acid construct.

Transgenic plant cells growing in suspension culture, or tissue or organ culture, can be useful for extraction of polypeptides or compounds of interest, e.g., polypeptides encoded by sequences of interest, lignin, compounds in a lignin biosynthesis pathway, or flavonoids. For the purposes of this invention, solid and/or liquid tissue culture techniques can be used. When using solid medium, transgenic plant cells can be placed directly onto the medium or can be placed onto a filter film that is then placed in contact with the medium. When using liquid medium, transgenic plant cells can be placed onto a floatation device, e.g., a porous membrane that contacts the liquid medium. Solid medium typically is made from liquid medium by adding agar. For example, a solid medium can be Murashige and Skoog (MS) medium containing agar and a suitable concentration of an auxin, e.g., 2,4-dichlorophenoxyacetic acid (2,4-D), and a suitable concentration of a cytokinin, e.g., kinetin.

When transiently transformed plant cells are used, a reporter sequence encoding a reporter polypeptide having a reporter activity can be included in the transformation procedure and an assay for reporter activity or expression can be performed at a suitable time after transformation. A suitable time for conducting the assay typically is about 1-21 days after transformation, e.g., about 1-14 days, about 1-7 days, or about 1-3 days. The use of transient assays is particularly convenient for rapid analysis in different species, or to confirm expression of a heterologous regulatory protein whose expression has not previously been confirmed in particular recipient cells.

Techniques for introducing nucleic acids into monocotyledonous and dicotyledonous plants are known in the art, and include, without limitation, *Agrobacterium*-mediated transformation, viral vector-mediated transformation, electroporation and particle gun transformation, e.g., U.S. Pat. Nos. 5,538,880, 5,204,253, 6,329,571 and 6,013,863. If a cell or tissue culture is used as the recipient tissue for transformation, plants can be regenerated from transformed cultures if desired, by techniques known to those skilled in the art. See, e.g., Niu et al., *Plant Cell Rep.* V19:304-310 (2000); Chang and Yang, *Bot. Bull. Acad. Sin.*, V37:35-40 (1996), and Han et al., Biotechnology in Agriculture and Forestry, V44:291 (ed. by Y. P. S. Bajaj), Springer-Verlag, (1999).

A population of transgenic plants can be screened and/or selected for those members of the population that have a desired trait or phenotype conferred by expression of the transgene. For example, a population of progeny of a single transformation event can be screened for those plants having a desired level of expression of a regulatory protein or nucleic acid encoding a regulatory protein. Physical and biochemical methods can be used to identify expression levels. These include Southern analysis or PCR amplification for detection of a polynucleotide; Northern blots, S1 RNase protection, primer-extension, or RT-PCR amplification for detecting RNA transcripts; enzymatic assays for detecting enzyme or ribozyme activity of polypeptides and polynucleotides; and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or polynucleotides. Methods for performing all of the referenced techniques are known. As an alternative, a population of plants comprising independent transformation events can be screened for those plants having a desired trait, such as a modulated lignin content. Selection and/or screening can be carried out over one or more generations, which can be useful to identify those plants that have a desired trait, such as an increased lignin content. Selection and/or screening can also be carried out in more than one geographic location. In some cases, transgenic plants can be grown and selected under conditions which induce a desired phenotype or are otherwise necessary to produce a desired phenotype in a transgenic plant. In addition, selection and/or screening can be carried out during a particular developmental stage in which the phenotype is exhibited by the plant. Selection and/or screening can be carried out to choose those transgenic plants having a statistically significant difference in lignin content relative to a control plant that lacks the transgene. Selected or screened transgenic plants have an altered phenotype as compared to a corresponding control plant, as described in the "Transgenic Plant Phenotypes" section herein.

Plant Species

The polynucleotides and vectors described herein can be used to transform a number of monocotyledonous and dicotyledonous plants and plant cell systems, including dicots such as alfalfa, almond, amaranth, apple, apricot, ash, avocado, beans (including kidney beans, lima beans, dry beans, green beans), beech, bilberry, birch, black-eyed pea, blackberry, blessed milk thistle, blueberry, brazil nut, broccoli, Brussels sprouts, buckwheat, cabbage, canola, carrot, cashew, castor bean, celery, chamomile, cherry, chick peas, chicory, chocolate, clover, cocoa, coffee, cotton, cottonseed, crambe, eucalyptus, flax, foxglove, gooseberry, grape, grapefruit, hawthorn, hazelnut, hemp, jatropha, jojoba, lemon, lentils, lettuce, linseed, loganberry, lupine, macadamia nut, mahogany, mango, maple, melon (e.g., watermelon, cantaloupe), mustard, neem, oak, olive, orange, parsley, peach, peanut, peach, pear, peas, pecan, pepper, pistachio, plum, poplar, poppy, potato, pumpkin, oilseed rape, quinoa, rapeseed (high erucic acid and canola), raspberry, red clover, rhubarb, safflower, sesame, soaptree bark, soybean, spinach, strawberry, sugar beet, sunflower, sweet potatoes, tangerine, tea, teak, tomato, vetch, walnut, willow, and yams, as well as monocots such as banana, barley, bluegrass, chives, coconut, corn, date palm, fescue, field corn, garlic, ginger, millet, miscanthus, oat, oil palm, onion, palm kernel oil, pineapple, popcorn, rice, rye, ryegrass, sorghum, sudangrass, sugarcane, sweet corn, switchgrass, turf grasses, timothy, and wheat. Gymnosperms such as fir, pine, and spruce can also be suitable.

Thus, the methods and compositions described herein can be used with dicotyledonous plants belonging, for example, to the orders Apiales, Arecales, Aristolochiales, Asterales, Batales, Campanulales, Capparales, Caryophyllales, Casuarinales, Celastrales, Cornales, Cucurbitales, Diapensales, Dilleniales, Dipsacales, Ebenales, Ericales, Eucomiales, Euphorbiales, Fabales, Fagales, Gentianales, Geraniales, Haloragales, Hamamelidales, Illiciales, Juglandales, Lamiales, Laurales, Lecythidales, Leitneriales, Linales, Magniolales, Malpighiales, Malvales, Myricales, Myrtales, Nymphaeales, Papaverales, Piperales, Plantaginales, Plumbaginales, Podostemales, Polemoniales, Polygalales, Polygonales, Primulales, Proteales, Rafflesiales, Ranunculales, Rhamnales, Rosales, Rubiales, Salicales, Santales, Sapindales, Sarraceniaceae, Scrophulariales, Solanales, Trochodendrales, Theales, Umbellales, Urticales, and Violales. The methods and compositions described herein also can be utilized with monocotyledonous plants such as those belonging to the orders *Alismatales, Arales, Arecales, Asparagales, Bromeliales, Commelinales, Cyclanthales, Cyperales, Eriocaulales, Hydrocharitales, Juncales, Liliales, Najadales, Orchidales, Pandanales, Poales, Restionales, Triuridales,*

Typhales, Zingiberales, and with plants belonging to Gymnospermae, e.g., Cycadales, Ephedrales, Ginkgoales, Gnetales, Taxales, and Pinales.

The methods and compositions can be used over a broad range of plant species, including species from the dicot genera Abelmoschus, Acokanthera, Acer, Aconitum, Aesculus, Afzelia, Alangium, Alchornea, Alexa, Alnus, Alseodaphne, Amaranthus, Ammodendron, Anabasis, Anacardium, Andrographis, Angophora, Anisodus, Anthemis, Apium, Apocynum, Arabidopsis, Arachis, Argemone, Artemisia, Asclepias, Atropa, Azadirachta, Beilschmiedia, Berberis, Bertholletia, Beta, Betula, Bixa, Bleekeria, Borago, Brassica, Calendula, Camellia, Camptotheca, Canarium, Cannabis, Capsicum, Carthamus, Carya, Catharanthus, Centella, Cephaelis, Chelidonium, Chenopodium, Chrysanthemum, Cicer, Cichorium, Cinchona, Cinnamomum, Cissampelos, Citrus, Citrullus, Cocculus, Cocos, Coffea, Cola, Coleus, Convolvulus, Coptis, Corylus, Corymbia, Crambe, Crataegus, Crotalaria, Croton, Cucumis, Cucurbita, Cuphea, Cytisus, Datura, Daucus, Dendromecon, Dianthus, Dichroa, Digitalis, Dioscorea, Duguetia, Eriogonum, Erythroxylum, Eschscholzia, Eucalyptus, Euphorbia, Euphoria, Fagus, Ficus, Fragaria, Fraxinus, Galega, Gelsemium, Glaucium, Glycine, Glycyrrhiza, Gossypium, Helianthus, Heliotropium, Hemsleya, Hevea, Hydrastis, Hyoscyamus, Jatropha, Juglans, Lactuca, Landolphia, Lavandula, Lens, Linum, Litsea, Lobelia, Luffa, Lupinus, Lycopersicon, Macadamia, Mahonia, Majorana, Malus, Mangifera, Manihot, Meconopsis, Medicago, Menispermum, Mentha, Micropus, Nicotiana, Ocimum, Olea, Origanum, Papaver, Parthenium, Persea, Petroselinum, Petunia, Phaseolus, Physostigma, Pilocarpus, Pistacia, Pisum, Poinsettia, Populus, Prunus, Psychotria, Pyrus, Quercus, Quillaja, Rabdosia, Raphanus, Rauwolfia, Rheum, Rhizocarya, Ribes, Ricinus, Rosa, Rosmarinus, Rubus, Rubia, Salix, Salvia, Sanguinaria, Scopolia, Senecio, Sesamum, Silybum, Simmondsia, Sinapis, Sinomenium, Solanum, Sophora, Spinacia, Stephania, Strophanthus, Strychnos, Tagetes, Tanacetum, Tectona, Theobroma, Thymus, Trifolium, Trigonella, Vaccinium, Vicia, Vigna, Vinca, and Vitis; and the monocot genera Agrostis, Allium, Alopecurus, Alstroemeria, Ananas, Andropogon, Areca, Arundo, Asparagus, Avena, Cocos, Colchicum, Convallaria, Curcuma, Cynodon, Elaeis, Eragrostis, Erianthus, Festuca, Festulolium, Galanthus, Hemerocallis, Hordeum, Lemna, Lolium, Milium, Miscanthus, Musa, Oryza, Panicum, Pennisetum, Phalaris, Phleum, Phoenix, Poa, Ruscus, Saccharum, Secale, Sorghum, Spartina, Triticosecale, Triticum, Uniola, Veratrum, Zea, Zingiber, and Zoysia; and the gymnosperm genera Abies, Cephalotaxus, Cunninghamia, Ephedra, Picea, Pinus, Pseudotsuga and Taxus.

In some embodiments, a plant is a member of the species Abelmoschus esculentus (okra), Abies spp. (fir), Acer spp. (maple), Allium cepa (onion), Alstroemeria spp., Ananas comosus (pineapple), Andrographis paniculata, Andropogon gerardii (big bluestem), Artemisia annua, Arundo donax (giant reed), Atropa belladonna, Avena sativa, bamboo, bentgrass (Agrostis spp.), Berberis spp., Beta vulgaris (sugarbeet), Bixa orellana, Brassica juncea, Brassica napus (canola), Brassica rapa, Brassica oleracea (broccoli, cauliflower, brusselsprouts), Calendula officinalis, Camellia sinensis (tea), Camptotheca acuminate, Cannabis sativa, Capsicum annum (hot & sweet pepper), Carthamus tinctorius (safflower), Catharanthus roseus, Cephalotaxus spp., Chrysanthemum parthenium, Cinchona officinalis, Citrullus lanatus (watermelon), Coffea arabica (coffee), Colchicum autumnale, Coleus forskohlii, Cucumis melo (melon), Cucumis sativus (cucumber), Cucurbita maxima (squash), Cucurbita moschata (squash), Cynodon dactylon (bermudagrass), Datura stomonium, Dianthus caryophyllus (carnation), Digitalis lanata, Digitalis purpurea, Dioscorea spp., Elaeis guineensis (palm), Ephedra sinica, Ephedra spp., Erianthus spp., Erythroxylum coca, Eucalyptus spp. (eucalyptus), Festuca arundinacea (tall fescue), Fragaria ananassa (strawberry), Galanthus wornorii, Glycine max (soybean), Gossypium hirsutum (cotton), Gossypium herbaceum, Helianthus annuus (sunflower), Hevea spp. (rubber), Hordeum vulgare, Hyoscyamus spp., Jatropha curcas (jatropha), Lactuca sativa (lettuce), Linum usitatissimum (flax), Lupinus albus (lupin), Lycopersicon esculentum (tomato), Lycopodium serratum (=Huperzia serrata), Lycopodium spp., Manihot esculenta (cassava), Medicago sativa (alfalfa), Mentha piperita (mint), Mentha spicata (mint), Miscanthus giganteus (miscanthus), Miscanthus hybrid (Miscanthus×giganteus), Miscanthus sinensis, Miscanthus sacchariflorus, Musa paradisiaca (banana), Nicotiana tabacum (tobacco), Oryza sativa (rice), Panicum spp., Panicum virgatum (switchgrass), Papaver somniferum (opium poppy), Papaver orientale, Parthenium argentatum (guayule), Pennisetum glaucum (pearl millet), Pennisetum purpureum (elephant grass), Petunia spp. (petunia), Phalaris arundinacea (reed canarygrass), Pinus spp. (pine), Poinsettia pulcherrima (poinsettia), Populus spp., Populus trichocarpa (poplar), Populus tremuloides (aspen), Rauwolfia serpentina, Rauwolfia spp., Ricinus communis (castor), Rosa spp. (rose), Saccharum spp. (energycane), Saccharum officinarum Salix spp. (willow), Sanguinaria canadensis, Scopolia spp., Secale cereale (rye), Solanum melongena (eggplant), Solanum tuberosum (potato), Sorghum spp., Sorghum almum, Sorghum bicolor (sorghum), Sorghum halapense, Sorghum vulgare, Spartina pectinata (prairie cordgrass), Spinacea oleracea (spinach), Tanacetum parthenium, Taxus baccata, Taxus brevifolia, Theobroma cacao (cocoa), Triticale (wheat×rye), Triticum aestivum (wheat), Uniola paniculata (oats), Veratrum californica, Vinca rosea, Vitis vinifera (grape), and Zea mays (corn).

In certain embodiments, the polynucleotides and vectors described herein can be used to transform a number of monocotyledonous and dicotyledenous plants and plant cell systems, wherein such plants are hybrids of different species or varieties of a specific (e.g., Saccharum sp.×Miscanthus sp.)

Transgenic Plant Phenotypes

Compositions and methods described herein are useful for modulating the amount and/or chemical composition of lignin in plants. For example, the regulatory proteins described herein can modulate transcription of sequences involved in lignin biosynthesis. Thus, a transgenic plant, tissue, or cell comprising a recombinant nucleic acid expressing such a regulatory protein can have a modulated amount and/or rate of lignin biosynthesis when the plant contains an associated regulatory region, either as a genomic sequence or introduced in a recombinant nucleic acid construct. Plants, tissues, or cells containing a recombinant nucleic acid construct described herein typically have a difference in the amount and/or rate of synthesis of lignin, relative to a corresponding control plant, tissue, or cell that is not transformed with the recombinant nucleic acid construct.

A number of different types of lignin, based on chemical and structural features, can be produced by different species of plants, by different tissues of the same plant, or by different parts of the same plant cell. Such lignins include, without limitation, lignins comprising primarily or only coniferyl alcohols such as guaiacyl lignin, lignins comprising primarily or only sinapyl alcohols such as syringyl lignin, lignins comprising primarily or only p-coumaryl alcohols such as p-hydroxyphenyl lignin, and lignins comprising primarily or only coniferyl and sinapyl alcohols such as guaiacyl-syringyl lignin. In addition, other compounds can be incorporated into lignins, including, without limitation, coniferyl/sinapyl p-coumarate, coniferyl/sinapyl p-hydroxybenzoate, coniferyl/sinapyl acetate, ferulate esters, 5-hydroxy-coniferyl alcohol, 3,4-dihydroxy-cinnamyl alcohol, feruloyl amides such as tyramine ferulate, coniferaldehyde/sinapaldehyde, vanillin/syringaldehyde, benzodioxanes, 5-hydroxyguaiacyl, and dihydroconiferyl/dihydro-p-coumaryl alcohol.

The amount and/or rate of synthesis of any type of lignin can be modulated, e.g., increased or decreased, in a transgenic plant, tissue, or cell relative to a control plant, tissue, or cell using the methods described herein. In some cases, the amounts of two or more types of lignin (e.g., two, three, four, five, six, seven, eight, nine, ten or even more types of lignin) can be independently modulated relative to a control plant, tissue, or cell.

In some embodiments, the amount of lignin is decreased in transgenic plants, tissues, or cells described herein (e.g., transgenic plants expressing a regulatory protein or an antisense or double-stranded RNA targeted to a regulatory protein as described herein). A decrease ratio can be expressed as the ratio of the lignin in such a transgenic plant, tissue, or cell on a weight basis (e.g., fresh weight basis) as compared to the lignin in a corresponding control plant, tissue, or cell (e.g., a corresponding plant, tissue, or cell that lacks the recombinant nucleic acid encoding the regulatory protein or the antisense or double-stranded RNA targeted to a regulatory protein). The decrease ratio can be from about 0.05 to about 0.90. In certain cases, the ratio can be from about 0.2 to about 0.6, or from about 0.4 to about 0.6, or from about 0.3 to about 0.5, or from about 0.2 to about 0.4.

In some cases, a decrease in the amount of lignin in a transgenic plant described herein can be calculated as a percent decrease in the weight of lignin extracted per weight of tissue of the transgenic plant relative to the weight of lignin extracted per weight of tissue of a corresponding control plant. For example, the amount of lignin in a tissue of a transgenic plant provided herein can be decreased by about 1% to about 10%, or about 5% to about 15%, or about 20% to about 50%, or about 25% to about 40%, or about 30% to about 60%, or about 50% to about 75%, or about 75% to about 90% relative to the amount of lignin in a tissue of a corresponding control plant.

The decrease in amount of lignin can be restricted in some embodiments to particular tissues and/or organs, relative to other tissues and/or organs. For example, a transgenic plant can have a decreased amount of lignin in stem tissue relative to leaf tissue. The decreased amount of lignin can be in the cell wall of plant cells such as tracheids, xylem fibres, and sclereids.

An increase in the amount of lignin in a transgenic plant, tissue, or cell described herein can be from about 1.02-fold to about 10-fold, about 1.03-fold to about 1.7-fold, or about 1.04-fold to about 1.6-fold, or about 1.05-fold to about 1.7-fold, or about 1.06-fold to about 2.3-fold, or about 1.07-fold to about 2.5-fold, or about 1.08-fold to about 2-fold, or about 1.09-fold to about 2.4-fold, or about 1.1-fold to about 2-fold, or about 1.2-fold to about 3-fold, or about 1.3-fold to about 2.5-fold, or about 1.4-fold to about 3-fold, or about 1.5-fold to about 5-fold, or about 2-fold to about 6-fold, or about 2-fold to about 5-fold, or about 1.5-fold to 7-fold, or about 3-fold to about 4-fold, or about 3-fold to about 7.5-fold, or about 4-fold to about 8-fold, or about 5-fold to about 10-fold higher than the amount in corresponding control plants, tissues, or cells.

In some cases, an increase in the amount of lignin in a transgenic plant described herein can be calculated as a percent increase in the weight of lignin extracted per weight of tissue of the transgenic plant relative to the weight of lignin extracted per weight of tissue of a corresponding control plant. For example, the amount of lignin in a tissue of a transgenic plant provided herein can be increased by about 1% to about 10%, or about 5% to about 15%, or about 20% to about 50%, or about 25% to about 40%, or about 30% to about 60%, or about 50% to about 75%, or about 75% to about 100%, or about 90% to about 150%, or about 50% to about 200%, or about 100% to about 300%, or about 150% to about 500%, or about 200 to about 600%, or about 300% to about 800% relative to the amount of lignin in a tissue of a corresponding control plant.

In some embodiments, the lignin that is increased in a tissue of a transgenic plant described herein is either not produced or is not detectable in a corresponding tissue of a control plant. Thus, in such embodiments, the increase in lignin is infinitely high. For example, in certain cases, a regulatory protein described herein may activate a biosynthetic pathway in a plant tissue that is not normally activated or operational in a control plant tissue and one or more new types of lignin that were not previously produced in that plant tissue can be produced.

The increase in amount of lignin can be restricted in some embodiments to particular tissues and/or organs, relative to other tissues and/or organs. For example, a transgenic plant can have an increased amount of lignin in stem tissue relative to leaf tissue. The increased amount of lignin can be in the cell wall of plant cells such as tracheids, xylem fibres, and sclereids.

In some embodiments, the amount of lignin in transgenic switchgrass (*Panicum virgatum*) expressing a regulatory protein or an antisense or double-stranded RNA targeted to a regulatory protein as described herein can be decreased by about 40% to about 75%, or about 45% to about 70%, or about 48% to about 68%, or about 50% to about 66%, or about 53% to about 66%, or about 55% to about 65%, or about 57% to about 71%, or about 50% to about 70%, or about 55% to about 60%, or about 60% to about 65% by weight relative to the amount of lignin in corresponding control switchgrass (e.g., corresponding wild-type switchgrass or switchgrass that lacks the nucleic acid encoding the regulatory protein or the antisense or double-stranded RNA targeted to a regulatory protein). In some cases, the decrease ratio of lignin in transgenic switchgrass as compared to the lignin in corresponding control switchgrass can be from about 0.4 to about 0.8, or about 0.4 to about 0.7, or about 0.45 to about 0.7, or about 0.5 to about 0.66, or about 0.5 to about 0.7, or about 0.5 to about 0.68, or about 0.55 to about 0.7, or about 0.6 to about 0.7, or about 0.53 to about 0.66.

In some embodiments, the amount of lignin in transgenic switchgrass expressing a regulatory protein or an antisense or double-stranded RNA targeted to a regulatory protein as described herein can be increased by about 100% to about 300%, or about 100% to about 275%, or about 125% to about 300%, or about 125% to about 275%, or about 150% to about 275%, or about 150% to about 250%, or about 175% to about 250%, or about 175% to about 225%, or about 100% to about 250%, or about 150% to 300% by weight as compared to the amount of lignin in corresponding control switchgrass. In some cases, an increase in lignin in transgenic switchgrass described herein can be from about 1.2-fold to about 3-fold, or about 1.3-fold to about 2-fold, or about 1.3-fold to about 2.5-fold, or about 1.5-fold to about 2.1-fold, or about 1.25-fold to about 2.75-fold, or about 1.2-fold to about 2.15-fold, or about 1.4-fold to about 2.8-fold, or about 1.5-fold to about 2.5-fold, or about 1.75-fold to about 2.75-fold, or about 1.2-fold to about 1.9-fold relative to corresponding control switchgrass.

The amount of lignin in a plant can be determined by known techniques, e.g., the acid detergent, Klason, acetyl bromide, and permanganate lignin methods. See, for example, Hatfield and Fukushima, *Crop Sci.*, 45:832-839 (2005); and *Methods in Lignin Chemistry*, Dence and Lin, eds., Springer-Verlag, Berlin, p. 33-61 (1992). Pyrolysis-gas chromatography-mass spectrometry, liquid chromatography-mass spectrometry (LC-MS), or a degradative method, e.g., the DFRC method or thioacidolysis, combined with mass spectrometry also can be used. If desired, the composition and structure of lignin can be characterized by GC-MS, LC-MS, nuclear magnetic resonance spectroscopy, Fourier-transform infrared spectroscopy, and/or other known techniques. In addition, histochemical analysis can be performed to determine the amount and distribution of lignin in a plant. For example, tissue sections can be stained with toluidine blue O (TBO), the Wiesner reagent, or the Maule reagent. TBO is a metachromatic stain that imparts a turquoise color to lignified cell walls and stains non-lignified cell walls purple. Phloroglucinol stains lignified cells red upon reaction with hydroxycinnamaldehyde groups present in the polymer. The Maule reagent is a histochemical stain that allows syringyl lignin to be distinguished chromogenically from guaiacyl lignin in situ. A pink or red color can indicate the presence of syringyl units, whereas a light to dark brown color can indicate the presence of guaiacyl units.

A transgenic plant, tissue, or cell expressing a regulatory protein described herein can have a modulated, e.g., increased or decreased, level of one or more compounds in a lignin biosynthesis pathway as compared to a control plant, tissue, or cell not transgenic for the particular regulatory protein. In certain cases, the amount of more than one compound (e.g., two, three, four, five, six, seven, eight, nine, ten or even more compounds) included in a lignin biosynthetic pathway can be modulated relative to a control plant, tissue, or cell that is not transgenic for a regulatory protein described herein. Such a compound can be, for example, a precursor compound, an intermediate compound, or an end product in a lignin biosynthesis pathway.

Compounds in a lignin biosynthesis pathway include, without limitation, phenylalanine, cinnamic acid, p-coumaric acid, p-coumaraldehyde, p-coumaryl alcohol, caffeic acid, ferulic acid, 5-hydroxy-ferulic acid, 5-hydroxy-feruloyl CoA, sinapic acid, sinapoyl CoA, p-coumaroyl CoA, p-coumaroyl shikimic acid, p-coumaroyl quinic acid, caffeoyl shikimic acid, caffeoyl quinic acid, caffeoyl CoA, feruloyl CoA, coniferaldehyde, 5-hydroxy-coniferaldehyde, sinapaldehyde, coniferyl alcohol, 5-hydroxy-coniferyl alcohol, sinapyl alcohol, caffeyl aldehyde, and caffeyl alcohol.

The amount of one or more compounds in a lignin biosynthesis pathway can be increased or decreased in transgenic cells or tissues expressing a regulatory protein described herein. An increase can be from about 1.2-fold to about 150-fold, about 1.3-fold to about 20-fold, or about 1.2-fold to about 3-fold, or about 1.3-fold to about 2-fold, or about 1.4-fold to about 3-fold, or about 2-fold to about 4-fold, or about 2-fold to about 5-fold, or about 1.5-fold to 7-fold, or about 3-fold to about 4-fold, or about 3-fold to about 7-fold, or about 4-fold to about 8-fold, or about 5-fold to about 10-fold, or about 10-fold to about 15-fold, or about 12-fold to about 18-fold, or about 14-fold to about 22-fold, or about 18-fold to about 30-fold, or about 10-fold to about 100-fold, or about 30-fold to about 100-fold, or about 75-fold to about 130-fold, or about 5-fold to about 50-fold, or about 40-fold to about 150-fold higher than the amount in corresponding control cells or tissues that lack the recombinant nucleic acid encoding the regulatory protein.

In some embodiments, the compound in a lignin biosynthesis pathway that is increased in transgenic cells expressing a regulatory protein described herein is either not produced or is not detectable in a corresponding control cell that lacks the recombinant nucleic acid encoding the regulatory protein. Thus, in such embodiments, the increase in such a compound is infinitely high as compared to corresponding control cells or tissues that lack the recombinant nucleic acid encoding the regulatory protein. For example, in certain cases, a regulatory protein described herein may activate a biosynthetic pathway in a plant that is not normally activated or operational in a control plant, and one or more compounds in a lignin biosynthetic pathway that were not previously produced in that plant species can be produced.

The increase in amount of one or more compounds in a lignin biosynthesis pathway can be restricted in some embodiments to particular tissues and/or organs, relative to other tissues and/or organs. For example, a transgenic plant can have an increased amount of a lignin biosynthesis compound in stem tissue relative to leaf or root tissue.

In some embodiments, the amount of one or more than one compound in a lignin biosynthesis pathway is decreased in transgenic cells expressing a regulatory protein as described herein. A decrease ratio can be expressed as the ratio of the compound in such a transgenic cell on a weight basis (e.g., fresh weight basis) as compared to the compound in a corresponding control cell that lacks the recombinant nucleic acid encoding the regulatory protein. The decrease ratio can be from about 0.05 to about 0.90. In certain cases, the ratio can be from about 0.2 to about 0.6, or from about 0.4 to about 0.6, or from about 0.3 to about 0.5, or from about 0.2 to about 0.4.

In certain embodiments, the compound in a lignin biosynthesis pathway that is decreased in transgenic cells expressing a regulatory protein as described herein is decreased to an undetectable level as compared to the level in corresponding control cells that lack the recombinant nucleic acid encoding the regulatory protein. Thus, in such embodiments, the decrease ratio for such a compound is zero.

The decrease in amount of one or more compounds in a lignin biosynthesis pathway can be restricted in some embodiments to particular tissues and/or organs, relative to other tissues and/or organs. For example, a transgenic plant can have a decreased amount of a compound in stem tissue relative to leaf tissue.

In some embodiments, the amounts of two or more compounds in a lignin biosynthesis pathway are increased and/or decreased, e.g., the amounts of two, three, four, five, six, seven, eight, nine, ten, or more, lignin compounds are independently increased and/or decreased. The amount of a lignin compound can be determined by known techniques, e.g., by extraction of compounds in a lignin biosynthesis pathway from a plant tissue followed by gas chromatography-mass spectrometry (GC-MS) or liquid chromatography-mass spectrometry (LC-MS). If desired, the structure of the lignin compound can be confirmed by GC-MS, LC-MS, nuclear magnetic resonance and/or other known techniques.

In addition to having a modulated amount of lignin and/or a modulated level of one or more than one compound in a lignin biosynthesis pathway, a transgenic plant or cell produced using the materials and methods described herein can produce one or more lignins having an altered structure and/or composition relative to the lignin(s) produced by a corresponding control plant or cell that is not transformed with the recombinant nucleic acid construct. For example, the lignin composition can be altered from essentially 100% guaiacyl units to essentially 100% syringyl units. In some cases, the ratio of syringyl to guaiacyl units incorporated into lignin in a transgenic plant can be modulated relative to the corresponding ratio in a control plant. For example, the ratio of syringyl to guaiacyl units can be increased, e.g., by 1.2-fold, 1.3-fold, 1.4-fold, 1.5-fold, 1.6-fold, 1.7-fold, 1.8-fold, 1.9-fold, 2.0-fold, 2.1-fold, 2.2-fold, 2.3-fold, 2.4-fold, 2.5-fold, 2.6-fold, 2.7-fold, 2.8-fold, 2.9-fold, 3.0-fold, or more than 3.0-fold, in a transgenic plant provided herein as compared to the corresponding ratio in a control plant. In some cases, the ratio of syringyl to guaiacyl units incorporated into lignin in a transgenic plant described herein can be decreased, e.g., by 5%, 10%, 15%, 20%, 25%, 30%, 35%, 40%, 45%, 50%, 60%, 70%, 80%, 90%, 100%, or more than 100%, as compared to the corresponding ratio in a control plant. In some cases, the composition of lignin can be altered in a transgenic plant by having compounds incorporated into lignin that are not normally incorporated into lignin in a wild-type plant. Such compounds can include, without limitation, dihydroconiferyl alcohol, coniferaldehyde, hydroxycinnamaldehydes, and hydroxybenzaldehydes. The composition of lignin in a plant can be determined using well known methods, such as those described herein.

Methods of Screening for Associations and Modulating Expression of Sequences of Interest Provided herein are methods of screening for novel regulatory region-regulatory protein association pairs. The described methods can thus determine whether or not a given regulatory protein can activate a given regulatory region (e.g., to modulate expression of a sequence of interest operably linked to the given regulatory region).

A method of determining whether or not a regulatory region is activated by a regulatory protein can include determining whether or not reporter activity is detected in a plant cell transformed with a recombinant nucleic acid construct comprising a test regulatory region operably linked to a nucleic acid encoding a polypeptide having the reporter activity and with a recombinant nucleic acid construct comprising a nucleic acid encoding a regulatory protein described herein. Detection of the reporter activity indicates that the test regulatory region is activated by the regulatory protein. In certain cases, the regulatory region is a regulatory region as described herein, e.g., comprising a nucleic acid sequence having 80% or greater sequence identity to a regulatory region as set forth in SEQ ID NOs:1909-1918.

For example, a plant can be made that is stably transformed with a sequence encoding a reporter operably linked to the regulatory region under investigation. The plant is inoculated with *Agrobacterium* containing a sequence encoding a regulatory protein on a Ti plasmid vector. A few days after inoculation, the plant tissue is examined for expression of the reporter, or for detection of reporter activity associated with the reporter. If reporter expression or activity is observed, it can be concluded that the regulatory protein increases transcription of the reporter coding sequence, such as by binding the regulatory region. A positive result indicates that expression of the regulatory protein being tested in a plant would be effective for increasing the in planta amount and/or rate of biosynthesis of one or more sequences of interest operably linked to the associated regulatory region.

Similarly, a method of determining whether or not a regulatory region is activated by a regulatory protein can include determining whether or not reporter activity is detected in a plant cell transformed with a recombinant nucleic acid construct comprising a regulatory region as described herein operably linked to a reporter nucleic acid, and with a recombinant nucleic acid construct comprising a nucleic acid encoding a test regulatory protein. Detection of reporter activity indicates that the regulatory region is activated by the test regulatory protein. In certain cases, the regulatory protein is a regulatory protein as described herein, e.g., comprising a polypeptide sequence having 80% or greater sequence identity to a polypeptide sequence set forth in any of SEQ ID NO:96, SEQ ID NOs:98-100, SEQ ID NO:102, SEQ ID NO:104, SEQ ID NO:106, SEQ ID NO:108, SEQ ID NOs:110-112, SEQ ID NOs:114-117, SEQ ID NOs:119-122, SEQ ID NO:124, SEQ ID NOs:126-128, SEQ ID NOs:130-132, SEQ ID NOs:134-137, SEQ ID NO:139, SEQ ID NO:141, SEQ ID NO:143, SEQ ID NOs:145-147, SEQ ID NO:149, SEQ ID NOs:151-155, SEQ ID NO:157, SEQ ID NO:159, SEQ ID NO:161, SEQ ID NO:163, SEQ ID NOs:165-168, SEQ ID NO:170, SEQ ID NOs:172-176, SEQ ID NOs:178-194, SEQ ID NO:196, SEQ ID NOs:198-215, SEQ ID NO:217, SEQ ID NO:219, SEQ ID NOs:221-251, SEQ ID NO:253, SEQ ID NOs:255-256, SEQ ID NO:258, SEQ ID NO:260, SEQ ID NOs:262-265, SEQ ID NO:267, SEQ ID NOs:269-270, SEQ ID NOs:272-273, SEQ ID NOs:275-277, SEQ ID NOs:279-280, SEQ ID NO:282, SEQ ID NO:284, SEQ ID NOs:286-287, SEQ ID NOs:289-290, SEQ ID NO:292, SEQ ID NOs:294-298, SEQ ID NO:300, SEQ ID NO:302, SEQ ID NO:304, SEQ ID NO:306, SEQ ID NOs:308-313, SEQ ID NOs:315-316, SEQ ID NOs:318-319, SEQ ID NO:321, SEQ ID NO:323, SEQ ID NOs:325-326, SEQ ID NO:328, SEQ ID NO:330, SEQ ID NO:332, SEQ ID NOs:334-335, SEQ ID NO:337, SEQ ID NOs:339-341, SEQ ID NO:343, SEQ ID NO:345, SEQ ID NOs:347-351, SEQ ID NO:353, SEQ ID NO:355, SEQ ID NOs:357-359, SEQ ID NOs:361-368, SEQ ID NO:370, SEQ ID NO:372, SEQ ID NOs:374-375, SEQ ID NO:377, SEQ ID NO:379, SEQ ID NOs:381-385, SEQ ID NOs:387-389, SEQ ID NOs:391-392, SEQ ID NOs:394-398, SEQ ID NO:400, SEQ ID NOs:402-403, SEQ ID NO:405, SEQ ID NO:407, SEQ ID NO:409, SEQ ID NO:411, SEQ ID NO:413, SEQ ID NO:415, SEQ ID NOs:417-430, SEQ ID NOs:432-434, SEQ ID NO:436, SEQ ID NO:438, SEQ ID NO:440, SEQ ID NOs:442-443, SEQ ID NOs:445-447, SEQ ID NO:449, SEQ ID NOs:451-452, SEQ ID NOs:454-457, SEQ ID NO:459, SEQ ID NOs:461-463, SEQ ID NOs:465-468, SEQ ID NOs:470-471, SEQ ID NO:473, SEQ ID NOs:475-476, SEQ ID NOs:478-481, SEQ ID NOs:483-485, SEQ ID NOs:487-488, SEQ ID NO:490, SEQ ID NO:492, SEQ ID NO:494, SEQ ID NOs:496-499, SEQ ID NOs:501-502, SEQ ID NOs:504-506, SEQ ID NO:508, SEQ ID NOs:510-514, SEQ ID NO:516, SEQ ID NO:518, SEQ ID NOs:520-522, SEQ ID NO:524, SEQ ID NOs:526-527, SEQ ID NOs:529-533, SEQ ID NO:535, SEQ ID NO:537, SEQ ID NO:539, SEQ ID NO:541, SEQ ID NO:543, SEQ ID NOs:545-546, SEQ ID NOs:548-551, SEQ ID NO:553, SEQ ID NOs:555-561, SEQ ID NOs:563-564, SEQ ID NOs:566-568, SEQ ID NO:570, SEQ ID NO:572, SEQ ID NOs:574-576, SEQ ID NOs:578-579, SEQ ID NO:581, SEQ ID NO:583, SEQ ID NOs:585-588, SEQ ID NOs:590-591, SEQ ID NOs:593-594, SEQ ID NOs:596-597, SEQ ID NO:599, SEQ ID NO:601, SEQ ID NOs:603-604, SEQ ID NO:606, SEQ ID NO:608, SEQ ID NO:610, SEQ ID NO:612, SEQ ID NOs:614-617, SEQ ID NO:619, SEQ ID NOs:621-636, SEQ ID NOs:638-648, SEQ ID NO:650, SEQ ID NOs:652-654, SEQ ID NOs:656-657, SEQ ID NO:659, SEQ ID NOs:661-663, SEQ ID NOs:665-669, SEQ ID NOs:671-673, SEQ ID NOs:675-676, SEQ ID NO:678, SEQ ID NO:680, SEQ ID NO:682, SEQ ID NO:684, SEQ ID NOs:686-687, SEQ ID NOs:689-693, SEQ ID NOs:695-696, SEQ ID NO:698, SEQ ID NOs:700-701, SEQ ID NO:703, SEQ ID NO:705, SEQ ID NO:707, SEQ ID NOs:709-711, SEQ ID NO:713, SEQ ID NOs:715-716, SEQ ID NO:718, SEQ ID NO:720, SEQ ID NO:722, SEQ ID NOs:724-728, SEQ ID NOs:730-735, SEQ ID NOs:737-740, SEQ ID NO:742, SEQ ID NOs:744-745, SEQ ID NOs:747-751, SEQ ID NO:753, SEQ ID NOs:755-758, SEQ ID NOs:760-763, SEQ ID NOs:765-777, SEQ ID NO:779, SEQ ID NOs:781-784, SEQ ID NOs:786-788, SEQ ID NOs:790-791, SEQ ID NOs:793-794, SEQ ID NO:796, SEQ ID NO:798, SEQ ID NO:800, SEQ ID NOs:802-806, SEQ ID NOs:808-809, SEQ ID NOs:811-812, SEQ ID NO:814, SEQ ID NOs:816-818, SEQ ID NO:820, SEQ ID NO:822, SEQ ID NOs:824-826, SEQ ID NO:828, SEQ ID NOs:830-831, SEQ ID NO:833, SEQ ID NOs:835-836, SEQ ID NOs:838-839, SEQ ID NO:841, SEQ ID NOs:843-847, SEQ ID NOs:849-850, SEQ ID NOs:852-853, SEQ ID NOs:855-857, SEQ ID NO:859, SEQ ID NOs:861-863, SEQ ID NOs:865-866, SEQ ID NOs:868-883, SEQ ID NOs:885-888, SEQ ID NO:890, SEQ ID NO:892, SEQ ID NO:894, SEQ ID NO:896, SEQ ID NO:898, SEQ ID NOs:900-902, SEQ ID NOs:904-905, SEQ ID NOs:907-910, SEQ ID NO:912, SEQ ID NOs:914-915, SEQ ID NO:917, SEQ ID NO:919, SEQ ID NOs:921-925, SEQ ID NO:927, SEQ ID NOs:929-932, SEQ ID NO:934, SEQ ID NO:936, SEQ ID NOs:938-941, SEQ ID NO:943 SEQ ID NOs:945-957, SEQ ID NOs:959-962, SEQ ID NO:964, SEQ ID NO:966, SEQ ID NOs:968-971, SEQ ID NO:973, SEQ ID NOs:975-978, SEQ ID NO:980, SEQ ID NOs:982-992, SEQ ID NOs:994-1005, SEQ ID NOs:1007-1009, SEQ ID NOs:1011-1014, SEQ ID NOs:1016-1026, SEQ ID NOs:1028-1029, SEQ ID NOs:1031-1033, SEQ ID NOs:1035-1048, SEQ ID NO:1050, SEQ ID NOs:1052-1053, SEQ ID NOs:1055-1056, SEQ ID NO:1058, SEQ ID NO:1060, SEQ ID NO:1062, SEQ ID NOs:1064-1066, SEQ ID NOs:1068-1069, SEQ ID NOs:1071-1076, SEQ ID NOs:1078-1079, SEQ ID NO:1081, SEQ ID NO:1083, SEQ ID NO:1085, SEQ ID NOs:1087-1089, SEQ ID NOs:1091-1092, SEQ ID NO:1094, SEQ ID NO:1096, SEQ ID NOs:1098-1102, SEQ ID NOs:1104-1107, SEQ ID NOs:1109-1115, SEQ ID NOs:1117-1120, SEQ ID NOs:1122-1123, SEQ ID NOs:1125-1127, SEQ ID NO:1129, SEQ ID NOs:1131-1132, SEQ ID NO:1134, SEQ ID NOs:1136-1137, SEQ ID NOs:1139-1141, SEQ ID NOs:1143-1147, SEQ ID NOs:1149-1154, SEQ ID NOs:1156-1157, SEQ ID NO:1159, SEQ ID NO:1161, SEQ ID NO:1163, SEQ ID NOs:1165-1169, SEQ ID NO:1171, SEQ ID NOs:1173-1174, SEQ ID NOs:1176-1181, SEQ ID NO:1183, SEQ ID NOs:1185-1207, SEQ ID NO:1209, SEQ ID NO:1211, SEQ ID NO:1213, SEQ ID NO:1215, SEQ ID NO:1217, SEQ ID NO:1219, SEQ ID NO:1221, SEQ ID NO:1223, SEQ ID NOs:1225-1235, SEQ ID NO:1237, SEQ ID NO:1239, SEQ ID NO:1241, SEQ ID NO:1243, SEQ ID NO:1245, SEQ ID NO:1247, SEQ ID NO:1249, SEQ ID NO:1251, SEQ ID NO:1253, SEQ ID NO:1255, SEQ ID NO:1257, SEQ ID NO:1259, SEQ ID NO:1261, SEQ ID NO:1263, SEQ ID NO:1265, SEQ ID NO:1267, SEQ ID NO:1269, SEQ ID NO:1271, SEQ ID NO:1273, SEQ ID NO:1275, SEQ ID NO:1277, SEQ ID NO:1279, SEQ ID NO:1281, SEQ ID NO:1283, SEQ ID NOs:1285-1290, SEQ ID NO:1292, SEQ ID NO:1294, SEQ ID NO:1296, SEQ ID NO:1298, SEQ ID NO:1300, SEQ ID NOs:1302-1309, SEQ ID NO:1311, SEQ ID NO:1313, SEQ ID NO:1315, SEQ ID NO:1317, SEQ ID NO:1319, SEQ ID NO:1321, SEQ ID NO:1323, SEQ ID NO:1325, SEQ ID NO:1327, SEQ ID NO:1329, SEQ ID NO:1331, SEQ ID NO:1333, SEQ ID NO:1335, SEQ ID NO:1337, SEQ ID NO:1339, SEQ ID NO:1341, SEQ ID NO:1343, SEQ ID NO:1345, SEQ ID NO:1347, SEQ ID NO:1349, SEQ ID NO:1351, SEQ ID NO:1353, SEQ ID NO:1355, SEQ ID NO:1357, SEQ ID NO:1359, SEQ ID NOs:1361-1367, SEQ ID NO:1369, SEQ ID NO:1371, SEQ ID NO:1373, SEQ ID NO:1375, SEQ ID NO:1377, SEQ ID NO:1379, SEQ ID NO:1381, SEQ ID NO:1383, SEQ ID NO:1385, SEQ ID NO:1387, SEQ ID NO:1389, SEQ ID NO:1391, SEQ ID NO:1393, SEQ ID NO:1395, SEQ ID NO:1397, SEQ ID NO:1399, SEQ ID NO:1401, SEQ ID NO:1403, SEQ ID NOs:1405-1410, SEQ ID NO:1412, SEQ ID NOs:1414-1415, SEQ ID NO:1417, SEQ ID NO:1419, SEQ ID NO:1421, SEQ ID NOs:1423-1429, SEQ ID NO:1431, SEQ ID NO:1433, SEQ ID NOs:1436-1442, SEQ ID NOs:1444-1463, SEQ ID NO:1465, SEQ ID NO:1467, SEQ ID NO:1469, SEQ ID NO:1471, SEQ ID NO:1473, SEQ ID NO:1475, SEQ ID NO:1477, SEQ ID NO:1479, SEQ ID NO:1481, SEQ ID NO:1483, SEQ ID NO:1485, SEQ ID NOs:1487-1491, SEQ ID NOs:1493-1500, SEQ ID NO:1502, SEQ ID NOs:1504-1516, SEQ ID NO:1518, SEQ ID NO:1520, SEQ ID NO:1522, SEQ ID NO:1524, SEQ ID NO:1526, SEQ ID NOs:1528-1534, SEQ ID NO:1536, SEQ ID NO:1538, SEQ ID NO:1540, SEQ ID NO:1542, SEQ ID NO:1544, SEQ ID NO:1546, SEQ ID NO:1548, SEQ ID NO:1550, SEQ ID NO:1552, SEQ ID NO:1554, SEQ ID NO:1556, SEQ ID NO:1558, SEQ ID NO:1560, SEQ ID NO:1562, SEQ ID NO:1564, SEQ ID NO:1566, SEQ ID NO:1568, SEQ ID NOs:1570-1571, SEQ ID NO:1573, SEQ ID NO:1575, SEQ ID NO:1577, SEQ ID NO:1579, SEQ ID NO:1581, SEQ ID NO:1583, SEQ ID NO:1585, SEQ ID NO:1587, SEQ ID NO:1589, SEQ ID NO:1591, SEQ ID NO:1593, SEQ ID NOs:1595-1608, SEQ ID NO:1610, SEQ ID NO:1612, SEQ ID NO:1614, SEQ ID NO:1616, SEQ ID NO:1618, SEQ ID NOs:1620-1622, SEQ ID NO:1624, SEQ ID NO:1626, SEQ ID NO:1628, SEQ ID NO:1630, SEQ ID NOs:1632-1635, SEQ ID NOs:1637-1651, SEQ ID NOs:1653-1655, SEQ ID NO:1657, SEQ ID NO:1659, SEQ ID NO:1661, SEQ ID NO:1663, SEQ ID NO:1665, SEQ ID NO:1667, SEQ ID NO:1669, SEQ ID NO:1671, SEQ ID NO:1673, SEQ ID NOs:1675-1679, SEQ ID NO:1681, SEQ ID NOs:1683-1690, SEQ ID NO:1692, SEQ ID NO:1694, SEQ ID NO:1696, SEQ ID NO:1698, SEQ ID NO:1700, SEQ ID NO:1702, SEQ ID NO:1704, SEQ ID NO:1706, SEQ ID NO:1708, SEQ ID NO:1710; SEQ ID NO:1712, SEQ ID NO:1714, SEQ ID NO:1716, SEQ ID NO:1718, SEQ ID NO:1720, SEQ ID NO:1722, SEQ ID NO:1724, SEQ ID NO:1726, SEQ ID NOs:1728-1731, SEQ ID NO:1733, SEQ ID NOs:1735-1747, SEQ ID NOs:1749-1750, SEQ ID NOs:1752-1765, SEQ ID NOs:1767-1775, SEQ ID NO:1777, SEQ ID NO:1779, SEQ ID NO:1781, SEQ ID NO:1783, SEQ ID NOs:1785-1804, SEQ ID NOs:1806-1820, SEQ ID NO:1822, SEQ ID NO:1824, SEQ ID NO:1826, SEQ ID NO:1828, SEQ ID NO:1830, SEQ ID NO:1832, SEQ ID NO:1834, SEQ ID NO:1836, SEQ ID NO:1838, SEQ ID NO:1840, SEQ ID NO:1842, SEQ ID NO:1844, SEQ ID NO:1846, SEQ ID NO:1848, SEQ ID NO:1850, SEQ ID NO:1852, SEQ ID NO:1854, SEQ ID NO:1856, SEQ ID NO:1858, SEQ ID NO:1860, SEQ ID NO:1862, SEQ ID NO:1864, SEQ ID NO:1866, SEQ ID NO:1868, SEQ ID NO:1870, SEQ ID NO:1872, SEQ ID NO:1874, SEQ ID NO:1876, SEQ ID NO:1878, SEQ ID NO:1880, SEQ ID NO:1882, SEQ ID NO:1884, SEQ ID NO:1886, SEQ ID NO:1888, SEQ ID NO:1890, SEQ ID NOs:1892-1895, SEQ ID NO:1897, SEQ ID NO:1899, SEQ ID NOs:1901-1902, SEQ ID NO:1904, SEQ ID NO:1906, SEQ ID NO:1908, SEQ ID NOs:1921-2059, SEQ ID NO:2061, SEQ ID NO:2063, SEQ ID NOs:2065-2083, SEQ ID NO:2085, or SEQ ID NO:2087.

A transformation can be a transient transformation or a stable transformation, as discussed previously. The regulatory region and the nucleic acid encoding a test regulatory protein can be on the same or different nucleic acid constructs.

A reporter activity, such as an enzymatic or optical activity, can permit the detection of the presence of the reporter polypeptide in situ or in vivo, either directly or indirectly. For example, a reporter polypeptide can itself be bioluminescent upon exposure to light. A reporter polypeptide also can catalyze a chemical reaction in vivo that yields a detectable product that is localized inside or that is associated with a cell that expresses the chimeric polypeptide. Exemplary bioluminescent reporter polypeptides that emit light in the presence of additional polypeptides, substrates or cofactors include firefly luciferase and bacterial luciferase. Bioluminescent reporter polypeptides that fluoresce in the absence of additional proteins, substrates or cofactors when exposed to light having a wavelength in the range of 300 nm to 600 nm include, for example: amFP486, Mut15-amFP486, Mut32-amFP486, CNFP-MODCd1 and CNFP-MODCd2; asFP600, mut1-RNFP, NE-RNFP, d1RNFP and d2RNFP; cFP484, A19-cFP484 and A38-cFP484; dgFP512; dmFP592; drFP583, E5 drFP583, E8 drFP583, E5UP drFP583, E5down drFP583, E57 drFP583, AG4 drFP583 and AG4H drFP583; drFP583/dmFP592, drFP583/dmFP592-2G and drFP583/dmFP592-Q3; dsFP483; zFP506, N65M-zFP506, d1zFP506 and d2zFP506; zFP538, M128V-zFP538, YNFPM128V-MODCd1 and YNFPM128V-MODCd2,; GFP; EGFP, ECFP, EYFP, EBFP, BFP2; d4EGFP, d2EGFP, and d1EGFP; and DsRed and DsRed1. See WO 00/34318; WO 00/34320; WO 00/34319; WO 00/34321; WO 00/34322; WO 00/34323; WO 00/34324; WO 00/34325; WO 00/34326; GenBank Accession No. AAB57606; Clontech User Manual, April 1999, PT2040-1, version PR94845; Li et al., *J Biol Chem* 1998, 273:34970-5; U.S. Pat. No. 5,777,079; and Clontech User Manual, October 1999, PT34040-1, version PR9×217. Reporter polypeptides that catalyze a chemical reaction that yields a detectable product include, for example, β-galactosidase or β-glucuronidase. Other reporter enzymatic activities for use in the invention include neomycin phosphotransferase activity and phosphinotricin acetyl transferase activity.

In some cases, it is known that a particular transcription factor can activate transcription from a particular lignin regulatory region(s), e.g., a regulatory region involved in lignin biosynthesis. In these cases, similar methods can also be useful to screen other regulatory regions, such as other regulatory regions involved in lignin biosynthesis, to determine whether they are activated by the same transcription factor. Thus, the method can comprise transforming a plant cell with a nucleic acid comprising a test regulatory region operably linked to a nucleic acid encoding a polypeptide having reporter activity. The plant cell can include a recombinant nucleic acid encoding a regulatory protein operably linked to a regulatory region that drives transcription of the regulatory protein in the cell. If reporter activity is detected, it can be concluded that the regulatory protein activates transcription mediated by the test regulatory region.

Provided herein also are methods to modulate expression of sequences of interest. Modulation of expression can be expression itself, an increase in expression, or a decrease in expression. Such a method can involve transforming a plant cell with, or growing a plant cell comprising, at least one recombinant nucleic acid construct. A recombinant nucleic acid construct can include a regulatory region as described above, e.g., comprising a nucleic acid having 80% or greater sequence identity to a regulatory region set forth in SEQ ID NOs:1909-1918, where the regulatory region is operably linked to a nucleic acid encoding a sequence of interest. In some cases, a recombinant nucleic acid construct can further include a nucleic acid encoding a regulatory protein as described above, e.g., comprising a polypeptide sequence having 80% or greater sequence identity to a polypeptide sequence set forth in any of SEQ ID NO:96, SEQ ID NOs:98-100, SEQ ID NO:102, SEQ ID NO:104, SEQ ID NO:106, SEQ ID NO:108, SEQ ID NOs:110-112, SEQ ID NOs:114-117, SEQ ID NOs:119-122, SEQ ID NO:124, SEQ ID NOs:126-128, SEQ ID NOs:130-132, SEQ ID NOs:134-137, SEQ ID NO:139, SEQ ID NO:141, SEQ ID NO:143, SEQ ID NOs:145-147, SEQ ID NO:149, SEQ ID NOs:151-155, SEQ ID NO:157, SEQ ID NO:159, SEQ ID NO:161, SEQ ID NO:163, SEQ ID NOs:165-168, SEQ ID NO:170, SEQ ID NOs:172-176, SEQ ID NOs:178-194, SEQ ID NO:196, SEQ ID NOs:198-215, SEQ ID NO:217, SEQ ID NO:219, SEQ ID NOs:221-251, SEQ ID NO:253, SEQ ID NOs:255-256, SEQ ID NO:258, SEQ ID NO:260, SEQ ID NOs:262-265, SEQ ID NO:267, SEQ ID NOs:269-270, SEQ ID NOs:272-273, SEQ ID NOs:275-277, SEQ ID NOs:279-280, SEQ ID NO:282, SEQ ID NO:284, SEQ ID NOs:286-287, SEQ ID NOs:289-290, SEQ ID NO:292, SEQ ID NOs:294-298, SEQ ID NO:300, SEQ ID NO:302, SEQ ID NO:304, SEQ ID NO:306, SEQ ID NOs:308-313, SEQ ID NOs:315-316, SEQ ID NOs:318-319, SEQ ID NO:321, SEQ ID NO:323, SEQ ID NOs:325-326, SEQ ID NO:328, SEQ ID NO:330, SEQ ID NO:332, SEQ ID NOs:334-335, SEQ ID NO:337, SEQ ID NO:339-341, SEQ ID NO:343, SEQ ID NO:345, SEQ ID NO:347-351, SEQ ID NO:353, SEQ ID NO:355, SEQ ID NO:357-359, SEQ ID NOs:361-368, SEQ ID NO:370, SEQ ID NO:372, SEQ ID NOs:374-375, SEQ ID NO:377, SEQ ID NO:379, SEQ ID NOs:381-385, SEQ ID NOs:387-389, SEQ ID NOs:391-392, SEQ ID NOs:394-398, SEQ ID NO:400, SEQ ID NOs:402-403, SEQ ID NO:405, SEQ ID NO:407, SEQ ID NO:409, SEQ ID NO:411, SEQ ID NO:413, SEQ ID NO:415, SEQ ID NOs:417-430, SEQ ID NOs:432-434, SEQ ID NO:436, SEQ ID NO:438, SEQ ID NO:440, SEQ ID NOs:442-443, SEQ ID NOs:445-447, SEQ ID NO:449, SEQ ID NOs:451-452, SEQ ID NOs:454-457, SEQ ID NO:459, SEQ ID NOs:461-463, SEQ ID NOs:465-468, SEQ ID NOs:470-471, SEQ ID NO:473, SEQ ID NOs:475-476, SEQ ID NOs:478-481, SEQ ID NOs:483-485, SEQ ID NOs:487-488, SEQ ID NO:490, SEQ ID NO:492, SEQ ID NO:494, SEQ ID NOs:496-499, SEQ ID NOs:501-502, SEQ ID NOs:504-506, SEQ ID NO:508, SEQ ID NOs:510-514, SEQ ID NO:516, SEQ ID NO:518, SEQ ID NOs:520-522, SEQ ID NO:524, SEQ ID NOs:526-527, SEQ ID NOs:529-533, SEQ ID NO:535, SEQ ID NO:537, SEQ ID NO:539, SEQ ID NO:541, SEQ ID NO:543, SEQ ID NOs:545-546, SEQ ID NOs:548-551, SEQ ID NO:553, SEQ ID NOs:555-561, SEQ ID NOs:563-564, SEQ ID NOs:566-568, SEQ ID NO:570, SEQ ID NO:572, SEQ ID NOs:574-576, SEQ ID NOs:578-579, SEQ ID NO:581, SEQ ID NO:583, SEQ ID NOs:585-588, SEQ ID NOs:590-591, SEQ ID NOs:593-594, SEQ ID NOs:596-597, SEQ ID NO:599, SEQ ID NO:601, SEQ ID NOs:603-604, SEQ ID NO:606, SEQ ID NO:608, SEQ ID NO:610, SEQ ID NO:612, SEQ ID NOs:614-617, SEQ ID NO:619, SEQ ID NOs:621-636, SEQ ID NOs:638-648, SEQ ID NO:650, SEQ ID NOs:652-654, SEQ ID NOs:656-657, SEQ ID NO:659, SEQ ID NOs:661-663, SEQ ID NOs:665-669, SEQ ID NOs:671-673, SEQ ID NOs:675-676, SEQ ID NO:678, SEQ ID NO:680, SEQ ID NO:682, SEQ ID NO:684, SEQ ID NOs:686-687, SEQ ID NOs:689-693, SEQ ID NOs:695-696, SEQ ID NO:698, SEQ ID NOs:700-701, SEQ ID NO:703, SEQ ID NO:705, SEQ ID NO:707, SEQ ID NOs:709-711, SEQ ID NO:713, SEQ ID NOs:715-716, SEQ ID NO:718, SEQ ID NO:720, SEQ ID NO:722, SEQ ID NOs:724-728, SEQ ID NOs:730-735, SEQ ID NOs:737-740, SEQ ID NO:742, SEQ ID NOs:744-745, SEQ ID NOs:747-751, SEQ ID NO:753, SEQ ID NOs:755-758, SEQ ID NOs:760-763, SEQ ID NOs:765-777, SEQ ID NO:779, SEQ ID NOs:781-784, SEQ ID NOs:786-788, SEQ ID NOs:790-791, SEQ ID NOs:793-794, SEQ ID NO:796, SEQ ID NO:798, SEQ ID NO:800, SEQ ID NOs:802-806, SEQ ID NOs:808-809, SEQ ID NOs:811-812, SEQ ID NO:814, SEQ ID NOs:816-818, SEQ ID NO:820, SEQ ID NO:822, SEQ ID NOs:824-826, SEQ ID NO:828, SEQ ID NOs:830-831, SEQ ID NO:833, SEQ ID NOs:835-836, SEQ ID NOs:838-839, SEQ ID NO:841, SEQ ID NOs:843-847, SEQ ID NOs:849-850, SEQ ID NOs:852-853, SEQ ID NOs:855-857, SEQ ID NO:859, SEQ ID NOs:861-863, SEQ ID NOs:865-866, SEQ ID NOs:868-883, SEQ ID NOs:885-888, SEQ ID NO:890, SEQ ID NO:892, SEQ ID NO:894, SEQ ID NO:896, SEQ ID NO:898, SEQ ID NOs:900-902, SEQ ID NOs:904-905, SEQ ID NOs:907-910, SEQ ID NO:912, SEQ ID NOs:914-915, SEQ ID NO:917, SEQ ID NO:919, SEQ ID NOs:921-925, SEQ ID NO:927, SEQ ID NOs:929-932, SEQ ID NO:934, SEQ ID NO:936, SEQ ID NOs:938-941, SEQ ID NO:943 SEQ ID NOs:945-957, SEQ ID NOs:959-962, SEQ ID NO:964, SEQ ID NO:966, SEQ ID NOs:968-971, SEQ ID NO:973, SEQ ID NOs:975-978, SEQ ID NO:980, SEQ ID NOs:982-992, SEQ ID NOs:994-1005, SEQ ID NOs:1007-1009, SEQ ID NOs:1011-1014, SEQ ID NOs:1016-1026, SEQ ID NOs:1028-1029, SEQ ID NOs:1031-1033, SEQ ID NOs:1035-1048, SEQ ID NO:1050, SEQ ID NOs:1052-1053, SEQ ID NOs:1055-1056, SEQ ID NO:1058, SEQ ID NO:1060, SEQ ID NO:1062, SEQ ID NOs:1064-1066, SEQ ID NOs:1068-1069, SEQ ID NOs:1071-1076, SEQ ID NOs:1078-1079, SEQ ID NO:1081, SEQ ID NO:1083, SEQ ID NO:1085, SEQ ID NOs:1087-1089, SEQ ID NOs:1091-1092, SEQ ID NO:1094, SEQ ID NO:1096, SEQ ID NOs:1098-1102, SEQ ID NOs:1104-1107, SEQ ID NOs:1109-1115, SEQ ID NOs:1117-1120, SEQ ID NOs:1122-1123, SEQ ID NOs:1125-1127, SEQ ID NO:1129, SEQ ID NOs:1131-1132, SEQ ID NO:1134, SEQ ID NOs:1136-1137, SEQ ID NOs:1139-1141, SEQ ID NOs:1143-1147, SEQ ID NOs:1149-1154, SEQ ID NOs:1156-1157, SEQ ID NO:1159, SEQ ID NO:1161, SEQ ID NO:1163, SEQ ID NOs:1165-1169, SEQ ID NO:1171, SEQ ID NOs:1173-1174, SEQ ID NOs:1176-1181, SEQ ID NO:1183, SEQ ID NOs:1185-1207, SEQ ID NO:1209, SEQ ID NO:1211, SEQ ID NO:1213, SEQ ID NO:1215, SEQ ID NO:1217, SEQ ID NO:1219, SEQ ID NO:1221, SEQ ID NO:1223, SEQ ID NOs:1225-1235, SEQ ID NO:1237, SEQ ID NO:1239, SEQ ID NO:1241, SEQ ID NO:1243, SEQ ID NO:1245, SEQ ID NO:1247, SEQ ID NO:1249, SEQ ID NO:1251, SEQ ID NO:1253, SEQ ID NO:1255, SEQ ID NO:1257, SEQ ID NO:1259, SEQ ID NO:1261, SEQ ID NO:1263, SEQ ID NO:1265, SEQ ID NO:1267, SEQ ID NO:1269, SEQ ID NO:1271, SEQ ID NO:1273, SEQ ID NO:1275, SEQ ID NO:1277, SEQ ID NO:1279, SEQ ID NO:1281, SEQ ID NO:1283, SEQ ID NOs:1285-1290, SEQ ID NO:1292, SEQ ID NO:1294, SEQ ID NO:1296, SEQ ID NO:1298, SEQ ID NO:1300, SEQ ID NOs:1302-1309, SEQ ID NO:1311, SEQ ID NO:1313, SEQ ID NO:1315, SEQ ID NO:1317, SEQ ID NO:1319, SEQ ID NO:1321, SEQ ID NO:1323, SEQ ID NO:1325, SEQ ID NO:1327, SEQ ID NO:1329, SEQ ID NO:1331, SEQ ID NO:1333, SEQ ID NO:1335, SEQ ID NO:1337, SEQ ID NO:1339, SEQ ID NO:1341, SEQ ID NO:1343, SEQ ID NO:1345, SEQ ID NO:1347, SEQ ID NO:1349, SEQ ID NO:1351, SEQ ID NO:1353, SEQ ID NO:1355, SEQ ID NO:1357, SEQ ID NO:1359, SEQ ID NOs:1361-1367, SEQ ID NO:1369, SEQ ID NO:1371, SEQ ID NO:1373, SEQ ID NO:1375, SEQ ID NO:1377, SEQ ID NO:1379, SEQ ID NO:1381, SEQ ID NO:1383, SEQ ID NO:1385, SEQ ID NO:1387, SEQ ID NO:1389, SEQ ID NO:1391, SEQ ID NO:1393, SEQ ID NO:1395, SEQ ID NO:1397, SEQ ID NO:1399, SEQ ID NO:1401, SEQ ID NO:1403, SEQ ID NOs:1405-1410, SEQ ID NO:1412, SEQ ID NOs:1414-1415, SEQ ID NO:1417, SEQ ID NO:1419, SEQ ID NO:1421, SEQ ID NOs:1423-1429, SEQ ID NO:1431, SEQ ID NO:1433, SEQ ID NOs:1436-1442, SEQ ID NOs:1444-1463, SEQ ID NO:1465, SEQ ID NO:1467, SEQ ID NO:1469, SEQ ID NO:1471, SEQ ID NO:1473, SEQ ID NO:1475, SEQ ID NO:1477, SEQ ID NO:1479, SEQ ID NO:1481, SEQ ID NO:1483, SEQ ID NO:1485, SEQ ID NOs:1487-1491, SEQ ID NOs:1493-1500, SEQ ID NO:1502, SEQ ID NOs:1504-1516, SEQ ID NO:1518, SEQ ID NO:1520, SEQ ID NO:1522, SEQ ID NO:1524, SEQ ID NO:1526, SEQ ID NOs:1528-1534, SEQ ID NO:1536, SEQ ID NO:1538, SEQ ID NO:1540, SEQ ID NO:1542, SEQ ID NO:1544, SEQ ID NO:1546, SEQ ID NO:1548, SEQ ID NO:1550, SEQ ID NO:1552, SEQ ID NO:1554, SEQ ID NO:1556, SEQ ID NO:1558, SEQ ID NO:1560, SEQ ID NO:1562, SEQ ID NO:1564, SEQ ID NO:1566, SEQ ID NO:1568, SEQ ID NOs:1570-1571, SEQ ID NO:1573, SEQ ID NO:1575, SEQ ID NO:1577, SEQ ID NO:1579, SEQ ID NO:1581, SEQ ID NO:1583, SEQ ID NO:1585, SEQ ID NO:1587, SEQ ID NO:1589, SEQ ID NO:1591, SEQ ID NO:1593, SEQ ID NOs:1595-1608, SEQ ID NO:1610, SEQ ID NO:1612, SEQ ID NO:1614, SEQ ID NO:1616, SEQ ID NO:1618, SEQ ID NOs:1620-1622, SEQ ID NO:1624, SEQ ID NO:1626, SEQ ID NO:1628, SEQ ID NO:1630, SEQ ID NOs:1632-1635, SEQ ID NOs:1637-1651, SEQ ID NOs:1653-1655, SEQ ID NO:1657, SEQ ID NO:1659, SEQ ID NO:1661, SEQ ID NO:1663, SEQ ID NO:1665, SEQ ID NO:1667, SEQ ID NO:1669, SEQ ID NO:1671, SEQ ID NO:1673, SEQ ID NOs:1675-1679, SEQ ID NO:1681, SEQ ID NOs:1683-1690, SEQ ID NO:1692, SEQ ID NO:1694, SEQ ID NO:1696, SEQ ID NO:1698, SEQ ID NO:1700, SEQ ID NO:1702, SEQ ID NO:1704, SEQ ID NO:1706, SEQ ID NO:1708, SEQ ID NO:1710; SEQ ID NO:1712, SEQ ID NO:1714, SEQ ID NO:1716, SEQ ID NO:1718, SEQ ID NO:1720, SEQ ID NO:1722, SEQ ID NO:1724, SEQ ID NO:1726, SEQ ID NOs:1728-1731, SEQ ID NO:1733, SEQ ID NOs:1735-1747, SEQ ID NOs:1749-1750, SEQ ID NOs:1752-1765, SEQ ID NOs:1767-1775, SEQ ID NO:1777, SEQ ID NO:1779, SEQ ID NO:1781, SEQ ID NO:1783, SEQ ID NOs:1785-1804, SEQ ID NOs:1806-1820, SEQ ID NO:1822, SEQ ID NO:1824, SEQ ID NO:1826, SEQ ID NO:1828, SEQ ID NO:1830, SEQ ID NO:1832, SEQ ID NO:1834, SEQ ID NO:1836, SEQ ID NO:1838, SEQ ID NO:1840, SEQ ID NO:1842, SEQ ID NO:1844, SEQ ID NO:1846, SEQ ID NO:1848, SEQ ID NO:1850, SEQ ID NO:1852, SEQ ID NO:1854, SEQ ID NO:1856, SEQ ID NO:1858, SEQ ID NO:1860, SEQ ID NO:1862, SEQ ID NO:1864, SEQ ID NO:1866, SEQ ID NO:1868, SEQ ID NO:1870, SEQ ID NO:1872, SEQ ID NO:1874, SEQ ID NO:1876, SEQ ID NO:1878, SEQ ID NO:1880, SEQ ID NO:1882, SEQ ID NO:1884, SEQ ID NO:1886, SEQ ID NO:1888, SEQ ID NO:1890, SEQ ID NOs:1892-1895, SEQ ID NO:1897, SEQ ID NO:1899, SEQ ID NOs:1901-1902, SEQ ID NO:1904, SEQ ID NO:1906, SEQ ID NO:1908, SEQ ID NOs:1921-2059, SEQ ID NO:2061, SEQ ID NO:2063, SEQ ID NOs:2065-2083, SEQ ID NO:2085, or SEQ ID NO:2087. In other cases, the nucleic acid encoding the described regulatory protein is contained on a second recombinant nucleic acid construct. In either case, the regulatory region and the regulatory protein are associated, e.g., as indicated in Table 4 (in Example 2) or as described herein (e.g., all orthologs/homologs of a regulatory protein are also considered to associate with the regulatory regions shown to associate with a given regulatory protein in Table 4 (in Example 2). A plant cell is typically grown under conditions effective for expression of the regulatory protein.

As will be recognized by those having ordinary skill in the art, knowledge of an associated regulatory region-regulatory protein pair can also be used to modulate expression of endogenous sequences of interest that are operably linked to endogenous regulatory regions. In such cases, a method of modulating expression of a sequence of interest includes transforming a plant cell that includes an endogenous regulatory region as described herein, with a recombinant nucleic acid construct comprising a nucleic acid encoding a regulatory protein as described herein, where the regulatory region and the regulatory protein are associated as indicated in Table 4 (in Example 2) and as described herein. A method for expressing an endogenous sequence of interest can include growing such a plant cell under conditions effective for expression of the regulatory protein. An endogenous sequence of interest can in certain cases be a nucleic acid encoding a polypeptide involved in lignin biosynthesis, such as a lignin biosynthesis enzyme or a regulatory protein involved in lignin biosynthesis.

In some cases, knowledge of an associated regulatory region-regulatory protein pair can be used to modulate expression of exogenous sequences of interest by endogenous regulatory proteins. Such method can include transforming a plant cell that includes a nucleic acid encoding a regulatory protein as described herein, with a recombinant nucleic acid construct comprising a regulatory region described herein, where the regulatory region is operably linked to a sequence of interest, and where the regulatory region and the regulatory protein are associated as shown in Table 4 (in Example 2) and described herein. A method of expressing a sequence of interest can include growing such a plant cell under conditions effective for expression of the endogenous regulatory protein.

Also provided are methods for modulating the amount of lignin in a plant. Such a method can include growing a plant cell that includes a nucleic acid encoding an exogenous regulatory protein as described herein and an endogenous regulatory region as described herein operably linked to a sequence of interest. The regulatory protein and regulatory region are associated, as described previously. A sequence of interest can encode a polypeptide involved in lignin biosynthesis. A plant cell can be from a plant capable of producing lignin. The plant cell can be grown under conditions effective for expression of the regulatory protein. The lignin produced can be a novel lignin, e.g., not normally produced in a wild-type plant cell.

In some cases, a method for modulating the amount of lignin in a plant can include growing a plant cell that includes a nucleic acid encoding an endogenous regulatory protein as described herein and a nucleic acid including an exogenous regulatory region as described herein operably linked to a sequence of interest. A sequence of interest can encode a polypeptide involved in lignin biosynthesis. A plant cell can be grown under conditions effective for expression of the regulatory protein. The lignin produced can be a novel type of lignin, e.g., not normally produced in a wild-type plant cell. In some embodiments, a sequence of interest can be in an antisense orientation relative to the exogenous regulatory region. In some cases, a sequence of interest can be transcribed into an interfering RNA.

Provided herein also are methods for modulating (e.g., altering, increasing, or decreasing) the lignin content in a plant. The method can include growing a plant cell as described above, e.g., a plant cell that includes a nucleic acid encoding an endogenous or exogenous regulatory protein, where the regulatory protein associates with, respectively, an exogenous or endogenous regulatory region operably linked to a sequence of interest. In such cases, a sequence of interest can encode a polypeptide involved in lignin biosynthesis. Alternatively, a sequence of interest can result in a transcription product such as an antisense RNA or interfering RNA that affects lignin biosynthesis pathways, e.g., by modulating the steady-state level of mRNA transcripts available for translation that encode one or more lignin biosynthesis enzymes.

The materials and methods described herein are useful for modifying biomass characteristics, such as characteristics of biomass renewable energy source plants. A biomass renewable energy source plant is a plant having or producing material (either raw or processed) that comprises stored solar energy that can be converted to fuel. In general terms, such plants comprise dedicated energy crops as well as agricultural and woody plants. Examples of biomass renewable energy source plants include: switchgrass, elephant grass, giant chinese silver grass, energycane, giant reed (also known as wild cane), miscanthus, tall fescue, bermuda grass, sorghum, napier grass (also known as uganda grass), triticale, rye, winter wheat, shrub poplar, shrub willow, big bluestem, reed canary grass, and corn.

Articles of Manufacture

Transgenic plants provided herein have particular uses in agricultural industries. For example, transgenic plants, e.g., trees, described herein can be used to produce wood that is more lignified, and therefore more durable, than wood from corresponding wild-type plants. Such wood can serve as a superior wood fuel and/or raw material for applications such as woodworking. Transgenic plants such as trees having increased lignin content can also serve as sinks for carbon in the biosphere. Increased sequestration of carbon as lignin in transgenic plants may reduce atmospheric carbon dioxide and global warming. Transgenic plants can also be used to produce crops having an increased lignin content that are less susceptible to lodging. Increasing lignin in fruit, such as tomatoes, can increase the firmness of the fruit, thereby making it more amenable to shipping, storing, slicing, and dicing.

Also provided herein are transgenic plants, such as trees, having a reduced lignin content, which can be useful, e.g., to reduce the pulping cost and energy consumption in the pulping process used to make paper from wood. In addition, transgenic plants having a reduced lignin content can produce crops that are more digestible than crops produced from wild-type plants, which, in turn, can impact the livestock industry. Feeding dairy cattle corn silage produced from corn plants having a reduced and altered lignin content due to homozygosity at one or more bm loci can improve milk production (See, U.S. Pat. No. 6,114,609). Plants having a reduced lignin content also can be valuable for the production of biofuels. The crosslinking structure of lignin is known to complex with cellulose and hemicellulose, thus limiting the efficiency of the conversion process to produce ethanol from plant material. Reducing the lignin content in plants may increase the yield of ethanol from the plant material. See, for example, Mooney et al., *Bioresour Technol,* 64:113-119 (1998); Bernardez et al., *Biotechnol Bioeng.,* 42:899-907 (1993); Chernoglazov et al., *Enzyme Microbiol Technol,* 10:503-507 (1988); and Vinzant et al., *Appl Biochem Biotechnol,* 62:99-104 (1997).

Lignin itself, which can be harvested from transgenic plants provided herein, can be converted into valuable fuel additives. Lignin can be removed from wood pulp of transgenic trees having an increased lignin content, and lignin can be recovered from any bioethanol production process using agricultural materials such as straw, corn stalks and switchgrass engineered to have an increased lignin content. Lignin can also be combusted to provide heat and/or power for the ethanol process; however, increasing the value of the lignin by converting it to higher value fuel additives can significantly enhance the competitiveness of bioethanol technology. Lignins removed from wood pulp as sulphates can be used as dust suppression agents for roads, as dispersants in high performance cement applications, water treatment formulations, and textile dyes, or as raw materials for several chemicals, such as vanillin, DMSA, ethanol, torula yeast, xylitol sugar, and humic acid.

Seeds of transgenic plants described herein can be conditioned and bagged in packaging material by means known in the art to form an article of manufacture. Packaging material such as paper and cloth are well known in the art. A package of seed can have a label e.g., a tag or label secured to the packaging material, a label printed on the packaging material, or a label inserted within the package. The package label may indicate that the seed herein incorporates transgenes that provide increased amounts of lignin in one or more tissues of plants grown from such seeds.

The invention will be further described in the following examples, which do not limit the scope of the invention described in the claims.

EXAMPLES

Example 1

Generation of Lignin Regulatory Region::Luciferase Constructs and Regulatory Protein Constructs Regulatory regions from genes encoding enzymes involved in phenylpropanoid (e.g., lignin) biosynthesis in *Populus trichocarpa* were examined for their ability to associate with regulatory proteins. Regulatory regions from each of the genes listed in Table 2 were amplified from *Populus trichocarpa* genomic DNA using PCR. Nucleotide sequences of the cloned regulatory regions are set forth in SEQ ID NOs:1909-1918.

TABLE 2

Regulatory regions isolated from *Populus trichocarpa* genes encoding enzymes involved in lignin biosynthesis

| Regulatory Region | Enzyme | Regulatory Region SEQ ID NO: |
|---|---|---|
| Pt-4CL | 4-Coumaroyl:CoA ligase | 1909 |
| Pt-F5H1 | Ferulate 5-hydroxylase | 1912 |
| Pt-CCR1 | Cinnamoyl-CoA reductase | 1918 |
| Pt-C4H | Cinnamate 4-hydroxylase | 1916 |
| Pt-PAL4 | Phenylalanine ammonia lyase | 1910 |
| Pt-CAD6 | Cinnamyl alcohol dehydrogenase | 1915 |
| Pt-HCT | Hydroxycinnamoyl transferase | 1911 |
| Pt-C3H1 | p-Coumarate 3-hydroxylase | 1917 |

TABLE 2-continued

Regulatory regions isolated from *Populus trichocarpa* genes encoding enzymes involved in lignin biosynthesis

| Regulatory Region | Enzyme | Regulatory Region SEQ ID NO: |
|---|---|---|
| Pt-COMT | Caffeic acid O-methyltransferase | 1913 |
| Pt-CCoAOMT1 | Caffeoyl-CoA O-methyltransferase | 1914 |

T-DNA binary vector constructs were made using standard molecular biology techniques. A set of constructs was generated using multi-site gateway cloning that contained a luciferase coding sequence operably linked to one of the regulatory regions set forth in Table 2 and SEQ ID NOs:1909-1918. Each of these constructs also contained a marker gene conferring resistance to the herbicide Finale®.

T-DNA binary vector constructs containing nucleic acids encoding regulatory proteins also were generated. Each construct contained a nucleic acid encoding one of the regulatory proteins listed in Table 4 (in Example 2) operably linked to a promoter. A CaMV 35S promoter was operably linked to each regulatory protein coding sequence with the following exception. Gemini ID 5217H1 (SEQ ID NO:1891) was operably linked to the 326F promoter. Each T-DNA binary vector construct was transformed into *Agrobacterium*. One colony from each transformation was selected and maintained as a glycerol stock. Five μL of the glycerol stock of each transformant were inoculated into 800 μL of YEB broth containing 80 μg/mL spectinomycin and 80 μg/mL rifampicin. The cultures were grown overnight in an incubator-shaker at 28° C. and harvested by centrifugation at 4,000 rpm for 15 minutes. The supernatants were discarded, and each pellet was resuspended in sterilized water to an optical density ($OD_{600}$) of about 0.05 to 0.1.

Example 2

Co-Infection Experiments in *Nicotiana* Plants

Wild-type *Nicotiana tabaccum* seeds were planted in 72-well trays containing a 60:40 (v:v) mixture of Sunshine mix and coarse vermiculite with six tablespoons of Marathon™ and nine tablespoons of Osmocote™ per 45 liters of Sunshine mix. The 72-well trays were covered with clear plastic propagation domes. Two weeks after planting, the domes were removed and plants in excess of one plant per well were removed. Four to five weeks after planting, the tobacco seedlings were co-infected with a mixture of two different *Agrobacterium* cultures described in Example 1. One of the *Agrobacterium* cultures contained a vector comprising a regulatory region listed in Table 2 operably linked to a luciferase reporter gene, and the other culture contained a vector that included a nucleotide sequence encoding a regulatory protein listed in Table 4 operably linked to a promoter. Two hundred μL of each of the two different *Agrobacterium* suspensions were mixed together. The mixture was loaded into a 1 mL syringe without a needle and infused in duplicate on the underside of a *Nicotiana* leaf. Each *Agrobacterium* suspension containing a regulatory region listed in Table 2 operably linked to a luciferase reporter gene, or a nucleotide sequence encoding a regulatory protein listed in Table 4 operably linked to a promoter, was infused separately on the underside of the same *Nicotiana* leaf as a control for background luciferase expression and as a negative control, respectively. Two leaves per tobacco seedling were infused. The plants were incubated in a greenhouse for two to four days.

Leaves of *Nicotiana* plants that were infused with *Agrobacterium* were removed from the plants, the non-infused regions of the leaves were trimmed, and the trimmed leaves were arranged in 150×15 mm Petri dishes containing 1% agarose gel. The leaves were sprayed with 1 mM beetle luciferin (catalog no. E1602, Promega, Madison, Wis.) in 0.01% Triton X-100. The Petri dishes were then placed on the stage inside the chamber a Night Owl™ CCD camera (Berthold Technology, Oak Ridge, Tenn.) for about one or two minutes to minimize autofluorescence. Luciferase images were acquired using a one minute exposure time, and a two minute and a five minute exposure time if the signal was low. After acquiring the luciferase images, bright field images also were acquired using a 20 millisecond exposure time.

Qualitative scoring of luciferase reporter activity from each infused leaf was done by visual inspection and comparison of images, taking into account whether or not the luminescence signal in the portions of the leaf that were infused with a mixture of *Agrobacterium* cultures, containing both the regulatory region and the regulatory protein constructs, was higher than the luminescence signal in the portion of the leaf infused with either culture independently. Results of the visual inspection were noted according to the rating system listed in Table 3, and with respect to both the positive and negative controls.

TABLE 3

Luciferase activity scoring system

| Score | Score Comment |
|---|---|
| +++ | signal in the co-infected portion of the leaf is much stronger than in the background control portion of the leaf |
| ++ | signal in the co-infected portion of the leaf is stronger than in the background control portion of the leaf |
| + | signal in the co-infected portion of the leaf is somewhat stronger than in the background control portion of the leaf |
| +/− | signal in the co-infected portion of the leaf is weak, but still stronger than in the background control portion of the leaf |
| − | no detectable signal |

Lignin regulatory region/regulatory protein combinations, also referred to as associations herein, that resulted in a score of ++ or +++ in *Nicotiana* co-infection experiments are listed in Table 4.

TABLE 4

Combinations of regulatory regions and regulatory proteins producing expression of a reporter gene operably linked to each regulatory region

| Regulatory Region | Regulatory Protein SEQ ID NO: | Regulatory Protein Gemini_ID | Regulatory Protein Clone_ID | Regulatory Protein Annot_ID | Regulatory Protein Locus ID | Regulatory Protein Source Organism |
|---|---|---|---|---|---|---|
| Pt4CL | 1862 | 532E10 | 2767 | | At3g25930 | *Arabidopsis thaliana* |
| Pt4CL | 1828 | 5110C1 | | 841947 | At3g24070 | *Arabidopsis thaliana* |
| Pt4CL | 1822 | 5110D6 | | 541941 | At1g03840 | *Arabidopsis thaliana* |
| Pt4CL | 157 | 5110G4 | | 568299 | At5g01980 | *Arabidopsis thaliana* |
| Pt4CL | 159 | 5110H1 | | 574716 | At5g55690 | *Arabidopsis thaliana* |
| Pt4CL | 165 | 5110H6 | | 840236 | At3g10490 | *Arabidopsis thaliana* |
| Pt4CL | 1767 | 531A5 | 32791 | | At4g09960 | *Arabidopsis thaliana* |
| Pt4CL | 1064 | 531B4* | 6042 | | At4g17500 | *Arabidopsis thaliana* |
| Pt4CL | 1860 | 531F2* | 266712 | | At4g39260 | *Arabidopsis thaliana* |
| Pt4CL | 1595 | 531F6 | 41439 | | At3g19580 | *Arabidopsis thaliana* |
| Pt4CL | 1882 | 531G11 | 605218 | | | *Glycine max* |
| Pt4CL | 1886 | 531H11* | 625035 | | | *Glycine max* |
| Pt4CL | 1573 | 531H5 | 36272 | | At1g54830 | *Arabidopsis thaliana* |
| Pt4CL | 1444 | 531H7 | 16204 | | At4g35570 | *Arabidopsis thaliana* |
| Pt4CL | 1897 | 531H8 | 5398 | | At1g15100 | *Arabidopsis thaliana* |
| Pt4CL | 1475 | 531H9 | 21374 | | At4g22745 | *Arabidopsis thaliana* |
| Pt4CL | 1836 | 533D3 | 114074 | | At5g42630 | *Arabidopsis thaliana* |
| Pt4CL | 1249 | 533F7 | 21604 | | At3g48590 | *Arabidopsis thaliana* |
| Pt4CL | 671 | 533H10 | 2942 | | At3g07565 | *Arabidopsis thaliana* |
| Pt4CL | 1581 | 539A11 | 389585 | | | *Zea mays* subsp. *mays* |

TABLE 4-continued

Combinations of regulatory regions and regulatory proteins producing expression of a reporter gene operably linked to each regulatory region

| Regulatory Region | Regulatory Protein SEQ ID NO: | Regulatory Protein Gemini_ID | Regulatory Protein Clone_ID | Regulatory Protein Annot_ID | Regulatory Protein Locus ID | Regulatory Protein Source Organism |
|---|---|---|---|---|---|---|
| Pt4CL | 1383 | 539B6 | 115924 | | At2g01060 | Arabidopsis thaliana |
| Pt4CL | 518 | 539F5 | 157740 | | At3g25790 | Arabidopsis thaliana |
| Pt4CL | 1052 | 540H7 | 557009 | | | Glycine max |
| Pt4CL | 583 | 555C3 | 222885 | | | Zea mays subsp. mays |
| PtC3H | 170 | 5110E5* | | 844490 | At3g55340 | Arabidopsis thaliana |
| PtC3H | 134 | 5109A8 | | 550729 | At2g04240 | Arabidopsis thaliana |
| PtC3H | 1728 | 5109C6 | | 574705 | At5g55580 | Arabidopsis thaliana |
| PtC3H | 104 | 5109H7 | | 542746 | At1g10585 | Arabidopsis thaliana |
| PtC3H | 1828 | 5110C1 | | 841947 | At3g24070 | Arabidopsis thaliana |
| PtC3H | 157 | 5110G4 | | 568299 | At5g01980 | Arabidopsis thaliana |
| PtC3H | 165 | 5110H6 | | 840236 | At3g10490 | Arabidopsis thaliana |
| PtC3H | 520 | 531B2 | 158240 | | At3g14230 | Arabidopsis thaliana |
| PtC3H | 1832 | 531F1 | 106887 | | At1g62990 | Arabidopsis thaliana |
| PtC3H | 1882 | 531G11* | 605218 | | | Glycine max |
| PtC3H | 548 | 532A12 | 1845 | | At2g14900 | Arabidopsis thaliana |
| PtC3H | 590 | 532C7 | 22671 | | | Arabidopsis thaliana |
| PtC3H | 1692 | 532F1 | 92102 | | At5g61600 | Arabidopsis thaliana |
| PtC3H | 808 | 532H8 | 37980 | | At2g47450 | Arabidopsis thaliana |
| PtC3H | 885 | 534A3 | 41634 | | At3g54810 | Arabidopsis thaliana |
| PtC3H | 614 | 534C10 | 2831 | | At3g62420 | Arabidopsis thaliana |
| PtC3H | 221 | 534F12 | 1011900 | | At2g21660 | Arabidopsis thaliana |
| PtC3H | 1526 | 535B8 | 26867 | | At1g22810 | Arabidopsis thaliana |
| PtC3H | 417 | 535G9 | 12256 | | At4g16265 | Arabidopsis thaliana |
| PtC3H | 1854 | 535H2 | 25793 | | At4g31720 | Arabidopsis thaliana |
| PtC3H | 678 | 536C10 | 299144 | | | Zea mays subsp. mays |
| PtC3H | 1211 | 539F4 | 14909 | | At3g62290 | Arabidopsis thaliana |
| PtC3H | 1830 | 539F6 | 100085 | | At5g14000 | Arabidopsis thaliana |
| PtC3H | 1239 | 552A11 | 19340 | | At3g60800 | Arabidopsis thaliana |
| PtC3H | 1323 | 552C9 | 225321 | | | Zea mays subsp. mays |
| PtC3H | 610 | 553H11 | 25816 | | At3g04070 | Arabidopsis thaliana |
| PtC3H | 1653 | 553H5 | 660003 | | | Glycine max |
| PtC4H | 1414 | 555E5 | 12997 | | At5g45100 | Arabidopsis thaliana |
| PtC4H | 1610 | 531E8 | 42530 | | At1g72730 | Arabidopsis thaliana |
| PtC4H | 1377 | 531E9 | 108109 | | At1g68520 | Arabidopsis thaliana |
| PtC4H | 833 | 539E10 | 388074 | | | Zea mays subsp. mays |
| PtC4H | 1806 | 531A7 | 519 | | At1g74500 | Arabidopsis thaliana |
| PtC4H | 1752 | 531F11 | 603410 | | | Glycine max |
| PtC4H | 1661 | 531F12 | 681088 | | | Glycine max |

TABLE 4-continued

Combinations of regulatory regions and regulatory proteins producing expression of a reporter gene operably linked to each regulatory region

| Regulatory Region | Regulatory Protein SEQ ID NO: | Regulatory Protein Gemini_ID | Regulatory Protein Clone_ID | Regulatory Protein Annot_ID | Regulatory Protein Locus ID | Regulatory Protein Source Organism |
|---|---|---|---|---|---|---|
| PtC4H | 885 | 534A3 | 41634 | | At3g54810 | *Arabidopsis thaliana* |
| PtC4H | 1469 | 534G9 | 20769 | | At4g24470 | *Arabidopsis thaliana* |
| PtC4H | 1906 | 534H5 | 9325 | | At1g06680 | *Arabidopsis thaliana* |
| PtC4H | 2065 | 536F6 | 9804 | | At2g02080 | *Arabidopsis thaliana* |
| PtC4H | 585 | 536H10 | 224919 | | | *Zea mays* subsp. *mays* |
| PtC4H | 1315 | 538B5 | 208429 | | | *Zea mays* subsp. *mays* |
| PtC4H | 1585 | 539D12 | 397320 | | | *Zea mays* subsp. *mays* |
| PtC4H | 2085 | 539D9 | 362993 | | | *Zea mays* subsp. *mays* |
| PtC4H | 1058 | 540B5 | 558003 | | | *Glycine max* |
| PtC4H | 914 | 540B6 | 479006 | | | *Glycine max* |
| PtC4H | 1878 | 540C4 | 558431 | | | *Glycine max* |
| PtC4H | 566 | 553A11 | 21406 | | At1g05805 | *Arabidopsis thaliana* |
| PtC4H | 760 | 553A7 | 34635 | | At3g54340 | *Arabidopsis thaliana* |
| PtC4H | 1552 | 553C11 | 33333 | | At4g21440 | *Arabidopsis thaliana* |
| PtC4H | 1904 | 553D4 | 33016 | | At1g22070 | *Arabidopsis thaliana* |
| PtC4H | 703 | 553F1 | 33139 | | At3g28910 | *Arabidopsis thaliana* |
| PtC4H | 964 | 553H3 | 539801 | | | *Glycine max* |
| PtC4H | 1653 | 553H5 | 660003 | | | *Glycine max* |
| PtC4H | 1481 | 553H9 | 21863 | | At5g59550 | *Arabidopsis thaliana* |
| PtC4H | 1518 | 554G8 | 25795 | | At2g46410 | *Arabidopsis thaliana* |
| PtC4H | 583 | 555C3 | 222885 | | | *Zea mays* subsp. *mays* |
| PtC4H | 835 | 555F10 | 38961 | | At5g18090 | *Arabidopsis thaliana* |
| PtC4H | 379 | 555F8 | 115358 | | At2g40340 | *Arabidopsis thaliana* |
| PtC4H | 339 | 555H5 | 105162 | | At1g55910 | *Arabidopsis thaliana* |
| PtCAD6 | 1165 | 532E2 | 99033 | | At5g58787 | *Arabidopsis thaliana* |
| PtCAD6 | 370 | 539E6 | 112194 | | At1g78600 | *Arabidopsis thaliana* |
| PtCAD6 | 1874 | 540E6 | 474636 | | | *Glycine max* |
| PtCAD6 | 555 | 536E7 | 205648 | | At1g56010 | *Arabidopsis thaliana* |
| PtCAD6 | 833 | 539E10 | 388074 | | | *Zea mays* subsp. *mays* |
| PtCAD6 | 415 | 553E10 | 119790 | | At4g35550 | *Arabidopsis thaliana* |
| PtCAD6 | 374 | 553E12 | 113639 | | At3g47500 | *Arabidopsis thaliana* |
| PtCAD6 | 149 | 5109G6 | | 554970 | At2g41460 | *Arabidopsis thaliana* |
| PtCAD6 | 1722 | 5109H3 | | 552542 | At2g21320 | *Arabidopsis thaliana* |
| PtCAD6 | 1735 | 5110H5 | | 834509 | At1g32150 | *Arabidopsis thaliana* |
| PtCAD6 | 1785 | 531A9 | 8607 | | At5g15160 | *Arabidopsis thaliana* |
| PtCAD6 | 520 | 531B2 | 158240 | | At3g14230 | *Arabidopsis thaliana* |
| PtCAD6 | 606 | 531C8 | 2499 | | At5g25890 | *Arabidopsis thaliana* |
| PtCAD6 | 1842 | 532A5 | 152630 | | At1g16490 | *Arabidopsis thaliana* |
| PtCAD6 | 461 | 532B12 | 1480 | | At5g20240 | *Arabidopsis thaliana* |

TABLE 4-continued

Combinations of regulatory regions and regulatory proteins producing expression of a reporter gene operably linked to each regulatory region

| Regulatory Region | Regulatory Protein SEQ ID NO: | Regulatory Protein Gemini_ID | Regulatory Protein Clone_ID | Regulatory Protein Annot_ID | Regulatory Protein Locus ID | Regulatory Protein Source Organism |
|---|---|---|---|---|---|---|
| PtCAD6 | 590 | 532C7 | 22671 | | | Arabidopsis thaliana |
| PtCAD6 | 1504 | 532H5 | 251466 | | At5g52020 | Arabidopsis thaliana |
| PtCAD6 | 838 | 532H9 | 3900 | | At1g05710 | Arabidopsis thaliana |
| PtCAD6 | 1163 | 533A2 | 98716 | | At1g25330 | Arabidopsis thaliana |
| PtCAD6 | 172 | 533A9 | 1001761 | | At5g09250 | Arabidopsis thaliana |
| PtCAD6 | 1850 | 534D12 | 231890 | | | Arabidopsis thaliana |
| PtCAD6 | 413 | 534F6 | 119460 | | At3g04060 | Arabidopsis thaliana |
| PtCAD6 | 1469 | 534G9 | 20769 | | At4g24470 | Arabidopsis thaliana |
| PtCAD6 | 1570 | 535F5 | 34589 | | At1g74430 | Arabidopsis thaliana |
| PtCAD6 | 337 | 536B6 | 104839 | | At2g14490 | Arabidopsis thaliana |
| PtCAD6 | 638 | 536G9 | 285598 | | | Zea mays subsp. mays |
| PtCAD6 | 585 | 536H10 | 224919 | | | Zea mays subsp. mays |
| PtCAD6 | 1333 | 538C6 | 333753 | | | Zea mays subsp. mays |
| PtCAD6 | 686 | 538H5 | 312833 | | | Zea mays subsp. mays |
| PtCAD6 | 1564 | 538H6 | 333416 | | | Zea mays subsp. mays |
| PtCAD6 | 1585 | 539D12 | 397320 | | | Zea mays subsp. mays |
| PtCAD6 | 779 | 539G8 | 362438 | | | Zea mays subsp. mays |
| PtCAD6 | 2087 | 539H3 | 28026 | | At1g07980 | Arabidopsis thaliana |
| PtCAD6 | 1779 | 540A8 | 541719 | | | Glycine max |
| PtCAD6 | 1878 | 540C4 | 558431 | | | Glycine max |
| PtCAD6 | 1876 | 552A4 | 520515 | | | Glycine max |
| PtCAD6 | 601 | 552A6 | 240112 | | | Zea mays subsp. mays |
| PtCAD6 | 1062 | 552A8 | 560961 | | | Glycine max |
| PtCAD6 | 1864 | 552C6* | 280261 | | | Zea mays subsp. mays |
| PtCAD6 | 1868 | 552H9 | 284030 | | | Zea mays subsp. mays |
| PtCAD6 | 566 | 553A11 | 21406 | | At1g05805 | Arabidopsis thaliana |
| PtCAD6 | 1884 | 553B10 | 6163 | | At3g62690 | Arabidopsis thaliana |
| PtCAD6 | 1259 | 553C3 | 29637 | | At1g13690 | Arabidopsis thaliana |
| PtCAD6 | 1653 | 553H5* | 660003 | | | Glycine max |
| PtCAD6 | 1129 | 554D11 | 93825 | | At3g61950 | Arabidopsis thaliana |
| PtCAD6 | 680 | 554G6 | 31044 | | At2g44940 | Arabidopsis thaliana |
| PtCCoAOMT | 1165 | 532E2 | 99033 | | At5g58787 | Arabidopsis thaliana |
| PtCCoAOMT | 1610 | 531E8 | 42530 | | At1g72730 | Arabidopsis thaliana |
| PtCCoAOMT | 372 | 555E8 | 113443 | | At2g05440 | Arabidopsis thaliana |
| PtCCoAOMT | 1785 | 531A9 | 8607 | | At5g15160 | Arabidopsis thaliana |
| PtCCoAOMT | 606 | 531C8 | 2499 | | At5g25890 | Arabidopsis thaliana |
| PtCCoAOMT | 1595 | 531F6 | 41439 | | At3g19580 | Arabidopsis thaliana |
| PtCCoAOMT | 1183 | 532G2 | 99612 | | At4g32800 | Arabidopsis thaliana |

TABLE 4-continued

Combinations of regulatory regions and regulatory proteins producing
expression of a reporter gene operably linked to each regulatory region

| Regulatory Region | Regulatory Protein SEQ ID NO: | Regulatory Protein Gemini_ID | Regulatory Protein Clone_ID | Regulatory Protein Annot_ID | Regulatory Protein Locus ID | Regulatory Protein Source Organism |
|---|---|---|---|---|---|---|
| PtCCoAOMT | 1104 | 533F11 | 8334 | | At3g29035 | *Arabidopsis thaliana* |
| PtCCoAOMT | 432 | 533H4 | 123804 | | At4g09040 | *Arabidopsis thaliana* |
| PtCCoAOMT | 1872 | 535A8 | 35890 | | At5g46690 | *Arabidopsis thaliana* |
| PtCCoAOMT | 1405 | 535A9 | 12071 | | At1g53160 | *Arabidopsis thaliana* |
| PtCCoAOMT | 652 | 535H5 | 2898 | | At1g43890 | *Arabidopsis thaliana* |
| PtCCoAOMT | 599 | 539H2 | 231109 | | At5g29000 | *Arabidopsis thaliana* |
| PtCCoAOMT | 2087 | 539H3 | 28026 | | At1g07980 | *Arabidopsis thaliana* |
| PtCCoAOMT | 1540 | 552D1* | 325800 | | | *Zea mays* subsp. *mays* |
| PtCCoAOMT | 355 | 554A9 | 110419 | | At4g33565 | *Arabidopsis thaliana* |
| PtCCoAOMT | 1267 | 554B7 | 34414 | | At2g47170 | *Arabidopsis thaliana* |
| PtCCoAOMT | 504 | 554D10 | 156373 | | At3g11200 | *Arabidopsis thaliana* |
| PtCCoAOMT | 407 | 554D2 | 117643 | | At1g74840 | *Arabidopsis thaliana* |
| PtCCoAOMT | 816 | 554D4 | 38360 | | At4g22750 | *Arabidopsis thaliana* |
| PtCCoAOMT | 835 | 555F10 | 38961 | | At5g18090 | *Arabidopsis thaliana* |
| PtCCoAOMT | 1870 | 555G3 | 306139 | | | *Zea mays* subsp. *mays* |
| PtCCoAOMT | 1848 | 555G5* | 21674 | | At3g55330 | *Arabidopsis thaliana* |
| PtCCR1 | 1722 | 5109H3 | | 552542 | At2g21320 | *Arabidopsis thaliana* |
| PtCCR1 | 96 | 5110G12 | | 541887 | At1g03360 | *Arabidopsis thaliana* |
| PtCCR1 | 1637 | 531A4 | 6397 | | At2g44840 | *Arabidopsis thaliana* |
| PtCCR1 | 1806 | 531A7 | 519 | | At1g74500 | *Arabidopsis thaliana* |
| PtCCR1 | 524 | 531A8* | 15990 | | At3g44750 | *Arabidopsis thaliana* |
| PtCCR1 | 1661 | 531F12* | 681088 | | | *Glycine max* |
| PtCCR1 | 1573 | 531H5 | 36272 | | At1g54830 | *Arabidopsis thaliana* |
| PtCCR1 | 1444 | 531H7 | 16204 | | At4g35570 | *Arabidopsis thaliana* |
| PtCCR1 | 1096 | 532C9 | 7774 | | At3g03270 | *Arabidopsis thaliana* |
| PtCCR1 | 1423 | 532D11* | 14246 | | At3g52380 | *Arabidopsis thaliana* |
| PtCCR1 | 1183 | 532G2 | 99612 | | At4g32800 | *Arabidopsis thaliana* |
| PtCCR1 | 808 | 532H8 | 37980 | | At2g47450 | *Arabidopsis thaliana* |
| PtCCR1 | 838 | 532H9 | 3900 | | At1g05710 | *Arabidopsis thaliana* |
| PtCCR1 | 1836 | 533D3 | 114074 | | At5g42630 | *Arabidopsis thaliana* |
| PtCCR1 | 1844 | 534G10 | 19561 | | At1g68840 | *Arabidopsis thaliana* |
| PtCCR1 | 1469 | 534G9 | 20769 | | At4g24470 | *Arabidopsis thaliana* |
| PtCCR1 | 1570 | 535F5 | 34589 | | At1g74430 | *Arabidopsis thaliana* |
| PtCCR1 | 652 | 535H5 | 2898 | | At1g43890 | *Arabidopsis thaliana* |
| PtCCR1 | 678 | 536C10 | 299144 | | | *Zea mays* subsp. *mays* |
| PtCCR1 | 1628 | 537H2 | 560731 | | | *Glycine max* |
| PtCCR1 | 707 | 538F5 | 331755 | | | *Zea mays* subsp. *mays* |

TABLE 4-continued

Combinations of regulatory regions and regulatory proteins producing expression of a reporter gene operably linked to each regulatory region

| Regulatory Region | Regulatory Protein SEQ ID NO: | Regulatory Protein Gemini_ID | Regulatory Protein Clone_ID | Regulatory Protein Annot_ID | Regulatory Protein Locus ID | Regulatory Protein Source Organism |
|---|---|---|---|---|---|---|
| PtCCR1 | 744 | 538G9* | 339518 | | | Zea mays subsp. mays |
| PtCCR1 | 695 | 538H10 | 325679 | | | Zea mays subsp. mays |
| PtCCR1 | 686 | 538H5 | 312833 | | | Zea mays subsp. mays |
| PtCCR1 | 934 | 540B2 | 479015 | | | Glycine max |
| PtCCR1 | 938 | 540F4 | 534281 | | | Glycine max |
| PtCCR1 | 1345 | 540H1 | 475689 | | | Glycine max |
| PtCCR1 | 994 | 540H5 | 543118 | | | Glycine max |
| PtCCR1 | 1052 | 540H7 | 557009 | | | Glycine max |
| PtCCR1 | 601 | 552A6 | 240112 | | | Zea mays subsp. mays |
| PtCCR1 | 1540 | 552D1 | 325800 | | | Zea mays subsp. mays |
| PtCCR1 | 381 | 552H11 | 115366 | | At3g14100 | Arabidopsis thaliana |
| PtCCR1 | 760 | 553A7 | 34635 | | At3g54340 | Arabidopsis thaliana |
| PtCCR1 | 1884 | 553B10 | 6163 | | At3g62690 | Arabidopsis thaliana |
| PtCCR1 | 1698 | 553C6* | 968026 | | | Brassica napus |
| PtCCR1 | 355 | 554A9 | 110419 | | At4g33565 | Arabidopsis thaliana |
| PtCCR1 | 1518 | 554G8 | 25795 | | At2g46410 | Arabidopsis thaliana |
| PtCCR1 | 1395 | 555C1 | 120302 | | At4g38620 | Arabidopsis thaliana |
| PtCCR1 | 1675 | 553H6 | 691319 | | | Glycine max |
| PtCCR1 | 1473 | 553C1 | 21240 | | At5g25220 | Arabidopsis thaliana |
| PtCOMT | 898 | 536E6 | 41875 | | At2g01760 | Arabidopsis thaliana |
| PtCOMT | 163 | 5109E9 | | 830468 | At2g44330 | Arabidopsis thaliana |
| PtCOMT | 833 | 539E10 | 388074 | | | Zea mays subsp. mays |
| PtCOMT | 1722 | 5109H3 | | 552542 | At2g21320 | Arabidopsis thaliana |
| PtCOMT | 1826 | 5109H5 | | 566835 | At4g28990 | Arabidopsis thaliana |
| PtCOMT | 1892 | 5217H1 | | | | Populus trichocarpa |
| PtCOMT | 1371 | 531B11 | 597624 | | | Glycine max |
| PtCOMT | 730 | 531C5 | 33435 | | At4g29020 | Arabidopsis thaliana |
| PtCOMT | 606 | 531C8 | 2499 | | At5g25890 | Arabidopsis thaliana |
| PtCOMT | 689 | 531C9 | 31322 | | At4g35570 | Arabidopsis thaliana |
| PtCOMT | 1681 | 531D4* | 7559 | | At1g09140 | Arabidopsis thaliana |
| PtCOMT | 781 | 535B5 | 36370 | | At3g14110 | Arabidopsis thaliana |
| PtCOMT | 1526 | 535B8 | 26867 | | At1g22810 | Arabidopsis thaliana |
| PtCOMT | 417 | 535G9 | 12256 | | At4g16265 | Arabidopsis thaliana |
| PtCOMT | 608 | 535H10 | 25211 | | At5g44080 | Arabidopsis thaliana |
| PtCOMT | 1361 | 537A3 | 560948 | | | Glycine max |
| PtCOMT | 2085 | 539D9 | 362993 | | | Zea mays subsp. mays |
| PtCOMT | 1052 | 540H7 | 557009 | | | Glycine max |
| PtCOMT | 1239 | 552A11 | 19340 | | At3g60800 | Arabidopsis thaliana |
| PtCOMT | 1323 | 552C9 | 225321 | | | Zea mays subsp. mays |
| PtCOMT | 1518 | 554G8 | 25795 | | At2g46410 | Arabidopsis thaliana |

TABLE 4-continued

Combinations of regulatory regions and regulatory proteins producing expression of a reporter gene operably linked to each regulatory region

| Regulatory Region | Regulatory Protein SEQ ID NO: | Regulatory Protein Gemini_ID | Regulatory Protein Clone_ID | Regulatory Protein Annot_ID | Regulatory Protein Locus ID | Regulatory Protein Source Organism |
|---|---|---|---|---|---|---|
| PtCOMT | 1435 | 555B2 | 149496 | | At1g04990 | *Arabidopsis thaliana* |
| PtF5H1 | 119 | 5109B4 | | 549656 | At1g75510 | *Arabidopsis thaliana* |
| PtF5H1 | 1806 | 531A7 | 519 | | At1g74500 | *Arabidopsis thaliana* |
| PtF5H1 | 1785 | 531A9 | 8607 | | At5g15160 | *Arabidopsis thaliana* |
| PtF5H1 | 1371 | 531B11 | 597624 | | | *Glycine max* |
| PtF5H1 | 1185 | 531B7* | 3929 | | At2g05440 | *Arabidopsis thaliana* |
| PtF5H1 | 730 | 531C5 | 33435 | | At4g29020 | *Arabidopsis thaliana* |
| PtF5H1 | 1661 | 531F12 | 681088 | | | *Glycine max* |
| PtF5H1 | 1860 | 531F2 | 266712 | | At4g39260 | *Arabidopsis thaliana* |
| PtF5H1 | 1692 | 532F1 | 92102 | | At5g61600 | *Arabidopsis thaliana* |
| PtF5H1 | 445 | 532G6 | 14203 | | At2g27580 | *Arabidopsis thaliana* |
| PtF5H1 | 526 | 533G9 | 16284 | | At1g51070 | *Arabidopsis thaliana* |
| PtF5H1 | 361 | 533H2 | 112098 | | At1g67950 | *Arabidopsis thaliana* |
| PtF5H1 | 1850 | 534D12 | 231890 | | | *Arabidopsis thaliana* |
| PtF5H1 | 1526 | 535B8 | 26867 | | At1g22810 | *Arabidopsis thaliana* |
| PtF5H1 | 1570 | 535F5 | 34589 | | At1g74430 | *Arabidopsis thaliana* |
| PtF5H1 | 1315 | 538B5 | 208429 | | | *Zea mays* subsp. *mays* |
| PtF5H1 | 707 | 538F5 | 331755 | | | *Zea mays* subsp. *mays* |
| PtF5H1 | 1866 | 538H1 | 280814 | | | *Zea mays* subsp. *mays* |
| PtF5H1 | 357 | 539A7 | 110428 | | At3g19500 | *Arabidopsis thaliana* |
| PtF5H1 | 1876 | 552A4 | 520515 | | | *Glycine max* |
| PtF5H1 | 566 | 553A11 | 21406 | | At1g05805 | *Arabidopsis thaliana* |
| PtF5H1 | 1302 | 554A1 | 124720 | | At3g20310 | *Arabidopsis thaliana* |
| PtF5H1 | 355 | 554A9 | 110419 | | At4g33565 | *Arabidopsis thaliana* |
| PtF5H1 | 793 | 554C4 | 37739 | | At2g27820 | *Arabidopsis thaliana* |
| PtF5H1 | 698 | 554G1 | 32754 | | At4g35785 | *Arabidopsis thaliana* |
| PtF5H1 | 1620 | 554G4* | 45 | | At4g12040 | *Arabidopsis thaliana* |
| PtF5H1 | 1518 | 554G8 | 25795 | | At2g46410 | *Arabidopsis thaliana* |
| PtF5H1 | 1840 | 554H2* | 14432 | | At3g49760 | *Arabidopsis thaliana* |
| PtF5H1 | 1081 | 555B4* | 626054 | | | *Glycine max* |
| PtF5H1 | 1395 | 555C1 | 120302 | | At4g38620 | *Arabidopsis thaliana* |
| PtF5H1 | 490 | 555C11 | 156298 | | At1g24440 | *Arabidopsis thaliana* |
| PtF5H1 | 1285 | 531C6 | 38311 | | At1g25560 | *Arabidopsis thaliana* |
| PtF5H1 | 1421 | 535G10 | 13930 | | At5g02590 | *Arabidopsis thaliana* |
| PtHCT | 415 | 553E10 | 119790 | | At4g35550 | *Arabidopsis thaliana* |
| PtHCT | 106 | 5110B11 | | 548715 | At1g67340 | *Arabidopsis thaliana* |
| PtHCT | 1824 | 5110C9 | | 543489 | At1g16880 | *Arabidopsis thaliana* |
| PtHCT | 1493 | 532G5 | 250132 | | At1g12440 | *Arabidopsis thaliana* |

TABLE 4-continued

Combinations of regulatory regions and regulatory proteins producing expression of a reporter gene operably linked to each regulatory region

| Regulatory Region | Regulatory Protein SEQ ID NO: | Regulatory Protein Gemini_ID | Regulatory Protein Clone_ID | Regulatory Protein Annot_ID | Regulatory Protein Locus ID | Regulatory Protein Source Organism |
|---|---|---|---|---|---|---|
| PtHCT | 409 | 532H3 | 118001 | | At1g12860 | Arabidopsis thaliana |
| PtHCT | 1504 | 532H5 | 251466 | | At5g52020 | Arabidopsis thaliana |
| PtHCT | 808 | 532H8 | 37980 | | At2g47450 | Arabidopsis thaliana |
| PtHCT | 1083 | 533B10 | 6639 | | At5g57660 | Arabidopsis thaliana |
| PtHCT | 661 | 533B11 | 2913 | | At1g69780 | Arabidopsis thaliana |
| PtHCT | 1249 | 533F7 | 21604 | | At3g48590 | Arabidopsis thaliana |
| PtHCT | 652 | 535H5 | 2898 | | At1g43890 | Arabidopsis thaliana |
| PtHCT | 337 | 536B6 | 104839 | | At2g14490 | Arabidopsis thaliana |
| PtHCT | 638 | 536G9 | 285598 | | | Zea mays subsp. mays |
| PtHCT | 1060 | 537H3 | 560765 | | | Glycine max |
| PtHCT | 1858 | 539C3 | 261272 | | At1g17970 | Arabidopsis thaliana |
| PtHCT | 1852 | 539C4 | 250028 | | At1g24210 | Arabidopsis thaliana |
| PtHCT | 1888 | 539D2 | 6827 | | At5g47520 | Arabidopsis thaliana |
| PtHCT | 518 | 539F5* | 157740 | | At3g25790 | Arabidopsis thaliana |
| PtHCT | 1830 | 539F6 | 100085 | | At5g14000 | Arabidopsis thaliana |
| PtHCT | 438 | 539F7* | 125917 | | At4g39470 | Arabidopsis thaliana |
| PtHCT | 436 | 539H7 | 124496 | | At1g30210 | Arabidopsis thaliana |
| PtHCT | 936 | 540A4 | 531573 | | | Glycine max |
| PtHCT | 1131 | 552B2* | 963031 | | | Brassica napus |
| PtHCT | 1890 | 552C2 | 969682 | | | Brassica napus |
| PtHCT | 1323 | 552C9 | 225321 | | | Zea mays subsp. mays |
| PtHCT | 1050 | 552G4 | 545182 | | | Glycine max |
| PtHCT | 1868 | 552H9* | 284030 | | | Zea mays subsp. mays |
| PtHCT | 703 | 553F1 | 33139 | | At3g28910 | Arabidopsis thaliana |
| PtPAL4 | 1414 | 555E5 | 12997 | | At5g45100 | Arabidopsis thaliana |
| PtPAL4 | 370 | 539E6 | 112194 | | At1g78600 | Arabidopsis thaliana |
| PtPAL4 | 1874 | 540E6 | 474636 | | | Glycine max |
| PtPAL4 | 737 | 538E7 | 337432 | | | Zea mays subsp. mays |
| PtPAL4 | 372 | 555E8 | 113443 | | At2g05440 | Arabidopsis thaliana |
| PtPAL4 | 1377 | 531E9 | 108109 | | At1g68520 | Arabidopsis thaliana |
| PtPAL4 | 1862 | 532E10 | 2767 | | At3g25930 | Arabidopsis thaliana |
| PtPAL4 | 833 | 539E10 | 388074 | | | Zea mays subsp. mays |
| PtPAL4 | 374 | 553E12 | 113639 | | At3g47500 | Arabidopsis thaliana |
| PtPAL4 | 119 | 5109B4 | | 549656 | At1g75510 | Arabidopsis thaliana |
| PtPAL4 | 161 | 5109B8 | | 829219 | At2g34200 | Arabidopsis thaliana |
| PtPAL4 | 1637 | 531A4 | 6397 | | At2g44840 | Arabidopsis thaliana |
| PtPAL4 | 1767 | 531A5 | 32791 | | At4g09960 | Arabidopsis thaliana |
| PtPAL4 | 1806 | 531A7 | 519 | | At1g74500 | Arabidopsis thaliana |

TABLE 4-continued

Combinations of regulatory regions and regulatory proteins producing
expression of a reporter gene operably linked to each regulatory region

| Regulatory Region | Regulatory Protein SEQ ID NO: | Regulatory Protein Gemini_ID | Regulatory Protein Clone_ID | Regulatory Protein Annot_ID | Regulatory Protein Locus ID | Regulatory Protein Source Organism |
|---|---|---|---|---|---|---|
| PtPAL4 | 1785 | 531A9 | 8607 | | At5g15160 | Arabidopsis thaliana |
| PtPAL4 | 1185 | 531B7 | 3929 | | At2g05440 | Arabidopsis thaliana |
| PtPAL4 | 689 | 531C9 | 31322 | | At4g35570 | Arabidopsis thaliana |
| PtPAL4 | 1681 | 531D4 | 7559 | | At1g09140 | Arabidopsis thaliana |
| PtPAL4 | 1475 | 531H9 | 21374 | | At4g22745 | Arabidopsis thaliana |
| PtPAL4 | 548 | 532A12 | 1845 | | At2g14900 | Arabidopsis thaliana |
| PtPAL4 | 1842 | 532A5 | 152630 | | At1g16490 | Arabidopsis thaliana |
| PtPAL4 | 461 | 532B12 | 1480 | | At5g20240 | Arabidopsis thaliana |
| PtPAL4 | 411 | 532C4 | 118756 | | At1g14260 | Arabidopsis thaliana |
| PtPAL4 | 590 | 532C7 | 22671 | | | Arabidopsis thaliana |
| PtPAL4 | 1096 | 532C9 | 7774 | | At3g03270 | Arabidopsis thaliana |
| PtPAL4 | 865 | 532D10 | 40334 | | At5g20240 | Arabidopsis thaliana |
| PtPAL4 | 1423 | 532D11 | 14246 | | At3g52380 | Arabidopsis thaliana |
| PtPAL4 | 1692 | 532F1 | 92102 | | At5g61600 | Arabidopsis thaliana |
| PtPAL4 | 1183 | 532G2 | 99612 | | At4g32800 | Arabidopsis thaliana |
| PtPAL4 | 1493 | 532G5 | 250132 | | At1g12440 | Arabidopsis thaliana |
| PtPAL4 | 445 | 532G6 | 14203 | | At2g27580 | Arabidopsis thaliana |
| PtPAL4 | 465 | 532H11 | 1492 | | At5g47200 | Arabidopsis thaliana |
| PtPAL4 | 409 | 532H3 | 118001 | | At1g12860 | Arabidopsis thaliana |
| PtPAL4 | 838 | 532H9 | 3900 | | At1g05710 | Arabidopsis thaliana |
| PtPAL4 | 1163 | 533A2 | 98716 | | At1g25330 | Arabidopsis thaliana |
| PtPAL4 | 1838 | 533B6 | 143475 | | At4g36570 | Arabidopsis thaliana |
| PtPAL4 | 405 | 533C4 | 116968 | | At2g37580 | Arabidopsis thaliana |
| PtPAL4 | 1836 | 533D3 | 114074 | | At5g42630 | Arabidopsis thaliana |
| PtPAL4 | 1104 | 533F11 | 8334 | | At3g29035 | Arabidopsis thaliana |
| PtPAL4 | 1249 | 533F7 | 21604 | | At3g48590 | Arabidopsis thaliana |
| PtPAL4 | 526 | 533G9 | 16284 | | At1g51070 | Arabidopsis thaliana |
| PtPAL4 | 671 | 533H10 | 2942 | | At3g07565 | Arabidopsis thaliana |
| PtPAL4 | 361 | 533H2 | 112098 | | At1g67950 | Arabidopsis thaliana |
| PtPAL4 | 1872 | 535A8 | 35890 | | At5g46690 | Arabidopsis thaliana |
| PtPAL4 | 852 | 535C4 | 39855 | | At2g36930 | Arabidopsis thaliana |
| PtPAL4 | 1361 | 537A3 | 560948 | | | Glycine max |
| PtPAL4 | 1628 | 537H2 | 560731 | | | Glycine max |
| PtPAL4 | 1333 | 538C6 | 333753 | | | Zea mays subsp. mays |
| PtPAL4 | 1866 | 538H1 | 280814 | | | Zea mays subsp. mays |
| PtPAL4 | 695 | 538H10 | 325679 | | | Zea mays subsp. mays |
| PtPAL4 | 1564 | 538H6 | 333416 | | | Zea mays subsp. mays |

TABLE 4-continued

Combinations of regulatory regions and regulatory proteins producing expression of a reporter gene operably linked to each regulatory region

| Regulatory Region | Regulatory Protein SEQ ID NO: | Regulatory Protein Gemini_ID | Regulatory Protein Clone_ID | Regulatory Protein Annot_ID | Regulatory Protein Locus ID | Regulatory Protein Source Organism |
|---|---|---|---|---|---|---|
| PtPAL4 | 357 | 539A7 | 110428 | | At3g19500 | Arabidopsis thaliana |
| PtPAL4 | 1852 | 539C4 | 250028 | | At1g24210 | Arabidopsis thaliana |
| PtPAL4 | 1585 | 539D12 | 397320 | | | Zea mays subsp. mays |
| PtPAL4 | 1465 | 539D5 | 207419 | | At1g66810 | Arabidopsis thaliana |
| PtPAL4 | 599 | 539H2 | 231109 | | At5g29000 | Arabidopsis thaliana |
| PtPAL4 | 436 | 539H7 | 124496 | | At1g30210 | Arabidopsis thaliana |
| PtPAL4 | 914 | 540B6 | 479006 | | | Glycine max |
| PtPAL4 | 980 | 540F9 | 542773 | | | Glycine max |
| PtPAL4 | 900 | 540G8 | 478453 | | | Glycine max |
| PtPAL4 | 1052 | 540H7 | 557009 | | | Glycine max |
| PtPAL4 | 1131 | 552B2 | 963031 | | | Brassica napus |
| PtPAL4 | 1294 | 552G11 | 109490 | | At1g21450 | Arabidopsis thaliana |
| PtPAL4 | 381 | 552H11 | 115366 | | At3g14100 | Arabidopsis thaliana |
| PtPAL4 | 1880 | 552H7* | 560898 | | | Glycine max |
| PtPAL4 | 1552 | 553C11 | 33333 | | At4g21440 | Arabidopsis thaliana |
| PtPAL4 | 1904 | 553D4 | 33016 | | At1g22070 | Arabidopsis thaliana |
| PtPAL4 | 703 | 553F1 | 33139 | | At3g28910 | Arabidopsis thaliana |
| PtPAL4 | 1302 | 554A1 | 124720 | | At3g20310 | Arabidopsis thaliana |
| PtPAL4 | 529 | 554B3* | 17402 | | At2g23780 | Arabidopsis thaliana |
| PtPAL4 | 1267 | 554B7 | 34414 | | At2g47170 | Arabidopsis thaliana |
| PtPAL4 | 793 | 554C4 | 37739 | | At2g27820 | Arabidopsis thaliana |
| PtPAL4 | 504 | 554D10 | 156373 | | At3g11200 | Arabidopsis thaliana |
| PtPAL4 | 1129 | 554D11 | 93825 | | At3g61950 | Arabidopsis thaliana |
| PtPAL4 | 407 | 554D2 | 117643 | | At1g74840 | Arabidopsis thaliana |
| PtPAL4 | 816 | 554D4 | 38360 | | At4g22750 | Arabidopsis thaliana |
| PtPAL4 | 1620 | 554G4 | 45 | | At4g12040 | Arabidopsis thaliana |
| PtPAL4 | 680 | 554G6 | 31044 | | At2g44940 | Arabidopsis thaliana |

*Indicates that the regulatory protein also was observed to be associated with the indicated regulatory region in a secondary screen in Populus, described below.
Pt4CL = Populus 4-Coumaroyl:CoA ligase
PtF5H1 = Populus Ferulate 5-hydroxylase
PtCCR1 = Populus Cinnamoyl-CoA reductase
PtC4H = Populus Cinnamate 4-hydroxylase
PtPAL4 = Populus Phenylalanine ammonia lyase
PtCAD6 = Populus Cinnamyl alcohol dehydrogenase
PtHCT = Populus Hydroxycinnamoyl transferase
PtC3H = Populus p-Coumarate 3-hydroxylase
PtCOMT = Populus Caffeic acid O-methyltransferase
PtCCoAOMT = Populus Caffeoyl-CoA O-methyltransferase Certain regulatory proteins and regulatory regions have been tested in a secondary screen in Populus. The procedure used to perform the secondary screen in Populus was similar to that used to perform the primary screen in Nicotiana as described above, with the following modifications. About 17 µL of the glycerol stock of each Agrobacterium culture containing a vector comprising a regulatory region or a regulatory protein were inoculated into four mL of YEB medium containing spectinomycin and rifampicin. After growing overnight, each culture was harvested and resuspended to the original volume in an aqueous solution containing 10 mM $MgCl_2$, 10 mM MES (pH 5.7), and 150 µM acetosyringone.

Populus plants were grown in soil comprising a 60:40 mixture of Sunshine mix to coarse vermiculite, containing six tablespoons of Marathon™ and nine tablespoons of Osmocote™ per 45 liters of Sunshine mix. The plants were maintained in a greenhouse, zone C, and watered every other day. Once a week, the plants were watered with an aqueous solution containing Peter supplement. About 20 discs per leaf were punched from leaves of the *Populus* plants using a hole punch. The discs were placed in a Petri dish containing a mixture of two different *Agrobacterium* cultures, one containing a vector comprising a regulatory region listed in Table 2 operably linked to a luciferase reporter gene, and the other containing a vector including a nucleotide sequence encoding a regulatory protein listed in Table 4 operably linked to a promoter. Equal amounts (500 µL) of each *Agrobacterium* culture were mixed in the Petri dish with 12.5 mL of an aqueous solution containing 10 mM MgCl$_2$, 10 mM MES (pH 5.7), and 150 µM acetosyringone. For negative and background controls, leaf discs were placed in Petri dishes containing a single *Agrobacterium* culture with a vector including a nucleotide sequence encoding a regulatory protein or a vector including a regulatory region operably linked to a luciferase gene, respectively. Vacuum infiltration was performed for seven minutes at about 75% full-strength. A background control corresponding to the regulatory region being tested was included in the same vacuum infiltration setting. Upon completion of vacuum infiltration, the leaf discs were blot-dried on paper towels and transferred to square Petri dishes lined with paper towels wetted with MS medium (1×MS salt in ddH$_2$O, pH 5.7). The leaf discs were incubated for two to four days in a growth chamber (27° C., 16 hour light cycle) prior to CCD analysis as described above. Results of these experiments are presented in Table 4 above.

Based on the results presented above, expression of a sequence of interest can be modulated in a plant by operably linking a regulatory region from Table 2 to that sequence and controlling expression via one or more of the regulatory proteins that are associated with that regulatory region.

It will be appreciated that regulatory proteins other than those described herein can be screened to determine whether they associate with the regulatory regions of Table 2. That is, one of ordinary skill can use the techniques described herein to identify new regulatory region-regulatory protein association pairs.

Example 3

Histological Analysis of Lignin Content in Transgenic *Arabidopsis* Lines

Transgenic *Arabidopsis* lines transformed with nucleic acid constructs encoding regulatory proteins were analyzed for lignin content using histological staining. Each transgenic line that was analyzed is listed in Table 5 along with identifiers for the corresponding regulatory protein, the nucleic acid encoding the regulatory protein, and the promoter used to express the regulatory protein.

TABLE 5

Transgenic *Arabidopsis* lines analyzed for lignin content

| Transgenic Line ID | Promoter | Regulatory Protein Clone ID | Regulatory Protein Gemini ID | Vector Construct ID | Regulatory Protein SEQ ID NO: |
|---|---|---|---|---|---|
| ME22388 | PT0843 | 16204 | 572C1 | 35199513 | 1444 |
| ME04442 | 35S | 97001 | 216G3 | | 1134 |
| ME04932 | 35S | 1003205 | 280D7 | | 178 |
| ME02500 | 35S | 152630 | 162G10 | 14300834 | 1842 |
| ME04445 | 35S | 124720 | 216B4 | 14300682 | 1302 |
| ME04024 | 35S | 92102 | 159A3 | 14299950 | 1692 |
| ME02589 | 35S | 207629 | 83D4 | | 1846 |
| ME05057 | 35S | 691319 | 284E8 | | 1675 |
| ME01535 | 35S | 36272 | 87F4 | 14299254 | 1573 |
| ME03502 | 35S | 14246 | 179A12 | 14297678 | 1423 |
| ME02276 | 35S | 5398 | 113C2 | 14297012 | 1897 |
| ME02013 | 35S | 6042 | 107E8 | 14297067 | 1064 |
| ME10647 | 35S | 331755 | 527D4 | 21992337 | 707 |
| ME08450 | 35S | 240112 | 474E10 | 22795850 | 601 |
| ME03301 | 35S | 3900 | 178A7 | 14296905 | 838 |
| ME01567 | 35S | 38311 | 87B9 | | 1285 |
| ME00122 | 32449 | 117643 | 15D9 | 25357704 | 407 |
| ME01486 | 35S | 32791 | 86A9 | 14298935 | 1767 |
| ME06485 | 35S | 13930 | 332E3 | | 1421 |
| ME06492 | 35S | 21240 | 332F4 | | 1473 |
| ME23571 | 326F | | 5217H1 | | 1892 |
| ME02171 | 35S | 113443 | 110E9 | 14300413 | 372 |
| ME12975 | 35S | 118184 | 549H3 | | 1393 |

Seeds from the transgenic lines listed in Table 5 were sown in a 60:40 mixture of Sunshine Mix #5 and coarse vermiculite. The sown seeds were stratified for at least three days in a refrigerated cabinet prior to germination in the greenhouse.

To test the staining protocol and determine the optimum developmental stage for histology screening, wild-type plants were collected at different time points starting from the seedling stage just after bolting, about 16 to 18 days after germination, up to the mature stage, about 35 days after germination. Based on the results of this analysis, which are summarized in Table 6 below, *Arabidopsis* plants were allowed to grow for at least 24 to 26 days post-germination prior to performing the primary histological analysis.

Some of the transgenic lines were analyzed further for ectopic lignin accumulation. Transgenic *Arabidopsis* seedlings were collected two weeks post germination and incubated overnight in a 12-well dish containing 80% ethanol to remove the chlorophyll. In addition, mature rosette and cauline leaves were collected from transgenic plants five weeks after germination, placed in a 12-well dish, and processed in a manner similar to the manner in which the seedlings were processed.

Phloroglucinol Staining

For the primary histological analysis, the main inflorescence stem was cut at the basal end, about 0.5 cm from the junction of the rosette leaves, using a razor blade. Thin sections of the stems, about 200 microns thick, were manually generated using a razor blade against a Styrofoam support. Up to three individual plants were sampled from each transformation event. Up to five transformation events per transgenic line were used.

The tissue sections were immediately placed on a microscope slide and a drop of 1% phloroglucinol solution in 6 M HCl was placed on top of each section to adequately cover the sample for about 2 minutes. The phloroglucinol reagent present in the tissue sections was diluted by adding about 5 drops of water using a pipette. A cover slip was placed on the tissue sections in preparation for microscopy, and any excess liquid was removed with a tissue paper.

For seedlings and whole leaf tissues, ethanol was removed after overnight incubation and replaced with 1 mL of 1% phloroglucinol solution in 6 M HCl to cover the tissues in the well. The tissues were stained for about 2 minutes. The phloroglucinol solution was subsequently removed and replaced with 1 mL of water. The tissues were kept in the 12-well dish for scanning.

Microscopy, Image Acquisition, and Image Analysis

Digital images of tissue sections were taken in tif format at 50× magnification using a Carl Zeiss Axioshop 2 microscope set in a dark field view at 3200K exposure. The microscope was linked to Axiovision software version 3.1.2.1 set at 3200K white balance exposure. The tif format images were adjusted and converted into jpeg format using the Adobe Photoshop plug-in software (AGD Color Temperature Correction version 4) set at 6000K correction condition.

The adjusted jpeg format images were read by WinRhizo Pro software (Regent Instruments Inc.) using a calibration method to classify the pixels within the image view according to whether they belonged to stained lignified cells/tissues (designated as X), to non-lignified cells/tissues (designated as NL), or to the background (designated as B). The results of this "binning" process were exported into an Excel spreadsheet.

The lignified area within an image taken at 50× magnification was semi-quantified and represented as the ratio (R) of the lignified region relative to the whole tissue within an image. The R value was calculated as follows: R=X/(X+NL). The R values from tissue sections of three plants per transformation event were averaged, and the standard deviation was calculated for each average R value. The average R value and standard deviation for each transformation event was compared to the average R value and standard deviation for the wild-type plants to determine whether the difference between the average R values was statistically significant.

The degree of increase or decrease in lignin content within the sampled stem sections of a transgenic line relative to the lignin content in sampled stem sections of wild-type plants was calculated using the following formula.

$$[(R_{transgenic})-(\text{Average } R_{wild-type})]/(\text{Average } R_{wild-type}) \times 100$$

A relative value, calculated using the formula above, that was positive indicated an increased lignin content in the transgenic line relative to wild-type plants (Table 7). A relative value that was negative indicated a decreased lignin content in the transgenic line relative to wild-type plants (Table 7).

The microscope images of stem tissue sections were also qualitatively inspected to determine if there was ectopic deposition of lignin in regions not normally lignified in wild-type stem tissues, or if there were developmental changes in tissue arrangement compared to the arrangement in wild-type plants.

Digital images of seedlings and whole leaf tissues were taken in jpeg format using an Epson 4870 Photo Scanner. Images of transgenic tissues were compared to images of wild-type tissues to qualitatively determine if there was ectopic or increased accumulation of lignin in organs from transgenic plants as compared to organs from wild-type plants.

Results of Histological Analysis

Results of the semi-quantitative analysis of the lignified areas of stem sections from wild-type *Arabidopsis* plants at different developmental stages are summarized in Table 6.

TABLE 6

Lignin content of wild-type *Arabidopsis* plants at different stages of development

| Development Stage (Days after Germination) | Stem Region | R value (Average) | Standard Deviation | Comments |
|---|---|---|---|---|
| 18 | Top | N/A | | Tissues too soft for sectioning |
| | Middle | 0.03 | | Tissues still soft for sectioning |
| | Base | 0.06 | | Tissues still soft for sectioning |
| 24 | Top | N/A | | Tissues too soft for sectioning |
| | Middle | 0.25 | 0.04 | |
| | Base | 0.30 | 0.06 | |
| 25 | Top | N/A | | Tissues too soft for sectioning |
| | Middle | N/A | | |
| | Base | 0.29 | 0.03 | |
| 27 | Top | 0.17 | | Tissues still soft for sectioning |
| | Middle | 0.23 | 0.03 | |
| | Base | 0.32 | 0.10 | |
| 35 | Top | 0.23 | 0.08 | |
| | Middle | 0.21 | 0.005 | |
| | Base | 0.37 | 0.09 | Stem becoming brittle |

Based on the results presented in Table 6, the basal regions of transgenic and corresponding wild-type control plants between 24 to 26 days post germination were used for histological analysis. The results are summarized in Table 7.

TABLE 7

Summary of the histological analysis of lignin content in transgenic *Arabidopsis* lines

| Gemini ID or Genomic Locus | Source | Construct Code | Transgenic line - event | Change in lignin content relative to wild-type controls | Observable Phenotype |
|---|---|---|---|---|---|
| 538F5 | Zm | Clone ID 331755 | ME10647-02 | 30% Increase | |
| | | | ME10647-03 | 34% Increase | |
| 552A6 | Zm | Clone ID 240112 | ME08450-01 | 35% Increase | |
| | | | ME08450-05 | 35% Increase | |
| 553H6 | Gm | Clone ID 691319 | ME05057-01 | 73% Decrease | Dwarf; twisted rosette leaves; "wilting" under greenhouse conditions |
| | | | ME05057-05 | 56% Decrease | Dwarf; twisted rosette leaves; "wilting" under greenhouse conditions |
| | | | ME05057-06 | 39% Decrease | Dwarf; twisted rosette leaves; "wilting" under greenhouse conditions |
| | | | ME05057-07 | 35% Decrease | Dwarf; twisted rosette leaves; "wilting" under greenhouse conditions |
| 5217H1 | Pt | Gemini ID 5217H1 | ME23571-01 | Increase | Dwarf; vascular bundles of amphivasal type |
| | | | ME23571-03 | 25% Increase | Dwarf; vascular bundles of amphivasal type |
| | | | ME23571-04 | 28% Increase | Shorter than wild-type; vascular bundles of amphivasal type |
| At1g05710 | At | Clone ID 3900 | ME03301-02 | 50% Decrease | Shorter than wild-type |
| | | | ME03301-05 | 36% Decrease | Shorter than wild-type |
| | | | ME03301-06 | 19% Decrease | Shorter than wild-type |
| At1g15100 | At | Clone ID 5398 | ME02276-03 | 22% Increase | |
| | | | ME02276-04 | 23% Increase | |
| | | | ME02276-05 | 28% Increase | |
| At1g16490 | At | Clone ID 152630 | ME02500-03 | 38% Increase | |
| | | | ME02500-05 | 21% Increase | |
| At1g25560 | At | Clone ID 38311 | ME01567-02 | 35% Decrease | Shorter than wild-type |
| | | | ME01567-04 | 15% Decrease | |
| At1g54830 | At | Clone ID 36272 | ME01535-02 | 27% Increase | |
| | | | ME01535-03 | 24% Increase | |
| | | | ME01535-04 | 26% Increase | |
| | | | ME01535-05 | 31% Increase | |
| At1g74840 | At | Clone ID 117643 | ME00122-01 | 16% Increase | |
| | | | ME00122-02 | 20% Increase | |
| | | | ME00122-03 | 17% Increase | |
| | | | ME00122-04 | 25% Increase | |
| At2g05440 | At | Clone ID 113443 | ME02171-01 | 41% Increase | |
| | | | ME02171-02 | 29% Increase | |
| | | | ME02171-04 | 18% Increase | |
| | | Clone ID 207629 | ME02589-02 | Increase | Ectopic lignin in seedling petiole |
| | | | ME02589-04 | 16% Increase | Ectopic lignin in seedling petiole |
| | | | ME02589-05 | Increase | Ectopic lignin in seedling petiole |
| | | Clone ID 118184 | ME12975-01 | 26% Increase | |
| | | | ME12975-04 | 25% Increase | |
| | | | ME12975-05 | 25% Increase | |
| At3g20310 | At | Clone ID 124720 | ME04445-03 | Increase | Low ectopic lignin in pith |
| | | | ME04445-04 | 33% Increase | Ectopic lignin in pith; reduced fertility |
| | | | ME04445-05 | 38% Increase | Ectopic lignin in pith; reduced fertility |
| At3g52380 | At | Clone ID 14246 | ME03502-05 | 15% Increase | Amphivasal vascular bundle; extended xylem region |
| At4g09960 | At | Clone ID 32791 | ME01486-02 | 34% Decrease | Smaller, shorter than wild-type |
| | | | ME01486-07 | 36% Decrease | Smaller, shorter than wild-type |
| | | | ME01486-08 | 45% Decrease | Smaller, shorter than wild-type |

TABLE 7-continued

Summary of the histological analysis of lignin content in transgenic *Arabidopsis* lines

| Gemini ID or Genomic Locus | Source | Construct Code | Transgenic line - event | Change in lignin content relative to wild-type controls | Observable Phenotype |
|---|---|---|---|---|---|
| At4g17500 | At | Clone ID 6042 | ME02013-02 | 33% Increase | |
| | | | ME02013-03 | 16% Increase | |
| | | | ME02013-05 | 30% Increase | Low ectopic lignin in pith |
| At4g35570 | At | Clone ID 16204 | ME22388-02 | 16% Decrease | Curly rosette leaves |
| | | | ME22388-05 | 14% Decrease | |
| | | | ME22388-06 | 12% Decrease | Curly rosette leaves |
| At4g39260 | At | Clone ID 97001 | ME04442-02 | 10% Increase | |
| | | | ME04442-03 | 13% Increase | |
| | | Clone ID 1003205 | ME04932-01 | 20% Increase | |
| | | | ME04932-05 | 6% Increase | |
| At5g02590 | At | Clone ID 13930 | ME06485-03 | 58% Increase | |
| | | | ME06485-05 | 84% Increase | |
| At5g25220 | At | Clone ID 21240 | ME06492-02 | 42% Decrease | Shorter than wild-type |
| | | | ME06492-07 | 29% Decrease | Shorter than wild-type |
| At5g61600 | At | Clone ID 92102 | ME04024-01 | 38% Increase | Low ectopic lignin in the pith; amphivasal vascular bundle |

Zm = *Zea mays*;
Gm = *Glycine max*;
Pt = *Populus trichocarpa*;
At = *Arabidopsis thaliana*

Clone ID 1003205, listed in Table 7 above, is a homolog of Clone ID 266712, listed in Table 4 above. Clone ID 97001 is a different polypeptide encoded by genomic locus At4g39260 that also has activity based on histology data (Table 7). In addition, a homolog of Clone ID 1003205, identified herein as Clone ID 1011900 (SEQ ID NO:193), is associated with a p-Coumarate 3-hydroxylase regulatory region.

Figure 52:
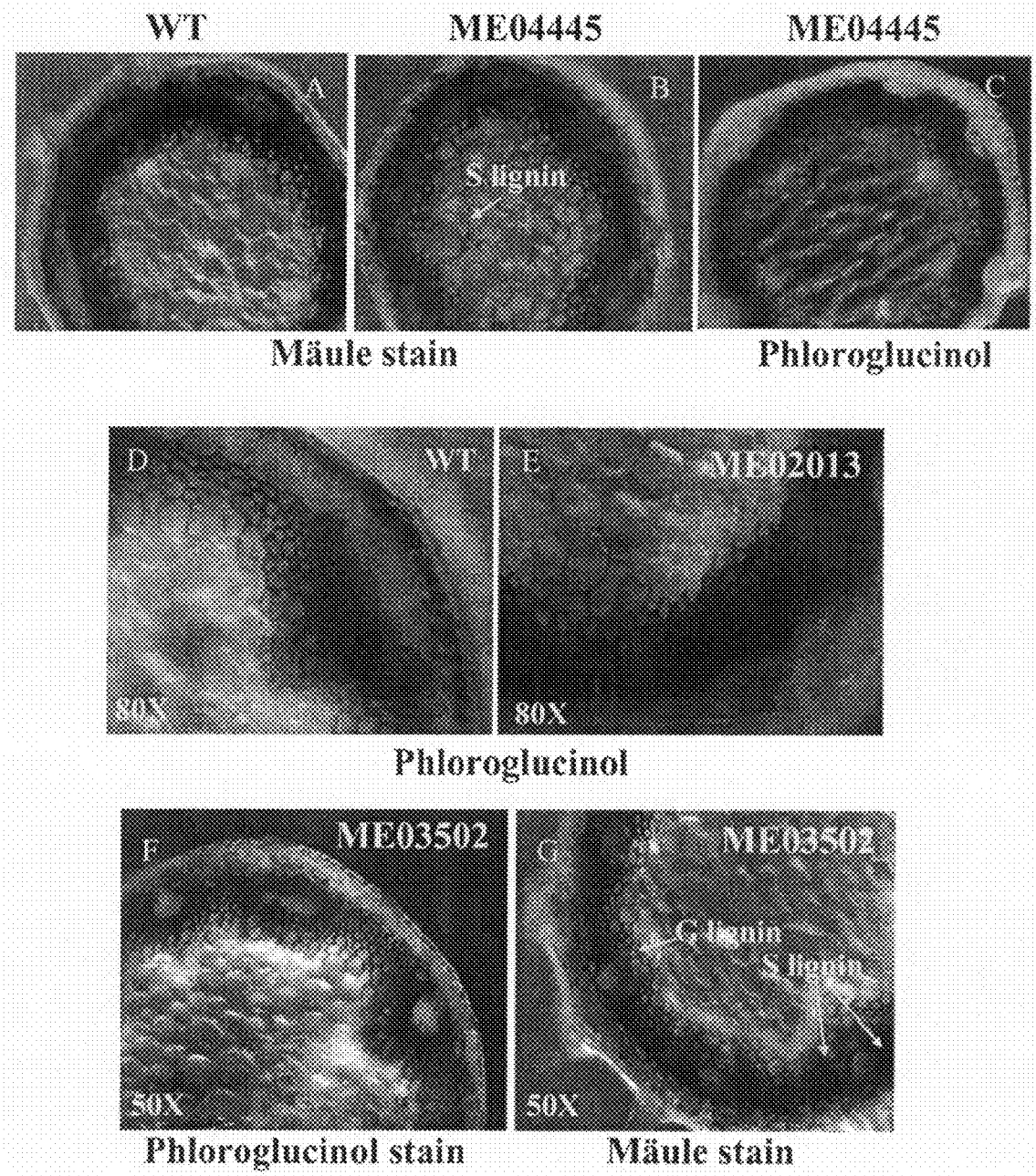
FIG. 52 contains photomicrographs of sections from the basal region of the main stems of wild-type or transgenic *Arabidopsis* plants 22 to 24 days after germination. The sections were stained using phloroglucinol and Maule reagents as indicated.

Ectopic deposition of lignin was observed in the pith (the central parenchyma region of the stem) in some of the transgenic lines exhibiting increased lignin accumulation, such as ME02013, ME04024, and ME04445 (FIG. 52, panels A-E). The extent of lignin deposition in the pith was much higher in ME04445.

The transgenic line ME03502 was observed to have an increased accumulation of lignin and a vascular bundle arrangement that was altered from a collateral type to an amphivasal type (FIG. 52, panels F-G). A collateral type is typical of a wild-type arrangement, where the phloem cells are surrounded by cortex cells towards the epidermal tissues and by xylem cells towards the pith. In an amphivasal type of arrangement, the phloem tissues are surrounded by xylem cells. It appeared that some of the cortical cells were converted to lignified xylem cells in plants from ME03502.

Some transgenic lines such as ME03301 and ME05057 were observed to have a decreased accumulation of lignin relative to wild-type plants and a reduced height. The transgenic line ME22388 was observed to have a decreased accumulation of lignin relative to wild-type plants, but did not exhibit a reduced height. The cylindrical band corresponding to the xylem-interfascicular region was thinner in the transgenic line ME03301 than that which is normally observed in wild-type plants at the time the tissue sections were sampled. In the case of transgenic line ME05057, the xylem-interfascicular region was not fully developed at the time of sampling.

Two transgenic lines, ME04442 and ME04932, that were observed to have an increased lignin content (Table 7) were each transformed with a nucleic acid encoding a polypeptide homolog of the regulatory protein identified herein as Gemini ID 531F2 (SEQ ID NO:1860), which was identified as being associated with the 4CL and F5H1 regulatory regions (Table 4).

Example 4

Determination of Functional Homolog and/or Ortholog Sequences

A candidate sequence was considered a functional homolog or ortholog of a reference sequence if the candidate and reference sequences encoded proteins having a similar function and/or activity. A process known as Reciprocal BLAST (Rivera et al., *Proc. Natl. Acad. Sci. USA*, 95:6239-6244 (1998)) was used to identify potential functional homolog and/or ortholog sequences from databases consisting of all available public and proprietary peptide sequences, including NR from NCBI and peptide translations from Ceres clones.

Before starting a Reciprocal BLAST process, a specific reference polypeptide was searched against all peptides from its source species using BLAST in order to identify polypeptides having BLAST sequence identity of 80% or greater to the reference polypeptide and an alignment length of 85% or greater along the shorter sequence in the alignment. The reference polypeptide and any of the aforementioned identified polypeptides were designated as a cluster.

The BLASTP version 2.0 program from Washington University at Saint Louis, Mo., USA was used to determine BLAST sequence identity and E-value. The BLASTP version 2.0 program includes the following parameters: 1) an E-value cutoff of 1.0e-5; 2) a word size of 5; and 3) the -postsw option. The BLAST sequence identity was calculated based on the alignment of the first BLAST HSP (High-scoring Segment Pairs) of the identified potential functional homolog and/or ortholog sequence with a specific reference polypeptide. The number of identically matched residues in the BLAST HSP alignment was divided by the HSP length, and then multiplied by 100 to get the BLAST sequence identity. The HSP length typically included gaps in the alignment, but in some cases gaps were excluded.

The main Reciprocal BLAST process consists of two rounds of BLAST searches; forward search and reverse search. In the forward search step, a reference polypeptide sequence, "polypeptide A," from source species SA was BLASTed against all protein sequences from a species of interest. Top hits were determined using an E-value cutoff of $10^{-5}$ and a sequence identity cutoff of 35%. Among the top hits, the sequence having the lowest E-value was designated as the best hit, and considered a potential functional homolog or ortholog. Any other top hit that had a sequence identity of 80% or greater to the best hit or to the original reference polypeptide was considered a potential functional homolog or ortholog as well. This process was repeated for all species of interest. In the reverse search round, the top hits identified in the forward search from all species were BLASTed against all protein sequences from the source species SA. A top hit from the forward search that returned a polypeptide from the aforementioned cluster as its best hit was also considered as a potential functional homolog or ortholog.

Functional homologs and/or orthologs were identified by manual inspection of potential functional homolog and/or ortholog sequences. Representative functional homologs and/or orthologs and their corresponding reference sequences are shown in FIGS. 1-51 and FIGS. 53-131. Some of the homologs and/or orthologs identified using Reciprocal BLAST were analyzed for association with various regulatory regions as described in Example 2 above. The results are presented in Table 8.

TABLE 8

Combinations of regulatory regions and regulatory proteins, or corresponding homologs/orthologs, producing expression of a reporter gene operably linked to each regulatory region

| Associated Regulatory Protein SEQ ID NO: | Associated Regulatory Region SEQ ID NO: | Homolog/ Ortholog SEQ ID NO: | Regulatory Region Tested for Association with Homolog/ Ortholog | Luciferase Activity |
|---|---|---|---|---|
| Clone 16204 SEQ ID NO: 1444 | Pt4CL SEQ ID NO: 1909 | Clone 98140 SEQ ID NO: 1445 | Pt4CL SEQ ID NO: 1909 | positive |
| Clone 16204 SEQ ID NO: 1444 | PtCCR1 SEQ ID NO: 1918 | Clone 98140 SEQ ID NO: 1445 | PtCCR1 SEQ ID NO: 1918 | negative |
| Clone 560731 SEQ ID NO: 1628 | PtCCR1 SEQ ID NO: 1918 | Clone 4267 SEQ ID NO: 1633 | PtCCR1 SEQ ID NO: 1918 | negative |
| Clone 560731 SEQ ID NO: 1628 | PtPAL4 SEQ ID NO: 1910 | Clone 4267 SEQ ID NO: 1633 | PtPAL4 SEQ ID NO: 1910 | positive |
| Clone 156298 SEQ ID NO: 490 | PtF5H1 SEQ ID NO: 1912 | Clone 398632 SEQ ID NO: 502 | PtF5H1 SEQ ID NO: 1912 | negative |
| Clone 2942 SEQ ID NO: 671 | Pt4CL SEQ ID NO: 1909 | Clone 337432 SEQ ID NO: 676 | Pt4CL SEQ ID NO: 1909 | negative |
| Clone 2942 SEQ ID NO: 671 | PtPAL4 SEQ ID NO: 1910 | Clone 337432 SEQ ID NO: 676 | PtPAL4 SEQ ID NO: 1910 | negative |
| Clone 6397 SEQ ID NO: 1637 | PtCCR1 SEQ ID NO: 1918 | Clone 605218 SEQ ID NO: 1639 | PtCCR1 SEQ ID NO: 1918 | negative |
|  |  | Clone 603410 SEQ ID NO: 1752 | PtCCR1 SEQ ID NO: 1918 | positive |
| Clone 6397 SEQ ID NO: 1637 | PtPAL4 SEQ ID NO: 1910 | Clone 605218 SEQ ID NO: 1639 | PtPAL4 SEQ ID NO: 1910 | negative |
|  |  | Clone 603410 SEQ ID NO: 1752 | PtPAL4 SEQ ID NO: 1910 | negative |
| Clone 603410 SEQ ID NO: 1752 | PtC4H SEQ ID NO: 1916 | Clone 6397 SEQ ID NO: 1637 | PtC4H SEQ ID NO: 1916 | negative |
|  |  | Clone 605218 SEQ ID NO: 1639 | PtC4H SEQ ID NO: 1916 | negative |
| Clone 38311 SEQ ID NO: 1285 | PtF5H1 SEQ ID NO: 1912 | Clone 597624 SEQ ID NO: 1289 | PtF5H1 SEQ ID NO: 1912 | positive |
|  |  | Clone 19561 SEQ ID NO: 1957 | PtF5H1 SEQ ID NO: 1912 | negative |
| Clone 519 SEQ ID NO: 1806 | PtC4H SEQ ID NO: 1916 | Clone 560948 SEQ ID NO: 1817 | PtC4H SEQ ID NO: 1916 | negative |
|  |  | Clone 560681 SEQ ID NO: 1815 | PtC4H SEQ ID NO: 1916 | negative |

TABLE 8-continued

Combinations of regulatory regions and regulatory proteins, or corresponding homologs/orthologs, producing expression of a reporter gene operably linked to each regulatory region

| Associated Regulatory Protein SEQ ID NO: | Associated Regulatory Region SEQ ID NO: | Homolog/ Ortholog SEQ ID NO: | Regulatory Region Tested for Association with Homolog/ Ortholog | Luciferase Activity |
|---|---|---|---|---|
| Clone 519 SEQ ID NO: 1806 | PtCCR1 SEQ ID NO: 1918 | Clone 560948 SEQ ID NO: 1817 | PtCCR1 SEQ ID NO: 1918 | negative |
| | | Clone 560681 SEQ ID NO: 1815 | PtCCR1 SEQ ID NO: 1918 | negative |
| Clone 519 SEQ ID NO: 1806 | PtF5H1 SEQ ID NO: 1912 | Clone 560948 SEQ ID NO: 1817 | PtF5H1 SEQ ID NO: 1912 | negative |
| | | Clone 560681 SEQ ID NO: 1815 | PtF5H1 SEQ ID NO: 1912 | negative |
| Clone 519 SEQ ID NO: 1806 | PtPAL4 SEQ ID NO: 1910 | Clone 560948 SEQ ID NO: 1817 | PtPAL4 SEQ ID NO: 1910 | positive |
| | | Clone 560681 SEQ ID NO: 1815 | PtPAL4 SEQ ID NO: 1910 | positive |
| Clone 8607 SEQ ID NO: 1785 | PtCAD6 SEQ ID NO: 1915 | Clone 560948 SEQ ID NO: 1817 | PtCAD6 SEQ ID NO: 1915 | negative |
| | | Clone 560681 SEQ ID NO: 1815 | PtCAD6 SEQ ID NO: 1915 | negative |
| Clone 8607 SEQ ID NO: 1785 | PtCCoAOMT SEQ ID NO: 1914 | Clone 560948 SEQ ID NO: 1817 | PtCCoAOMT SEQ ID NO: 1914 | negative |
| | | Clone 560681 SEQ ID NO: 1815 | PtCCoAOMT SEQ ID NO: 1914 | negative |
| Clone 8607 SEQ ID NO: 1785 | PtF5H1 SEQ ID NO: 1912 | Clone 560948 SEQ ID NO: 1817 | PtF5H1 SEQ ID NO: 1912 | negative |
| | | Clone 560681 SEQ ID NO: 1815 | PtF5H1 SEQ ID NO: 1912 | negative |
| Clone 8607 SEQ ID NO: 1785 | PtPAL4 SEQ ID NO: 1910 | Clone 560948 SEQ ID NO: 1817 | PtPAL4 SEQ ID NO: 1910 | positive |
| | | Clone 560681 SEQ ID NO: 1815 | PtPAL4 SEQ ID NO: 1910 | positive |
| Clone 124720 SEQ ID NO: 1302 | PtF5H1 SEQ ID NO: 1912 | Clone 1044385 SEQ ID NO: 1304 | PtF5H1 SEQ ID NO: 1912 | negative |
| Clone 124720 SEQ ID NO: 1302 | PtPAL4 SEQ ID NO: 1910 | Clone 1044385 SEQ ID NO: 1304 | PtPAL4 SEQ ID NO: 1910 | negative |
| Clone 8334 SEQ ID NO: 1104 | PtCCoAOMT SEQ ID NO: 1914 | Clone 114858 SEQ ID NO: 1106 | PtCCoAOMT SEQ ID NO: 1914 | negative |
| Clone 8334 SEQ ID NO: 1104 | PtPAL4 SEQ ID NO: 1910 | Clone 114858 SEQ ID NO: 1106 | PtPAL4 SEQ ID NO: 1910 | negative |
| Clone 543118 SEQ ID NO: 994 | PtCCR1 SEQ ID NO: 1918 | Clone 10506 SEQ ID NO: 1047 | PtCCR1 SEQ ID NO: 1918 | negative |
| | | Clone 3115 SEQ ID NO: 1045 | PtCCR1 SEQ ID NO: 1918 | positive |
| Clone 115366 SEQ ID NO: 381 | PtCCR1 SEQ ID NO: 1918 | Clone 148506 SEQ ID NO: 385 | PtCCR1 SEQ ID NO: 1918 | negative |
| Clone 115366 SEQ ID NO: 381 | PtPAL4 SEQ ID NO: 1910 | Clone 148506 SEQ ID NO: 385 | PtPAL4 SEQ ID NO: 1910 | negative |

TABLE 8-continued

Combinations of regulatory regions and regulatory proteins, or corresponding homologs/orthologs, producing expression of a reporter gene operably linked to each regulatory region

| Associated Regulatory Protein SEQ ID NO: | Associated Regulatory Region SEQ ID NO: | Homolog/ Ortholog SEQ ID NO: | Regulatory Region Tested for Association with Homolog/ Ortholog | Luciferase Activity |
|---|---|---|---|---|
| Clone 3929* SEQ ID NO: 1185 | PtF5H1 SEQ ID NO: 1912 | Clone 207629* SEQ ID NO: 1192 | PtF5H1 SEQ ID NO: 1912 | positive |
|  |  | Clone 18215 SEQ ID NO: 1188 | PtF5H1 SEQ ID NO: 1912 | negative |
| Clone 3929 SEQ ID NO: 1185 | PtPAL4 SEQ ID NO: 1910 | Clone 207629 SEQ ID NO: 1192 | PtPAL4 SEQ ID NO: 1910 | negative |
|  |  | Clone 18215 SEQ ID NO: 1188 | PtPAL4 SEQ ID NO: 1910 | negative |

*Indicates that the regulatory protein also was observed to be associated with the indicated regulatory region in a secondary screen in *Populus*, described in Example 2.
Pt4CL = *Populus* 4-Coumaroyl:CoA ligase
PtF5H1 = *Populus* Ferulate 5-hydroxylase
PtCCR1 = *Populus* Cinnamoyl-CoA reductase
PtC4H = *Populus* Cinnamate 4-hydroxylase
PtPAL4 = *Populus* Phenylalanine ammonia lyase
PtCAD6 = *Populus* Cinnamyl alcohol dehydrogenase
PtCCoAOMT = *Populus* Caffeoyl-CoA O-methyltransferase Clone 19561 (SEQ ID NO:1957), which is a homolog/ortholog of Clone 38311 (SEQ ID NO:1285), also was observed to associate with regulatory region PtCCR1 (SEQ ID NO:1918).

Example 5

Analysis of Lignin Structure and Content in Transgenic *Arabidopsis* Lines

*Arabidopsis* overexpression lines (ME lines) were grown in batches in the greenhouse under long-day condition at 28° C. until senescence stage. Each transformation event corresponding to an overexpression line was planted in several pots (represented as replicates) with each pot randomly distributed in separate flats. The corresponding wild type non-transgenic control for each batch was planted in the same manner. At the senescence stage, stem tissues were divided into three parts (bottom, center, and upper) and were collected separately. Collected tissues were dried in a freeze dryer for at least two days before milling.

Pyrolysis GC-MS was performed on a Py-2020 is pyrolyzer (Frontier Labs, Japan) coupled to a QP2010 GC-MS (Shimadzu, Japan). Finely ground material (2 mm minimum) was weighed out (3 mg) into a deactivated stainless steel cup. Sample was introduced into the pyrolyzer set at 500° C. by gravity. The interface between the pyrolyzer and GC inlet was set at 300° C. Separation of pyrolysates was performed on a GC-column (VF-5MS, 30M×0.25 mm×0.25 um). Helium flow through the pyrolyzer and column was set at 1052 mL/min and 1.0 mL/min respectively. Inlet split ratio was 700:1. Column temperature program was initially set at 70° C. (held for 4 minutes) at a ramp rate of 20° C./min to a final temperature of 350° C. Mass spectral acquisition was at 3333 amu/sec from 50 amu-300 amu after a 4.5 min delay.

The areas of the peaks corresponding to different types of lignin monomers (i.e., H=p-Hydroxyphenyl monomer, G=Guaiacyl monomer, S=Syringyl monomer) and to levoglucosan and furfural (both as cellulose markers) were collected. Total lignin is the sum of all the peaks for H, G, and S monomoers. The ratios shown in Table 9 were normalized relative to total lignin.

Comparisons of overexpression lines were made relative to the wild-type control for each batch. The overexpression of the following clones or genes (as indicated by Annot IDs) leads to relatively higher S/G ratio (generally indicative of a positive parameter that may enhance conversion of biomass to ethanol) as shown by their corresponding ME lines: 124720 (ME04445), 6042 (ME02013), Annot 1493072 (ME23571), 38915 (ME01050), 108109 (ME01973), 92102 (ME04024), 5398 (ME02276), 108362 (ME03210), 603410 (ME03986), Annot 550729 (ME10852), Annot 548715 (ME11894), Annot 554970 (ME10196), 41875 (ME04890), 34589 (ME05722 and ME01130), Annot 535161 (ME05335), 38360 (ME04274), 1821051 (ME27373), 11988 (ME00259), 2898 (ME05855), Annot 869854 (ME18127), Annot 869790 (ME20794).

The overexpression of clone 208429 in ME12091 line leads to lower S/G ratio indicating that downregulating the corresponding gene (by antisense or RNAi) may reverse this effect.

The overexpression of clones 1804242 (ME26515) and 1821051 (ME27373) leads to an increase in cellulose/lignin ratio indicating an increase in the absolute amount of cellulose or a decrease in lignin.

The overexpression of the following clones leads to lower cellulose/lignin ratio (indicating either an increase in the absolute amount of lignin or decrease in cellulose) as shown by their corresponding ME lines: 11988 (ME00259), 8049 (ME01752), 2898 (ME05855), 118184 (ME12975), 34589 (ME01130), 11830 (ME03582), 20948 (ME06540).

TABLE 9

| Batch | Clone or AnnotID | SEQ ID NO | Transformation Events | H/ Total Lignin Ratio | G/ Total Lignin Ratio | S/ Total Lignin Ratio | S/G Ratio | H/G Ratio | Amount of Cellulose/ Lignin |
|---|---|---|---|---|---|---|---|---|---|
| 1 | Ceres Clone ID 14246 | 1423 | ME03502-01-B | 0.13 | 0.63 | 0.24 | 0.39 | 0.20 | |
| 1 | | | ME03502-05-C | 0.13 | 0.62 | 0.24 | 0.39 | 0.21 | |
| 1 | Ceres Clone ID 124720 | 1302 | ME04445-04-B | 0.13 | 0.62 | 0.25 | 0.40 | 0.21 | |
| 1 | | | ME04445-05-A | 0.11 | 0.62 | 0.27 | 0.44 | 0.18 | |
| 1 | Ceres Annot ID 1493072 | 1892 | ME23571-01-B | 0.11 | 0.62 | 0.26 | 0.42 | 0.18 | |
| 1 | | | ME23571-03-A | 0.12 | 0.62 | 0.25 | 0.41 | 0.19 | |
| 1 | Ceres Clone ID 6042 | 1064 | ME02013-01-01-C | 0.11 | 0.62 | 0.26 | 0.42 | 0.18 | |
| 1 | | | ME02013-05-01-E | 0.14 | 0.59 | 0.25 | 0.42 | 0.24 | |
| 1 | Ceres Clone ID 92102 | 1692 | ME04024-01-A | 0.14 | 0.62 | 0.23 | 0.38 | 0.22 | |
| 1 | | | ME04024-01-B | 0.14 | 0.64 | 0.21 | 0.32 | 0.22 | |
| 1 | | | ME04024-05-E | 0.12 | 0.60 | 0.27 | 0.45 | 0.21 | |
| 1 | Ceres Clone ID 5398 | 1897 | ME02276-03-A | 0.17 | 0.58 | 0.24 | 0.42 | 0.29 | |
| 1 | | | ME02276-04-D | 0.13 | 0.60 | 0.26 | 0.44 | 0.22 | |
| 1 | | | ME02276-05-B | 0.14 | 0.61 | 0.25 | 0.40 | 0.22 | |
| 1 | Ceres Clone ID 207629 | 1192 | ME02589-04-D | 0.12 | 0.62 | 0.26 | 0.42 | 0.19 | |
| 1 | Wild Type Control | | WT | 0.10 | 0.64 | 0.25 | 0.39 | 0.16 | |
| 2 | Ceres Clone ID 28026 | 2087 | ME06884-01-C | 0.12 | 0.65 | 0.24 | 0.36 | 0.18 | 0.10 |
| 2 | | | ME06884-05-F | 0.16 | 0.61 | 0.23 | 0.38 | 0.26 | 0.10 |
| 2 | Ceres Clone ID 115924 | 1383 | ME07070-01-E | 0.15 | 0.62 | 0.24 | 0.38 | 0.24 | 0.10 |
| 2 | | | ME07070-03-G | 0.14 | 0.61 | 0.25 | 0.42 | 0.23 | 0.10 |
| 2 | Ceres Clone ID 115366 | 381 | ME07290-02-D | 0.17 | 0.59 | 0.25 | 0.42 | 0.28 | 0.08 |
| 2 | | | ME07290-05-A | 0.14 | 0.63 | 0.23 | 0.36 | 0.23 | 0.10 |
| 2 | Ceres Annot ID 844490 | 170 | ME11448-01-G | 0.13 | 0.61 | 0.26 | 0.42 | 0.21 | 0.11 |
| 2 | | | ME11448-03-C | 0.14 | 0.62 | 0.23 | 0.37 | 0.23 | 0.10 |
| 2 | Ceres Clone ID 25816 | 610 | ME07556-04-D | 0.17 | 0.61 | 0.21 | 0.35 | 0.28 | 0.09 |
| 2 | | | ME07556-05-D | 0.14 | 0.61 | 0.25 | 0.42 | 0.23 | 0.10 |
| 2 | Ceres Clone ID 1845 | 548 | ME03547-01-D | 0.13 | 0.60 | 0.27 | 0.45 | 0.21 | 0.09 |
| 2 | | | ME03547-05-A | 0.14 | 0.58 | 0.27 | 0.47 | 0.25 | 0.10 |
| 2 | Ceres Clone ID 331755 | 707 | ME10647-02-E | 0.14 | 0.58 | 0.28 | 0.48 | 0.23 | 0.09 |

TABLE 9-continued

| Batch | Clone or AnnotID | SEQ ID NO | Transformation Events | H/Total Lignin Ratio | G/Total Lignin Ratio | S/Total Lignin Ratio | S/G Ratio | H/G Ratio | Amount of Cellulose/Lignin |
|---|---|---|---|---|---|---|---|---|---|
| 2 | | | ME10647-03-A | 0.13 | 0.67 | 0.20 | 0.30 | 0.19 | 0.09 |
| 2 | Ceres Clone ID 603410 | 1752 | ME03986-03-G | 0.16 | 0.56 | 0.28 | 0.50 | 0.29 | 0.11 |
| 2 | | | ME03986-05-G | 0.16 | 0.52 | 0.32 | 0.60 | 0.30 | 0.13 |
| 2 | Ceres Clone ID 112194 | 370 | ME07113-03 | 0.14 | 0.60 | 0.26 | 0.44 | 0.23 | 0.10 |
| 2 | | | ME07113-05 | 0.14 | 0.61 | 0.25 | 0.40 | 0.23 | 0.10 |
| 2 | Ceres Clone ID 208429 | 1315 | ME12091-01 | 0.17 | 0.61 | 0.22 | 0.36 | 0.27 | 0.10 |
| 2 | | | ME07113-02 | 0.13 | 0.64 | 0.23 | 0.36 | 0.20 | 0.08 |
| 2 | Wild Type Control | | WT | 0.15 | 0.59 | 0.26 | 0.44 | 0.25 | 0.10 |
| 3 | Ceres Annot ID 1493072 | 1892 | ME23571-01-A | 0.13 | 0.60 | 0.27 | 0.44 | 0.22 | 0.11 |
| 3 | | | ME23571-03-B | 0.13 | 0.57 | 0.30 | 0.53 | 0.23 | 0.12 |
| 3 | | | ME23571-04-B | 0.14 | 0.59 | 0.27 | 0.46 | 0.23 | 0.10 |
| 3 | Ceres Clone ID 36272 | 1573 | ME01535-02-B | 0.13 | 0.60 | 0.27 | 0.45 | 0.22 | 0.10 |
| 3 | | | ME01535-05-C | 0.14 | 0.61 | 0.26 | 0.42 | 0.22 | 0.12 |
| 3 | Ceres Clone ID 520515 | 1876 | ME08968-01-A | 0.14 | 0.61 | 0.25 | 0.42 | 0.22 | 0.11 |
| 3 | | | ME08968-04-A | 0.14 | 0.59 | 0.27 | 0.45 | 0.23 | 0.11 |
| 3 | Ceres Clone ID 333416 | 1564 | ME12097-01-A | 0.14 | 0.60 | 0.26 | 0.44 | 0.23 | 0.10 |
| 3 | | | ME12097-05-A | 0.14 | 0.60 | 0.27 | 0.44 | 0.23 | 0.09 |
| 3 | Wild Type Control | | WT | 0.15 | 0.56 | 0.28 | 0.50 | 0.27 | 0.12 |
| 4 | Ceres Clone ID 2898 | 652 | ME05855-02 | 0.14 | 0.61 | 0.25 | 0.41 | 0.22 | 0.15 |
| 4 | | | ME05855-03 | 0.09 | 0.71 | 0.20 | 0.29 | 0.13 | 0.04 |
| 4 | Ceres Annot ID 541887 | 96 | ME12380-01-H | 0.10 | 0.69 | 0.22 | 0.31 | 0.14 | 0.09 |
| 4 | Ceres Clone ID 240112 | 601 | ME08450-01-B | 0.10 | 0.68 | 0.22 | 0.33 | 0.15 | 0.09 |
| 4 | | | ME08450-05-A | 0.09 | 0.69 | 0.22 | 0.32 | 0.13 | 0.09 |
| 4 | Wild Type Control | | WT | 0.10 | 0.68 | 0.22 | 0.32 | 0.15 | 0.09 |
| 5 | Ceres Clone ID 118184 | 1393 and 1201 | ME12975-01-A | 0.11 | 0.68 | 0.21 | 0.30 | 0.16 | 0.08 |
| 5 | | | ME12975-04-A | 0.10 | 0.69 | 0.21 | 0.30 | 0.15 | 0.09 |
| 5 | Ceres Clone ID 205648 | 555 | ME07579-01-99-F | 0.11 | 0.69 | 0.21 | 0.30 | 0.16 | 0.11 |
| 5 | | | ME07579-03-99-B | 0.12 | 0.68 | 0.20 | 0.30 | 0.17 | 0.10 |
| 5 | Ceres Annot ID 550729 | 134 | ME10852-03-A | 0.15 | 0.64 | 0.21 | 0.33 | 0.24 | 0.10 |

TABLE 9-continued

| Batch | Clone or AnnotID | SEQ ID NO | Transformation Events | H/Total Lignin Ratio | G/Total Lignin Ratio | S/Total Lignin Ratio | S/G Ratio | H/G Ratio | Amount of Cellulose/Lignin |
|---|---|---|---|---|---|---|---|---|---|
| 5 | | | ME10852-05-A | 0.14 | 0.61 | 0.25 | 0.42 | 0.23 | 0.14 |
| 5 | Ceres Annot ID 548715 | 106 | ME11894-01-B | 0.14 | 0.60 | 0.25 | 0.42 | 0.24 | 0.11 |
| 5 | | | ME11894-05-C | 0.14 | 0.63 | 0.23 | 0.37 | 0.22 | 0.14 |
| 5 | Ceres Annot ID 554970 | 149 | ME10196-01-E | 0.14 | 0.60 | 0.26 | 0.44 | 0.24 | 0.12 |
| 5 | | | ME10196-02-C | 0.13 | 0.63 | 0.24 | 0.38 | 0.20 | 0.13 |
| 5 | Ceres Clone ID 41875 | 898 | ME04890-02-C | 0.14 | 0.61 | 0.25 | 0.41 | 0.23 | 0.14 |
| 5 | | | ME04890-03-F | 0.14 | 0.58 | 0.27 | 0.47 | 0.25 | 0.14 |
| 5 | Ceres Clone ID 34589 | 1570 | ME05722-01-A | 0.14 | 0.58 | 0.28 | 0.48 | 0.25 | 0.15 |
| 5 | | | ME05722-08-A | 0.13 | 0.61 | 0.26 | 0.43 | 0.22 | 0.11 |
| 5 | Ceres Clone ID 34589 | 1570 | ME01130-01-A | 0.16 | 0.56 | 0.27 | 0.49 | 0.29 | 0.03 |
| 5 | | | ME01130-03-99-A | 0.13 | 0.66 | 0.22 | 0.33 | 0.19 | 0.10 |
| 5 | Wild Type Control | | WT | 0.11 | 0.69 | 0.20 | 0.29 | 0.17 | 0.12 |
| 6 | Ceres Clone ID 158240 | 520 | ME01404-03-B | 0.14 | 0.64 | 0.22 | 0.35 | 0.21 | 0.13 |
| 6 | | | ME01404-05-C | 0.12 | 0.64 | 0.24 | 0.37 | 0.19 | 0.13 |
| 6 | Ceres Clone ID 6397 | 1637 and 1755 | ME02011-04-A | 0.13 | 0.62 | 0.25 | 0.40 | 0.21 | 0.12 |
| 6 | | | ME02011-05-A | 0.14 | 0.63 | 0.24 | 0.38 | 0.22 | 0.11 |
| 6 | Ceres Clone ID 40729 | 781 | ME04213-02-99-E | 0.11 | 0.65 | 0.24 | 0.37 | 0.17 | 0.11 |
| 6 | | | ME04213-04-99-D | 0.12 | 0.65 | 0.23 | 0.35 | 0.18 | 0.12 |
| 6 | Ceres Clone ID 14432 | 1840 | ME04241-04-B | 0.15 | 0.64 | 0.20 | 0.31 | 0.24 | 0.12 |
| 6 | | | ME04241-05-D | 0.17 | 0.64 | 0.19 | 0.30 | 0.27 | 0.13 |
| 6 | Ceres Clone ID 38360 | 816 | ME04274-01-F | 0.13 | 0.59 | 0.28 | 0.47 | 0.23 | 0.11 |
| 6 | Ceres Clone ID 100085 | 1830 | ME05105-01-B | 0.12 | 0.63 | 0.25 | 0.40 | 0.20 | 0.11 |
| 6 | | | ME05105-03-99-B | 0.14 | 0.62 | 0.24 | 0.38 | 0.22 | 0.10 |
| 6 | Ceres Clone ID 14909 | 1211 | ME15117-01-C | 0.12 | 0.64 | 0.24 | 0.37 | 0.18 | 0.13 |
| 6 | | | ME15117-05-A | 0.14 | 0.63 | 0.23 | 0.37 | 0.23 | 0.14 |
| 6 | Ceres Clone ID 16204 | 1444 | ME22388-02-B | 0.24 | 0.58 | 0.18 | 0.30 | 0.41 | 0.10 |
| 6 | Wild Type Control | | WT | 0.12 | 0.64 | 0.24 | 0.38 | 0.19 | 0.11 |

Example 6

Determination of Functional Homologs by Hidden Markov Models

Hidden Markov Models (HMMs) were generated by the program HMMER 2.3.2. To generate each HMM, the default HMMER 2.3.2 program parameters, configured for glocal alignments, were used.

An HMM was generated using the sequences shown in FIG. 28 as input. These sequences were fitted to the model and a representative HMM bit score for each sequence is shown in the Sequence Listing. Additional sequences were fitted to the model, and representative HMM bit scores for any such additional sequences are shown in the Sequence Listing. The results indicate that these additional sequences are functional homologs of SEQ ID NO:566.

The procedure above was repeated and an HMM was generated for each group of sequences shown in FIGS. 30, 53, 74, 81, 107, and 119, using the sequences shown in each Figure as input for that HMM. A representative bit score for each sequence is shown in the Sequence Listing. Additional sequences were fitted to certain HMMs, and representative HMM bit scores for such additional sequences are shown in the Sequence Listing. The results indicate that these additional sequences are functional homologs of the sequences used to generate that HMM.

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (2692 sequences)

SEQ ID NO: 1 - DNA, 1823 bp, Arabidopsis thaliana
  misc_feature (1)..(1823): Ceres Promoter 21876
gtctcttaaaaaggatgaacaaacacgaaactggtggattatacaaatgtcgccttatacatatatcggttattggccaaaagagctattttaccttatggataatggtgctactatggttggagttggaggtgtagttcaggcttcaccttctggtttaagccctccaatgggtaatggtaaatttccggcaaaaggtcctttgagatcagccatgttttccaatgttgaggtcttatattccaagtatgagaaaggtaaaataaatgcgtttcctatagtggagttgctagatagtagtagatgttatgggctacgaattggtaagagagttcgattttggactagtccactcggatactttttcaattatggtggtcctggaggaatctcttgtggagtttgatatttgcgagtataatctttgaacttgtgtagattgtacccaaaaccgaaaacatatcctatataaatttcattatgagagtaaaattgtttgttttatgtatcatttctcaactgtgattgagttgactattgaaaacatatcttagataagtttcgttatgagagttaatgatgattgatgacatacacactcctttatgatggtgattcaacgttttggagaaaatttatttataatctctcataaattctccgttattagttgaataaaatcttaaatgtctcctttaaccatagcaaaccaacttaaaaatttagattttaaagttaagatggatattgtgattcaacgattaattatcgtaatgcatattgattatgtaaaataaaatctaactaccggaatttattcaataactccattgtgtgactgcatttaaatatatgttttatgtcccattaattaggctgtaatttcgatttatcaatttatatactagtattaatttaattccatagatttatcaaagccaactcatgacggctagggttttccgtcaccttttcgatcatcaagagagtttttttataaaaaaatttatacaattatacaatttcttaaccaaacaacacataattataagctatttaacatttcaaattgaaaaaaaaaatgtatgagaattttgtggatccatttttgtaattctttgttgggtaaattcacaaccaaaaaaatagaaaggcccaaaacgcgtaagggcaaattagtaaaagtagaaccacaaagagaaagcgaaaaccctagacacctcgtagctataagtaccctcgagtcgaccaggattagggtgcgctctcatatttctcacattttcgtagccgcaagactcctttcagattcttacttgcaggttagatattttctctctttagtgtctccgatcttcatcttcttatgattattgtagctgtttagggtttagattcttagttttagctctatattgactgtgattatcgcttattctttgctgttgttatactgcttttgattctctagctttagatccgtttactcgtcgatcaatattgttcctattgagtctgatgtataatcctctgattaattgatagcgtttagttttgatatcgtcttcgcatgttttttatcatgtcgatctgtatctgctctggttatagttgattctgatgtatttggttggtgatgttccttagatttgatatacctgttgtctcgtggtttgatatgatagctcaactggtgatatgtggttttgtttcagtggatctgtgtttgattatattgttgacgttttggttgttgtatggttgatggttgatgtatttttgttgattctgatgtttcgatttttgtttttgttttgacagct

SEQ ID NO: 2 - DNA, 1000 bp, Arabidopsis thaliana
  misc_feature (1)..(1000): Ceres Promoter PT0668
atagagttttactatgcttttggaatctttcttctaatgtgccaactacagagaaatacatgtattaccactaggaatcggaccatatcatagatatcaggattagataactagttctcgtcgctatcacttcgcattaagttctagtaattgttaaagattctaattttttactaaacaaaaactaaatcaacatcaaatatgcaaagtgtgtgttgtccacacaagtgactcaaagtatacgcaggtgggattggaccatattattgcaaatcgtttccgaaccactcatatttctttttttctctcctttttttatccggagaattatggaaccacttcatttcaacttcaaaactaattttttggttcagtgatcaaatacaaaaaaaaaaaaaaagttatagatattaaatagaaaactattccaatcttaaaaatacaaatgaaaccataattttaatttatacaaaactatttaattagctaagggttgtcttaacgtttagaaaataaaaaattatgattgtctgtttaaaattacaatgaatgaataaaaaaaatatgcaatgaatgaaagaataaattttgtacatccgatagaatgagaaaatgaattttgtacaaaccactcaagaattcaaaacaattgtcaaagttttcttctcagccgtgtgtcctcctctcctagccgccacatctcacacactaatgctaaccacgcgatgtaaccgtaagcgctgagtttttgcatttcagatttcacttccaccaaacaaaactcgccacgtcatcaatacgaatcattccgtataaacgtctagattctttacagcctacaatgttctcttctttggtcggccattatttaacgctttgaacctaaatctagcccagccaacgaagaagacgaagcaaatccaaaccaaagttctccattttcgtagcttctttaagctttttcagtatcatagagacacttttttttttttgattagaa

SEQ ID NO: 3 - DNA, 1000 bp, Arabidopsis thaliana
  misc_feature (1)..(1000): Ceres Promoter PT0535
ttagtgaaattatgacattaagtaaggttttcttagttagctaatgtatggctattcaattgttatgttaggctattttagttagtatatgaatttaggcagtctatgcaaatgatttcgttttcattttttcatatgtaaacatcaagatcaagtaacgccattcgagttgatattttttttttaaattagtgtgtgtaaattttggaccgcttatttgagtttgctaatgaagttgcatatatattacgttaaaccataggcaaactaatttgaaacatccgattcgatttcctgtaatttttcttggttaattgaccaaaatcaagatcttcagaaataaaataaaagacgaaagaaagctgtcgcaaagcagattgtgttaaaaaaaagtggattgggctcaaacgcaacttgtccagcccgtgacaattaccctatacgcaagtaagagtaacgtatcactggcaaaagttggtattagttacgatatctttgtcatgggggcatgcatgggcatggcttaagagttaagccttaagaagagtcccacactcgtgactctcatgatcacttgttgtttcttacgggcaaatacatttaactttattcttcatttattcacctatattcttttggataataacttttctctatataaaataacaaacatcgtacgtttcatttatttacaacaagcgatgagaattaaaaggagaccttaattgatgatactcttcttttctctcggttacaacgggattattacagataatgataatctatatggatgctgacgtggaaaaacaaaatttggtgaaacacgtcaattaagcacgacttttccatggctagtggctaagatcgtttcatcacatggctatatcatataatacttggatgaattcaaaataaacgactgagaaaatgtccacgtcacggcgcaccgctttggacttaagtctcctataataaatacaacaccaaacattgcattcca

SEQ ID NO: 4 - DNA, 999 bp, Arabidopsis thaliana
  misc_feature (1)..(999): Ceres Promoter PT0585
tgaagtcatttaatatgagtttgacattaggtaaacctaatctatgagattatagaatgtagcaaaactatcaatgtttcttttccaaaatattttgtggtttttctttttggttcattatgttttgttatttgtgaattattttaatatgaagtaattatattgattttatatgatatacatattattttgatataaaatttaacacttatccattaaaatagcatgggcataatcaaaatcgggactattacgatgaaaaagatagttaaattgtatgataaaataaaatgtgtaagattaaaattttgggttttagaaaattactaaacaaaatatagacaaagtatgttgactattatttaaaatttaaatatcatcaataagatatagttaaagtcattaagtgtatagcaaaatgaaaattctaagattaaaattcgattaaaattttttttactaaattaaatatttaaaaatagggattatcatttactatttacaattctaatatcatgggtaaaaattgataactttttttaaacccgcctatctaggtgggcctaacctagtttactaattactatatgattaacttattaccacttttacttcttcttttttggtcaaattactttattgttttttataaagtcaaattactctttgcattgtaaataatagtagtaactaaaatcttaaaacaaaatattcaacctttcccattattggaatggtaatgtcttcaacaccattgaccaacgttaaggaatgtcttttaatatttttggaacctaaatgctaatactgtataccacaatcacttatgagtattgaagttgagatagaggaggtacaaggagaccttatctgcagaagacaaaaagccatttttagcaaaactaaagaaagaaaaaagattgaaacacaaatatgcgccactcgtagtccacccctatctctttggcaaaagccacttcactctttttccctttttat

SEQ ID NO: 5 - DNA, 1000 bp, Arabidopsis thaliana
  misc_feature (1)..(1000): Ceres Promoter PT0613
ttaatactaacattgtagaaagccacaaaaaagaaattgaaatgtgagtagatgctgagtcagaggtttggtcaatacacaacagctaattgagataatattatacacgtcacgatgacttgttttttctcctcccaacttgttaatttctttattcttaaaattaaaccatcgcaaaaacagaagaacacagctgtttttctcgactcccaatttctattttgctgctaaggacatttcatttcattatttcccaattcaggactccttagattttcctaaatttgttttcctaacttgctctctctcattctaacattttctcatttttttagattatcttgtactttttagtagattattttatcaggttttacaaacatacattgacattctaaaaagggcttctaaaaattcagtgtggaatgctgatatactaaaaaaaggtcatgcaaaattatctacgatttatctaaaattagataatttgccatatataactattaactaataatcgatcctttgattttttgtttagataaaacgaaacagctatatcttttttttttgttatcggattttaatcgaataaaagctgaaaaataacagttatatcttcttcttttttaactaatgaaacagttatatcttaaacaaacaacagaaacagtaaaatattaatgcaaatccgcgtcaagagataaattttaacaaactaataacaattgagataagattagcgcaaaagaaactctaattttagagcgtgtaaacacaaacacgtcttgaaagtaaacgtgaattacacgcttctaaaacgagcgtgagttttggttataacgaagatacggtgaagtgtgacacctttctacgttaatttcagtttgaggacacaactcaagttatgtttgatatctaaggacttgcactgtctccaaatctgcaggaaggactttttgattggatcaatataaataccatctccattctcgtctccttc

SEQ ID NO: 6 - DNA, 351 bp, Arabidopsis thaliana
  misc_feature (1)..(351): Ceres Promoter PT0625
gatcatgatcagtttcaactcgctgtgcccacgtgtcgagagatcggcacgtgcctgagctctcagccgctcataaatacacttgtttagtagcaacagtatactatagtagtcctctcctgtttggcttttagcttgcatcgatggatggatggatggatcgcatgagagggcttcgcgaaggtacggaaccttacacaacgcgtgtcctttctacgtggccatcgtgtaggcgtctcgccatgctacgtgtcccggaggatgtctcgatgccaacccttataaatactgttccattccaatcccatcgccacagccagtgcaaatctgatcgatcaagataatcgagca

SEQ ID NO: 7 - DNA, 1022 bp, Arabidopsis thaliana
  misc_feature (1)..(1022): Ceres Promoter PT0633
cccgatcggccttaatctgagtcctaaaaactgttatacttaacagttaacgcatgatttgatggaggagccatagatgcaattcaatcaaactgaaatttctgcaagaatctcaaacacggagatctcaaagtttgaaagaaaatttatttcttcgactcaaaacaaacttacgaaatttaggtagaacttatatacattatattgtaattttttgtaacaaaatgtttttattattattatagaattttactggttaaattaaaaatgaatagaaaaggtgaattaagaggagagaggaggtaaacattttcttctattttttcatattttcaggataaattattgtaaaagtttacaagatttccatttgactagtgtaaatgaggaatattctctagtaagatcattatttcatctacttcttttatcttctaccagtagaggaataaacaatatttagctcctttgtaaatacaaattaattttcgttcttgacatcattcaattttaattttacgtataaaataaaagatcatacctattagaacgattaaggagaaatacaattcgaatgagaaggatgtgccgtttgttataataaacagccacacgacgtaaacgtaaaatgaccacatgatgggccaatagacatggaccgactactaataatagtaagttacattttaggatggaataaatatcataccgacatcagtttgaaagaaaagggaaaaaaagaaaaaataaataaaagatatactaccgacatgagttccaaaaagcaaaaaaaaagatcaagccgacacagacacgcgtagagagcaaaatgactttgacgtcacaccacgaaaacagacgcttcatacgtgtccctttatctctctcagtctctctataaacttagtgagaccctcctctgttttactcacaaatatgcaaactagaaaacaatcatcaggaataaagggtttgattacttctattggaaagaaaaaaatctttggaaaaggcctgcaggg

SEQ ID NO: 8 - DNA, 1000 bp, Arabidopsis thaliana
  misc_feature (1)..(1000): Ceres Promoter PT0650
catacttaattctaaaaaaacaacacttatagtttataagcagctcttatgataaaaatctttctgagttatagctctgttaaacttgtattcaccccaaaaacggatgtttcatttcttattttttacttggagtattttattgtaatttgtaaaaaaaaatgtaaagtgggggatatcatgaaaaacaacgtcactttgtttggtcacaatatacatttgataaaataatggtcgtcgcgtgatttagttgatttttgttttatcaaccacgtgtttcacttgatgagtagtttatatagttaacatgattcggccacttcagatttgggtttgcccacatatgacataccgacatagaaggttaaatccacgtgggaaatgccaatattcaatgtttggttttcaaaagagaatcatttctttatatgatctcaaaagtatggaattgaaatgactaatgagcacatgcaattggtgctatcttaaaaaccgaacgtctttgaatttaatttgtttttcaccaaaggtacctaatgaaaccctttcattaaaaaataaaggtaacaaacaaaattttgtattggaaaaaacattttttggaatatataatttggtaatagaattatgagcaaaaaagaaaaagaaaagaaagaataatgagcataataaagcctttacagtattactaattgggccgagcagttttgggctcttgatcatgtctagtaatcttaaacagacgataaagttaactgcaatttagttggttcaggtgagctaccaaatccaaaaatacgcagattaggttcaccgtaccggaacaaaccggatttatcaaaatccttaagttatacgaaatcacgcttttccttcgatttctccgctcttctccactcttcttctctgttctatcgcagacatttttgtttatatgcatacataataataatacactcttgtcaggatttttgattctctctttggttttctcggaaaa

SEQ ID NO: 9 - DNA, 998 bp, Arabidopsis thaliana
  misc_feature (1)..(998): Ceres Promoter PT0660
caagtcaagttccaatattctaaggagaaataatagtatactaaacatacattagagaggttaaacttctttttggatttaagtgtgtatgcataggctatttattcttaagtataactattaactgtagctagatttatacaagaaatacataaaactttatgcatgtgaggtagccatgaatatacgtacatgttgcaatcgattatacatgttgtatttggatttctctatacatgttttaacttgtcattctctaagtatatacataccattaatactgtgggcatgagtttatgataagacttttcttttggagaccagttttgttttcctttccacctatatttgtctataggcttcacggtacactagtttacaagtgtttttatatgttctaaataaaattgagattttccggaacggtatgatctgtttgcaaataaggacgtatatataacagtatcaaatatatttgttgttataaggcaataatatattttctgagatattgcgtgttacaaaaaagaaatatttgttaagaaaaaaaaagatggtcgaaaaaggggagtaggtgggggcggtcggcttttgattagtaataaaagaaaccacacgagtgacctaccgattcgactcaacgagtctaccgagctaacacagattcaactcgctcgagcttcgttttatgacaagttggtttttttttttttttttaattttttcatcttcttgggtttggttgggtcactcttcaggtcaggtgtgtaaaaaagaaagaaagaaaagagagattgttgtgttgtaacccctttgactaaaatctaatgaacttttttaacacaacaaaactccttcagatctgaaagggttcttcttctctcttagtctcttcgtccttttattctccgtcgtcgtttcatgatctgactctctggtcttctcttcttcttcttcttcttctattttttcttacttcgtcactgttgtgtctgaac

SEQ ID NO: 10 - DNA, 1000 bp, Arabidopsis thaliana
  misc_feature (1)..(1000): Ceres Promoter PT0665
aaaaaggatgggtaatgggacctattttccccaacatcccacatgcacacttccctctccattctctcacatttatttctttcattctaatttatccattccgtgtgtaacatattcactaataatctcatctcactaactcattcattgattgtgatatgtttatctagaattagtgttttaacactgtgtctacatatgatttccttttcattgtatgtgaacatgttaactcactaatcattttgtattttcgagttaacatgagtctccacttcggtagactaaagtaaagataggtttgagtataataaagtttaaaatttgctttaaaatcaatatttataaataagtttttatcataagtgatttttgtatgttatattggaccttgtataaacagactacagaagaaaattatttatgagaacttgtaatgttagagtggacctcgtataaactaattatgtgggcttttaccataaactatttatgaaaattattatggcccacaccactataactaaagcccacatatttagcagcccagtttcattgtaagagacatgttcgctctggaactagaattttctggtttttgggtatttgttttcttatgtgtagagaaatgatggtaacgattaaatgttgtgtattacaatttacaatggtaagacgattaatatatttacacacaattttgttgttgctgtaacacgttagtgtgtgtgatgatagaatttcataaagctttaactacgaggggcaaaatgttaattctaaatagttgacagcagaaaaagatatgtatacataatataaggattaaaacgtaaataataataaataaggcgagttaaattaaaaccctgttaaaaccctagcttgaaacacatgtataaaaacacttgcgagcgcagcttcatcgccatcgccattctctctctcatcaaaagcttttctccttgattttcgcattctttagagtcttaacgcaaag

SEQ ID NO: 11 - DNA, 999 bp, Arabidopsis thaliana
  misc_feature (1)..(999): Ceres Promoter PT0672
cagccgtaaatcctccataaatttattttgcaagttttgctcattatataatgagcggaatttatgatataatcgtttgtaataatgttatgttttgatcaaaatttgaaattaaaagtaggtgagaacttgttatacagtgtagataaggtggatcttgaatataaaaataaaatttataagatgtatttaaagcagaaaagcataaaactttagataaaataatgtaaaaatgtgttagcatcaatgttgggatattggccgacccgaacttaatcaatgtcggaagccattacttctctcccaaaagacctttttccttcggagaactaggaacttcctcactacctttcgcttaacgtgaaagccataaatttcatatattcataaaaatcagaaaatctaaaactgtttagtatcacctgtttttggtatagactattggttttgtgttacttcctaaactatatgatttcgtacttcattggatcttatagagatgaatattcgtaaaaagataagttatctggtgaaacgttacttcagtcatgttgggtctagatttacatactactatgaaacattttaagataataattatcctagccaactatatgttctatattatgggccaagaagatatagaactaaaagttcagaatttaacgatataaattactagtatattctaatacttgaatgattactgttttagttgtttagaataaatagtagcgtgttggttaagataccatctatccacatctatatttgtgtgggttacataaaatgtacataatattatatacatatatatgtatatttttgataaagccatatattactccttgacctctgcccccatttccttttactataaataggaatactcatgatcctctaattcagcaatcaacaccaacgaacacaaccttttccaaagccaataataaaagaacaaaagcttttagtttcatcaaagacgaagctgccttagaa

SEQ ID NO: 12 - DNA, 1000 bp, Arabidopsis thaliana
  misc_feature (1)..(1000): Ceres Promoter PT0676
aagatagtacagtttcagtgttttgagaaaaaaagctgaactaaaactaaaatgtttaaggacacaatatttagtttcaattagataattcaacagtttgaacaattttttttttttttttttgaagtcatttatttatacaatgttttaaaacgcattaagcatttaggcagccgacaaacgcctattgtctaactgtaaataggcgcttccacttaggttcatattgcatatttactatatgtgtatagtgacaaaaaccaatatttctcttattttggatgaaggtatagtagttgttaaatgttcaatataattaagcattaatgacaaataaaataaaattaatttagttgataaaaagataatcttataaaaagatcgatgaatagatataatggtttactgaattctatagctcttaccttgcacgactatgtcccaaggagaggaagtaccttaactataattctgaacataattttgtctatcttggtgagtattatatgacctaaaccctttaataagaaaaagtataatactggcgtaacgtaataaattaacacaatcataagttgttgacaagcaaaaaaacatacataatttgtttaatgagatatattagttatagttcttatgtcaaagtacaattatgcctaccaaaattaattaatgatttcaacaggaagtctgagatgatgggccgacgtgtagttacgtttcttgaattgtgagagatggtatttattatactgaagaaaacattatttactaaataaattttcatttcacatcttctgtaatcaatgcgggtagatgaagaagttgttaatacgatggccaaccatatggatctcttttttggcgtttctatatatagtaacctcgactccaaaggcattacgtgactcaataaaatcaagtcttttgtttccttttatccaaaaaaaaaaaaaagtcttgtgtttctcttaggttggttgagaatcatttcatttca

SEQ ID NO: 13 - DNA, 998 bp, Arabidopsis thaliana
  misc_feature (1)..(998): Ceres Promoter PT0678
aattaaatgaaaccgcccctaaattaggagggatttgggtaagtggtaacacattcactggaaacatgtgaagaaaggaggatgtcaagtagctgaaaactcagtatagtaaccaacggcttctcaccaacctttcattaataatttggtcatccctatatttttattcaacattttgtttttcaatagcttagagcaccttaatacctttcagtgtttttttataaaaaaaacaaaaattgggattaatcatcaatccccaaatgtaacgtttacttagattatgttcatttttctatacacacaaatcatattcttttgttttaatcttcgaaaaacgagaggacattaaatacccctaaaaaaggaggggacattactaccaacgtacattaacatgtttgatagcaaacgatttattttgttcgttttgaaaaggggaaagtaatgtgtaaattatgtaaagattaataaacttttatggtatagtaacattttcgaataataagagagggaaaacactcgccattgtcggcaatttagaaccaatattagaagggtttttttagagaaaaaggacttaaaagtttagagaccttaacaacaacttatttagaaatagacatgcttaagttgacaacagcgagtttattttctatatcgaagaaaaatacgaactttttcttaattagatttcgaatgcatgcactatcgagaatcgaccgtcacaagaaaaaactaatatacatactgtacatatctatattcaatattggtggggatgggtttaatgtgtatttataattcatggataaattcacacaataaggtccatgaaactagaaggtaccaaaaataagcattaatgactctttgccacttatatatatgattctctcatagtaccattttattctcccaaacctatcttcttcttcctctcttgtctctctcgctctctctcttctacattgtttcttgaggtcaatctattaaaa

SEQ ID NO: 14 - DNA, 1000 bp, Arabidopsis thaliana
  misc_feature (1)..(1000): Ceres Promoter PT0683
gattgaatgatgagtgtgcacccttgtattactaataaaaaatttagcaacagttataagctaacgtcatccatgagtcattcattagattcactatttgcgttctcaaaaatcgaattgttaaaatttgagaagctctaatatacgagtcaatgagatgtggcaaaagcatgtccttgaccataaaatttcgaggggtcaactcattagataaggacaagaatcaaccaattgaaggcgtcttctataacaagtttctttattactaatattaaagtccaatggggtgagggggagaagaacttaaataaaaggaaataattggtaagtgaataaaatctaaatacgatactagatgattgatttgtgctagtgcatggtattagatcagatatgtgttactattcgaattcaaattggcatattccatgttgttgataagaaaattgtagaagtgtaaaagctgagttactatattcaaactagtggtttacataaagtgagacaacaactgtttcacaaaaatgactataaaatagtaagtagtattaggtcaattgattttaaaattttaatcaaattcaaatttgtgatataatcaaatttgtttatagaaaatgttaagaaatcaattttggcagaactaattcagtgagaaacaatcatttacaaaaacaattttaacattatttaacagtaagatttgacatttaacccgttcgtgtgaacccatcatatctaacatggctctacccatgacgcctccatgccatggacaattttgacagatcagaagttctgaacgtggacgaggtaagaacaccatgatgatacgattggagttagttatgtcgccaccgacatcactgccaatctcattaataaaagtggtactaaatctctaatctctattaactataaatataacaaagaaccaaaagaaagtttcttatctctcttatctttcataatttccaagaaacacaaaccttttctacta

SEQ ID NO: 15 - DNA, 1000 bp, Arabidopsis thaliana
  misc_feature (1)..(1000): Ceres Promoter PT0688
acgttcagaggcatcgcttttgtacaaattgaagcgggtttgttcaatatttaaaataacacaggaaacattcaaatgtattattgatgttgcttaggtttgtgaaatgatatgaaccatatcgtatatattactagatttttcttatatgttttaagggtagtggggctgacctatcattctgtttggcattaccaatcagactatcagagtattcaccattcaggattccataactagaaaaagaaggggtttacattttctcatactgtataattttctactatcagagattttatcgattacattaatctcatagtgattattctgatttataaaaaagttgacaaaataattaaaaccagtattttataacaagattgtctctctcccatggccattattttgacctctgacttatttaaatcttaattaacagcataatactgtattaagcgtatttaaatgaaacaaaataaaagaaaaaaagaacaaaacgaaagagtggaccacatgcgtgtcaagaaaggccggtcgttaccgttaaggtgtgtcgaactgtgattgggccacgttaacggcgtatccaaaagaaagaaagggcacgtgtatagatctaggaaaaaagaaagaatggacggtttagattgtatctaggtaccaggaaatggaacgtcacaccaaacggtacgtgtcggatcctgcccgttgatgctgacggtcagcaacttccccttattcatgcccccctgcccgttaattacgtgtaacccttccatgcgaaaatcaaacccttttttttttttgcgttcttcttcaacttttctttttaaatcaaaccttttctttttaaaatcacattgcatttcctaacgctcaacaaaatctctctctactaatatctctctctctctctctctattgttgaagaagactcataatcggagattgtttgtttttggtttgctctgtaaattggagaagttttgttagagatcaa

SEQ ID NO: 16 - DNA, 1000 bp, Arabidopsis thaliana
  misc_feature (1)..(1000): Ceres Promoter PT0695
aacattttctttaacttactcttaaattttaatagtaagttgatgcatgttatgttgatccgtcttgatcacaaatattgttttatggacgaattctttgacagtaaatggctatagtgactcagcttggagcatcccgatatgaaaacaaagtgcagtattgtgtcgtggtcatcactaacgcactttcctagaactatcgcgcgtgtttgacctatgcaacacaccagatgtcatgaacgtatacttaaatagaaacaatgatatagacaattggctatattctgtcatggaacgcaaaccggataacatgtctattagattcatcggacttgatcatggttatgtcttaatagacgaattctttgttaacgattggttaaaacggctcacgttagagcatcctactatgacttcaaaattgataaatattacatggaaatcactttaattttagttagaaggtagttaatttagatattcttatttaataaattaaaaaatagaagaaaaaaagatgagaagagtttttgtttataaaataagaaatatcttttattgtaattttaaaattaaacaaatttaatttatattaaaattatctttgttttattgttaaggcaataattatttttttggtgggaattgttaaaacaataattagtatactgttaagtggtcctttaataataagataacgtgatttaaaaaagaacgagacaggctaatatagtagagaggaaaaaatacaatttaggcccaataaagcccaatatagagttgtgctcaaacacaggtcttcgccagatttcctatgacgccgtgtgtcaatcatgacgccaagtgtcattcaagaccgtcacgtggcgttgtttctacacataggcgatccatacaaatcagtaacaaacacgaaaagagcattcatatgtacgaaagtagaaaagaagagactctttgtgataaaactaagtaagaaatagcataaaagtaaaaggga

SEQ ID NO: 17 - DNA, 1000 bp, Arabidopsis thaliana
  misc_feature (1)..(1000): Ceres Promoter PT0708
gtttccaaaactagtattctttatttgctctattcattatatttttatatttgtaacgtcccgaccgtctttattaggtttcgacaatcacttctcggaaggtcgtccatcctgaaattactctatcctaaacatgtttaactataaaattctctcgaaacttttgtaacgtatataaccacataaattctcttaaacttatttgcatacaccattatatttctgaaatcgatatgttacaatattatttaatatttagattacttttactgaatcgaattaaatatcaaatcgaaacaaatctaatctaccaaaaataattttgttataaacatttcttgcctagttctacctcatatacattttagttaaagaaagaaatcacaacaattcccataattcaataattaaatccacaaaatcttggagtaagtaagagaaataaaaagatagtatcttaacataaacaattcaaagatgctctctcacacaattcacacacacttacaaaacaaaagacagaaacaatgttttcattcaaatcaaaagaagttataacactagtacaaaaaaagctcaaattctaatagtaactctttttatttcccaattacccaaagattctctctcacttcacaaaactagctttgagagtcgtgttccacaaaatccattaaagctgaaacggttttgctcaccattcaaacaaatacaaaattgcaaaaccccaaattataacaaaataatataaaaattaaaccgctaaaaagagtgaaccaacaaaaatcgccgaatgtgtgtgtaatgagaaaaccgacccatcatcccaatcatctcttcccgtgtcactctcttcctctcccacgtttcttctctcttccctttatgggttttaacttctccttcttcttcttcttcaatcttcagttttcaaattcaacaacaattcacattttgatttcttcatcatctctctctctctcgcttctctctcaaatcg

SEQ ID NO: 18 - DNA, 1000 bp, Arabidopsis thaliana
  misc_feature (1)..(1000): Ceres Promoter PT0710
tagtgcgcgtggggagagggaatggtgaaaccttagtggttaagttatgaggaaaatgataaaaggataaaacaatcaaatgcagcttgaaacggccataacataaagtaccttatggtggtgcgaatatttttgtgtttctttcactcttttattgctgaaagctacgacacttgtcttaatatattgtttccgcaagtcacatgatctactttttatttaacgtctagaaacgccgagatatatgatgattagtatatcacgtctatgcaaattgttagttcgtgtttggccaaaagatatcgagacatgtctgaagaaccgagtctggttttgagatatttcttcaagcattactatacaatagaaaaaggagacacgcgaatatgataatagcaaaaggcataaaaaggcgaaaattaaagaaaaacgtaaagtgatttggcctcaatcaacgggaacgtatcttaattttagaggttcttcttttacttttgagacgagagagtttgcgtctttgcgagctgctttggttgactaaacattatcatattgaaaaccaaaatacaacggaggaatatttgtcacagtttcactttcacattgtttccttaacgtttaatcaaccttgttcaaaatttctatagttgtaatcatcattgtttacaaaattttcgttcaaagatgattttaaataaaattgtgaaagaaaaccttttctgaaataaggattggatgatagtgttaaaagaaaaatatgaactgaggcaaaaagaggagtggtccccggaagattgtgaaatgtgtcatctaaaccagccagacgtagtcacgtgttctctctagctttatgaacttccttagccagcaccatcattgtgattgtagtatatatgtaaccctaccttcatctctcccattttccattctccatatagactcctttacaatatacaaaacctatccaaaagcgaagaagccaagcaaacatattataaaa

SEQ ID NO: 19 - DNA, 1002 bp, Arabidopsis thaliana
  misc_feature (1)..(1002): Ceres Promoter PT0723
gtcatatcttatcaacacgtcaacgatcaaaacctttagcctattaaattcaacggcttagatcaaaacgaaactaggtgggtcccacttttaatatcgtggctgcataacatttcctcgataactgaagccgttgtggtctttctcagaatctggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgttattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttrcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaa

SEQ ID NO: 20 - DNA, 1001 bp, Arabidopsis thaliana
  misc_feature (1)..(1001): Ceres Promoter PT0740
tgtggccactaaagatttacccttaaccgggcccatataagcccacgtcaagtggcgcttatacgctctccgtaagagagccaacatttggtatgtaatgttgcaaattattcttcaagacaataaattcaaatataattcaatattgtccaaatatagtgatgtacttcagttgtgcacatagaaactccactaaaccaacttttagatagatgcattcacaaattttcaacaatgtcgcgaaagtctaatccatcaccagattctaacattttaattattatatttaactatacatactctaatcagcatgagtcaaacgtgtacaatagcccaagcatataataagaccaaagtcaaactcaaataaatgtctccaaactcaaaacttgaaaaagacctaattattacatggtagatatgactttgtcgacaagtaaaccaactaatcctcgaagctaccttctcttcccagttattatgtgtgatcgatttataaatctcttcttctaataacacctatatttttcttatgatgtgaataaatataaaacttttaactttaaaacatatttatccgaaatattgcacttagatttcaaatagataaataatagtactatctaactgatattgaaaagacctaacacggaaaacagttttataaaaaatcccaaatgtgggtaattatcttgatttcttgggggaaacagaaaatggattaagattaatcggagtcgtgtcaagcagctcgttaataactgtagcaagttgactgagtaagcatcaacgtgtcatctccgtaaagcccattatttctagtctcgccgcgtcttctcttccacgtagcacttcactttttctctccttttgtttcctttggaacacaaacgtttctatttataggaataattacgtcgtccgtatctgtgtcggaacatagatccaaattaaaagcgacttacttaattacatatcgttcgtgtttttttcttcaaaaa

SEQ ID NO: 21 - DNA, 1024 bp, Arabidopsis thaliana
  misc_feature (1)..(1024): Ceres Promoter PT0743
tcgattggcccgatcggccccaaaatcaagctgagccgcttcaaacttcagcttttgaaatcacccccaaactcatgtcctcttatcattataactaaaggatctttcattttatttaactcatcgtcttgcactacccaacccaaaggttccaactatacccgaagctttctaaaggtccaaagactttttttttcgagccagactattcaagccaagaaaagccaaaccccacaagccagtacttttcaattccatattataaacttatctgtcttgttttagtcccactaaaaacaacagaatttaatttaggttgagctaaaacccttgacaaaagtgtatagtcgtcgattcagtagcacactcatcactcatcagatttgatagttgacctaaagtatgactactccatttcaactaacaaatgaaaataaaagagacctaagggttagaggattgaaactatactctcaagtcttttatcactaggctactaccagctagttaacttgatggatttaagcaagaaaacgtagaatttatattcgagcagattgtttagctaaaaaagcttgggtttgaaattgccttttctcccatataagcacgtcggttcctaaataactctttctagcggagagtgtctttccaataatttaataaaaatggtgtttgtatatcaaaaaaaaaagaaaaaagaaactgatcgagatagaacgtttgcagttttataaacaatttaaaaaacaaaaaaaattaaactcaatgtattttttattaattcacaaacaataataaatcataggatcgaatatttacacggtatcaaaacctactcgccgctactatataaaaattgaagtcaaatatcaaccgcaattattaaaccagcaagacaataattcataaacttaatataaacataaataaattaatgttacacaacgatatatggtgagggttattactatcttcttcctctcaaaacacatctcctaaccttaagctttagacggcctgc

SEQ ID NO: 22 - DNA, 1000 bp, Arabidopsis thaliana
  misc_feature (1)..(1000): Ceres Promoter PT0758
agctagccacatcagtgaccaaaaaagataattaacaaaccaaataaaataacaaattttgatcatttggaataaaatttataaaaggaacgaaagcgccttctcacgggtcccatccattgaaatatattctctctttttgctctatataataataacgcgtactaatttgtagtatatattattacaaagtcgatatttgattgttttgtgaacgttgatatattaattttcttggatgatgacaaaaaaagtcatagaaagtaacgtgtgaacatagcattaacaaaatacaaacataatatataaccaaatatatgaaaataggataaaatctcattgaatagatcttcttctattcaaatatataaatatttgtttgtctataaaattaacagagcattcacattatctaaaataatagtaaaatcaaaataaaactaaataaaaataactctggttttataacgattgattttaaatattagtttttgttgtaaagagatcattatatatgtctgtaatatttttatactgagttacatgatatttagttattatagcgtaattaactaagataagaaattaactaaagtgatattctgattattattatttttgttaggacacgtacgtggaaaaactaaacactataggttacaaaacggtataataaactcaccattactggaaaatgtttgcatttgactcaataagtaacttattataagttactgatataatgcatagttttgaaattcttaaataaattattttggtttcgcatgaaaatatgaaaggagagaaatttattattgtcacttatatatatatacatcgtaatcattttttcgtgaataattctctctcccattccattatttctcagtatctctctttctttcccttactttattgttgcttttaaaccttcaatttgctcataaaccaaatatataatatcaaaacaaacaaacaaaaaatcagaattcccctaata

SEQ ID NO: 23 - DNA, 921 bp, Arabidopsis thaliana
  misc_feature (1)..(921): Ceres Promoter PT0829
aaagttttgaattattgggaatcaatttcgaagttttgtaattctttgggggctaataggatattttattttcttggtttcgtctattgttgtttttctatttatggttgggcttttagaactctggacaggcccatgtcatatgttttcccttctccttatatttttcatttttcattttgttaaattaatgcataatatccaaaaacaatttaaatttttgaaggaaccctttagttacggctccgaagctttcacaagtgagaatgtgagatcaaagaaggcaaatggaggattttaaaagttaaaatcatcttttatctgcaaaagttgacaatttttttgtatcaaatctaaatcatcaaactctcttaaactacaagagcataacaacctctatgtaatccatgaaataatctgcttgaaggacataacataaatcattatggctagagtgactaacttcaatcaaatcctcttaactctagctcccttacaatggtatcgtaaaacattatgcattagggattgttgtcctaggaaaataaaataaaaatccccacagaccaactaccattttaacttaaaaataagcttcgtccgcgacgaattgttttccatcctaaaaatagaatggtgtaatctgctaatggtttagttccattaacttgcaagttctattgaaagcctaaatgtcaataaagatattaaaattcggagtcaaaagacaaatgaatcaaaagcaacaagacaagtcagctccattcttcactacccatcttttacaataaatcatctctcttttcacaaatttcaaactactctcattgccctttagctttgttatagagccaacactacagagagactcacacacttgtttcaataattaaatctgaatttggctcttcttataaacta

SEQ ID NO: 24 - DNA, 763 bp, Arabidopsis thaliana
  misc_feature (1)..(763): Ceres Promoter PT0837
aactacaagggagacataatatcaccatctggttcctgttatcatctgaagatttcttgttttaccttccagtgataaaatgatccttataatacatatagatatattaaattgctgtattttaagattatagatatataaggtacatgagagtgtttatttaaaaaaattcacttggaattcatgttttgtgatacgttagattggaatccatttgggaaaagaagaatcatctgttcttatgtctcaaattttgacttcattcacttttcttcttgtcttttaagaaagcttccacaatctaactgttcgatgtgaaaactgagattcgagtaagaaaatgtgaactgtgttatactgttttttaattagataatttagattgcactcagataaattaataacattcctcgaatacttttatgtgattggatatattaggtatatctgccaaccaaccaataaactgctatgtttaaacaaattaaataaattagtatatgtttactcaagaataaagaagatagaaaagaaaattctatatgagctaaatttgctggaggaggcatcggacgtgggtaccagacctttccaagcacacgagtagtgcttagccatgtcatgctaacatacaccatttggttcatacaaaatccaaatcaaaatctatttttaaaatcttttgcacacgtctttgaaaaacacctctcatactatagctacggaagcttcaatttcaaggtttgtctaaaagctaacgatt

SEQ ID NO: 25 - DNA, 751 bp, Arabidopsis thaliana
  misc_feature (1)..(751): Ceres Promoter PT0838
atactggtatgcttaaggttgaagccaagatctctgtcttacccaagtaaccactttctattagaagggatcaacactaagaatatggagatttaagcctaagggctaaggcggttctcaacaatacatgatgtgaatacaatcacagacgatttactgaggtttgttgataagatcttgatcagtctctgcatcatctgttcaacaatctcaatctttgactgtttgctttcggagccataaacagaggaatcccttattccctgttataggagcaatacaccaagtattatttccatggctgaaattctcttatggaaacctaattgttccattgaagctgtaaaatcgaatctggtgaatattctcgagcaaagccgcatgctaattatgtcaattcagaagagtttgattaggagactcgaagcgagtttgatgatctttcttgatgttcaactccgattgtaagggtataattgacttttcatgtattacggctccaccacctgacactaaggcactctttgtccatctcgttggtatcatcggattcggatggtaaaaataaaaagagcagaggaaacttgttactcatgcaagcttctcaggtgccacgtcactccattacgtgtcatcttcacacaccatctcgctcaaaaccgatctcatttttcaaaccttaaaggcagaagcaactgattaagttaacactcttgagaagctctcgattaagcttgaacttggaggatca

SEQ ID NO: 26 - DNA, 669 bp, Arabidopsis thaliana
  misc_feature (1)..(669): Ceres Promoter PT0848
tctctttaaatcagttaactaaccgtttatatatttacgataaggtttgaagagattattgataaaataatacatttcataatcccgcgttcaaccgtttaaagtaacatttaagttgactatatctaattttttttccattaaatatggagctggtaaactttatcaacttctaaaaagtgtaacaacaaaaattaggtcaatcacaattctgttttttttattattttggattgacttccaattgcaaatagtcttagtgatcaccattatcatacatatatacatcaagtaggtttcatcatgatataccacaaagtatttgacaagccatatggttttggatcaaaaagtcggtccaaaattaatgttttatgtgcaagaaccgacccattgtacacacgtgttaacatcttcaagactttcatctctatttttcttttggtcattaagatacccattgatccgaatctgttacattcccacctacttttttaatttttactatccactccaaattaaacacaaccgatgattttaataattggaagcttttaaaaatatttcaaaacaagcctctttgtgtttgtctatatatatacacgtaataagaaggtgaatgaatctcacagcttacttgttctaaggcttccaataacgaaaacagta

SEQ ID NO: 27 - DNA, 702 bp, Arabidopsis thaliana
  misc_feature (1)..(702): Ceres Promoter PT0863
cgggaaacgacaatctgatctctagtccagtcgattggcccgatcggccgattataaacttacatgagacaagtataaataattattataaacttattaagtttaagatcaaggcttttgtgcaatgtatcaatgaatgttagatgtgatatgatgaaagcaatgttttaaacacatacatagtcattgatcggaatgtgtgttattagaaatgcatgcctaagccgatagggttatctatgtttggtcttggacattatagccaaatttcgaatctaattcttccaatatatatttttttttttttgcttagggccactactagtattgcttatcaattttaagagctcatgaaaatgcaacaatatagtagttgcaaatccttgtttcaagagaaatcaaagggccacttgtgaattgaataataataatatttgcaaataacctttcactaaaccataccaacaaaaccacacagatttggcaaagacataacctttgggagacgtgaaaaggctcaaaatttgacaattgtccttacaaattcgctcattagtgcaattgtgagatttgtttgcatccaaatccaattcataactcacactcgtctcaaattcgaaaaggcctgcagggccagtgcactgggatccaacaatgtcctccgactcgtccaagatcaagaggaagcggaaccgcaccgcg

SEQ ID NO: 28 - DNA, 435 bp, Arabidopsis thaliana
  misc_feature (1)..(435): Ceres Promoter PT0879
ttctaggaagactggtcaagctaagctgtttctgttttttgtttttgtactttactttttgtttgctagtgggaactgggtttattgggccttgaagttgataaaagatgaataaaagacatatcgcctaaagcccatatgagaagcagaagacaaaaacctccaactttgggcataaattttgattatagttaaaagtccagacccaatttggcacctggcttagttacgattctaaggcatgacacctgcctaatatgtttattacagaaaataaagagaatcagctaggtgtcccttattgaacacattaacaaactccaacgacactacgtgtcttcgtgactcttactatatccaaaaacctatagctaaagctgaattttccatgattagtatagtcccaaccaaaaaaatactgaagaaggcataagc

SEQ ID NO: 29 - DNA, 397 bp, Arabidopsis thaliana
  misc_feature (1)..(397): Ceres Promoter PT0886
agtgtatttgaaaacgacattgaagaattaatatatttttttttaattttagttttttatagtacaaatattaaaacaaacaatcctaccatatcataacatttgtaaataacattttaagttttgttttgagttttaattaattttctatgacaaaaaaatgaagtcaatagactaagtgaatcatatagtataaataaacacaatttaaatagtttcaaataaatttagaaagaataaaacaaatagaaatcagaaggtgtctgtttcctcctcgcaacatacgatcaaagagaaacaacttgaccctttacattgctcaagagctcatctcttccctctacaaaaatggccgcacgtctccaaccttctcccaactccttcttccgccatcatc

SEQ ID NO: 30 - DNA, 1024 bp, Arabidopsis thaliana
  misc_feature (1)..(1024): Ceres Promoter YP0007
agcagaacaactatatttattgtgtcacataaatctgagatcatttataaccaccaaagaacctatacacagtaaatgacaaatgtatctccctctatctctattgcccatatgtagatgctaaagtaagatttctcttttttttaatgtacttttttttgtataaagtatattccataagaaaaaggaaaagcttgtttatggatcaattgaccccaaaaaaagtttttagatcaaagcccaatataaaaaaaaaacacagtagtgacacaaaggaacttaaataaaccatgaattgatctataaacagtagagatcgataaggcgaacattttccatgtgaagtgtcttctttcatctataatatttttgacatccaataatttcctctataatatcattcacataattgatagaaacattatgttagaattgtccacatcatttgagctgtaatatattctgttttaacaaattatatggtagttgcttaatcttatgtccatcttcttctatgcatcgttttcgcgcctagttgtccagtccatttcaactacctacctctaattcttatcttaaaacaacattttttaatttaagtattatgctcaaagactaactagatagaaaaccgttattaaacattaaacgaattaaaagtcttacatggaaaatgtaggtttataaaccacgagttatgattgacaataaaaaaaatgcaaatcatcaatcaaaagagacttgagtgcgactctatatcaaccattgcaattaaaattatctatcacaaaaattttagacagattaagttaatttagtctaaattcactaatttattttctataattagtaattaactatatttatttatttacacattttctgataatttagaaatttgcatgaataacaaatataagattttggaaattagtagcaaatttaattaataattatttttgcctaaatgaaccaaactataaaacctccacatacaccagtcatcaaatttacagagacaaca

SEQ ID NO: 31 - DNA, 1000 bp, Arabidopsis thaliana
  misc_feature (1)..(1000): Ceres Promoter YP0008
ctcgagagatgaagtcttagtaatgtttgaacaaacaataatcacgttttccatcaaattcgagcatttaaagtttatattactacatgccccaagatgataccgtccatctcatccgaaaatatttctgaaattgcgctaagacaacaatgtttgctcaaattcgatcatttaaagtttacaaatctctcatcaatcttacaaacttctcacactaaacagaggtacatattttcttataaagacaaaaggttcgaacagctggcttctcaactcgagttgtttgtcagggcctctcttcactaactacaagttggtacttcaaatattggtggctagcttcacgtgatattgtctacaaattaaacccatgaaaaagctgcattaattgttccaagtgaaccctgaggagtgtcaatagtctttgctttagtgtgatcattaaaccaaatctctaaattcctaatttgtactaacatttggaacgtatttcctactcttctccctgctccaactcccaaaaataagattagttagatttctataactaatatacatgtatactcccaaaaacagtaaaaccatattaataaagctaattttgcatagatttatttcggtaaaccggcggttcaagttggggaaaaaaaagacaaacggtctaaagtcatccaaagacaaaaaaccaaagacaagttgagagagacgagaccaatcacaacattgcttcgtagattgcgtgacatcatccttgacggctactttcatttgtgtcttatttggataaaacgcacgtgtttaattcacgaaccttcatagcaataagaaatttccattactttcatattttcaactttttttattacccattacatgcttaaaatattaattcacaagtctttgtcaaaattcaatattttccaggttcatgaaccctttttatctcaatctactctataatatctccctataaattacaacaaaacctctttatttttca

SEQ ID NO: 32 - DNA, 999 bp, Arabidopsis thaliana
  misc_feature (1)..(999): Ceres Promoter YP0019
gatataagtagaatcattttttgccgccgtttctcgctaacacaccgaaaactgaatcaaatctcctagctcttctacgcaaaatcgagtgcatcgacaatggcggaacgtggtgtcgaacgtggtggagatcgcggcgatttcggacgtggattcggtggtcgcggcggtggaagaggtggtccgagaggtcgtggtcgccgtgcaggtcgtgctccagaggaggagaaatgggtgccagtgactaagcttggtcgtctcgtaaaggaaggtaagatcacaaagattgagcagatctacctccattctctcccagtcaaggagtaccagatcatagatttactcgtcggtccttcattgaaagacgaagtgatgaaaatcatgccggttcaaaaacaaaccagagccggtcagagaacgagattcaaggccttcatcgtcgtcggagatagtaacggtcacgtcggattaggagtcaaatgctccaaggaagttgcgacggcgatcagaggcgcgatcattctcgcgaaattgtctgtggttccgatacgaagaggttattggggtaacaagattggaaaaccacatacggttccgtgtaaggtaaccgggaaatgtggatctgttactgtacgtatggttccagctccgagaggttctggtattgtggcggctagagttcctaagaaggttcttcaattcgctggaattgatgatgtctttacttcttctagaggatccaccaaaactcttggaaacttcgtcaaggtatgtactttcacaatggctgttttggtttgatgaactctgaattaggcagtgaaaaagtaatcattaccagttaagtgaatttatattgaagattaggatttagctgattgtattggtttgagcatgtgagtttgtgtttaagattgcttgaattgaaatgctttaggttgtttgattacgctaaattctgactaatgtaattcaaattgttgttgtttttttttggtc

SEQ ID NO: 33 - DNA, 1024 bp, Arabidopsis thaliana
  misc_feature (1)..(1024): Ceres Promoter YP0028
gtcagtgaagtcgattggtagtacttgaaacacttggttggtttcatgtatttggcctatatataaacaaacatcgtaattatatacggatttttttcggaattttacgccatatctgtaagtatatataacatgcatgtcgttttcaaattcatatgatgaacgatccacgtaagtgctactactcctacaatattgcatgagagagatatgtatttataaattttattttgaagaagaaataagagggaaggttacttgggtggatcgatgtgaaaacaaaagaagaaaaagcgaaacccactaagccattacatgatatcgaccttcttatctttttcctctttattttatttttctcatcttctttttgtcaggacttttttctacttaatgaaacctccaaactatctaactaatacactcccatgtagaataaagaaaattatataagatattgttgatattttgtaactagaaaatatatttgctctgtaatttttcgtaagttaaatcaacattttaaagtagaaacaaatattactgcaaaaagtaggatcattatttttgtccaaaatctcagttagctatagggttgtagtaaaaacaaaacacattcttgatttgccccaaaaaataaagagagagaagaatattgttcaaaagtggtctcttctctctctaattatgttttcactaaacccaattagattcaaacagtctacaaagtccaaaagataaacatgggacaacaattcgatgcaaaaaatcctcttttcatgctctttttttattctctagtcttttaaattactaataaaaactcacaaatccaccaaacccattctctacaactcaccttcatctagatttacccactcccaccgagaaacacaagaaaaaaaatatacatatataaatatacaagacaacacatgatgctgatgcaatatacacaacaaagtattaaatcttagatattgtgggtctccctttcttctattcattttcttattcattaaaa

SEQ ID NO: 34 - DNA, 1024 bp, Arabidopsis thaliana
  misc_feature (1)..(1024): Ceres Promoter YP0039
ccgttcgagtatttgaaaatttcgggtacacccgcctaaataggcggaccttatctagtatatatatacatttgaactatattgtttactttttagttgatttaggctatgtcatgacattgacataaatctacctgttatttatcacgtgtaattcgtgtaaagtgtaaactagaaagttcaaatacgtatttgtttttgttctgttatataggattgtcatagttgtaaatctacaatttattacaacatgaataagtacacaagcaatgtaattggatttaattgctaaactctttacatggtcaatctaaatttgataagaaatacgtcacatattactaagactgatagtttttttgttgtcaccaattatttttgttaaattgacgaaaacaattccaaaaactcaaatgtacaaaatcatacagtctcacaaacatctcatagagaaagatataaatctcccatatgggaacgataacacgaggtcgaaatactattcgtaaaactaaaacgccttagttataaatcgttagttgtaaccgcggtcgagaatacatacagatccacgaaactactactacacatgctgctgaattggaatttggaaaagaccatcttctttaggaagagctcacccaatgagtgacaaaggtgtcggtggcttgttttctacccatatgtatacatcaaatggtagtttcattaacgtttggttttgagaaaagtaagactttggctagtagctaggttcgtatataataaactcttttgagaaagttcatcactggtggaaaatgttaaaccggttttttctcattttttccgccatgttaaccaccggtttaaaaagaccgtaacacattgaaagattaataagggtatatttgtaattacggtttgctggcaatttttaattattattttaattagagaaaatagagaagccctatcaatgtacatggtatatatataaaaggcaaaaccctagaaaacgatactattcgactcagccgtcctt

SEQ ID NO: 35 - DNA, 1024 bp, Arabidopsis thaliana
  misc_feature (1)..(1024): Ceres Promoter YP0050
aatctgatctctagtccagtcgattggtacttgagggaaacatcatatttttaaaccttgtctcagtaagctaacacacaccccttgtgattacttatccatgtttatccacaagaatgcagttggattgagatattttcttctttgttgaaatcaggcctcaaggtgttcatgtggtctgcaaaaaaattcccaaaaataaagatagtgacatctgaaatcgataatggattagacgaagagtttcgtgttattccttggtatgggcgggtttggggacagatattttggcacagacgaggactaggccactgtggtcctgcagcattaggtgtcccttccatgtcctgcattacattttattgatggattcatcaccctatctactacaacggctacacaaactatgaagagttttgtttactaataaatgcccaagtgaggggtcgatcgaacccgggacacgtttttcagtttaccatatagaattatccttggaacccttgatactccatagaacatcaccacctctgttgtcatctcaggaatccaggttcaaacctagtctctctctccctagtgggaggtatatggccactgggccaatgatgacaaaatgcaaaaaaaataaaatacatttgggttcattatctaaaatatctcttgtgtttgtaagttttggttgcacactcgtgtggttgaagtgtgtgtgagaggtactatacaatacactctgcttttgttttgtacctatctctttctcttctccacatatccaagactttggggataaagctgagatcattggttgccatttggttgtgtagaagcaatcacccatttgctttatccgaggttgataaatttcctcgggttctccttctgacacgtatgacaaattctaatagtatattcctcgtagatattacctatatattctcaatagttgcaggtacttaaggctttgtcttggcatcctcgtcctcttcagcaaaactcgtctctcttgcactccaaaaagcaa

SEQ ID NO: 36 - DNA, 999 bp, Arabidopsis thaliana
  misc_feature (1)..(999): Ceres Promoter YP0086
cttatcctttaacaatgaacaggtttttagaggtagcttgatgattcctgcacatgtgatcttggcttcaggcttaattttccaggtaaagcattatgagatactcttatatctcttacatacttttgagataatgcacaagaacttcataactatatgctttagtttctgcatttgacactgccaaattcattaatctctaatatctttgttgttgatctttggtagacatgggtactagaaaaagcaaactacaccaaggtaaaatacttttgtacaaacataaactcgttatcacggaacatcaatggagtgtatatctaacggagtgtagaaacatttgattattgcaggaagctatctcaggatattatcggtttatatggaatctcttctacgcagagtatctgttattccccttcctctagctttcaatttcatggtgaggatatgcagttttctttgtatatcattcttcttcttctttgtagcttggagtcaaaatcggttccttcatgtacatacatcaaggatatgtccttctgaatttttatatcttgcaataaaaatgcttgtaccaattgaaacaccagctttttgagttctatgatcactgacttggttctaaccaaaaaaaaaaaaatgtttaatttacatatctaaaagtaggtttagggaaacctaaacagtaaaatatttgtatattattcgaatttcactcatcataaaaacttaaattgcaccataaaattttgttttactattaatgatgtaatttgtgtaacttaagataaaaataatattccgtaagttaaccggctaaaaccacgtataaaccagggaacctgttaaaccggttctttactggataaagaaatgaaagcccatgtagacagctccattagagcccaaaccctaaatttctcatctatataaaaggagtgacattagggtttttgttcgtcctcttaaagcttctcgttttctctgccgtctctc

SEQ ID NO: 37 - DNA, 1024 bp, Arabidopsis thaliana
  misc_feature (1)..(1024): Ceres Promoter YP0088
tcgattgggattactacttcatctagtaaggttctgaaaacgtttgttgttgataaggaagattcgtctcaggttattactgttgatcttcaaggtttgtgattgtgacgcttatacatgtgctgaaactgtggtgtttatttattgaaaacaaaaaaaaagtctctcttgtagtttcattgtactaaatagaaaacaagaaacgtttttttctttaatcttctacattgataatattggatcaaaggattgtttctgcaagacacaacacaaacatacttatactagtttacttctactaagtactaactacatacccatacacacacttgcacctagactttacttctagacatcattaccctaaggtagaaccaagcttacaagcaagttttaccgacaactcttacattacaactctagtctgtagtctttaacgtagacttactaactagtcattagtggtttaattttttaaattttcatccatatgtttttgttgtagatataaactaaagtcggtcacatttaataattgtcattatgtccgcgtaaaagtcaattcagctattggacatttatgaaatgtaagattttctctctcatttccccgtgcgtgaagacatgcattggtttttctgtaataatcaacaaatccaaaccccttttcgatctttatttggacattgttagagacaaaatttctctatagtctttttcctaatttgataccatgtttttgtttctgcacaaatttactcactggtttaactaactatccacttatttatgattttaccattaggcgtcagctagccctagtcaaatttgtaaacaagccaagctatctacataaatcgagatgtcattaacgttaatcgtcgttaattcgaatttgaaaacatagatagctttagcagtacaatgggcaatggtaagaagaatagcaaaaggcccaatatttggtttgcagaaattaaagccttaaaaaaaagcccacagatatttgtcaaagaaccctaat

SEQ ID NO: 38 - DNA, 1024 bp, Arabidopsis thaliana
  misc_feature (1)..(1024): Ceres Promoter YP0092
aaagattgagttgagagagatggtggagacgcagaacagacaaagggagtttaccatatagtgctctaaagggcaatgagattgcagtgatgtggctatccggggaatcatcgcaggttattccttcccatgagcaacaatcaatggatgggttccaattcagaggagaaacagaagaagaaacgtttccagagaaccacagtagggattctcgatcttgcgagttgcagagagcctctgaaactgcaatagaaaggacactgatgaaaagaacacactgaaggagtatgccaatcatgtgaaaactcagagcttgtattggtcttgtggttgatgaagttctcacaaaacctttggctttgaatctcccctcattagtcatggtgagaacaagaacaagacgagaaacagacaaagaagatgaaaaaacttgttggccagtgttgactaagggggaatagccccagacataacaaaattagacttgtcgtacatctttaatatttttttatctgtttctttgtcctgacgctttcattattcctgtgatcaattttctcataccattggtccatcgttaatcctttcttaatttcattttctacgtaacatgagaggagaccaagtcctatgagaacagttgacgtaacagtggttgttaagttaagttaaaaagaggaagctagtgagagtgaccgttaggtagagaagtgagatctttaaccactcttctttctctctctctctgcttttttcgtcgtctttcacatctactgttcgcaaactctcttatgcttccaataatggtgataccaattgagacttgcaggagaatctcctcttctccacactctatcaactggtcagccatggaatggtcgtttcagtttcaatattcctggattctttttaaggattcctgtttctcttctgttcctggtatattcttaacgacgaaattagtatcggatcctggtaatacattttgaagcttttaagtaccattgcactgggatccaacaat

SEQ ID NO: 39 - DNA, 1020 bp, Arabidopsis thaliana
  misc_feature (1)..(1020): Ceres Promoter YP0096
gaggtcagtgagtcgattggtgcaaaattgaaaaattgaagggtgaaacaaatttaaagataatatctattaaatcctctaattttaaaaatttagcaaaaattgtattttcttatggatctgttagttcacacgtatcttaattagtaccaaatcatatctaatgattagtgataaaactagttagatatctatatgtgtctttaccatttaacttgaatccttcttcttttttttacgtaaacaacttgaatccttcgttaatacataaatttaaagcattttttctttaattctattgatcggtatatatttactataagttttagctcatatgcaatttcaaatgatatgcttttaaattttgtctaggtgtgatagttgtatctttaacataaatcttatagcaaaattatacttgatattctaaatttatctatttgctcttgtgaacctcatattagtctagagaaactttgaaatcctttcaattagttgtatgtccaatacatttttactaacatttattagtctttttaattaagattattgttagaaaaaaaaagattttttaaaaataaataatatgttttagatacaatgtgagttaggcttcttatattttaaaaaataaatttatttcatacttaaaaatagtttggaatttcaatttatttggctgaataccataaaatatgtcaatttgaaccttatacccattgactatttggtgttagaaaccctttaacaaaaaaaaactatttggtgttagatatcaaaataaaaaaagtttaaccattggtttcttatattgaattggatattgttacatgtattaaagtttttttggtttaattttgaaacgttgatagaaactattaagtttaagtttggtagtatatttatttgtggaaaatttaattgccattaaatataacgtcaactttttttggttttttttgagaagttacgttgtgattttgatttcctatataaaagttagattacgtcattttttaa

SEQ ID NO: 40 - DNA, 1000 bp, Arabidopsis thaliana
  misc_feature (1)..(1000): Ceres Promoter YP0097
ttcatctttatatttaagagtttaaaaactgcaacttttgtttttctttcactaagtcttatggccacagttaattaaaagcagatgaaaggtggtccaatggaaaaggagaatgtgattgggctagttgggagagttctgatgtctagtgttgggtacacgtgtccgtcagttacacatagcattaaatcagacggcatgtcattattcaaatctagttcacatagtacgactaatagctgataaattaatgattatacagcatatgaattatgaattcaaaaaaaaaaaaaaattgaaaatgttaaggagatgctatattttacaaaattcatcgcaatgctttctactaatttgctaagtggtcttctccagttagtcttgtcgattccaagcgatattattaaatcttgaagcatcgctcaaagcattatagcttaagataaccaaattgttattaaaaacacctagtgaaatttttaaattaaaacaattttgatatctttgtaatatctaatactactctttctgtgtctaaaaggattaattttcaaaaatttcacacatattaaaaaaaaaaaaaaattactagctaaacaattttcaataatcataaaacaatagtaacttaataatttttttttattttcaaaatagtccttcaagtttacaattcattttagtattataatcaacaaaatttgtattaaaaagttggaaaattaatctttgtggaacaaaaaaatctagaaatcattttttagaattagagagaggtttgataaaaaaaaataaaaaaaaatagagagaggtagtacatactaaacgatgtgatactactattgacaaaatcttaattctcagtttagtagaataaactagaaggaatgaatgaagtaaatgcgaatccaactactaacaaaccctacttagtcatcatattttcccatatgaaatccctatataaacccatcatcatctcccacttttttcatatcca

SEQ ID NO: 41 - DNA, 1004 bp, Arabidopsis thaliana
  misc_feature (1)..(1004): Ceres Promoter YP0101
ttctcgttctctagaatattgctggaccggattaggtcaatattattgggccagattagatattgaattgtcgacgttgcttacgttacgttatatcttgtttaagaattaaacctatcgacttagtcttaattaagaaaacattgccttaaattctctggtctgcgaccgtttttttgaccgttaacccctaattaaagaaacaaaataattatagaaagagcactgaaatgtgattattttaacagtactcttatgagaaaattcgtactttttagttttttttttgtacaaatctctaagaaaaacactactactaattaagaaacgtttcaaacaattttattttcgttggctcataatctttctttctcggtccgggactaaccgttggcaaaaaaaaaaaaaaagttgacaataattattaaagcgtaaatcatacctctcaaataaaaacttgaatttggaaacaaagacaactaaaaaactcgaatttaagagaattcctaaaatcaagtgaagtatcatcacttggtaaaatttcataaccgttggcttctatttctatgtgtgccttggtttgcaggagataatatttcatttccaaccaatgatattcgtacacatagtcaaacaaatgtttgtctttgttattatattgagaaagaaacaagaaagagagagagagatagataagacgaaggaagtgaagcttccaagcgcccaccgttaaaaatctcgtgtgcaagtttcaaatacaagtggccggtggtctccataatttgatcgtcatccaattaaaaaggaagaaaaagcgtgttttatacaagaaaactcattaaaatagcaagtctagaaatatctcaacactaatctaccacgtctattacacacacacacacacacacttgatcttaatttattttcaagattcaagaaaatacccattccattaccacaacttgaccacacgcctatatataaaacataaaagccctttcccc

SEQ ID NO: 42 - DNA, 1000 bp, Arabidopsis thaliana
  misc_feature (1)..(1000): Ceres Promoter YP0102
atttggttgataacgttttcactcgactaattatatacttcagaaggatagtaatagaataccaaaataattaaatgattggttagtgccttagtggagactttttaaccgattctaatagactaatgatgtagctaagcatttatttgggatcatcactgtttgaaaacgtgaaatgtgataaaagttatgaaacgattaaaatataaaataaccgtacaaaacattatgtaccgtttttttctctgttcttttggcgatttggtttagttcgttacactctaaatgttattgcagatatatatataatgatgcatttgcatctgaggaacatataattccggttaacacttccaaatcttatatccgtctaggtagggattttataaatcatttgtgtcatcatgcgttatgcttgtcggctttgaccataacgcagagatatagaactagcttttacttaacttttagatttattatttgatctagagttaagtggagatatatagtgtttttgttagattattggtggatgtgagagtttgtctttagtttcaagttgagaatataaggcaagaggagactctgaggcaatcagaggttttgattggcaaaatatccaaaaggcccaaaccaagtcgaagcccatctcgtacaaaaaaagaaagagatctgtaagaaaaaatattctttgatattcttacaaaaataagtgtaaaacttttattagtcaaaatcttcaatctttaaaaactctcatcactcctacgaaagcgcgtgagagttatgagacattccttaatagcattactcacaagtcacaagttcaaaacgtctgactgaaacagaaacaagcctttgttgaagtcttgaagaagagacattagtactcgtcgtatagccataaaaggtaatatacgaaatttcttcgctaatctcttcaccttcctctacgcgtttcactttcactttataaatccaaatctcccttcgaaaacat

SEQ ID NO: 43 - DNA, 1004 bp, Arabidopsis thaliana
  misc_feature (1)..(1004): Ceres Promoter YP0103
gttttgaagaacaatctggatcgaaatctaacataaggtcatcgtattcaagttacgcagtcaaggacttgacatcatcctactctggtctgaggttaccacttccaaagatgggatttttcgactcggtatgcttcctaagaaattcgttttattgaacctagcaaatatcttgtaatgtaagattcctgagatgatgaagaaaaaacaaacttttgttacagcaggagaacggagagaaagaaaacagagaaccaaatgctcttgaagcaaacagaagaagaagacacaaatccaaacttgagacttcttctacaccagaaaaccgcagcattctgggacaacgcaaaacacgaaagtgaaacgggcaatgatatatatgtcttgggtgcgttacaaggcatcgtttgcaactgttgagttggataagtcaactgtcttcttttcctttggttgtagtagctgccttttttttcctttgttgctttaagaaatagcccgaaaaaaagaatgttctacatttcggagcagaaaactaaccgaatgagtttttggtcggatcatcggatcgatcagatatattttgagttacgaactgttataaaaaaagccataattttgtgttgagtttgcaaaataccttataacttgttatttgagattgcacctccatatatattaattcgtaagagtatttattaagtaagctttagtataaatccttttttcctttaaagtaagttaatgttctactaaataatagtaaagttgaagaaccgctccgtttttacaccatgcacgtgttatctaacaaagaaaatatggtacacctaatggctaatgcaaaggacaacacaatgaaactaacttgactctgtgttatagaaacccatagacatctgcatacatcctagtatttgtataaattggactcaaattcctgaggacaatcatagcaaacaatcacatcatcgcaatatacataaacaaaagaggaagaaaaa

SEQ ID NO: 44 - DNA, 1003 bp, Arabidopsis thaliana
  misc_feature (1)..(1003): Ceres Promoter YP0107
taacaatccttgggaacattgcatccatagatatccggttaagatcgatctttgaactcataaaaactagtagattggttggttggtttccatgtaccagaaggcttaccctattagttgaaagttgaaactttgttccctactcaattcctagttgtgtaaatgtatgtatatgtaatgtgtataaaacgtagtacttaaatgactaggagtggttcttgagaccgatgagagatgggagcagaactaaagatgatgacataattaagaacgaatttgaaaggctcttaggtttgaatcctattcgagaatgtttttgtcaaagatagtggcgattttgaaccaaagaaaacatttaaaaaatcagtatccggttacgttcatgcaaatagaaagtggtctaggatctgattgtaattttagacttaaagagtctcttaagattcaatcctggctgtgtacaaaactacaaataatctattttagactatttgggccttaactaaacttccactccattatttactgaggttagagaatagacttgcgaataaacacattccccgagaaatactcatgatcccataattagtcggagggtatgccaatcagatctaagaacacacattccctcaaattttaatgcacatgtaatcatagtttagcacaattcaaaaataatgtagtattaaagacagaaatttgtagacttttttttggcgttaaaagaagactaagtttatacgtacattttattttaagtggaaaaccgaaattttccatcgaaatatatgaatttagtatatatatttctgcaatgtactattttgctattttggcaactttcagtggactactactttattacaatgtgtatggatgcatgagtttgagtatacacatgtctaaatgcatgctttgtaaaacgtaacggaccacaaaagaggatccatacaaatacatctcatagcttcctccattattttccgacacaaacagagca

SEQ ID NO: 45 - DNA, 1024 bp, Arabidopsis thaliana
  misc_feature (1)..(1024): Ceres Promoter YP0110
gggatgcggttccgcttcctcttgatcttggacgagtcggaggacattgttggatcccagtgcaatggtaatataaaacaagaaaacaagagattttataggacaatcactaaatgacatttaattgattaaacatttattcattaataattgtatgttactaacttcaacatttaataattttgtttaagatacgtttacatcagagactattaatatttttacaggttgtaactttaaactttgtcttgaatcgaacatgactatagattttgggcaaacttaaagataacaacatttccgttttttttcaaattattacaaatcaaactgatatattagacacaacacgattacacgtaatgaaaaaagaaaaagataaaaagataaaagaagggatcgattctgtttggtctggtttagtgagattcaaagttaagctcttcctttcaagacatgccttcttaaaccgggaatgtgaacgtttgtaatgtagtccgtccagttaatgcttccaacatcaaatccaaattctctcttctcgtcctctgacatattctccattaatctctggggtattgctgttatcaaatctgtaaaagaaaccaaaaaaaaaagatgaaaactttgcgggtaccggttttgtctgctctaagaattagaatgttaatgagttctgtcttaccttccaccatagaaagtgtatggctcataaatagtagcaaggtgtttggcttgttcaacagatttcttgcatataaactttagcttctgcatcatcttactatccactgaactcataccactcatcaacccactccgttcttgagcatctctccacaaatgatccgagaaatcatcaacggaattgaaaagtttcatcaaacgcaccataataggatcacctttagagtccatgcatggagatgttttgtagtggttataaagaagctccgctaagtcttcgaaaaccagcgggtttatcgccgaagaagcgatctgatacacgtttatttcaggttcc

SEQ ID NO: 46 - DNA, 1024 bp, Arabidopsis thaliana
  misc_feature (1)..(1024): Ceres Promoter YP0111
cgattggatttagtctatacattatagggcgcaagtttgtggatttaagaattatataaaaacttgaaatatatagtttttatgcattctcctcttgtgtaatacataaaccaaatatgagataggttaatctgtatttcagataatattaaattccaaacaatatttttacttgttataagaaggcaattaatatctctctgttaatggcaagtggtaccaagtagtattaaactattaatgcaatggaagagtactgttggaaattataatcctctatcacacattcaaacagatctcctgaaatcttctcttccaaacttgtacttctctgatccaaatgtaggctccaaaatatagacatttaccatttactaagtccacaactcctttcttgtctccttcaaaaatgactcttgtgtaaccaccatatgactccgacagttcggcattgccatgatgagagcttaaaaattcaccttcctgagcatttcaagtcttcactcccttagcttgacctgaaccaagataaaatgcctttgtcgtcccgtaatatccatcctgctttggacggcatcatagttacattcgatccatcctatttacaatgttattttagtattaaaaacatgacaataaatttgttgttaaacatattcaaatacaatatgattggatttataagtaattgtaatatgaaatgtccttagtaatatgttaaaaaatacatagatacacacacgtactaaaagaggcaacgcgggagatgtcattagaggaagaactaggaagcagagcgttcatgcaaaatgctaccaaaaacgttaatgcaatatctcaactaatcagcacagtccatttcatactgagaatgtaaaaaccaatcagcatcgtccattttttcatctaattatttgttaactcttaattggccacaacttccaaccacatgacgctctttctattccctttatatattcccatctcaaatgttcttggagacacaaaatatcataaacatata

SEQ ID NO: 47 - DNA, 996 bp, Arabidopsis thaliana
  misc_feature (1)..(996): Ceres Promoter YP0115
gtcgattggatgatgaacattctacatatataattattatgtttaagcacttagacagcataaattctttctaattatataaatctaaccttgttacattgtacatctataaattacttgaagaaataacgagttctatttctttttaaaaattaaaaatactataccatatctcagtgattaagttgaaccaaaaggtacggaggagaaacaagcatttgattcttccttattttattttattcatctctcactaatgatggtggagaaaaaaagaaaatacctaacaaacaaatatatattgtcatacaaaaatatttctatatttttagttaattagtttatattcctcacttttcagggcttatataagaaagtgagcaaacacaaatcaaaatgcagcagcaaatactatcatcacccatctccttagttctattttataattcctcttctttttgttcatagctttgtaattatagtcttatttctctttaaggctcaataagaggaggtactattactacacttctctctacttttacttgtattttagcattaaaatcctaaaatccgttttaaattcaaaaataaacttagagatgtttaatctcgattcggtttttcggctttaggagaataattatatgaaattagtatggatatctttactagtttccattcaaatgattctgatttcaatctaatactctcactctttaattaaactatatgtagtgtaatttcacactgttaaatttctaccatgtcatgtatattagagttgcatagaaaattgtaaaacatccatttgaattcgaatgaaacaaaatgttttaaaataaaattttggtttttaaaagaaaaatctaaaactgaattatatcgtttaaccaagttgtaaaagtcataaaacgtagtatcttgtaaatcgctcttccacggtccaaatagacttctagtaataaacaagtaaaactaattttggtttcttac

SEQ ID NO: 48 - DNA, 1024 bp, Arabidopsis thaliana
  misc_feature (1)..(1024): Ceres Promoter YP0117
gtcagtgagtcgattggatcacagtcctttatgataaaacaaactcataattattccaccgacaacatgcgttttaaattattttttcttaaattatattatattatattgatatcaacctagctaaaataattcggatggcgaaatcggacaatttttaatagaaaaaatgggtatgaagatagtctatgattccgttcttagcgactagagggacctgctcaaatctcccgggtgatacgcgatgtcaagctcaatagaaccccacaaccgacgagaccgagaaatccttgatttgggctagaagattttgaaataaatttaatatattctaagtaacttgcttaaattttttttcaaactctaaagacataactaacataaagtaaaaaaaaaaaagttaatacatgggaagaaaaaaattaaactaatgattagctctctaacgtgtttaatctcgtatcaagtttttttttaaaaattatattgctattaaaacattgtactattgtttctattttgtttagctattattcttgtgaaatgaaaagttgtgtttattcaattactaaatggcaatatttatcttggaaaactatacctctaattggattaggccctagacatcctctttagcttattgacgttaaaattattcccaaaactattaaagtttagtagtttgaaagatgcatcaagacctactcagataggtaaaagtagaaaactacagttagtgtgattatattttaaaatatataaaacaatcttattaaactaaatattcaagatatatactcaaatggaagataaaaacatttagtctgttaccactaccagcctagctagtcactaatagtcactttggaactgagtagatatttgcatcttgagttaccatggactcaaaagtccaaaaagagaccccgagtgaaaatgctaccaacttaataacaaagaagcatttacagcggtcaaaaagtatctataaatgtttacacaacagtagtcataagcaccattg

SEQ ID NO: 49 - DNA, 1000 bp, Arabidopsis thaliana
  misc_feature (1)..(1000): Ceres Promoter YP0119
taccaaaaataaggagtttccaaaagatggttctgatgagaaacagagcccatccctctccttttccccttcccatgaaagaaatcggatggtcctccttcaatgtcctccacctactcttctcttctttctttttttctttcttattattaaccatttaattaatttccccttcaatttcagtttctagttctgtaaaaagaaaatacacatctcacttatagatatccatatctatttatatgcatgtatagagaataaaaaagtgtgagtttctaggtatgttgagtatgtgctgtttggacaattgttagatgatctgtccatttttttcttttttcttctgtgtataaatatatttgagcacaaagaaaaactaataaccttctgttttcagcaagtagggtcttataaccttcaaagaaatattccttcaattgaaaacccataaaccaaaatagatattacaaaaggaaagagagatattttcaagaacaacataattagaaaagcagaagcagcagttaagtggtactgagataaatgatatagtttctcttcaagaacagtttctcattacccaccttctcctttttgctgatctatcgtaatcttgagaactcaggtaaggttgtgaatattatgcaccattcattaaccctaaaaataagagatttaaaataaatgtttcttctttctctgattcttgtgtaaccaattcatgggtttgatatgtttcttggttattgcttatcaacaaagagatttgatcattataaagtagattaataactcttaaacacacaaagtttctttattttttagttacatccctaattctagaccagaacatggatttgatctatttcttggttatgtattcttgatcaggaaaagggatttgatcatcaagattagccttctctctctctctctagatatctttcttgaatttagaaatctttatttaattatttggtgatgtcatatataggatcaa

SEQ ID NO: 50 - DNA, 999 bp, Arabidopsis thaliana
  misc_feature (1)..(999): Ceres Promoter YP0120
tagtttttgatttaatctacgtttttcttaatcataaatgggtaattattagtttttgcaaaatcaaaatccaaaaattgttctaaacactgcaaccatttaaggcctatatcactcagaaaatttctggtgggagaactaatcgtttgtcctttctaaatctcacatattagaatttagaattagtgtgctacataagaatattagttcagctcggaacaactattttttggtaaaacagagaacttaaacaaatgcattattttatcaacatgcattttgaattgaatataaaatttcataattgtaaagacataaattacataaaattttacatgaaaaaatagatatagaaagaaaatgaaactaactgatgatatgctctctaaattttttaatctcataacaagaattcaaattaattagttcatatttttggttaatataacatttacctgtctaagttggaactttcatttttttctgttttgtttagtcagtattcttaatgtgaaacggaaagttgaatttattcaaacttaaattcaatagcattaattaaaggcgaaagctattatctctacatgtggttcaaactagacatccaatttaattagcttattgacgttgaaatgttttccaaaactactatagtttggcaatttgaaagatgcatcagaactactcagacaggtaaaagtagaacctctagctgtgtgaattgtatgttagtccataaagaacatcttgtaaacttcatacttaagatatatattacaatatatacttgaatggtagataaaaacgattagtctgattgctagcatactcacaactatttggaaatgagtaagatattggcattctagagttactactatggagacaaaagtcgaataaaagagacctcacgtgaaaatgttacgagctagtaaaaaaagcatttacactaacggtaaaaaaagtatctataaatgtttacacaaggtagtagtcatt

SEQ ID NO: 51 - DNA, 999 bp, Arabidopsis thaliana
  misc_feature (1)..(999): Ceres Promoter YP0121
ttggattttttttttgttgagtcagcagaccatctaatctctctttttccaccacagcctgctttctatgaagcatttgggcttacggttgtggaatcaatgacttgtgcactcccaacgtttgctacctgtcatggtggacccgcagagattatcgaaaacggagtttctgggttccacattgacccatatcatccagaccaggttgcagctaccttggtcagcttctttgagacctgtaacaccaatccaaatcattgggttaaaatctctgaaggagggctcaagcgaatctatgaaaggttggcccattctccttgacaggcttaacaatacaacttgtatcgcttcaacaagatgatggcttaataaggatttttgcatgtataggtacacatggaagaagtactcagagagactgcttaccctggctggagtctatgcattctggaaacatgtgtctaagctcgaaaggagagaaacacgacgttacctagagatgttttactcattgaaatttcgtgatttggttagtgtaacccactgttattcttttgatgtctacatctactttacttacattattcttttcttcggtttgcaggccaattcaatcccgctggcaacagatgagaactgatcatgacagggtaggattttatttcctgcactttctttagatcttttgtttgtgttatcttgaataaaaattgttgggttttgtttccttcagtggtttgattttggacttatttgtgttaatgttgttttggctgttctcttaatatcaataacaaataaatttactggttggtatctaagatctaacaatagttactatttttagaggtaaagacaccaaccttgttatattggtcagagagctaaaaccttgacttgttgggaaaacaaaactctaatgacagaaaatctgacatgatgccttataattcacagcctcatgttctacataaatcctaacaatagcactttgtttct

SEQ ID NO: 52 - DNA, 1004 bp, Arabidopsis thaliana
  misc_feature (1)..(1004): Ceres Promoter YP0128
gataaactgataatggaaaagaacaaagaaaccagtttttaactatttgcatatgtaatttatttgttgcaaattatatttagttaaaatgtttcctctatttatatatatatatatcagtcaagcactatgtataagaaatgtcaatttataaatttttacatgtcctttaacagaaagaaaatgaatttttacatgtcattcatagagagtcactcgtttatttcttatatagagaataacacactcacatgcatatgcatgcaatatgatacattttatgacaaagataatcaacggaaacggtcaagacataatttgataaacaacttgcacgatgcacagatctgatcaaatatataactctttaacatatccaaaatattcaaaaagaaaaactcgatccaaactagcaacatcacgctcacgcggtaggctaaaaatttattaatctccaaaagtctttcttatgaacactgcaaacacaacaacttgaaaagtcatataggtttagatgatgacgcgtattggctatcgcttaccggagtggctcataaatacaataaacaatacgtaaaagtcaaagtcaaatatatttagtcaactataaccattaatcgggcaaaacctttagctgtcaaaacaacgtgaaaacgatatttgtatatatcatcaagaatcagtagataagagaatgatttaatcccctgactattacaattttggtgtaataaacagtctctattggtttttattctttgttttaatttctcatgacctatagagagaattaggtagtttcgaaaattggctaatcaacttttgaaaactactgtctactttgcttaaattctctacacttagtttcggataagataattgtcggactaatagttaatcccttgacaatctttgatattataaaaggtttagttaatctcttctctatataaatattcatacaccagctttcaaaaatatataatccaaacaccaaaaacaaa

SEQ ID NO: 53 - DNA, 1001 bp, Arabidopsis thaliana
  misc_feature (1)..(1001): Ceres Promoter YP0137
gtggcacatgctgaaaccccgagcatctctccggaagacacgcgtcgttcgctccaaagaaaacagtcacagctgccggagaatctccgccgtcttcttctgccaccggaaaaactctctccaccactttcagtgcccacctcgtgttatatccactgtatcctcgtagcaccatatcagcctaataaaattttatgtatcaaattttaagacatagccgaaactacactatactagacaataataatatgatttgtttcctgaaaaattatggtttcatgagaaacattaatcatctataaaacaaattagctatggcatcgaagagttatcaatcaaaactgatgaatctttacttaatatatacaacatatctttaccttgcggcggagaagatcggcgagagaagcaccccagccaccgtcactaaaggattcttcagtgatggaatcaccaaagagaaaaaccttccgtctcatcatcttccacacaatcttcttgagaaaatctgagagataagaaaggtgtagtggttttgctgaagtgatcgtgtttgatttagtaaagaaatgctttatttattgttgggggaaacataaataaataaagtaaaagtggatgcactaaatgctttcacccactaatcaccgacctttcatggtttattgtgaaatacactcatagatagacatacaataccttatgtacgtaaataacattttatttgtcgacacttatgtaagtaacgcatagattattttctatgtgattgccactctcagactctcagtttcaaccaataataacaataactacaacaacattaatcataaacatatgctctggtttacaattaaagcttagattaagaaactgtaacaacgttacagaaaaaaaatgttatttacgttttgtaagattagtctctagaatcatcaccgttttttatatattaatgattctttcttatatataaaacctttctcgaaatacccatgaaa

SEQ ID NO: 54 - DNA, 1001 bp, Arabidopsis thaliana
  misc_feature (1)..(1001): Ceres Promoter YP0143
atacaacagatggcagatatcgagttaaatacgtgaatcagccgttacgatattttaaaactagaaaattatttaaaaatattgcaaaataccatttaatttcattgttcataaaaaaaagaaattcaaaaacttaaaaactgattcaaaaatttggattaattctcattaacagtcttcaacactacaacaacatgtttctaatttattttatattttaataattaaacaatatatacgtctgcacattgttgctccgacataatctagtataaaaatagttgcagcatatgtgaaaagcaagcagcatttatcactcaatacttttaattttatctgttgtatgtattaaggttttgtagctttaagaaaacgcttataatataaaataacttctaaaagatatttcatgcgtatacaataaatatttgtgaaaaaacatttcgaaaacgtgtacaatatataaactattgtgttatcttttgacattcaaacaaatgttgacaatgtaattttatccatgatatgattggccaattagctgcgaggtaaaaatccgtatacgagtaaaagtaagataaaatttcgcaagaagatttttagcaggaaatctaagacaagtgtcatgaacgtgtcaatcaacaaacgaaaaggagaattatagaatccagattcgacgtaccacattaataaatatcaaaacattttatgttattttatttttgctctggcagttacactctttttcattgctccaataaaaaaatcactcgcatgcatgcatatatatacaccatagtaaactccgcctcttcttcattttaaaagtatcagtttacactgacacaatccttaactattttcctttgttcttcttcatctttattacacatttttttcaaggtaacaaataatctttttaagtcacttttatactctttaaatcttagattgatatatgaatgcatgttaatatttcaagatttataggtctaccaaac

SEQ ID NO: 55 - DNA, 1003 bp, Arabidopsis thaliana
  misc_feature (1)..(1003): Ceres Promoter YP0144
aaacgttgcaagattattgattgtgagaaagagtgctcaaggtagtactgatttctgtaaagctcacggtggtgggaaacgatgttcttggggagatgggaaatgtgagaaaatttgctagaggaaagaagcggtttatgcgctgcgcataacactattatgtctcgggagaacaaagatggaagcaagagcggtttgattggaccgggactctttagtggccttgtttttggctctacttctgatcattctcagtctggagctagcgctgtctctgattgtactgattctgttgaacgaatacagtttgagaataggcagaagaacaagaagatgatgataccgatgcaggttctagtaccttcatcaatgaaatctccaagtaattcacatgaaggagaaacaaacatctatgacttcatggttccggaggagagagttcacggcggtgggctagtaatgtctttacttggtggctccattgatcgaaactgaaagccatttatggtaaaagtgtcacattctcagcaaaaacctgtgtaaagctgtaaaatgtgtgggaatctccgaatctgtttgtagccggttacgttatgctggatcaaaaactcaagatttgttggatattgttatgctggatcggtggtgaaaccacttcccggttgctaaataaataaacgtttttgttttataatctttttcactaaacggcagtatgggcctttagtgggcttcctttaagcgaccaatacaatcgtcgcaccggaatctactaccatttataggtttattcatgtaaaacctcggaaaatttgagagccacaacggtcaagagacaaaaacaacttgaagataaagggataaggaaggcttcctacatgatggacaacatttctttccacacaaattctcataataaaaatcttataatacaaatacttacgtcataatcattcaatctagtccccatgttttaaggtcctgtttcttgtctgatacaaat

SEQ ID NO: 56 - DNA, 1004 bp, Arabidopsis thaliana
  misc_feature (1)..(1004): Ceres Promoter YP0156
ttggtttgcattgtgaagatttgtattaactatagaacattgaattgatggtgttaagttcttacacaagcgtgcttctcggtttgaactgtttcttttgtatgttgaatcagagcttagtttataggaaccagagtatctacttagtcattctctgatgctaagtgctaaggttctacctagttgccctctaggcccttatgttattgataacttatgaagctatttgaacacttgattcttaggagacctaagttggtacagccagatagagtgtatgttcttgttctctatgtgacaggatcaagctgccacacatagttcaagggtatgctctgtgtgggtttgctcagattgaggacaaatctatacaaggaagtagagtctttgacattttgatgttgtatgataagaagaagaaaggagagtaataaagaaagagaaaagggaaacagaaacacgtgggagaacatcccaaagaggaagcacacgcggatcttcatgcaaagctccccgattctcccatgtggtccctttctccctttgtccccctcctctttcttcttttctcattttactcctttttttaccattatacaacgaatcttttttatcataattttttggttttggtttattttccaataacactttcttggttacttcccattctcactttttcatataagaaactcactttgggaaacttatgtttgagaatgacaagtctttttagagaaagtgatgtaacaaatctaaagtgattatataataaccttgcacaatgtttttgattttttgtaagattcgaatattaggtttattattcgtagggaataaacttactttcaaaagcgttcataagttaatactttcatatatgatcataagtacggacactattgttttttgtttgtttgtgtttattctaaaagaaagtagcttttaattgaaatgtcctcggaggcacagtttaaagttcgagtgtaacagtttctaaggca

SEQ ID NO: 57 - DNA, 1000 bp, Arabidopsis thaliana
  misc_feature (1)..(1000): Ceres Promoter YP0158
ttattagattaatagattgcattgcattgcttgtgctttcaatttacaaattgtctcccaactccatcgacacatctctttttgtgtatataagattcagacttgttatattttttttataaatatgttattagcatcttaagttaaattgattttttatatctgcattaaggattacacgactatatttgcgattgtgtgttggttaaaatataatttaggattgtctttaactacatttaggattatatgactatatttggttaaatataaaatctagctgtgattattagtattcaaaaataagtagcctaaccaattaaaacaacggctattggggcaaattagaacattttagtgtgtccaaaatataatggtcattaggtcatattcctcctagcttcatcgcagcataattgaatgattgccttatttagaagagcttttccactttcccaaaatctaggtgggatctttttgttttgaccttcatttttcttgtttaccatttttagctaaattatttacgattacaaaagatatcaaaagttggatcataatacaatttatagacttactgtagaaaattcgtatgtacaagtacaacaaattcttcataataaattttgaaaattctattacaaatgttgtaagaaatagaatttgaaatatatataaactaaggagaaaaaaaaagagaacatgcattgctctagtcagagtggaccaacatcaacgagataagataacataaaaaccaactcaccataactaaaaacatcccaagagatccaacgattcatatcaaacacaaaaacatcgaacgatcagatttaaaccatctctggtatctccaaaacacaaacacttttttttttcttttgtctgaatggaacaaaagcatgcgacatctctgtgtctttatcttctctctcctcttcttgaaaaactgaacctttaattctttcttcacatctcctttagctttctgaagctgcta

SEQ ID NO: 58 - DNA, 1005 bp, Arabidopsis thaliana
  misc_feature (1)..(1005): Ceres Promoter YP0188
gattggtatgaaatttcggagaccaacaaaaaaaactttattgagcttggagtgaagctatatatatggggcaagatcataatatgtttatatcggccttttcgttaactgaaaataatagttttgagaaatatatcaaatggtaaacagacatcatctttgaaaaataccatcaatgaagttaatattgttattggcatatggtttacccatcttaattttaatgcaaccaaacaaacaagaaacaaaaactgtataagatacaaggtgttttacgattttccgtcttaaaaccgaaatatttttgttcctacgactttaaacggactttgcttaagttgtgtgcatgtaagctcgtcgtccctcgattgtcatcaacattcaccaatatcagcctctatcacacgagtgaaggtggtgattcggcttaatgaaaacagagaaatatttcaatatgattcctattaaattttaaatcttttttctcaatctctagattttcattaaaagcatcatgatttttttccactatgttcatatatctctatcacagttttaggtacattgtagaaattggataagatacgtcatacgtctaacatgaatttggtctagcaaggaaggtttgagataataagtgaaaagaaaacacaagataataaattataatttataaatgctttatagtattgaaaaataagatgattttttttttttttaataccggattggctgatccacttatgatgactcaaatgttattaagtttcaagacaatttatgatgacacaaatcacaatgagtcaatagtagccacgaagccagaaaaaaaaaatgtactacaaaaagataatgatagtacaaaatgatacgtcgtactgccacatgtacgacacaactcgattaccaaaaagcagagccatccaaccataaaactcaaaacacacagattccactggcgtgtgctctcctcacttcactcgtccttgaaacttgaggtactga

SEQ ID NO: 59 - DNA, 1002 bp, Arabidopsis thaliana
  misc_feature (1)..(1002): Ceres Promoter YP0190
taaatagtgacattggtaagaagaaaaaaaacactattaaatagtgaaaaaatggtttataactctcttaattaacattacttattattgctagcacctaaaatctcccacaaaatatttgttgtaaaacacaaatttacaaaatgattttgtttttaaattagtaacacatgttcatatatacgttaataagaacataccctatatgattttatataaaaaaatttctttgagacgtcttattcttttttctttaataatatgcaattgtgagagtttggatttgaatggtagcattagaagcaaacttgaaccaaacatatttcatgaagtcaaacttgaaccaatgtgatcactaatcacagtgttcgcagtgtaaggcatcagaaaatagaagaagggacatagctatgaatcatataatcttgacacatgttttataggttttaggtgtgtatgctaacaaaaaatgagacagctttcttctaatagacttaatatttgggctaaatgtaccacagttgtgaatttcttacaaaaatgggccgagctacaaaaaactacaggcccactctcaactcttatcaaacgacagcgttttacttttttaaaagcacacactttttgtttggtgtcggtgacggtgagtttcgtccgctcttcctttaaattgaagcaacggttttgatccgatcaaatccaacggtgctgattacacaaagcccgagacgaaaacgttgactattaagttaggttttaatctcagccgttaatctacaaatcaacggttccctgtaaaacgaatcttccttccttcttcacttccgcgtcttctctctcaatcacctcaaaaaaatcgatttcatcaaaatattcacccgcccgaatttgactctccgatcatcgtctccgaatctagatcgacgagatcaaaaccctagaaatctaaatcggaatgagaaattgattttgatacgaattagggatctgtgtgttgaggac

SEQ ID NO: 60 - DNA, 995 bp, Arabidopsis thaliana
  misc_feature (1)..(995): Ceres Promoter YP0212
agtcgattggtacactcttaatttaattagagtaagagatcaacaaaaatatagaattttctttatatcgaagtgctacgaccttatatatatagaaaaaaaagcataggtgaatctctaaattgagattgtgctgtagtaaacatattaagtttttagtttttttaagaaatgaatctttttgttgattaattcaaactagtagtcattaagattccggagattccaatttagaaaagtcaaagattcaaagaacaagtccaggtccacatgttgaatccgattcatcatccactcatccttcatatcttcctccaccgtctccgcccaaaaaatcaataacaataaaaaatcctaaaaaaacatatttgattttgaaaaaactttatcatatattatattaattaaatagttatccgatgactcatcctatggtcagggccttgctgtctctgacgtccttaattatcattatttttaaatttgtctctctcagaaaattacgccacaatcttcctctttcccttttccgaaaacagctaatatttgtggacctaaactaaataacgtagcctctagattttatataattactaatactatatgctactacttgttattatttactccaatcatatatgataccaatcaagaatcactacataagtagaaaactttgcaatgagtccattaattaaaattaagaataaacttaaaattttatggtattttaagattccctttggattgtaatgacaagaaatcagcaaattagtcgtaactcgtaagaataaacaagatcaatttttactttctttacaaagattccgttgtaattttagaaatttttttttgtcactgtttttttatagattaatttatctgcatcaatccgattaagaagtgtacacatgggcatctatatatatctaacaggtaaaacgtgtatgtacatgcataaggttttacgtgcttctataaatatatgtggcagt

SEQ ID NO: 61 - DNA, 1024 bp, Arabidopsis thaliana
  misc_feature (1)..(1024): Ceres Promoter YP0214
ccagtcgattggcgcctcgcatgcctatcatatttaaccgtcaataatggatttggcggttttggtaggccgggtcaaccggattaaaagaaaacggtttggagtccttccttgcaattgaattttcacacattcgggttttgtgatttctctgtcataatgggcccggcacatatggttcataacccatgtgggcctatggtataatttttccaattaaaactattgttaggtcgataaaacaaaaaacaataaaaacgagtggaatacacataccaaaaagaatgtgatgaacattagtaattttattttgatggttaatgaaaaacaaaataaatgcatcttggcatcttccgttggaaagcgcaaatagggcagattttcagacagatatcactatgatggggggtgagagaaagaaaacgaggcgtacctaatgtaacactacttaattagtcgttagttataggactttttttttgtttgggcctagttataggatcataaggtaaaaatgaagaatgaatattagattagtaggagctaatgatggagttaagtatgcacgtgtaagaactgggaagtgaaacctcctgtatggtgaagaaactatacaacaaagccctttgttggtgtatacgtattaatttttattcttttatcacaagcgatacgtatcttaagacataataaatatatatcttactcataataaatatcttaagatatatatacagtatacacctgtatatatataataaataggcatatagtagaaattaatatgagttgttgttgttgcaaatatataaatcaatcaaaagatttaaaacccaccattcaatcttggtaagtaacgaaaaaaaagggaagcaagaagaaccacagaaaagggggctaacaactagacacgtagatcttcatctgcccgtccatctaacctaccacactctcatcttctttttcccgtgtcagtttgttatataagctctcactctccggtatatttccccattgcactgga

SEQ ID NO: 62 - DNA, 911 bp, Arabidopsis thaliana
  misc_feature (1)..(911): Ceres Promoter YP0263
atctagctgtggattccaccaaaattctggcagggccatgatctaaaaactgagactgcgcgtgttgttttgcagtgatttgtatttcatatttgcaccatcctacacagtccacttggtatcgtaaccaaacataaggagaacctaattacattattgttttaatttcgtcaaactggtttttaccttttagttacatagttgattcttcatttgttttagtagttatggagcacaataatgtgcaacaaagaaagatcatagtggattaatatgttgagaggtcagaaattcttggttaacaaaaaaaagttacaaggactgagattttgggtgggagaaagccatagcttttaaaacatgattgaacttaaaagtgatgttatggtttgaggggaaaaaggttgatgtcaactaagatagttgaagtaatgtcttaaactaaagtaaaccaccggtccaaccgtggtccggaagcatctctggtatgatttatcctaaaaatcaaaatagtagaaacatactttaaatatatacattgatcggacgaaaattgtaaactagtatagtttcaaaaactagttgaacaggttatgtaccttaaacatttatttcaaacttaaacactaaagaacatatatgaatagaagtttatataaattactatatatctaccataaatctcttataattatgatgtcacgatgaggaagtgttgaaacgttaaaatgccaaaatataagcatgcgacggaattttggcagaagattgtagagttgtaatctgtcgcaatcattactcgtgctagcatttttcattttcccttcatttgtggataacgcacgatataacattctacacaccaacaagattctataaaaacgcaaaggttgtctccatagaatatcgtc

SEQ ID NO: 63 - DNA, 999 bp, Arabidopsis thaliana
  misc_feature (1)..(999): Ceres Promoter YP0275
aaacattaatatgtagtaactatgggcgtatgctttactttttaaaatgggcctatgctataattgaatgacaaggattaaacaactaataaaattgtagatgggttaagatgacttatttttttacttaccaatttataaatgggcttcgatgtactgaaatatatcgcgcctattaacgaggccattcaacgaatgttttaagggccctatttcgacattttaaagaacacctaggtcatcattccagaaatggatattataggatttagataatttcccacgtttggtttatttatctattttttgacgttgaccaacataatcgtgcccaaccgtttcacgcaacgaatttatatacgaaatatatatatttttcaaattaagataccacaatcaaaacagctgttgattaacaaagagattttttttttttggttttgagttacaataacgttagaggataaggtttcttgcaacgattaggaaatcgtataaaataaaatatgttataattaagtgttttattttataatgagtattaatataaataaaacctgcaaaaggatagggatattgaataataaagagaaacgaaagagcaattttacttctttataattgaaattatgtgaatgttatgtttacaatgaatgattcatcgttctatatattgaagtaaagaatgagtttattgtgcttgcataatgacgttaacttcacatatacacttattacataacatttatcacatgtgcgtctttttttttttttactttgtaaaatttcctcacttttaagacttttataacaattactagtaaaataaagttgcttggggctacaccctttctccctccaacaactctatttatagataacattatatcaaaatcaaaacatagtccctttcttctataaaggttttttcacaaccaaatttccattataaatcaaaaaataaaaacttaattagtttttacagaagaaaagaaaaca

SEQ ID NO: 64 - DNA, 981 bp, Arabidopsis thaliana
  misc_feature (1)..(981): Ceres Promoter YP0285
gggattatatatgatagacgattgtatttgcgggacattgagatgtttccgaaaatagtcatcaaatatcaaaccagaatttgatgtgaaaacactaattaaaacatataattgacaactagactatatcatttgttaagttgagcgttgaaagaaaatgaaagagtgtagactgtagtacgtatgagtttcccaaaagatggtgcttgaatattattgggaagagactttggttggttcggttgaatgaagatttttacctgccatgttgatagagaaaggcaaataaatgtaggggtcgatgtctaacgtaaagactggatcaaccaagagtcctcctcctcgtcttcaccaaaaaaaaagagtcctcctcgtggaaacttatttcttctccagccaagatctcatctcatctcttcactctatgaaatataaaggaatcttatggtttttctaaaaactatagtacgtctatataccaaaggaaacaatataaaatcagttaatctgataaattttgagtaaataataaagttaactttgtacttacctatatcaaactaattcacaaaataaagtaataataacaaagaatttttagtagatccacaatatacacacacactatgagaaatcataatagagaattttaatgattttgtctaactcatagcaacaagtcgctttggccgagtggttaaggcgtgtgcctgctaagtacatgggctctgcccgcgagagttcgaatctctcaggcgacgtttcttttgttttcggccataaaggaaaaagcccaattaacacgtctcgcttataagcccataaagcaaacaatgggctgtctctgtctcactcacacacgcgttttcctactttttgactatttttataaccggcgggtctgacttaattagggttttctttaataatcagacactctctcactcgtttcgtcaacattgaacacagacaaaaccgcgt

SEQ ID NO: 65 - DNA, 996 bp, Arabidopsis thaliana
  misc_feature (1)..(996): Ceres Promoter YP0286
gaaaacaatcataggttacgctattatcatcgaaaggtatgtgatgcatattcccattgaaccagatttccatatattttatttgtaaagtgataatgaatcacaagatgattcaatattaaaaatgggtaactcactttgacgtgtagtacgtggaagaatagttagctatcacgcatacatatatctatgaataagtgtgtatgacataagaaactaaaatatttacctaaagtccagttactcatactgatttcatgcatatatgtattatttatttatttttaataaagaagcgattggtgttttcatagaaatcatgatagattgataggtatttcagttccacaaatctagatctgtgtgctatacatgcatgtattaattttttccccttaaatcatttcagttgataatattgctctttgttccaactttagaaaaggtatgaaccaacctgacgattaacaagtaaacattaattaatctttatatgagataaaaccgaggatatatatgattgtgttgctgtctattgatgatgtgtcgatattatgcttgttgtaccaatgctcgagccgagcgtgatcgatgccttgacaaactatatatgtttcccgaattaattaagttttgtatcttaattagaataacatttttatacaatgtaatttctcaagcagacaagatatgtatcctatattaattactatatatgaattgccgggcacctaccaggatgtttcaaatacgagagcccattagtttccacgtaaatcacaatgacgcgacaaaatctagaatcgtgtcaaaactctatcaatacaataatatatatttcaagggcaatttcgacttctcctcaactcaatgattcaacgccatgaatctctatataaaggctacaacaccacaaaggatcatcagtcatcacaaccacattaactcttcaccactatctctcaatctctcgtttcatttcttgacgcgtgaaaa

SEQ ID NO: 66 - DNA, 1000 bp, Arabidopsis thaliana
  misc_feature (1)..(1000): Ceres Promoter YP0337
taatttttttatttttggaactaacacttattagtttaggtttccatcacctatttaattcgtaattcttatacatgcatataatagagatacatatatacaaatttatgatcatttttgcacaacatgtgatctcattcattagtatgcattatgcgaaaacctcgacgcgcaaaagacacgtaatagctaataatgttactcatttataatgattgaagcaagacgaaaacaacaacatatatatcaaattgtaaactagatatttcttaaaagtgaaaaaaaacaaagaaatataaaggacaattttgagtcagtctcttaatattaaaacatatatacataaataagcacaaacgtggttacctgtcttcatgcaatgtggactttagtttatctaatcaaaatcaaaataaaaggtgtaatagttctcgtcatttttcaaattttaaaaatcagaaccaagtgatttttgtttgagtattgatccattgtttaaacaatttaacacagtatatacgtctcttgagatgttgacatgatgataaaatacgagatcgtctcttggttttcgaattttgaactttaatagttttcttttttagggaaactttaatagttgtttatcataagattagtcacctaatggttacgttgcagtaccgaaccaattttttacccttttttctaaatgtggtcgtggcataatttccaaaagagatccaaaacccggtttgctcaactgataagccggtcggttctggtttgaaaaacaagaaataatctgaaagtgtgaaacagcaacgtgtctcggtgtttcatgagccacctgccacctcattcacgtcggtcattttgtcgtttcacggttcacgctctagacacgtgctctgtccccaccatgactttcgctgccgactcgcttcgctttgcaaactcaaacatgtgtgtatatgtaagtttcatcctaataagcatctcttaccacattaattaaaaa

SEQ ID NO: 67 - DNA, 1000 bp, Arabidopsis thaliana
  misc_feature (1)..(1000): Ceres Promoter YP0356
ttagttcattgaaacgtcaactttttacttgcaaccactttgtaggaccattaactgcaaaataagaattctctaagcttcacaaggggttcgtttggtgctataaaaacattgttttaagaactggtttactggttctataaatctataaatccaaatatgaagtatggcaataataataacatgttagcacaaaaaatactcattaaattcctacccaaaaaaaatctttatatgaaactaaaacttatatacacaataatagtgatacaaagtaggtcttgatattcaactattcgggattttctggtttcgagtaattcgtataaaaggtttaagatctattatgttcactgaaatcttaactttgttttgtttccagttttaactagtagaaattgaaatttttaaaaattgttacttacaataaaatttgaatcaatatccttaatcaaaggatcttaagactagcacaattaaaacatataacgtagaatatctgaaataactcgaaaatatctgaactaagttagtagttttaaaatataatcccggtttggaccgggcagtatgtacttcaatacttgtgggttttgacgattttggatcggattgggcgggccagccagattgatctattacaaatttcacctgtcaacgctaactccgaacttaatcaaagattttgagctaaggaaaactaatcagtgatcacccaaagaaaacattcgtgaataattgtttgctttccatggcagcaaaacaaataggacccaaataggaatgtcaaaaaaaagaaagacacgaaacgaagtagtataacgtaacacacaaaaataaactagagatattaaaaacacatgtccacacatggatacaagagcatttaaggagcagaaggcacgtagtggttagaaggtatgtgatataattaatcggcccaaatagattggtaagtagtagccgtctatatcatccatactcatcataacttcaacct

SEQ ID NO: 68 - DNA, 1000 bp, Arabidopsis thaliana
  misc_feature (1)..(1000): Ceres Promoter YP0374
aagacacccgtaaatgttgtcatgtagaagaaactagaaacgttaaacgcatcaaatcaagaaattaaattgaaggtaatttttaacgccgcctttcaaatattcttcctaggagaggctacaagacgcgtatttctttcgaattctccaaaccattaccattttgatatataataccgacatgccgttgataaagtttgtatgcaaatcgttcattgggtatgagcaaatgccatccattggttcttgtaattaaatggtccaaaaatagtttgttcccactactagttactaatttgtatcactctgcaaaataatcatgatataaacgtatgtgctatttctaattaaaactcaaaagtaatcaatgtacaatgcagagatgaccataaaagaacattaaaacactacttccactaaatctatggggtgccttggcaaggcaattgaataaggagaatgcatcaagatgatatagaaaatgctattcagtttataacattaatgttttggcggaaaattttctatatattagacctttctgtaaaaaaaaaaaaatgatgtagaaaatgctattatgtttcaaaaatttcgcactagtataatacggaacattgtagtttacactgctcattaccatgaaaaccaaggcagtatataccaacattaataaactaaatcgcgatttctagcacccccattaattaattttactattatacattctctttgcttctcgaaataataaacttctctatatcattctacataataaataagaaagaaatcgacaagatctaaatttagatctattcagctttttcgcctgagaagccaaaattgtgaatagaagaaagcagtcgtcatcttcccacgtttggacgaaataaaacataacaataataaaataataaatcaaatatataaatccctaatttgtctttattactccacaattttctatgtgtatatatatacccacctctctcttgtgtatttg

SEQ ID NO: 69 - DNA, 998 bp, Arabidopsis thaliana
  misc_feature (1)..(998): Ceres Promoter YP0377
tataaaccattcctataacaccatatttaaacataacaatgaattgcttggatttcaaactttattaaatttggattttaaattttaatttgattgaattatacccccttaattggataaattcaaatatgtcaactttttttttgtaagatttttttatggaaaaaaaaattgattattcactaaaaagatgacaggttacttataatttaatatatgtaaaccctaaaaagaagaaaatagtttctgttttcactttaggtcttattatctaaacttctttaagaaaatcgcaataaattggtttgagttctaactttaaacacattaatatttgtgtgctatttaaaaaataatttacaaaaaaaaaaacaaattgacagaaaatatcaggttttgtaataagatatttcctgataaatatttagggaatataacatatcaaaagattcaaattctgaaaatcaagaatggtagacatgtgaaagttgtcatcaatatggtccacttttctttgctctataacccaaaattgaccctgacagtcaacttgtacacgcggccaaacctttttataatcatgctatttatttccttcatttttattctatttgctatctaactgatttttcattaacatgataccagaaatgaatttagatggattaattcttttccatccacgacatctggaaacacttatctcctaattaaccttactttttttttagtttgtgtgctccttcataaaatctatattgtttaaaacaaaggtcaataaatataaatatggataagtataataaatctttattggatatttctttttttaaaaaagaaataaatcttttttggatattttcgtggcagcatcataatgagagactacgtcgaaaccgctggcaaccacttttgccgcgtttaatttctttctgaggcttatataaatagatcaaaggggaaagtgagatataatacagacaaaacaagagaaaaga

SEQ ID NO: 70 - DNA, 999 bp, Arabidopsis thaliana
  misc_feature (1)..(999): Ceres Promoter YP0380
acaagtaccattcacttttttacttttcaatgtatacaatcatcatgtgataaaaaaaaaaatgtaaccaatcaacacactgagatacggccaaaaaatggtaatacataaatgtttgtaggttttgtaatttaaatactttagttaagttatgattttattatttttgcttatcacttatacgaaatcatcaatctattggtatctcttaatcccgctttttaatttccaccgcacacgcaaatcagcaaatggttccagccacgtgcatgtgaccacatattgtggtcacagtactcgtcctttttttttcttttgtaatcaataaatttcaatcctaaaacttcacacattgagcacgtcggcaacgttagctcctaaatcataacgagcaaaaaagttcaaattagggtatatgatcaattgatcatcactacatgtctacataattaatatgtattcaaccggtcggtttgttgatactcatagttaagtatatatgtgctaattagaattaggatgaatcagttcttgcaaacaactacggtttcatataatatgggagtgttatgtacaaaatgaaagaggatggatcattctgagatgttatgggctcccagtcaatcatgttttgctcgcatatgctatcttttgagtctcttcctaaactcatagaataagcacgttggttttttccaccgtcctcctcgtgaacaaaagtacaattacattttagcaaattgaaaataaccacgtggatggaccatattatatgtgatcatattgcttgtcgtcttcgttttcttttaaatgtttacaccactacttcctgacacgtgtccctattcacatcatccttgttatatcgttttacttataaaggatcacgaacaccaaaacatcaatgtgtacgtcttttgcataagaagaaacagagagcattatcaattattaacaattacacaagacagcgagattgtaaaagagtaagagagagag

SEQ ID NO: 71 - DNA, 1000 bp, Arabidopsis thaliana
  misc_feature (1)..(1000): Ceres Promoter YP0381
cacggtcaaagtattgctaacatggtcattacattgaaaaagaaaattaattgtctttactcatgtttattctatacaaataaaaatattaaccaaccatcgcactaacaaaatagaaatcttattctaatcacttaattgttgacaattaaatcattgaaaaatacacttaaatgtcaaatattcgttttgcatacttttcaatttaaatacatttaaagttcgacaagttgcgtttactatcatagaaaactaaatctcctaccaaagcgaaatgaaactactaaagcgacaggcaggttacataacctaacaaatctccacgtgtcaattaccaagagaaaaaaagagaagataagcggaacacgtggtagcacaaaaaagataatgtgatttaaattaaaaaacaaaaacaaagacacgtgacgacctgacgctgcaacatcccaccttacaacgtaataaccactgaacataagacacgtgtacgatcttgtctttgttttctcgatgaaaaccacgtgggtgctcaaagtccttgggtcagagtcttccatgattccacgtgtcgttaatgcaccaaacaagggtactttcggtattttggcttccgcaaattagacaaaacagctttttgtttgattgatttttctcttctctttttccatctaaattctctttgggctcttaatttctttttgagtgttcgttcgagatttgtcggagattttttcggtaaatgttgaaattttgtgggatttttttttatttctttattaaacttttttttattgaatttataaaaagggaaggtcgtcattaatcgaagaaatggaatcttccaaaatttgatattttgctgttttcttgggatttgaattgctctttatcatcaagaatctgttaaaatttctaatctaaaatctaagttgagaaaaagagagatctctaatttaaccggaattaatattctccgaccgaagttattatgttgcaggct

SEQ ID NO: 72 - DNA, 999 bp, Arabidopsis thaliana
  misc_feature (1)..(999): Ceres Promoter YP0384
tttaaaaaattggataaaacaccgataaaaattcacatttgcaaattttattcagtcggaatatatatttgaaacaagttttgaaatccattggacgattaaaattcattgttgagaggataaatatggatttgttcatctgaaccatgtcgttgattagtgattgactaccatgaaaaatatgttatgaaaagtataacaacttttgataaatcacatttattaacaataaatcaagacaaaatatgtcaacaataatagtagtagaagatattaattcaaattcatccgtaacaacaaaaaatcataccacaattaagtgtacagaaaaaccttttggatatatttattgtcgcttttcaatgattttcgtgaaaaggatatatttgtgtaaaataagaaggatcttgacgggtgtaaaaacatgcacaattcttaatttagaccaatcagaagacaacacgaacacttctttattataagctattaaacaaaatcttgcctattttgcttagaataatatgaagagtgactcatcagggagtggaaaatatctcaggatttgcttttagctctaacatgtcaaactatctagatgccaacaacacaaagtgcaaattcttttaatatgaaaacaacaataatatttctaatagaaaattaaaaagggaaataaaatatttttttaaaatatacaaaagaagaaggaatccatcatcaaagttttataaaattgtaatataatacaaacttgtttgcttccttgtctctccctctgtctctctcatctctcctatcttctccatatatacttcatcttcacacccaaaactccacacaaaatatctctccctctatctgcaaattttccaaagttgcatcctttcaatttccactcctctctaatataattcacattttcccactattgctgattcatttttttttgtgaattatttcaaacccacataaaaaaatctttgtttaaatttaaaacca

SEQ ID NO: 73 - DNA, 998 bp, Arabidopsis thaliana
  misc_feature (1)..(998): Ceres Promoter YP0385
actcaacaataggacaagccaaaaaaattccaattattgtgttactctattcttctaaatttgaacactaatagactatgacatatgagtatataatgtgaagtcttaagatattttcatgtgggagatgaataggccaagttggagtctgcaaacaagaagctcttgagccacgacataagccaagttgatgaccgtaattaatgaaactaaatgtgtgtggttatatattagggacccatggccatatacacaatttttgtttctgtcgatagcatgcgtttatatatatttctaaaaaaactaacatatttactggatttgagttcgaatattgacactaatataaactacgtaccaaactacatatgtttatctatatttgattgatcgaagaattctgaactgttttagaaaatttcaatacacttaacttcatcttacaacggtaaaagaaatcaccactagacaaacaatgcctcataatgtctcgaaccctcaaactcaagagtatacattttactagattagagaatttgatatcctcaagttgccaaagaattggaagcttttgttaccaaacttagaaacagaagaagccacaaaaaaagacaaagggagttaaagattgaagtgatgcatttgtctaagtgtgaaaggtctcaagtctcaactttgaaccataataacattactcacactccctttttttttctttttttttcccaaagtaccctttttaattccctctataacccactcactccattccctctttctgtcactgattcaacacgtggccacactgatgggatccacctttcctcttacccacctcccggtttatataaacccttcacaacacttcatcgctctcaaaccaactctctcttctctcttctctcctctcttctacaagaagaaaaaaaacagagcctttacacatctcaaaatcgaacttactttaaccaccaaatactgattgaacacacttgaaa

SEQ ID NO: 74 - DNA, 1000 bp, Arabidopsis thaliana
  misc_feature (1)..(1000): Ceres Promoter YP0396
catagtaaaagtgaatttaatcatactaagtaaaataagataaaacatgttatttgaatttgaatatcgtgggatgcgtatttcggtatttgattaaaggtctggaaaccggagctcctataacccgaataaaaatgcataacatgttcttccccaacgaggcgagcgggtcagggcactagggtcattgcaggcagctcataaagtcatgatcatctaggagatcaaattgtatgtcggccttctcaaaattacctctaagaatctcaaacccaatcatagaacctctaaaaagacaaagtcgtcgctttagaatgggttcggtttttggaaccatatttcacgtcaatttaatgtttagtataatttctgaacaacagaattttggatttatttgcacgtatacaaatatctaattaataaggacgactcgtgactatccttacattaagtttcactgtcgaaataacatagtacaatacttgtcgttaatttccacgtctcaagtctataccgtcatttacggagaaagaacatctctgtttttcatccaaactactattctcactttgtctatatatttaaaattaagtaaaaaagactcaatagtccaataaaatgatgaccaaatgagaagatggttttgtgccagattttaggaaaagtgagtcaaggtttcacatctcaaatttgactgcataatcttcgccattaacaacggcattatatatgtcaagccaattttccatgttgcgtacttttctattgaggtgaaaatatgggtttgttgattaatcaaagagtttgcctaactaatataactacgactttttcagtgaccattccatgtaaactctgcttagtgtttcatttgtcaacaatattgtcgttactcattaaatcaaggaaaaatatacaattgtataattttcttatattttaaaattaattttgatgtattacccctttataaataggctatcgctacaacaccaataac

SEQ ID NO: 75 - DNA, 1514 bp, Arabidopsis thaliana
  misc_feature (1)..(1514): Ceres Promoter p13879
tttcgatcctcttcttttttaggtttcttgatttgatgatcgccgccagtagagccgtcgtcggaagtttcagagattaaaaccatcaccgtgtgagttggtagcgaattaacggaaagtctaagtcaagattttttaaaaagaaatttatgtgtgaaaagaagccgttgtgtatatttatataatttagaaaatgtttcatcattttaattaaaaaattaataatttgtagaagaaagaagcattttttatacataaatcatttaccttctttactgtgtttttcttcacttacttcatttttacttttttacaaaaaagtgaaaagtaaattacgtaattggtaacataaattcactttaaatttgcatatgttttgttttcttcggaaactatatcgaaaagcaaacggaaagaacttcacaaaaaaccctagctaactaaagacgcatgtgttcttcttattcttcatatatcctctgtttcttgtgttctgttttgagtcttacattttcaatatctgactctgattactatatctaaaagggaacatgaagaacttgagaccatgttaaactgtacaatgccttcaaacatggctaactaaagatacattagatggctttacagtgtgtaatgcttattatctttaggttttttaaatcccttgtattaagttatttaccaaattatgttcttgtactgcttattggcttggttgttgtgtgctttgtaaacaacacctttggctttatttcatcctttgtaaacctactggtctttgttcagctcctcttggaagtgagtttgtatgcctggaacgggttttaatggagtgtttatcgacaaaaaaaaaatgtagcttttgaaatcacagagagtagttttatattcaaattacatgcatgcaactaagtagcaacaaagttgatatggccgagttggtctaaggcgccagattaaggttctggtccgaaagggcgtgggttcaaatcccactgtcaacattctctttttctcaaattaatatttttctgcctcaatggttcaggcccaattatactagactactatcgcgactaaaatagggactagccgaattgatccggcccagtatcagttgtgtatcaccacgttatttcaaatttcaaactaagggataaagatgtcatttgacatatgagatatttttttgctccactgagatatttttctttgtcccaagataaaatatcttttctcgcatcgtcgtctttccatttgcgcattaaaccaaaaagtgtcacgtgatatgtccccaaccactacgaattttaactacagatttaaccatggttaaaccagaattcacgtaaaccgactctaaacctagaaaatatctaaaccttggttaatatctcagcccccttataaataacgagacttcgtctacatcgttctacacatctcactgctcactactctcactgtaatcccttagatcttcttttcaaatttcaccattgcactggatg

SEQ ID NO: 76 - DNA, 1954 bp, Arabidopsis thaliana
  misc_feature (1)..(1954): Ceres Promoter p326
gtgggtaaaagtatccttctttgtgcatttggtatttttaagcatgtaataagaaaaaccaaaatagacggctggtatttaataaaaggagactaatgtatgtatagtatatgatttgtgtggaatataataaagttgtaaaatatagatgtgaagcgagtatctatcttttgactttcaaaggtgatcgatcgtgttctttgtgatagttttggtcgtcggtctacaagtcaacaaccaccttgaagttttcgcgtctcggtttcctcttcgcatctggtatccaatagcatacatataccagtgcggaaaatggcgaagactagtgggcttgaaccataaggtttggccccaatacggattccaaacaacaagcctagcgcagtcttttgggatgcataagactaaactgtcgcagtgatagacgtaagatatatcgacttgattggaatcgtctaagctaataagtttaccttgaccgtttatagttgcgtcaacgtccttatggagattgatgcccatcaaataaacctgaaaatccatcaccatgaccaccataaactcccttgctgccgctgctttggcttgagcaaggtgtttccttgtaaagctccgatctttggataaagtgttccactttttgcaagtagctctgacccctctcagagatgtcaccggaatcttagacagaacctcctctgccaaatcacttggaagatcggacaatgtcatcatttttgcaggtaatttctccttcgttgctgctttggcttgagcacggtgcttctttgtaaagctccgatctttggataagagcggatcggaatcctctaggaggtgccagtcccttgacctattaatttatagaaggttttagtgtattttgttccaatttcttctctaacttaacaaataacaactgcctcatagtcatgggcttcaaattttatcgcttggtgtatttcgttatttgcaaggccttggcccattttgagcccaataactaaatctagccttttcagaccggacatgaacttcgcatattggcgtaactgtgcagttttacctttttcggatcagacaagatcagatttagaccacccaacaatagtcagtcatatttgacaacctaagctagccgacactactaaaaagcaaacaaaagaagaattctatgttgtcattttaccggtggcaagtggacccttctataaaagagtaaagagacagcctgtgtgtgtataatctctaattatgttcaccgacacaatcacacaaacccttctctaatcacacaacttcttcatgatttacgacattaattatcattaactctttaaattcactttacatgctcaaaaatatctaatttgcagcattaatttgagtaccgataactattattataatcgtcgtgattcgcaatcttcttcattagatgctgtcaagttgtactcgcacgcggtggtccagtgaagcaaatccaacggtttaaaaccttcttacatttctagatctaatctgaaccgtcagatatctagatctcattgtctgaacacagttagatgaaactgggaatgaatctggacgaaattacgatcttacaccaaccccctcgacgagctcgtatatataaagcttatacgctcctccttcaccttcgtactactactaccaccacatttctttagctcaaccttcattactaatctccttttaaggtatgttcacttttcttcgattcatactttctcaagattcctgcatttctgtagaatttgaaccaagtgtcgatttttgtttgagagaagtgttgatttatagatctggttattgaatctagattccaatttttaattgattcgagtttgttatgtgtgtttatactacttctcattgatcttgtttgatttctctgctctgtattaggtttctttcgtgaatcagatcggaa

SEQ ID NO: 77 - DNA, 2016 bp, Arabidopsis thaliana
  misc_feature (1)..(2016): Ceres Promoter p32449
gatcggccttcttcaggtcttctctgtagctctgttacttctatcacagttatcgggtatttgagaaaaaagagttagctaaaatgaatttctccatataatcatggtttactacaggtttacttgattcgcgttagctttatctgcatccaaagttttttccatgatgttatgtcatatgtgataccgttactatgtttataactttatacagtctggttcactggagtttctgtgattatgttgagtacatactcattcatcctttggtaactctcaagtttaggttgtttgaattgcctctgttgtgatacttattgtctattgcatcaatcttctaatgcaccaccctagactatttgaacaaagagctgtttcattcttaaacctctgtgtctccttgctaaatggtcatgctttaatgtcttcacctgtctttctcttctatagatatgtagtcttgctagatagttagttctacagctctcttttgtagtcttgttagagagttagttgagatattacctcttaaaagtatccttgaacgctttccggttatgaccaatttgttgtagctccttgtaagtagaacttactgggaccagcgagacagtttatgtgaatgttcatgcttaagtgtcgaacgtatctatctctactatagctctgtagtcttgttagacagttagttttatatctccatttttttgtagtcttgctagttgagatattacctcttctcttcaaagtatccttgaacgctcaccggttatgaaatctctacactatagctctgtagtcttgctagatagttagttctttagctctctttttgtagcctagttctttagctctccttttgtagccttgctacagagtaagatgggatattacctccttgaacgctctccggttatgaccaatttgttgtagctccttgtaagtagaacttaggatagagtgagtcaactttaagaaagaacctagtatgtggcataaccagattgcaggctctgtctcggctacagtaacgtaactctatagctctttgttttgttcagaaagaaccagtgattggatgattcgtccttagaaactggacctaacaacagtcattggctttgaaatcaagccacaacaatgcctatatgaaccgtccatttcatttatccgtttcaaaccagcccattacatttcgtcccattgataaccaaaagcggttcaatcagattatgttttaattttaccaaattctttatgaagtttaaattatactcacattaaaaggattattggataatgtaaaaattctgaacaattactgattttggaaaattaacaaatattctttgaaatagaagaaaaagcctttttccttttgacaacaacatataaaatcatactcccattaaaaagattttaatgtaaaattctgaatataagatattttttacaacaacaaccaaaaatatttatttttttccttttttacagcaacaagaaggaaaaacttttttttttgtcaagaaaaggggagattatgtaaacagataaaacagggaaaataactaaccgaactctcttaattaacatcttcaaataaggaaaattatgatccgcatatttaggaagatcaatgcattaaaacaacttgcacgtggaaagagagactatacgctccacacaagttgcactaatggtacctctcacaaaccaatcaaaatactgaataatgccaacgtgtacaaattagggttttacctcacaaccatcgaacattctcgaaacattttaaacagcctggcgccatagatctaaactctcatcgaccaatttttgaccgtccgatggaaactctagcctcaacccaaaactctatataaagaaatcttttccttcgttattgcttaccaaatacaaaccctagccgccttattcgtcttcttcgttctctagttttttcctcagtctctgttcttagatcccttgtagtttccaaatcttccgataaggcct

SEQ ID NO: 78 - DNA, 667 bp, Arabidopsis thaliana
  misc_feature (1)..(667): Ceres Promoter PD1367
acagttttcttttctcatcttacaacaagtttccaggaggatagagacataaacgaagctcggattgtatcgttctttttagcttttattcacatccgaaagtcctgtagtttagattctgttatcttgcggttttgagttaatcagaaacagagtaatcaatgtaatgttgcaggctagatctttcatctttggaaatttgtttttttctcatgcaatttctttagcttgaccatgagtgactaaaagatcaatcagtagcaatgatttgatttggctaagagacatttgtccacttggcatcttgatttggatggttacaacttgcaagacccaattggatacttgctatgacaactccaactcaagagtgtcgtgtaactaagaaccttgactaatttgtaatttcaatcccaagtcatgttactatatgtttttttgtttgtattattttctctcctacaattaagctctttgacgtacgtaatctccggaaccaactcctatatccaccatttactccacgttgtctccaattattggacgttgaaacttgacacaacgtaaacgtatctacgtggttgattgtatgtacatatgtacaaacgtacacctttctcctctttcacttcatcacttggcttgtgaattcattaattcctgcgaa

SEQ ID NO: 79 - DNA, 1836 bp, Oryza sativa
  misc_feature (1)..(1836): Ceres Promoter p530c10
gcctctcgaccacgagtttagcacttgtgcaacatatatgcgtgcgatgaacatctactgatgcgccatgcgaattttagcgttcgttcatgacgcttccaacggcacagaggctgagcagcagcatgcatgcatggctcttgtgaaaacaaaaaaggttactggtaaatgacatgctgctgtagctagctagcagaatgcaaggcccatgcatatgcaatgctatgcgacaagtacagtaccagcatgtatggtagccagctaactaatctatcagcagaggcagcaagctcgtgcatggtgtgatgcacttctctccagtaatctagtggtaattttcacccaaagcgttgctcatatggacagtaattagtaatattaccaaggttcacaatcccgttacctgaccaaatactactcacgaatggtatctctggttttcgttaaaaccgttggtaaaccagcaaaaatagacaaaatttgtcaaaattttaaattttagttttttttttttaacttagccgggaaaccttgaagtttgtgctgtcgagctgtcctgggaaggacggttttggttgggattgtgaaccctggttactgcacttcatttttgaacagatattagtgcaacagacaaatgccaacgcatttttttctgtttaccggcaagctgaagcttttacgatccccatacagccgttgctgcaaacctgccaagaaagagcagcagaaacaggtgtcattttgtggtggaaagccaagtaaagtaaacagaagatggaagatagtgaggaccagggagtgaggcaggggacacatggcccacgcctccctgcacattttcgtgtataaatacaggtggatgcatcgctctcccagcatccatcggttctctgctctgttcatccatagagtttcctcctcttctcctttagtgcaaggtagagaagagcatgtgtgtgtgtgtgtgtgtgtgaactgtgaagtgcagagtgcttctgtagttctgtgttatgtccatagtgatcttgttaggattgttgctatggatgcatgatgttatggttgatctctgaattacagtagggacttttctgagatctctggattagtggggggtgctaaatttttttctggttgcatcagcttgggtttctggtattggtgtgggttcttgctctgaattttggttcagaatgtcgatttgtttgtgtttgttctctgaagttgagagtagctatgatccatccagcacagaactgcaggtcctgcctgccggctgcatatacaggacatgccattttgcaagctctgggcttatggtttctcttttggagttcttcttcttgcatgatctgtgttctctaacaaaggaagcaagatttagcaactttattcagagacaagaaaaggatctggcaaccttttgtttctgttttatcctactcgtaaagattgttatttaagcaaaaatttcccaaaagttttaaatataatttccatgatgtgccactctcatgtccttgaacctggcactcattatgggctcctcagaagtgctgtagctaatgtcactaatcttttgtatctttgttcatagtcttgtattttatgatgcttatccctttgtgctttccatgtttgatgtccaaatgtcatggcaatgtttttgacttctagtaggggttttagtacctttttgttagataagtacatccaaattctgtttatttattcaaaaatcattctgtttattcactgaaaacatttgtccattcaatggactcataaactgtctgtgtttttcaggcttgaggatccatctagaagatagca

SEQ ID NO: 80 - DNA, 3000 bp, Oryza sativa
  misc_feature (1)..(3000): Ceres Promoter pOsFIE2-2
gcttaacacatgaactaccaaaatatactgatcactttgttctagtcatacataccttaagtcattttattctgcagtgtttggattggagggagcattctagcatcccttgggtcgttccagcaaatgtggttctccaaagcagagtaagcacaacacagtattttaggttatgtttcccctatctcgtcacggacagctcacaagttaatgtgatttatctcactatagatacgaagaacatggagtatcctacatccaaaggaagtgcccatgaagttgtggagcatcgctacgatttgtgaccaaatttgggtgcatgtgggcaatcgtattacagccaccctgttgttgatctatatcgactattatccgacgatatttatcattatattatgactagttagtttgtagattttgagagggcaacataagaagcaatccagcttaacctgttatgttcttgatggtagattctagttcatgtgttgaatctgttctccctgctgtagaatgtatcgagttgctgctctctactctgtacttttagaataccttttcaatcatttggagtcagctgattgttgtactacttatacgccacctgattagtcatgtcaacaattaaacttgagcactggttaagttaagagtggcctgattgtagttgataatcacattttattcgtagacattgtatgctggatctttatcagccaccgtcagatcatcctctgtaataaatcttcatcagacgtgtgtgccaatcgcaaggaacacgaaatgcatccgaaatgttactctgagttaatcaatactataattcttggtcaaattaattatttatatctataaagtttaaattaaatttaggaaaatgaattcatgcaaatcttgtggtaagttgtcaatttcataaaaaatccagcttactactccctttttaggagtgtgttgtggctgcacacttctgccttttgatatatacggttctattctcggtgtactcctttattattattaaaacaatcccagttacttggtaagtgctaatcacgaatcaaagtcaacataacaaatcatgtgcgtacagctataactcgattacacaaacaacaaaattcatatttgaacataaatccagttgtagcatatctggtagtataaagttttttttttgtatagaagagttttaatttctgtaagttttggaaagcatttaatcctagaaattgtagtgtagctcaactaaaaaataaatgaacttgaatcgaaattgggttgtatcataaatctttaccactcaaacgaatatttatcctaaaccacaaatgactcttttcatcaaggaatgttttgttttcagcattttaaaaaaaaacttttctaatatggttttcatgtttcgttcttttgaaatttaacatctatttaatttgcacggctccataaattcaacggatacatattctgaataattactaaggaggcatatatcggctctcttaatacaaccgcttgtttctcaaaatttattttgagttttgtctacacattctcaaggacggtacaaacacactatagatgttcacaattttttttttctaaagttgattgatggacaaatgtttgaacatataaacatataagcactgaatatttgcttatgcaggaggtatttatatcaagttcgatactttactaccatagtccctaggacactaaaatgccttcaatgatctgatgaagcctaagagagaatattgatcagtggagcgacttgcaactacacatggcacaagtagactagacacggtatatattcatattaacttgttaaaattttactacttaacagttcacttgtggtgcatccatatcaattcttacttacacaatatttgtaaaaacaacctaacactataggatgacctagacaacctttatgtcaatcacacttagaagatgatcgtctttttaataaataatgtgtactacacaccatgctctccatatagatcaagatctacaaacccttccacttataaaccttaccaccaaaaactcattaagttgcttcatttatctatgctattaagaaaaaaacttatttcgtttatgccatttctagaaatggctagtcacactattcacaatattatataataaataaaagtttcaaatattcatccaccaaaaatcatcaagtcgtgggacttatatgttaattagagaagtccctttgggtgcaatcgattttggaaaccctaaattttttctatacatagaagagagagatgtctagttgcaattgcttttgcgatgtgccaaccacccttctagctttcatccacgtctacttaattgccattcttcttcttctttttcttcactattactacctcctatcttagcgaatcttcttcttcttcactattactacctcccaccttagtgaattcatcctcattgttcacaatgacattgctaagttaactaggtatgctaagtacacaattagaatataacctagagcctttgtttccatcatacttaaaagatgacatttttatatagataaagtgtgctactcacaaggcttactatatatatgtatgatacacacaaactccacaacccaaaactctttcaagttgtgtggcccatctatgctattaaaaagcccatttagcccatccaacatgagaaaccctagggttttttccctataaaagatacctaggttattgttgcttttccaccccgcccgccgccgctccctattcctatttaatcccatctctcttcctcatcaccgctctcctctctccaggcaagaggtacgcactttttgtttcggatttgaaatctttgcttcgttttactatcattggtcataagttcttttttgaagatgtttgagaataagtttatcattgagattatcgtcacttgtgataggaagtacgcaacctcaagccggacaagacgtgagcaaag

SEQ ID NO: 81 - DNA, 2023 bp, Oryza sativa
  misc_feature (1)..(2023): Ceres Promoter pOsMEA
gagagcagaacatagtagccgctgttttctgggggtgcaatttgtgcaagatcgctatccttatggaccatgcaagcaccaagcaatattaagccaggtccaacagcggtcttggggaattcagaaatgagcttaaaaacctccttgagctggccagctcagccaaggaggtccatcatgcatgtgcatgctcaatacttggaattattgcaaaatgatcggtcattgactggaagactttgcgcccttcctcagccaaccttatgtggctgcatgcatagagtaccaacaggaaggtagcgtttgttggaataaggtttgcatccagcatgtccttgtagagcttcaaagcctcagcaccttggcccatgaaggccatatccagctaattgcattccatgagaccacattcttgctatccatactgttgaagtgaagatgctccgagcttcggaaatgcttccacactatgcatacatgtcaatgagcactgtcatgacataaacattgggccccaagtcctcctcagcgataatcctatgcagccactttcccagggacaaagctccaagctgtgcacacgctgaaagagagctagaaatgatgattggatttggtcacacgctaagtaccagcatttgctcaaagagggcaattgccatctccgtccagccattctaggcataccctggtattattgctttccatgattccgattccgtggtcttctatggcatcgcattgaaggccttccttgcagactccatatcatttaacctacagtacaatatggtaattgctgtcgacactggagaattcgcagtaaatccagacttgagaggaccatgtaagcattgatcaagcagttcattcccaaacagactatacgggatcagtgccagtgctcgagtttggcttcaattccaaggccatcaacccaataaacagattaactgatgaaccaaccatgcaattcgccgagcaaacatagattaagcattgtaggcaaccaaatctggattctccatcaagtcaaagagacgccatgcagaattccacatccccgctgtatacaccgagatcaaccggtcagaacatgctcatactccgccaaccctctcttcagaacatgctcatactccgccaaccctctcttctctgcaagaggcatcctccccaattccccattgttatatctgttgctggtaagaccgttgccagcgtggttgtgtcagaccgaacagactctgcactcgccatcctcacgaacgactccagggcctccgaaccaggaagcccggccggccatcagcgtgttccacataacggtatccggcgactgcacagtgtcgaacaccttgcgtgcgtggtcacctctggacagcatgaagcgtacaggctacagcttggccaatgcggacgccacgaacgtgtcggcggcgtaacccgcgcgtgcagcgcgccgcgcgcgggctgcggagtcggttggagacgacacgccgccgccatgagagcaatgagcgaggtggcggcgaaggcgaaggagaagtagtcgaggcaagcggaagagaaggcggcagcggagaaagcgatcggggcggcggaggaggtgggtgggagggagggacgcgtagcggaggtcggaggaggagggagctgaggtttccggggcgggggtcgagagggtagtgtacggaggcgagggacacggcgaggatctggtcgaggtagcgcagtgtgaaggaaagcgcgatgaggcggagggcgccggcgaagagcggcgcggcggatagcgggaggaggcggcgccggcggggtctcatccgattggaaacagattgggaagggggagggggtaggaatacgtggcgtcggcagtattaggtagagagagaaaccctttccatcctttgtctcttagccccgaaggagagagaaaaatcagaaaaaaaaaaccctccgcgtgtgggggaagcagagctccggacgctggcgccgctcgcgccaccgcacccgcaccgcc

SEQ ID NO: 82 - DNA, 2034 bp, Oryza sativa
  misc_feature (1)..(2034): Ceres Promoter pOsYp102
gaacgacccaaacgcgtaaatggtggtactggtttccctgctttgccgagtaccagcagccacgaagaacgttacacaatcgagtacaaaatctataagagcaagtttaatagcatagccaaatactacctctaaatcatctatagccaatttaatagttcatttattcaataattacttataaacatatactacaatcattaatatatggtcttacttcttatacacataatattttggagtccgtgttacagctggctataaatataagggattttggttggatgtggtacatcctattataatgaatctagacatgaaacctgtccaaattcatcgtgctaggatacgccacatctaaccaaaatctcttatctttagggatggagagagtaataattaaatgaagctaggtagagtttcccggtcaatacgcttgcgtgtgcttataagagcatggccaacagtttcccgatactcttcccaatatcagttttgaggagttttgttggaaaaaatcgctccaacagtagacctaaatcacccctaaaagcttggcgtttccaaacccgcatatttcgttctccacttgtagggaagagactcggcgcccaatccttcaaccgcatgcacttcgcgcgcgctgtgtgaaaattttcctaccaggttcttctttgtgcgttcgtctacctgtgagtcaatccatcacgccagcagcctcatcttccccgcagctgtctgggaaagcagccatggctcccccaagcttccccagcgtcgacatttttttctcagcggcagcgccagacccatctccaacccaattgggcggaccttcgtcggcgctcccccagcaccaccaccgactcgaatcggccgtcgcccctattcatctccaatcgtccctcgaccctaccgcatcctgcagcacagcctgtctctcgcgtcagactggcgctgcgctccccccggtaatgtgcaggcgacaaaggccccatgcgatgcgaccagcagccggcgacaaccggaggtgcccagtcgctggccttcatcgaatcatcgtgcacctcggtcggagtcgatttctgattgttgctgctgctcaaatctggagcttgctattgctgagaactgcttggtggtggtactggaaatttgttgtttgctggctgatgaaaactgttgttctttgctgctaaaaactgctgcttgctagtactgaaaagtactattgcagctgctgaaatatcttgctgcttgctgctgaaaacttcaagttgttaacaccgttcacactaaaaaagctgaaattttttttctgggctgaaaaccccattgttgatgattgcagaaccaatatttttccatgtaaaatacaggagatcgtggtaataatcaagtgaaatatcattttggggcaaatactcagatcgtacctgaagccaatggaaacattgttcaatgcttaaactgtcagttatgatgtcaaagagattgatcactgaatgtcctgaaaggagccgtgaggaggatgcagcattgcagcgtgcgcgagcgtgagtggaggagaggaatgacgattctgttggtagttgtcgatgtggcctactttttttgttttgaggattaaattttgggaatctcttggagataaaaggtattctcataccttaaatcctttttagagatctaaaaaaaatgatttaggggattgaattttgggtggctgttggtgatgctctaagttgcacatcctggggaaaaacctccctaatccatcagcaaaccgatcaaccacccacgacaagtcgacgccaccgttttttttttctccctcctaagtcctaaccccacaaaaatcccgcgaactttcgtctcaccacgcgccgcgtgccccctacaaataccaaacaacacccaccacgtccactcacaaaccacgcaggaaacctcagaaaatcaccgtacgcgacgcgggcccaagaaaaccccgacagaaaccgcgcagcagcaacaccaccaccggcgtcggag

SEQ ID NO: 83 - DNA, 1877 bp, Oryza sativa
  misc_feature (1)..(1877): Ceres Promoter pOsYp285
ggcccgagttaaacgatcttccacgtgtcagcgaatcctagtcgttcgatgaatctgaatctgacttgtggtggttggacggccacgtgttaaaaaagggaaacgtccgcatcacccgatgctgggacatttgcaatttcgatccagctgtagattgaccagttgttactctcttttttttaacaccatacaaacgtaatactccctctgtcccaaaatataagtattttttttaacctcggttcagtcttcgaggtgctactttgaccaataatatttataaaaataagatgttttaaataaagagagttgcatattatgatagctcgtttaatgataaacaaagtaccatcaaatttacatgattaatctttttaatttatttgctattaatagttaaaatttaaaaagtttgacttcacactgttctaaaaatacttatattttgggacggagggagtacacattagagcaggtacaatagcagactagtagccagctataaacatattttaatgagataaaagatgagagagaacagcgggctacagatctgtagccagctgcagcacggactccaagacattgtgtgtgtatgacaggtgggaccatatattaatagtacagtaagtaactattgtatgaattggctattagattagctataggtgaattgtagctagtagtgggctatactattgaacttactcttatatctctcaatatctccagaaaactaggacgatatatattgatattaacaaagtcatcatagatatctcgctatcgacatatatattacctatcactgaaaaaataattaatcataaatgcaagcacatatactacgttcaacactgaatgtaggtagattggtagacgggttccaccgcaagaaaagcattgcaccagtgaagaaagaaacatcggaatttgtatgtagtttgttgtttgatgaattcttttgattaaaaaaaactaaaatcagagttgattcagttaatggtgttgcctacgatatacttccatatcatgatatcactgtagactatgaatcatatctttaattaaaactaaatcaagaaattaagtatgagacctcaactcaatgaagaatttctagttgaaaaacattcctagtgtgcgttcggatggaggtagggatcttctctccgttcatataaaaccggatggttcattagaacatgattaattaagcaacagttaatctaaaaataaattaatattttttaagaaatttttgtatagagatcttttgaaaaaaatacattggttagaaagcatactaataaaaagagaaaaataagaacatagtactatagtagaaaatgagaacttggagtatttgagaggatgggaaataagaagattaagaagatgcgtaaagtgaacggttaacgcatgattgattaattaaatattaattattttaaatttggaaaataaattagtatgatttttaagcaacatatatatatatatatatatatatatagaaaaacatagttttagaaaatataagcgtgtaaaacgatatgcaggaacgaaacgttgagcattcaaaatttcaaattgaacatatgaatcaagagagaataaaaaaagaggccttctaggctggcatggacaattggacatgttttcaactagggtttcaagcttcgagcatccacttttgtccttgcaaactttatacggcaaggcccgtgaatctagccccccacaccaccccacccgcccgcgccgcgcggccgcctcgcctcccctcccttctcctcctctccgcccccgccgccaggccgtccacctccgccgtctcctcccccattcgcacccaaggcgctggcgcggaaggc

SEQ ID NO: 84 - DNA, 1000 bp, Arabidopsis thaliana
  misc_feature (1)..(1000): Ceres Promoter PT0565
caccaaatatagtgttatttcaatactaaaatggtgttatggttggagatgccctaaagataaacatgacgagacacgagatttattaatttcttgatcaaccataacttaataacttaatattaatttcacttaataatttccaattaagtgaatctttacttcaccaaaagttcctaacgaactcttattttctagcatcaatattaccatgaactagcatcaatactatcatgaaaaattcctacttcctatccaactcttaataacaatgctagtcttaacaatattcatcaaaaacttgatatagaccttctaacttagccacgactagtatcggtgaataccaaaattaatgtattcatgagaacttgagatttctctaatgtattcttgttactaaacaagtaacaacactcaagaaatatcatgatcaaatattttactcataaactccatatttcacattttgaaaattttaaacagcaaatcacattgaattttcgtggtaaaagtatttaaaattgaaaaatagcagctcctgatttcaatgtataaatttatctttatatggtttatgtctccaacttattttaaaaaagagagaaagagcacccaaaaggtgaccgtttgaaattcgaatttatttccgtttgaaattcgaattcaaaaaaagtaaaccgaaccgagtctcgttactgactgtcacacattgtttccctaaaagctaattaacccatacgtggcgtaatataacaggtcagtgatcaatactaaataacagacatacacctttaaaattcgtgcacgctccaaaacaaaatctacacttcaaaatcaacggtcacgatcattcctcaaatttcaaaaaattatttaacctcacttccttcgctttgtttttaaaacctctctctctttctctttctctttcgccattaaaactctgtttcctttttcagagattctcagagaagattcattttaccctaagaaaaaa

SEQ ID NO: 85 - DNA, 999 bp, Arabidopsis thaliana
  misc_feature: Ceres Promoter YP0015
ttgagccttattgttgttattgacttttagccaatagaaagagatggaaattcaataattatccacaaaattccaaatcattggtgtacaaaaagatctaaggctgttatattttcaaaaaagaaagaaaagaaatgcaacaaatatggattaaactgtggtttgtaaattgagctttgcatgaaaactttatcactatgatttcactactccatatttattgactaaagtggcactaatgaatttcttaatcatgaaatcttgtatcaaaaagtactaaaataaacatgacattggcaattaggaaaattctaaattagaaattagtaaaaatgaaaggtgaaagggaaagatgatgatatgaattggttggtgaccaggagaaatgtatcccgatttttgcagacactttcagtgtccccattcatataattatggcccacctcgttaagatttttcattcaccaccataacaagatctaagcttagatttcatgtaattaaacatataatatacttgccaatactatctaataaagtatacttaagcaaaaattattactctagtgtaaggcgatgaaatataagtttagttgaaaatttatgtcgatataacaaagtataatgaattaagaccttggttttcgattaacaaactaattaaacactagttttgcctaataaaaccgggaatcgtattcaaaaccgaacgacaaaacaagggacaagttgagagacaaaaccaaatcagcatctttcttccagaaatgtcatgaccacatgacgtcatcttgacccttcttcattgtgatatctgtggataaagcgcacgtgtttaattcacgaaccttcgtagtaacgaaaaatccacaactttcatattttttaattacccactaaactaaaacaaatttggaaaaacatgaaaaactttttctttttttccaggttcgtgaacctcgtaccctctatataaacctcttaaccaccttccacata

SEQ ID NO: 86 - DNA, 999 bp, Arabidopsis thaliana
  misc_feature: Ceres Promoter YP0087
tgaattgagtaaaatgtgttttcaaacagttaggtggtagaaggtaaaggtaataacatcatgatcttactaaaagaattgttgcatactaactatcaatattctcaacaacataatataatgtttttttaggtaattttccattttaattttttgtgattaaacaattaaacaactcgaatgatgatgataaaaaaaaaaaattaacaactcgaataagttaaagtagcaatacacatgtcgttcaattcaaccaataaagtaagacttatatttttaagaagttgactaatagcttaataagttggaaaacttgtgtagtttcttaattcccacgtgcagtaagaaataaaaatgaaaaaaattattatatccttcccactctgcgacttttcttttattttatcaaatattaaaaagattcatatcacagtttacacattgaaatcataaacgataattatgtattttgtaataaaaagttagttctgaagctcatactttggatagtcgctagtcgctaatatgctccttgtaataattaaagtcactacgacgcacgtcaaagccgatatttagggcttaattgatgcgtgtttttcttttcatataatagtaatataaattagtactaataaagtatgatggatggttgagacagaaaagaaaaaagatgactgtatggtcatcattacaaagaagaatgtattcttcatgttcttaagaataataaaatgtcacttgtaaatcaagttggtaagcattttgagaactttgttcgatgcaacgtatgatgatttatgtagacaaaagataaaaccgtatcttcaactattgccaagaaaagataaaacctaatctagtcagtctctcaacataaatacaacccaatagccaaactgtgtccaattcggagagaaactaaactaaaacaaaacacaaaagcccaacataagcccaataaaacccattttataaacagaacattactaacactca

SEQ ID NO: 87 - DNA, 1000 bp, Arabidopsis thaliana
  misc_feature: Ceres Promoter YP0093
atgatgaacattctacatatataattattatgtttaagcacttagacagcataaattctttctaattatataaatctaaccttgttacattgtacatctataaattacttgaagaaataacgagttctatttctttttaaaaattaaaaatactataccatatctcagtgattaagttgaaccaaaaggtacggaggagaaacaagcatttgattcttccttattttattttattcatctctcactaatgatggtggagaaaaaaagaaaatacctaacaaacaaatatatattgtcatacaaaaatatttctatatttttagttaattagtttatattcctcacttttcagggcttatataagaaagtgagcaaacacaaatcaaaatgcagcagcaaatactatcatcacccatctccttagttctattttataattcctcttctttttgttcatagctttgtaattatagtcttatttctctttaaggctcaataagaggaggtactattactacacttctctctacttttacttgtattttagcattaaaatcctaaaatccgttttaaattcaaaaataaacttagagatgtttaatctcgattcggtttttcggctttaggagaataattatatgaaattagtatggatatctttactagtttccattcaaatgattctgatttcaatctaatactctcactctttaattaaactatatgtagtgtaatttcacactgttaaatttctaccatgtcatgtatattagagttgcatagaaaattgtaaaacatccatttgaattcgaatgaaacaaaatgttttaaaataaaattttggtttttaaaagaaaaatctaaaactgaattatatcgtttaaccaagttgtaaaagtcataaaacgtagtatcttgtaaatcgctcttccacggtccaaatagacttctagtaataaacaagtaaaactaattttggtttcttactaattttcacaga

SEQ ID NO: 88 - DNA, 999 bp, Arabidopsis thaliana
  misc_feature: Ceres Promoter YP0108
ttagctgaaccaggaaattgatctcttataccagtttccgggtttagattggtttgatggcgatttgattaaacccccgaaattttatgtcgtagttgtgcatagtattattattctttgcggacaatagacgtatcgggaccaagttctgtagcaaaattgtataagcttaagtttgatgaaatttaaaggtaatcactaaaacccaaatgggacaataaaccggtgaagatttagagtttttaattttgactcatgaatctggagaaagagccctcgttaaaaggagtgaatcaatccataggggaaaaagttttgtctttttaaaaactaaagaaccaaaccttaatagaagcagctcaatgtgtgacaactttccactggcactaagataaagtgactagcgatgagtgcaattattgaaatagtagatggtaaatattacatacaagagtaaaaatatctttatgtcaatgcttaattcagtgtttctggttaacaagagaaacttctctaactttcgtaattgggtcttataaaattttatgcaattatgattttacccttttactacttttcattagctttcacgaatctattttgacaagagaaatcattagaggtaaacatgctttttggtcaagggccttaacagttccaccaatcaagctcaaaagttgtacttaaccgacatcttctgtgaaaacatataattacatgtacaaatcaaaactaccttatgaaataaatagaaatattgcagttcatttctaatttaacctcttcaacttttaaaactatttacatttctttatgtcatttctagtcattttgatgcaaattgtaccatttatggattatcttcacaaatttttaagttggtgaaaactttttggtgggtagttaaaacttgaaatagaaatttactttaccaaaataaactaatgaaaagtaatcactccactccctataataagatttccaacgttcccactaagc

SEQ ID NO: 89 - DNA, 999 bp, Arabidopsis thaliana
  misc_feature: Ceres Promoter YP0022
tagttccattacaatttccaaatgatttgttacaaagctacaagattattcgaaataggatttcatccataagagagaatggtgtggtcgacgctacaatgttgatttattggttgtggtttgcatcttggggatgtcaaatcctaagtttcaagttcttgtaaaaacgttttcaggtttctttaatatattttaatattaatgtaaaaagaaaagatatagcttttgtacaaaaaaatttgtttaatcactatgtaggaggatgcgatcaaattcatggaatgatgtattattagcttttctatcctcactctaaaaacaatactatagtgagttaaataatttgatcatttcaatgtagattaaaattttattaaaagaagaaaaatttaaaagcctataacaaaataaaaaaggaggctcgaggtatgatgggtgtagcagaagagctggcaacagctatcgactgagtgattacgaactcagtactcagtgttctcagctcacacactctttttttgttctctttcttttggacagctttcattttctcttttcttttttctattttgtttcaaaattccatccatattaaaataggcctgatcatgagaataaaggaaatactaatgatgagtttctcaataatgcaataagatgcaattattatgagctatttactattgaaaatgagcaaataaatgtcaaaacacaatctggttaagttagagcaactccattgtataggattcatgtagtttctaagaaaacaaaatgtattaatattttacttttacatccaaaaaaccaacttatatgagtaatagaaacgatcctaatattaggaattttagagattttctctcatctgtttcttaacttttcaatatttttattttttaaaattgtatgagtttctactaagaaactactgctggagttggtcttagcttcccaatgcttctccacctatatatatgcatatctccttcttaaaac

SEQ ID NO: 90 - DNA, 999 bp, Arabidopsis thaliana
  misc_feature: Ceres Promoter YP0080
aagcggcaatttagtaagaagtactcaaagtatcatttaccaaaagtatatggttttgggaagagttgttagggatgtattctttctaaacagatgatatgacgatgttcttgaaaactaatgttaaagacggaatctctggcatcttcactcgggagatatattaaaccgttgattgtagttagccatgtacttagcttagtgcacaaataatctgctgcaagaaatctttttctattataatatctctcatttaaacattagaacatattgtttaacttgttcttctagaaataaaactgctaatttcttatggtaaactattttcctttagattgcacaatcgaactcgaaaatctagtggagactatgtgactatgtttatatatatgaaacctaaatcaaattatcccaataattgggagacacaaaagaaaaattacgaaagaaaacaggaaatcaaatcaaaagataaagagaaggtaaaaaaaggcaagaagcactaatgtttaatatttatagttttctccattaaagaaaaagcgatgatgtgtgttctcatcttttgtgaaagtatatatattgcttttgcttttctcaaaagcaaaagactcatccaacaagaacaaaaaaaaaaactaaagctcaatccaaaagacgaagaatgcattggatactacaacttctttttcacttttctttcaaatttacaattatgattttcacaatacagtttattcaaaaataaataaaaaaacgaggcatgaaaataatgattatcctcttcacttattaagccactcactataagcagagcaactccagaacatagtgagcccccaaaacattaaagcatgatgatgtctaatgatgatgatcttcttcgttccatttctctaaatttttgggatttctgcgaagacccttcttctctttctcttctctgaacttcaagattcgtgtcggacaaatttttgtttttatttttctgatgttaca

SEQ ID NO: 91 - DNA, 3000 bp, Arabidopsis thaliana
  misc_feature: Ceres Promoter PR0924
atctataacgagttaacatgttgccagtttgaatcaagaagcttggatgatgaatgaatggatcggtttgtggtacaattcttaaaattgtagtagaggagacagagaaaaaacatgataagactttggtatttacaacttgacggagacaagacagtaagccaaatctgtcacaaaaacactcaaactcttttctcagtgttttgagtttaaagagagacttattcacttcccctttcgtaacacttatttgtctcccaaccaaacagtttctgtcctttcccttgtcctcccacgtgcatctttatatctcatgacttttcgtttctagatcttgaataatgtcttagtggattaggtttgttgtcggtaaattaggtgaccgtttttttcttatatttggaagatcgcgggatgaagcagatactgagtttcagggcatacacacctaatttgaaaatcattgttagtccaatttcactttaatcttgtttacaaaaaaattgatctgaaaatgttgatgggataagtaaaaatgtaagttttgctagtagtcatgatataataatagcaaaaccagatcaattttgagcaaaaggaagaaacaaaaaacagatcgatcccacgagcaagactaagtgtaaagtggttcccacaagagccatatggatatggtccttcaacttttaaagcccattacttcagtggtcgacccgacattacgccacgagtagtcacgcacgcacgactccgttcacgtgacattcacgttgatatttccccctctactctcttctgcttggttgatctaaaaaacatgaagagaccaacctaatttcatattaatatatgatatagacttcatactcaacagtcactttcgtaatccaaatccatatcttacgaaattagttcttaataaaggttgtggattaagttataatattgtgttaagagttaagacacagcatataaccttgtaccaacagtgctttattcttaaatggaaacaaaacatatgtcaatgtcaagcatacagctaaaatatcattatctaatattaagagtaaaacaagataattaaaaattgaaacaacaccatatttttatagctttacttatcgtatttttctagtcttcatggtaattgtgttgctttattttgtttataaatgaatttggttcgaccagatagtctaatatcagtttttaaacactggttttaataaaatcatatgtcggcaattcaacctgttacgttgtatgattgtatcctagtcaaataggggaggaggtactagtcgtttcaattagtttacgtaatcaatccaaagaaactataagctataaagatcctcaatttgttggttacaataaaaacaacagttgtcaaaatttatgtttataaaaagtaataactatgttccttcccatatagagcaaagtacctcaggataggcaaaccgtacttaatagcccttattcataatttgatccaactcttccccacaaaattgcaactgatgaagtcaatacttgtatagtgagtcaagctataaatgtctagtgatagttttgtctcttaaaaggttaacaaaagttatgacaagctgaaaaatcagagtttgctaggagtattacttacagttatcagtttaagtatcacatttatagtattgtatacaatgattcttaaattccaccttttccgtgcgaaaccaaattttctattggaaacatagaatgtaaacaaaaatatgggacgttgtccgttccaacattaaccaaacttgtctattactaatattcgtgttggtttgatgttggatgtctaaattcgttgaatcatgtgtctcttgacgaaatatgcatcttcttatttcttagtatagatgcactttatcattcttttagtacatgcttaatttttttttttaaaatatgttgattgtcatattgccaaaagtatgaattaaagacgcacatctaacacaagttagcagccgtaaatccttccataaatttattttgcaagttttgctcattatataatgagcggaatttatgatataatcgtttgtaataatgttatgttttgatcaaaatttgaaattaaaagtaggtgagaacttgttatacagtgtagataaggtggatcttgaatataaaaataaaatttataagatgtatttaaagcagaaaagcataaaactttagataaaataatgtaaaaatgtgttagcatcaatgttgggatattggccgacccgaacttaatcaatgtcggaagccattacttctctcccaaaagacctttttccttcggagaactaggaacttcctcactacctttcgcttaacgtgaaagccataaatttcatatattcataaaaatcagaaaatctaaaactgtttagtatcacctgtttttggtatagactattggttttgtgttacttcctaaactatatgatttcgtacttcattggatcttatagagatgaatattcgtaaaaagataagttatctggtgaaacgttacttcagtcatgttgggtctagatttacatactactatgaaacattttaagataataattatcctagccaactatatgttctatattatgggccaagaagatatagaactaaaagttcagaatttaacgatataaattactagtatattctaatacttgaatgattactgttttagttgtttagaataaatagtagcgtgttggttaagataccatctatccacatctatatttgtgtgggttacataaaatgtacataatattatatacatatatatgtatatttttgataaagccatatattactccttgacctctgcccccatttccttttactataaataggaatactcatgatcctctaattcagcaatcaacaccaacgaacacaaccttttccaaagccaataataaaagaacaaaagcttttagtttcatcaaagacgaagctgccttagaa

SEQ ID NO: 92 - DNA, 1000 bp, Arabidopsis thaliana
  misc_feature (1)..(1000): Ceres Promoter YP0388
agaagtattcacgcaccaaggttatatttgtagtgacatattctacaattatcacatttttctcttatgtttcgtagtcgcagatggtcaattttttctataataatttgtccttgaacacaccaaactttagaaacgatgatatataccgtattgtcacgctcacaatgaaacaaacgcgatgaatcgtcatcaccagctaaaagcctaaaacaccatcttagttttcactcagataaaaagattatttgtttccaacctttctattgaattgattagcagtgatgacgtaattagtgatagtttatagtaaaacaaatggaagtggtaataaatttacacaacaaaatatggtaagaatctataaaataagaggttaagagatctcatgttatattaaatgattgaaagaaaaacaaactattggttgatttccatatgtaatagtaagttgtgatgaaagtgatgacgtaattagttgtatttatagtaaaacaaattaaaatggtaaggtaaatttccacaacaaaacttggtaaaaatcttaaaaaaaaaaaaagaggtttagagatcgcatgcgtgtcatcaaaggttctttttcactttaggtctgagtagtgttagactttgattggtgcacgtaagtgtttcgtatcgcgatttaggagaagtacgttttacacgtggacacaatcaacggtcaagatttcgtcgtccagatagaggagcgatacgtcacgccattcaacaatctcctcttcttcattccttcattttgattttgagttttgatctgcccgttcaaaagtctcggtcatctgcccgtaaatataaagatgattatatttatttatatcttctggtgaaagaagctaatataaagcttccatggctaatcttgtttaagcttctcttcttcttctctctcctgtgtctcgttcactagttttttttcgggggagagtgatggagtgtgtttgttgaatagttttgacgatca

SEQ ID NO: 93 - DNA, 283 bp, Arabidopsis thaliana
  misc_feature: Ceres Promoter PD0901
caaagtatttgacaagccatatggttttggatcaaaaagtcggtccaaaattaatgttttatgtgcaagaaccgacccattgtacacacgtgttaacatcttcaagactttcatctctatttttcttttggtcattaagatacccattgatccgaatctgttacattcccacctacttttttaatttttactatccactccaaattaaacacaaccgatgattttaataattggaagctttttaaaatatttctccacgtgcctctttgtgtttgtctatata

SEQ ID NO: 94 - DNA, 1000 bp, Arabidopsis thaliana
  misc_feature: Ceres Promoter PT0623
aaagttattgacattttgaaaggaccgtaaatattaccaaaaaactgacggagttaggatcggccacgtagaaagggacaaagagagaacagtcacggactcggccagactaagtatgggcctgtctgaatccaaactcagctaagttccaaaagcataaagagagatgtgtaatgaaatgaacgtattctagaaacgaaagcaatgttatgctttgtttttgagccacatgtttttgggagatggagagaatcttttttacgtttttaacctaacccacttggcacttggccaaaaaagtgagaagaaactgtggcgaatgagtaggccacgccatggactttgttccttgtccttcaaaagttaaatttatgttatgcgtggggacaatctaagcaacgtggttcctttaaatatcgcagcttcctcttttacacttttggagcctacgtgttttgttttggaccggccaaatacacgagtcagtcagtttagaaataatttggatgtccaaaaatcttggagatccaaataaaataattagcatgttttagttcataagaatatgaaatgtagataaactgtctatattaatttttccatagaattggctttttatcgaggtgatgtacttaatgactttgttgattactactcgtataacaataaagaatatgatactatgtgagacttataatgaatttggtgtgtgttaattaatccagttgaaacagtttaataacaaatcagaataaaaattgtagtaagaaaatttgaacgctgatccttcaacctagatagtgaacctttcaaatactatatgattcacgtgtaatgtttttgaccgttggttatttttgtgtgaactatattaacttatcaatatcgaaaggctaaataagtaaataactaaaagaaagttcaggaaacaactcgacctaatgacctatcatttctgatcacccgtcctataaatacatacgtaagatcattcgttact

SEQ ID NO: 95 - DNA, 969 bp, Arabidopsis thaliana
  misc_feature (1)..(969): Ceres ANNOT ID no. 541887
atggtgatgagaaagctacagttaccgttgagccagacgcagaaggttaggtttgagagagcaatcgagcggcttcaatcactgtcgtcgtcggctaactctgacgcttctgttatcgtcaccgactctattcccgtcaaccatgacgatgccttcctcaagggacatggaacttccgaggtcgatggtgagttgctcgcgacggtctgtggagtagtggagcgtgtggataagcttgtctatgtacgcaccttgcgagccaggtacaagcctgaagttggggatattgtggtaggccgtgtcattgaggttgctcaaaaacgttggagagtggagctcaacttcaatcaggatggagtactgatgctttcttccatgaacatgcctgatggtattcagaggcgaagaacctctgtggatgaactcaatatgcggaatatctttgtagagcatgatgtcgtatgtgctgaagtacgcaactttcagcatgatggtagcttgcagttacaagccagaagtcagaagtatggcaagctcgagaagggacaacttctgaaggtcgatccttacttggttaagagaagcaaacatcactttcattacgtagaaagtcttgggattgatttgattattggctgcaatggtttcatatgggttggagaacatgtcgaagtgagagatcctatggcaatagatgatcagaaagatgaggaaatgatctcatcctcctccacaggaaaagagcaaagccatattccactcgagactcgacaaaccatatgcagaatcgggaatgcgatacgtgtcttgtctaatctaggcttcaccgtgacactagaagtaatcatggagactgttaacctcagtaactcaaagaatattgacatacatgatatgcttggatcagagtttcacgttgtggtagcagagaatgaagctgaaagaagacgtacaaagaggaaaaagtga

SEQ ID NO: 96 - protein, 322 aa, Arabidopsis thaliana
  misc_feature (1)..(322): Ceres ANNOT ID no. 541887
MVMRKLQLPLSQTQKVRFERAIERLQSLSSSANSDASVIVTDSIPVNHDDAFLKGHGTSEVDGELLATVCGVVERVDKLVYVRTLRARYKPEVGDIVVGRVIEVAQKRWRVELNFNQDGVLMLSSMNMPDGIQRRRTSVDELNMRNIFVEHDVVCAEVRNFQHDGSLQLQARSQKYGKLEKGQLLKVDPYLVKRSKHHFHYVESLGIDLIIGCNGFIWVGEHVEVRDPMAIDDQKDEEMISSSSTGKEQSHIPLETRQTICRIGNAIRVLSNLGFTVTLEVIMETVNLSNSKNIDIHDMLGSEFHVVVAENEAERRRTKRKK

SEQ ID NO: 97 - DNA, 963 bp, Populus balsamifera subsp. trichocarpa
  misc_feature (1)..(963): Ceres ANNOT ID no.1448288
atgagagggatagagatatcattgaatcaaacccaaaagataaggttgcagagagctctgaaacagctagaatctttgtatttgagagccaacttcaatgcttctgtaactgtcgccgataccatccccgttagcaacgaagacaccatcctcaagggtcatggcacctctgagcgcgacggagaagtggtggcgacgctctgtggtgtggtggagcgtgttaacaaattagtgtatgttcgcacgttgcgtgccaggtacaagccagagattggagatatcatagtggggcgtgttgttgaggtagcgcaaaagcggtggaaattggaaattaatttcagccaagatgctgttttgatgctttcttctatgaatttacctgatgggcttcagaggcggcgaactgcattggatgaactcaacatgcgcagtatttttgaggagaatgatgttgtgtgtggtgaggtgcgtaattttcagaatgatggtggcatacaattgcaagcaagaagtcagaagtatggaaagcttgagaagggtcagttgctcacgattccaccatatctagtgaaaagacaaaaacatcatttccatcatttggaacagtatggagttgacctgatactaggatgtaatgggttcatttgggttggtgagcatgtagaggccagggactgtattgtagaggatcaactaaacaatacggaacaacaattcaccaaatccaatacaaccaaagaaatgccactagagacgaggcggagcatatgtcagatagcaaatgctatccgtgtcttgtcaattttgggctttaatgtaactttagaagtgatactggagactattgacttgagcagcacactgaatcttggaatagatgagatgcttgggccagagttccatgttttggtagcagagagagaagctgaacgccgcacatcgatgacaaaaaggaaggggtga

SEQ ID NO: 98 - protein, 320 aa, Populus balsamifera subsp. trichocarpa
  misc_feature (1)..(320): Ceres ANNOT ID no. 1448288
  misc_feature (1)..(320): Functional Homolog of  Ceres ANNOT ID no. 541887
MRGIEISLNQTQKIRLQRALKQLESLYLRANFNASVTVADTIPVSNEDTILKGHGTSERDGEVVATLCGVVERVNKLVYVRTLRARYKPEIGDIIVGRVVEVAQKRWKLEINFSQDAVLMLSSMNLPDGLQRRRTALDELNMRSIFEENDVVCGEVRNFQNDGGIQLQARSQKYGKLEKGQLLTIPPYLVKRQKHHFHHLEQYGVDLILGCNGFIWVGEHVEARDCIVEDQLNNTEQQFTKSNTTKEMPLETRRSICQIANAIRVLSILGFNVTLEVILETIDLSSTLNLGIDEMLGPEFHVLVAEREAERRTSMTKRKG

SEQ ID NO: 99 - protein, 316 aa, Triticum aestivum
  misc_feature (1)..(316): Ceres CLONE ID no. 644583
  misc_feature (1)..(316): Functional Homolog of  Ceres ANNOT ID no. 541887
MRDLHLPLNQTQRVRLEAALHELQTLAPAAASAAAVTVADNIPVNHEDNILKGHGTTDQDGEVVATLCGVVERVNKLVYVRTLRARYKPEVGDIIVGRVIEIAPKRWRLEINFSQDAVLMLSSMNLPDGIQRRRTAVDELNMRSIFEENDVVCAEVRGFQHDGSLHLQARSQKYGKLQRGQLLTVPAYLVKRRKLHFHHLEQYDVDLILGCNGFIWVGEHVVVREIADLKEDEQKLSAEAETFTPIETRRHICRLANAARLLSALGFTLTVELIIQTAEASVSSNVEINDMLGAEFYVQTAEGEAKRRGDLLGKKR

SEQ ID NO: 100 - protein, 315 aa, Oryza sativa
  misc_feature (1)..(315): Public GI no. 50926522
  misc_feature (1)..(315): Functional Homolog of  Ceres ANNOT ID no. 541887
MRDLQLSLNQTQRVRLEAALHELQTVAPAAAVTVADTIPVNDEDNILKGHGTSDQDGEVVATLCGVVERVNKLVYVRTLRARYKPEVGDIIVGRVIEIAPKRWRLEINFSQDAVLMLSSMNLPDGIQRRRTAVDELNMRTIFEENDVICAEVRGFQHDGSLHLQARSQKYGKLERGQLLVVPAYLVKRRKQHFHHLEQYDVDLILGCNGFIWVGEHVVVGENANMMENKLNLSAEVENFTPLETRKHICRLANAVRVLSALGFTLTVELIIETAEASVSSNIEINNMLGAEFYVQTAEREVKRRADLLRKKSGAR

SEQ ID NO: 101 - DNA, 1183 bp, Panicum virgatum
  misc_feature (1)..(1183): Ceres CLONE ID no.1791381
attttgctagggttttacctcgccttcctcggcaccgttgcctgatcgcctccacccgcctactcctcttccggtgcttccgaggcggggagatcggccatgagggacctccacctctcactgaaccagactcagcgggtccgcctcgaggcggcgttccacgagctccagtccctcgcgcccgccgccgcgtccgccgccgccgtcaccgtcgcggacaccatccccgtcaaccaggaggacaacatcctcaaggggcacgggacgtcggaccaggacggggaggtggtggcgacgctatgcggggtggtggagcgggtcaacaagctggtctacgtccgtactctccgggcgagatataagccggaggttggtgatatcattgttggacgtatcattgagattgctcctaagcgctggagattggagataaattttagccaggatgctgtgttgatgctttcttccatgaatttgcctgacggcattcagagaaggagaactgctgttgatgaacttaatatgcggagtatctttgaagaaaatgatgttatctgtgctgaagttcgtggtttccaacatgatggatctctgcacctacaagcaaggagtgaaaagtatggaaagcttgagaggggtcaattgctgacggtacctccgtacttggttaaacgaaggaagcagcatttccatcatctcgcacagtatgatgttgatttgattcttggttgcaacggattcatctgggtaggtcagcatgttgtggtgggtgaaaaaactaaaacgacagaggatcagcagaaatccagtgctgatgcagagaatttcaccccactagaaacgaggaagcatatctgccaacttgccaatgccgtgcgtgtactttcagccctaggattcactttgactgttgagctgataattgagacagcggaagcaagtgtgacatcaaatgttgaggtaaacaacatgctgggggctgaattttatgtccagacggctgagagagaggctaagcgccgagctgatctgctgaggaagaagaatggggggaggtaaaataggtgacgccttgatgatcctggctacctgatttgcagagaacagtacctgacatgtagcagtgtgtaaacatttccatttgaggtctggcatttccatcgaaaaaaaaaaaaaaaaaaaa

SEQ ID NO: 102 - protein, 319 aa, Panicum virgatum
  misc_feature (1)..(319): Ceres CLONE ID no. 1791381
  misc_feature (1)..(319): Functional Homolog of  Ceres ANNOT ID no. 541887
MRDLHLSLNQTQRVRLEAAFHELQSLAPAAASAAAVTVADTIPVNQEDNILKGHGTSDQDGEVVATLCGVVERVNKLVYVRTLRARYKPEVGDIIVGRIIEIAPKRWRLEINFSQDAVLMLSSMNLPDGIQRRRTAVDELNMRSIFEENDVICAEVRGFQHDGSLHLQARSEKYGKLERGQLLTVPPYLVKRRKQHFHHLAQYDVDLILGCNGFIWVGQHVVVGEKTKTTEDQQKSSADAENFTPLETRKHICQLANAVRVLSALGFTLTVELIIETAEASVTSNVEVNNMLGAEFYVQTAEREAKRRADLLRKKNGGR

SEQ ID NO: 103 - DNA, 369 bp, Arabidopsis thaliana
  misc_feature (1)..(369): Ceres ANNOT ID no. 542746
atgatccaattgaaagagaatgtaaattatttgaaagagaagaaaaggacattgttacaaggagaactcgggaatctctacgaagggtcgtttcttctacccaaactcagtattcgttcgcgggattcgaccatagaaatgaatctgatcatggatctaaacatgaaaagagtaatgttacacgagcttgtgagtatttttgaagaagaaggagctcaagtaatgagtgctaatcttcagaacttgaatgataggaccacttacacaatcatagcccaggctatcattagtcggattggcattgatccatcaaggatagaagagagagtacggaaaatcatctatggatatatatattttgaagcatga

SEQ ID NO: 104 - protein, 122 aa, Arabidopsis thaliana
  misc_feature (1)..(122): Ceres ANNOT ID no. 542746
MIQLKENVNYLKEKKRTLLQGELGNLYEGSFLLPKLSIRSRDSTIEMNLIMDLNMKRVMLHELVSIFEEEGAQVMSANLQNLNDRTTYTIIAQAIISRIGIDPSRIEERVRKIIYGYIYFEA

SEQ ID NO: 105 - DNA, 899 bp, Arabidopsis thaliana
  misc_feature (1)..(899): Ceres ANNOT ID no. 548715
tattccatcatacaacttccctgaagtgctcttcaaccattacaatcataatttcactaaccttgttcttaatttgaaatgtgaaatgtatatcttgaaagaccggacacgaacttcactcctggattggccaatacgatttgagataatcgtaggcattgcgcgaggcatgtkgtatcttcaccaagactccagattgagagtgattcatagagacctgaaaaccagcaacattcttctagatgaggagatgaatccaaagatatcagacttkggtcttgccaaaatatttgggggaaaagaaacggaagccagtacagagagagtagtgggaacctatggatacatggctccagagtatgccttggacggattcttttcaatcaaatccgacgttttcagctttggagtagtccttctagagattcttagtggaaaaaggaacactggattctatcagtccaagcaaatttctagccttttgggtcatgcatggaagttatggacagagaatwagctactggatttaatggacccatctytttgsgaaacatgcaacgaaaatgaattcattaagtgtgcagtcattggacttttatgsgkacaagatgaaccaagtgatcgacccmctatgtcaaatgttttgtcaatgcttgacatagaggcagtaaccatgccaattcccacgccaccaaccttttttgtgaacaagsgtcattctagctcagcttcctyttctagcaaaccagatataggtcagtttgagagcagttatcaagaaggtcgatagtgcatgattgaagctattgttagagtacgtgtaaaataattaataatattttaattgtattttataacaatttagagtattctgtattatttttaaggatcaattttgg

SEQ ID NO: 106 - protein, 379 aa, Arabidopsis thaliana
  misc_feature (1)..(379): Ceres ANNOT ID no. 548715
  misc_feature (193)..(228): Pfam Name: Sel1 Pfam Description: Sel1 repeat
  misc_feature (307)..(346): Pfam Name: zf-MYND Pfam Description: MYND finger
MLPSRKTKRVFSCDFTPGRKRRRCVVVPSSVSPVPENTTGADLLDSIPDDLVISILCKLGSTSRCPADFINVLLTCKRLKGLAMNPIVLSRLSPKAIAVKAHNWSEYSHRFLKRCVDAGSLEACYTLGMIRFYCLQNRGNGASLMAKAAISSHAPALYSLAVIQFNGSGGSKNDKDLRAGVALCARAAFLGHVDALRELGHCLQDGYGVPQNVSEGRRFLVQANARELAAVLSSGIQARSTWLSLSQPPPPVVPNHGQQTCPLLSDFGCNVPAPETHPANRFLADWFAVRGGDCPGDGLRLCSHAGCGRPETRKHEFRRCSVCGVVNYCSRACQALDWKLRHKMDCAPVQRWLEEGDGGEGNVQIDGNGNGDNVLLPMS

SEQ ID NO: 107 - DNA, 1212 bp, Populus balsamifera subsp. trichocarpa
  misc_feature (1)..(1212): Ceres ANNOT ID no.1447956
atgagaacacggagagggctttcttatcctagaggagcagcagtaaacgcttgtgatacagcagcagggaagaggacggcaacaacaagttataagagagaaagacctgatttcgccgccggagattacctggtttgccggaaaaagaatcgattaatctcaactcaaaaaaccggagagaccgacttgtttgattctttacccgatgatcttgtcatttctatcctctgcaaacttagctcttctgcttcttgcccctccgatttcatcaacgttttacttacgtgcaagagactaaatgggttgggccttcattctctagtactatccaaagcttcgccgaaaacatttgcagtcaaagccaaaaattggtctgattctgctcaccgtttcctcaaactcttcgccgacgctggaaatgttgaagcttgttacactcttggcatgattcggttttactgtttacaaaaccgagggagtggagcttctctgatggccaaggcagcgattagctcatacgcgcctgcactttattcccttgctgttatacaattcaatggaagcggtggctctaaaagcgacaaagaccttcgtgccggcgttgcgctgtgtgcacgcgctgcctttcttggccacatcgacgccctacgcgagctaggacactgcctgcaagacggttatggtgtccggcaaaacgtaacagaaggacggcgtttcctcgtccaagcaaacgcgcgtgaacttgcggctgttttatcgaaacataattctgggttcccaacacgcacttggttctcgtggaacccacacgcgcatcctaaccatcgacaccctactgggaatggacctagcgggtgccctttattgagtgactttgggtgtaatgttccagctcctgagagtcatccggccagtcgttttatgacggaatggtttgctattcggggcgggtcttcgggttctggtctccgcttgtgctctcatactggttgtgggcgttccgagacgagaaagcatgagtttagacggtgttctgtttgtggagctgttaattattgttcacgcgcctgtcaagcacttgactggaagctcaggcataaagaggggtgcgcccctgttgagcggtgggtcgatgaggatggtgagggtggtgcagacggggatgacggtggcgtggatggtgacgacgacgatgtcatgattgagagctaa

SEQ ID NO: 108 - protein, 403 aa, Populus balsamifera subsp. trichocarpa
  misc_feature (1)..(403): Ceres ANNOT ID no. 1447956
  misc_feature (1)..(403): Functional Homolog of  Ceres ANNOT ID no. 548715
  misc_feature (174)..(212): Pfam Name: Sel1 Pfam Description: Sel1 repeat
  misc_feature (331)..(370): Pfam Name: zf-MYND Pfam Description: MYND finger
MRTRRGLSYPRGAAVNACDTAAGKRTATTSYKRERPDFAAGDYLVCRKKNRLISTQKTGETDLFDSLPDDLVISILCKLSSSASCPSDFINVLLTCKRLNGLGLHSLVLSKASPKTFAVKAKNWSDSAHRFLKLFADAGNVEACYTLGMIRFYCLQNRGSGASLMAKAAISSYAPALYSLAVIQFNGSGGSKSDKDLRAGVALCARAAFLGHIDALRELGHCLQDGYGVRQNVTEGRRFLVQANARELAAVLSKHNSGFPTRTWFSWNPHAHPNHRHPTGNGPSGCPLLSDFGCNVPAPESHPASRFMTEWFAIRGGSSGSGLRLCSHTGCGRSETRKHEFRRCSVCGAVNYCSRACQALDWKLRHKEGCAPVERWVDEDGEGGADGDDGGVDGDDDDVMIES

SEQ ID NO: 109 - DNA, 1374 bp, Gossypium hirsutum
  misc_feature (1)..(1374): Ceres CLONE ID no.1923054
aaaggccttgttttgtgcttttcccttctcagtttgctttttctatttcctctccttttatcgtatctcttgcgccgctaaggcacataaaaactgagaaacaaccaacacataagaaaattttgaggtaaagtagatatatttagggtagatttctaggttatagggatagagagaaatgagaacaaggagagggctttgttatcctagagccgatgtttgtgttgataagatagtagttaaacggagggatttcgccggatataatatggcttgccggaaacgccaaagattctcgccggtgattgctggaaacagtgatttgtttgacgctttacccgatgatcttgtcatttccatactctccaagcttagctcttccgcctcttgcccttccgatttcatcaacgttttgattacatgcaagagattaaatagttttgcacttcaacctttggtattatcaaaagcctcttcaaaattgttcgccattaaagctgaaaactggtcggagtcagctcacagattcttgaagtgttgcgccgatgccggaaatgttgaagcttgttacaccctcggcatgattcggttctactgtttgcaaaatcgagggagtggggcttctcttatggctaaggcggcgattagttctcacgcgccggcgctttactccttagctgtaattcagttcaacggcagcggtggctctaagaacgataaggaccttagagccggtgtggctttgtgcgcccgggctgcttttcttggccacatcgatgctttgcgtgagctcggtcactgcctgcaggacgggtacggcgtccgacaaaacatcaccgagggtcgtcggtttctcgtccaagccaacgcccgagagcttgcggcgggtttatcatcagcatctgtttcaaacatcgctacgtgctcttggctcacctggagcccccacccgatcccccacccgaccaaccgtcatccgaacgtgccgggatgcccgttgctgagtgattttggatgcaatgtaccggcgccggaggctcacccggcgaacaagttcttaacggattggttcggctctcgggacgggattcccggcccgggtttgaggctatgctcgcacgttggttgtgggaggccggagacgagaagacacgagttccgccggtgttcggtttgtggtgccgtgaattactgttcacgcgcttgccaggcgctcgattggaaactacgccacaaagccgagtgcgcgccggtagagcggtggctcgacgaagaaggtgtcggtggcgacggaatggatgaagtcattgccgaaagctaaaaatggttacggcgatgttaacggccaggttaatatatcagttttaagacgat

SEQ ID NO: 110 - protein, 380 aa, Gossypium hirsutum
  misc_feature (1)..(380): Ceres CLONE ID no. 1923054
  misc_feature (1)..(380): Functional Homolog of  Ceres ANNOT ID no. 548715
  misc_feature (160)..(198): Pfam Name: Sel1 Pfam Description: Sel1 repeat
  misc_feature (317)..(356): Pfam Name: zf-MYND Pfam Description: MYND finger
MRTRRGLCYPRADVCVDKIVVKRRDFAGYNMACRKRQRFSPVIAGNSDLFDALPDDLVISILSKLSSSASCPSDFINVLITCKRLNSFALQPLVLSKASSKLFAIKAENWSESAHRFLKCCADAGNVEACYTLGMIRFYCLQNRGSGASLMAKAAISSHAPALYSLAVIQFNGSGGSKNDKDLRAGVALCARAAFLGHIDALRELGHCLQDGYGVRQNITEGRRFLVQANARELAAGLSSASVSNIATCSWLTWSPHPIPHPTNRHPNVPGCPLLSDFGCNVPAPEAHPANKFLTDWFGSRDGIPGPGLRLCSHVGCGRPETRRHEFRRCSVCGAVNYCSRACQALDWKLRHKAECAPVERWLDEEGVGGDGMDEVIAES

SEQ ID NO: 111 - protein, 394 aa, Glycine max
  misc_feature (1)..(394): Ceres CLONE ID no. 1051305
  misc_feature (1)..(394): Functional Homolog of  Ceres ANNOT ID no. 548715
  misc_feature (178)..(216): Pfam Name: Sel1 Pfam Description: Sel1 repeat
  misc_feature (326)..(365): Pfam Name: zf-MYND Pfam Description: MYND finger
MRTRRGACYSGVVSRMCSDARVSKKKNKDLHMHMHMHMHVPAGDSIIYSRKRQKKTPEKTAGADYEFFESLPDDLVISIFCKLSSTATKPSDFVNILITCKRLNRLALHSLVLSKASPKTFTIKARDWCDSAHKFLKHCADAGNVEACYTLGMIRFYCLQNRGSGASFMAKAAINSHARALYALAVIQFNGSGGTKSDKDLRAGVALCARAAFLGHVDAMRELGHCLQDGYGVRQNIAEGRRFLVQANARELAAVLSTGAAARTWLSWNLQPQQLRQGSGCPLLSDFGCNVPAPEVHPASLFMAEWFAARGGSPGPGLRLCSHAGCGRPETRKHEFRRCSVCGVVNYCSRACQALDWKFRHKAECSPVQRWLEEDGEDVGNDDGDGEVEVMVDS

SEQ ID NO: 112 - protein, 395 aa, Oryza sativa
  misc_feature (1)..(395): Public GI no. 50923813
  misc_feature (1)..(395): Functional Homolog of  Ceres ANNOT ID no. 548715
  misc_feature (161)..(199): Pfam Name: Sel1 Pfam Description: Sel1 repeat
  misc_feature (327)..(368): Pfam Name: zf-MYND Pfam Description: MYND finger
MRTRRGACYSPASCQDGRRKRRRIAGGGGEGSAAAAAAVAGGAEGPANDMFEELPDDLVVSILADVAASARSPGDLAGAMLTCKRFRELGQSKVVLARASPRCLAVRAKAWSDAAHRFLQRCADAGNLDACYLLGMIRFYCLGSRGSGAALMAAAAVGGHREALYSLAVIQFNGSGGSKDDRDLRAGAALCARAASLGHVDALRELGHCLQDGYGVRRSVLDGRRLLIQANARELAAAVAASASLLRAATGKPAAAASRRHSCLLSDFGCHAAAPKAGGEAHAANRFLVDWFASRPLAGSTAAAAAAPTPGSAAEDEAAGLRLCSHALCGRPETRRHEFRRCSVCGVVNYCSRACQALHWKTAHKAECTPMDRWLDNAAAGAANPNAAAMAAPAP

SEQ ID NO: 113 - DNA, 1633 bp, Panicum virgatum
  misc_feature (1)..(1633): Ceres CLONE ID no.1746793
ccacaagcaccgcaccgcgctcccctgtcgtctcgccctcgccccccgcggccgtttcacccgcttcccccgcctgcgcgcgctccccgtccgtctccggcggcgacgacgacgaagaaccgcggggacagagaaacagagagatgaggactaggagcggttccctgtattccaacaacggaggcgaggccgccgtggggcagaagaggaagaggacggcgtcgccgatggggcagtcggccgtcgccggcgagtgcgccggcggcgggcggaggaagaggctcgcgagagggccggactacctggacgtgctccccgacgacctcgtcctctccatcctgtccaagctcgccgcctccgcctcggcgccctccgaccttgtctccgtgcacctcacatgcaagaagctcaacgagctcggcgggcatgacatggtgttcgccaaggcctcgccggcgtcgctggccgtgaaggcggcagcgtggtcggagccggcgcagaggttcctcaagcgctgtgccgacgccggcaacctcgaggcctgctacattctcggcatgattcgattctactgcctcgggagccggagcagcggcgccgcgctgctggcgagggcggcggtcggcgcgcacgccgcggcgctctactcactggcggtcatccagttcaacggcagcggcggcgccaagtccgaccgggacctccgcgcgggcgcggcgctgtgcgcgcgcgcggccgcgctgggccacgtcgacgcgctccgcgagctcgggcactgcctccaggacggctacggcgtgcggcgcgaccccgccgagggacgccgactcctggtggccgccaacgcccgcgagctcaccctcgcgctcgccgcggccgccgcctcgcgccaccccttcgccgcggcgctcccgctcggcgcggcggtcgagggctccggcgggtgcccgctcctctcggacttcgggtggagcctccccgaggcggacccccacgcggcgaaccagttcatggtggactggtgggcctcccgcggcgcccaggcggcggccgcgaagaagcccgctacaggcggcgacggcgacggcgcggagctccggctgtgctcccacgtccggtgcgggcggcgcgagacccggcggcacgagttccggcggtgctccgtgtgcggcgccgccaactactgctcccgcgcgtgccaggcgctggactggaagcgcgcccacagggcgcaatgcgttcccatggaccggtggctcgccgccaacgccggcgaggcggccccgcagtgacgctgcggcgcgcctccccaacggctgacctgacgtaccagtactactactagagtactagcccctcggcccaccgtagacccggtgtagcaaaggaaggaaaggcgcagcagatggaaatgcacctcggcccttttttttcctctcttttggtccctatcctttctcttttgcgcctctgctgtctgggcgtcgccttgtcagatgtacgtattctactagggaagaggagccgagggatacccgcgcccgtttctgtttttttgagctcttgttttgtctcggttaaagttaccgctagaactcaaatccttattttctaaaaaaaaaaaaaaaaaaaa

SEQ ID NO: 114 - protein, 382 aa, Panicum virgatum
  misc_feature (1)..(382): Ceres CLONE ID no. 1746793
  misc_feature (1)..(382): Functional Homolog of  Ceres ANNOT ID no. 548715
  misc_feature (164)..(202): Pfam Name: Sel1 Pfam Description: Sel1 repeat
  misc_feature (324)..(365): Pfam Name: zf-MYND Pfam Description: MYND finger
MRTRSGSLYSNNGGEAAVGQKRKRTASPMGQSAVAGECAGGGRRKRLARGPDYLDVLPDDLVLSILSKLAASASAPSDLVSVHLTCKKLNELGGHDMVFAKASPASLAVKAAAWSEPAQRFLKRCADAGNLEACYILGMIRFYCLGSRSSGAALLARAAVGAHAAALYSLAVIQFNGSGGAKSDRDLRAGAALCARAAALGHVDALRELGHCLQDGYGVRRDPAEGRRLLVAANARELTLALAAAAASRHPFAAALPLGAAVEGSGGCPLLSDFGWSLPEADPHAANQFMVDWWASRGAQAAAAKKPATGGDGDGAELRLCSHVRCGRRETRRHEFRRCSVCGAANYCSRACQALDWKRAHRAQCVPMDRWLAANAGEAAPQ

SEQ ID NO: 115 - protein, 385 aa, Triticum aestivum
  misc_feature (1)..(385): Ceres CLONE ID no. 843382
  misc_feature (1)..(385): Functional Homolog of  Ceres ANNOT ID no. 548715
  misc_feature (154)..(192): Pfam Name: Sel1 Pfam Description: Sel1 repeat
  misc_feature (312)..(353): Pfam Name: zf-MYND Pfam Description: MYND finger
MKTRRGACYSCHESAAAEAPEMHRRKRRRTAMEAAGCAAVGDMFEDLPDDLLVSILADVAASARSPADLAGAIMTCKRFRELGQSKVVLAKVSPRCLAVRAKSWSDSAHRFLQGCADAGNLDACYLLGMIRFYCLGSRGSGAALMAAAAVGGHREALYSLAVIQFNGSGGSKDDRDLRAGAALCARAASLGHVDALRELGHCLQDGYGVRRSLLDGRRLLIQANARELAAAVTTSASLLRAAAGSGKASRRHSCLLSDFGCRAAAAAAGEAHAANRFLVEWFALRPLGAESSPAPAPAPAEEGGGLRLCSHALCGRPETRRHEFRRCSVCGVVNYCSRACQALHWKMAHKAECTPMDRWLDGANANPNPNAVAGAGDAAVAAPAL

SEQ ID NO: 116 - protein, 328 aa, Zea mays
  misc_feature (1)..(328): Ceres CLONE ID no. 1540519
  misc_feature (1)..(328): Functional Homolog of  Ceres ANNOT ID no. 548715
  misc_feature (153)..(191): Pfam Name: Sel1 Pfam Description: Sel1 repeat
  misc_feature (192)..(227): Pfam Name: Sel1 Pfam Description: Sel1 repeat
  misc_feature (275)..(314): Pfam Name: zf-MYND Pfam Description: MYND finger
MRKPTRRRGTSAKGSSGGGISKAATLPAKQMVLSGYRGTVDAFDCLPDDLVLAVLAGIAARARCPADLAAAALPCRRFRDLAAHPAVLSRASAAAVAVPAGRWSDAAHRFLRRCAASGNLHACYLLGMVLFYCIGGRATGAALLARSAAGGHAAALYALAVVQFNGSGGDKADKDPRAGVALCARAAWLGHVPALRELGHCLQDGYGARRAAATGRYFLLHAAARELVSSHCRNGEDDAASRFMAEWWALPSKTGAQGDGNDADADARLCSHPRCGRRETRRHEFRQCSACGSAIYCSRACQALHWKRAHRSQCAAAASRWLAAGNAQ

SEQ ID NO: 117 - protein, 328 aa, Zea mays
  misc_feature (1)..(328): Ceres CLONE ID no. 488960
  misc_feature (1)..(328): Functional Homolog of  Ceres ANNOT ID no. 548715
  misc_feature (153)..(191): Pfam Name: Sel1 Pfam Description: Sel1 repeat
  misc_feature (192)..(227): Pfam Name: Sel1 Pfam Description: Sel1 repeat
  misc_feature (275)..(314): Pfam Name: zf-MYND Pfam Description: MYND finger
MRKPTRRRGTSAKGSSGGGISKAATLPAKQMVLSGYRGTVDAFDCLPDDLVLAVLAGIAARARCPADLAAAALPCRRFRDLAAHPAVLSRASAAAVAVPAGRWSDAAHRFLRRCAASGNLHACYLLGMVLFYCIGGRATGAALLARSAAGGHAAALYALAVVQFNGSGGDKADKDPRAGVALCARAAWLGHVPALRELGHCLQDGYGARRAAATGRYFLLHAAARELVSSHCRNGEDDAASRFMVEWWALPSKTGAQGDGNDADADARLCSHPRCGRRETRRHEFRQCSACGSAIYCSRACQALHWKRAHRSQCAAAASRWLAAGNAQ

SEQ ID NO: 118 - DNA, 786 bp, Arabidopsis thaliana
  misc_feature (1)..(786): Ceres ANNOT ID no. 549656
atggaagatattcataatctcgatatagagaaaagtgatagatcgatttggttgatgaagtgtcctgtagttgtagacaaggcatggcacaagatagcagcttcgtcgtcttcttcttttgcttcctcggattctcctcccgacatggcaaagattgttcgcgaagttgatcctctacgggacgattctccccccgagttcaaaatgtatatggttggtgctgagtatgggaacatgccaaagtgctacgctttgaacatgttcacagactttgttccgatggggggcttttccgatgttaatcaaggttgtgcagctgctgaaggaaaggttgatcacaaattcgatatgaagccatatggtgaaaccattgaagaatatgctaggctttgtcgtgagagaacgagcaaagccatggttaaaaatcgacagattcaggttattgataatgaccgcggagttcatatgaggcccatgcctggaatgcttggtttagtttcctccaattccaaggaaaagaggaaacctcccccagtcaagcaaaccgaggtgaagaggacgaggagagatcgtggtgagcttgaagctataatgttcaagctatttgaaggccagcctaactggacattgaagcagcttgtacaagagacggaccagccagctcagttcctgaaagaaatactaaacgagctgtgcgtgtacaataagagaggatcgaaccaagggacatatgagcttaaacctgaatacaagaaatctgctgaagatgatacaggtgggcagtga

SEQ ID NO: 119 - protein, 261 aa, Arabidopsis thaliana
  misc_feature (1)..(261): Ceres ANNOT ID no. 549656
  misc_feature (127)..(260): Pfam Name: TFIIF_beta Pfam Description: Transcription initiation factor IIF, beta subunit
MEDIHNLDIEKSDRSIWLMKCPVVVDKAWHKIAASSSSSFASSDSPPDMAKIVREVDPLRDDSPPEFKMYMVGAEYGNMPKCYALNMFTDFVPMGGFSDVNQGCAAAEGKVDHKFDMKPYGETIEEYARLCRERTSKAMVKNRQIQVIDNDRGVHMRPMPGMLGLVSSNSKEKRKPPPVKQTEVKRTRRDRGELEAIMFKLFEGQPNWTLKQLVQETDQPAQFLKEILNELCVYNKRGSNQGTYELKPEYKKSAEDDTGGQ

SEQ ID NO: 120 - protein, 261 aa, Arabidopsis thaliana; identical to SEQ ID NO: 119
  misc_feature (1)..(261): Public GI no. 39545896
  misc_feature (1)..(261): Functional Homolog of  Ceres ANNOT ID no. 549656
  misc_feature (127)..(260): Pfam Name: TFIIF_beta Pfam Description: Transcription initiation factor IIF, beta subunit

SEQ ID NO: 121 - protein, 261 aa, Arabidopsis thaliana; identical to SEQ ID NO: 119
  misc_feature (1)..(261): Ceres CLONE ID no. 24161
  misc_feature (1)..(261): Functional Homolog of  Ceres ANNOT ID no. 549656
  misc_feature (127)..(260): Pfam Name: TFIIF_beta Pfam Description: Transcription initiation factor IIF, beta subunit

SEQ ID NO: 122 - protein, 262 aa, Glycine max
  misc_feature (1)..(262): Ceres CLONE ID no. 463643
  misc_feature (1)..(262): Functional Homolog of  Ceres ANNOT ID no. 549656
  misc_feature (106)..(262): Pfam Name: TFIIF_beta Pfam Description: Transcription initiation factor IIF, beta subunit
MDEENGYSGSISSNLETTKAERSVWLMKCPLVVAKSWQTHPPSQPLAKVVLSLDPLHPEEDDPSAVQFTMEMAGTEAVNMSKTYSLNMFKDFVPMCVFSETSQGGKVAMEGKVEHKFDMKPHGENIEEYGKLCRERTNKSMIKNRQIQVIDNDRGVLMRPMPGMIGLVSSNSKDKKKTQPVKQSDTKRTRRDRGELEDIMFKLFERQPNWALKQLVQETDQPAQFLKEILNELCVYNKRGANQGTYELKPEYKKSVEDTSAE

SEQ ID NO: 123 - DNA, 798 bp, Populus balsamifera subsp. trichocarpa
  misc_feature (1)..(798): Ceres ANNOT ID no.1442640
atggaggaagatcacagtaatggtggaaatagcagcagcagcggtaatttagaaacatcgaaggctgataaagctgtttggctaatgaagtgtccagtagtggttgcaaagtcatggaagagtcatcatacctcttcttcagattctgctccgctcgctaaagtcgttctctccctcgatcctctccaatctgacgatccctctgctattcagttcactatggagatggctcgcactgagactgggaatgtgccgaagagttattctttgaatatgtttaaggactttgttccgatgggtgtcttttcggagacacctcaagggagggtttccatggaaggaaaagttgaacataaatttgacatgaagcctcacgaggaaaacattgaggaatatagtaaattatgccgtgacaggacgaaaaagtctatgatcaagaataggcagatacgggtgattgataatgaccgtggggtgcacatgaggcccatgcctggaatggtcggcctgatttcatctacctccaaggataagaagaaaacacaaccagttaaacaatcagatgtgaagagaaccaggagggatcgtggtgaattggaggatatcatgttcaagttatttgaaaggcaaccaaattgggccttaaagcagcttgttcaagaaacagatcaacctgcgcaattcttgaaagagatactgaatgagctttgtgtgtacaataagcggggaacaaaccaaggaacttatgagctaaaaccagaatataagaaaactgctgaggatacaggtgctgattaa

SEQ ID NO: 124 - protein, 265 aa, Populus balsamifera subsp. trichocarpa
  misc_feature (1)..(265): Ceres ANNOT ID no. 1442640
  misc_feature (1)..(265): Functional Homolog of  Ceres ANNOT ID no. 549656
  misc_feature (112)..(265): Pfam Name: TFIIF_beta Pfam Description: Transcription initiation factor IIF, beta subunit
MEEDHSNGGNSSSSGNLETSKADKAVWLMKCPVVVAKSWKSHHTSSSDSAPLAKVVLSLDPLQSDDPSAIQFTMEMARTETGNVPKSYSLNMFKDFVPMGVFSETPQGRVSMEGKVEHKFDMKPHEENIEEYSKLCRDRTKKSMIKNRQIRVIDNDRGVHMRPMPGMVGLISSTSKDKKKTQPVKQSDVKRTRRDRGELEDIMFKLFERQPNWALKQLVQETDQPAQFLKEILNELCVYNKRGTNQGTYELKPEYKKTAEDTGAD

SEQ ID NO: 125 - DNA, 786 bp, Populus balsamifera subsp. trichocarpa
  misc_feature (1)..(786): Ceres ANNOT ID no.1452795
atggaagaagataacagcagtagcagcgctaatttagaaacatcaaaggcagataaatctgtttggttgatgaagtgtccagtagtggttgcgaagtcatggaaaactcatacctccccttcttcttcagattctgcccctctcgctaaagtcgttctctccctcgatcctctccaatctgacgatccctctgctcttcagttcactatggagatggctcgcaccgaggctgggaatgtaccgaagagttattctttgaatatgtttaaagactttgttcctatgtgcgtcttttccgagacacctcaagggaaggtcgccatggaagggaaagtggaacataaatttgatatgaagccccatgagcagaacattgaggagtatcataaattgtgccgtgaaaggacgaagaaatctatggttaagattaggcagatacaggtgattaataatgaccgtggagttcacatgaggcccatgcctggaatggttggcttgatttcatctagctccaaggataagaagagaccacaaccagttaaacaatcagacgttaagagaaccaggagggatcgtggggaattggaagatatcatgttcaagttatttgaaagacaaccaaattgggccttaaagcagcttgttcaagaaacagatcaacctgcgcaattcttgaaagagatactgaatgagctctgtgtgtacaataagcggggaacaaaccaaggaacttatgaacttaagccagaatataagaaaactgttgaggatacaggtgctgattaa

SEQ ID NO: 126 - protein, 261 aa, Populus balsamifera subsp. trichocarpa
  misc_feature (1)..(261): Ceres ANNOT ID no. 1452795
  misc_feature (1)..(261): Functional Homolog of  Ceres ANNOT ID no. 549656
  misc_feature (101)..(261): Pfam Name: TFIIF_beta Pfam Description: Transcription initiation factor IIF, beta subunit
MEEDNSSSSANLETSKADKSVWLMKCPVVVAKSWKTHTSPSSSDSAPLAKVVLSLDPLQSDDPSALQFTMEMARTEAGNVPKSYSLNMFKDFVPMCVFSETPQGKVAMEGKVEHKFDMKPHEQNIEEYHKLCRERTKKSMVKIRQIQVINNDRGVHMRPMPGMVGLISSSSKDKKRPQPVKQSDVKRTRRDRGELEDIMFKLFERQPNWALKQLVQETDQPAQFLKEILNELCVYNKRGTNQGTYELKPEYKKTVEDTGAD

SEQ ID NO: 127 - protein, 263 aa, Triticum aestivum
  misc_feature (1)..(263): Ceres CLONE ID no. 704938
  misc_feature (1)..(263): Functional Homolog of  Ceres ANNOT ID no. 549656
  misc_feature (105)..(261): Pfam Name: TFIIF_beta Pfam Description: Transcription initiation factor IIF, beta subunit
MGDEAKYLETARADRSVWLMKCPPVVSQAWQGASSSSGDANPNPVVAKVVLSLDPLSSAEPSLQFKMEMSQTSVASTCNLPKSYSLNMFKDFVPMCVFSETNQGKLSCEGKVEHKFDMEPHKDNLLNYAKLCRERTQKSMVKTRKVQVLDNDHGMSMRPMPGMVGLISSSSKEKRKPTPTKPSDVKRTRRDRRELENIIFKLFEKQPNWALKALVQETDQPEQFLKEILNDLCMYNKRGPNQGTHELKPEYKKSSEDAAGAAP

SEQ ID NO: 128 - protein, 269 aa, Zea mays
  misc_feature (1)..(269): Ceres CLONE ID no. 281395
  misc_feature (1)..(269): Functional Homolog of  Ceres ANNOT ID no. 549656
  misc_feature (194)..(269): Pfam Name: TFIIF_beta Pfam Description: Transcription initiation factor IIF, beta subunit
MAEEAKYLETARADRSVWLMKCPPVVSRAWQAASASASSSDAANANPVVAKVVLSLDLLRPEERPEERPEEPTLQFKMELAQTNTGNTPKSYSLNMFKDFVPMCVFSESNQGKLSCEGKVEHKFDMEPHSDNLANYGKLCRERTQKYMVKSRQVQVLDNDHGMSMRPMPGLVGLIPSGSKEKKKQAPAKPSDVKRTRRDRTEMENIIFKLFERQPNWALKALVQETDQPEQFLKEILNDLCVYNKRGPNQGTHELKPEYKKSTGDTDAA

SEQ ID NO: 129 - DNA, 1172 bp, Panicum virgatum
  misc_feature (1)..(1172): Ceres CLONE ID no.1784166
gagctttccgccttcgttctccgcagtgtcagatcggccgtcgcgcgccgagcccgagccctagcgccgccgctcgccccgcctcccagtcctgacctctgaggaacagcgagggccttgcggttgcggatcggggatcgcgccgcggcggcgggacgacccgatgggcgaggaagccaagtacctggagacggcgcgggccgaccgctctgtgtggctcatgaagtgccccccggtcgtctcccgcgcctggcaggccgcctccgcctcgtcctcctccgacgccgccaaccccaaccccgtcgtcgccaaggtcgtcctctccctcgacctgcccagcggcgaagagcagcaagagccttccctccagttcaagatggagttggctcaaactaacactggcaatacacctaaaagctactctttgaacatgttccaagatttcgtgcccatgtgtgttttctcggaatctaaccaagggaaactttcatgtgaaggaaaagttgagcataaatttgacatggaaccacacagtgataatttggtgaactatggaaagttatgccgtgaaagaacacagaaatatatggttaaatccagacaagtgcaggtacttgacaatgaccacggcatgagcatgagaccaatgcccggcatggtcggtctaataccttctggttcaaaggagaagaagaagcaaacaccagccaaaccatctgatgtcaaaagaactcgtagggatcgcacggaaatggaaaatattatattcaagctttttgaaaggcagcctaattgggcactaaaggcgctagtgcaagaaactgaccagccggagcaattcctgaaggagatactgaatgatctctgtgtatacaacaaacgaggaccgaaccaggggacgcacgagctcaagcctgaatacaagaaatccacaggcgatactgatgctgcttgaagatgcaagtccatttatctgtagttttatgagtgagagatactgacaacctgttggcctgacatgcgaaaacattagctctctgttggtagctcaggcttcatgtttgtaaacatgagatgattcagtttcctttgcatgctttgagaggcatggtttgtaaggatatgtataagctggatacacattgtttacagaaaaaaaaaaaaaaaaaaaa

SEQ ID NO: 130 - protein, 263 aa, Panicum virgatum
  misc_feature (1)..(263): Ceres CLONE ID no. 1784166
  misc_feature (1)..(263): Functional Homolog of  Ceres ANNOT ID no. 549656
  misc_feature (188)..(263): Pfam Name: TFIIF_beta Pfam Description: Transcription initiation factor IIF, beta subunit
MGEEAKYLETARADRSVWLMKCPPVVSRAWQAASASSSSDAANPNPVVAKVVLSLDLPSGEEQQEPSLQFKMELAQTNTGNTPKSYSLNMFQDFVPMCVFSESNQGKLSCEGKVEHKFDMEPHSDNLVNYGKLCRERTQKYMVKSRQVQVLDNDHGMSMRPMPGMVGLIPSGSKEKKKQTPAKPSDVKRTRRDRTEMENIIFKLFERQPNWALKALVQETDQPEQFLKEILNDLCVYNKRGPNQGTHELKPEYKKSTGDTDAA

SEQ ID NO: 131 - protein, 277 aa, Oryza sativa
  misc_feature (1)..(277): Public GI no. 56785216
  misc_feature (1)..(277): Functional Homolog of  Ceres ANNOT ID no. 549656
  misc_feature (200)..(276): Pfam Name: TFIIF_beta Pfam Description: Transcription initiation factor IIF, beta subunit
MAEEAKNLETARADRSVWLMKCPTVVSRAWQEAATAAASSSSSSDAAAGANSNSNANPNPVVAKVIVSLDPLRSEDQQLQFKMEMAQTGNGNTPKSYSLNMFKDFVPMCVFSESNQGKLSCEGKVGHKFDMEPHSDNLVNYGKLCRERTQKSMIKNRKLMVLANDNGMSMRPLPGLVGLMSSGPKQKEKKPLPVKPSDMKRTRRDRRELENILFKLFERQPNWSLKNLMQETDQPEQFLKEILNDLCFYNKRGPNQGTHELKPEYKKSTEDADATAT

SEQ ID NO: 132 - protein, 261 aa, Oryza sativa
  misc_feature (1)..(261): Public GI no. 34909946
  misc_feature (1)..(261): Functional Homolog of  Ceres ANNOT ID no. 549656
  misc_feature (184)..(260): Pfam Name: TFIIF_beta Pfam Description: Transcription initiation factor IIF, beta subunit
MAEEAKNLETARADRSVWLMKCPTVVSRAWQEAATAAASSSSSSDAAAGANSNSNANPNPVVAKFKMEMAQTGNGNTPKSYSLNMFKDFVPMCVFSESNQGKLSCEGKVGHKFDMEPHSDNLVNYGKLCRERTQKSMIKNRKLMVLANDNGMSMRPLPGLVGLMSSGPKQKEKKPLPVKPSDMKRTRRDRRELENILFKLFERQPNWSLKNLMQETDQPEQFLKEILNDLCFYNKRGPNQGTHELKPEYKKSTEDADATAT

SEQ ID NO: 133 - DNA, 489 bp, Arabidopsis thaliana
  misc_feature (1)..(489): Ceres ANNOT ID no. 550729
atgggtctatcaagtcttcctggtccatcagaaggaatgttatgtgtgatattagttaatacagcattatcgatctccattgtcaaaggcattgtaagatcattccttggcatagtaggaatcagtctctcgccgtcttcatcctcgccttcttcggtgacggtatcttcagagaattcatcaacttcagagtcatttgatttccgggtctgccaaccagagagttaccttgaggagttcaggaaccggactccgacactgaggtttgagagcttgtgcaggtgcaagaaacaggcagacaatgagtgttctgtgtgtttgtcgaaattccaaggggattcagagatcaacaagctcaagtgcggccatttgtttcacaaaacatgcttggagaaatggatagactattggaacatcacttgcccattgtgtaggactcctcttgttgttgtgccagaagaccatcagctttcttctaatgtttggtga

SEQ ID NO: 134 - protein, 162 aa, Arabidopsis thaliana
  misc_feature (1)..(162): Ceres ANNOT ID no. 550729
  misc_feature (103)..(144): Pfam Name: zf-C3HC4 Pfam Description: Zinc finger, C3HC4 type (RING finger)
MGLSSLPGPSEGMLCVILVNTALSISIVKGIVRSFLGIVGISLSPSSSSPSSVTVSSENSSTSESFDFRVCQPESYLEEFRNRTPTLRFESLCRCKKQADNECSVCLSKFQGDSEINKLKCGHLFHKTCLEKWIDYWNITCPLCRTPLVVVPEDHQLSSNVW

SEQ ID NO: 135 - protein, 162 aa, Arabidopsis thaliana; identical to SEQ ID NO: 134
  misc_feature (1)..(162): Public GI no. 15228108
  misc_feature (1)..(162): Functional Homolog of  Ceres ANNOT ID no. 550729
  misc_feature (103)..(144): Pfam Name: zf-C3HC4 Pfam Description: Zinc finger, C3HC4 type (RING finger)

SEQ ID NO: 136 - protein, 164 aa, Thellungiella halophila
  misc_feature (1)..(164): Public GI no. 20340241
  misc_feature (1)..(164): Functional Homolog of  Ceres ANNOT ID no. 550729
  misc_feature (102)..(143): Pfam Name: zf-C3HC4 Pfam Description: Zinc finger, C3HC4 type (RING finger)
MGLSSLPGPSEGMLCVILVNTALSISIFKGIVRSVLHVLGIRLSQSSSSPSSVTASSEIPASEPFDFRVSHPESFLEEFRNKTPTLRYESLCRCKKHEDNECSVCLSKFEEDSEINKLKCGHLFHKTCLEKWIDYWNITCPLCRTPLVVVAAAEDQKQLSSNVW

SEQ ID NO: 137 - protein, 155 aa, Glycine max
  misc_feature (1)..(155): Ceres CLONE ID no. 473509
  misc_feature (1)..(155): Functional Homolog of  Ceres ANNOT ID no. 550729
  misc_feature (100)..(141): Pfam Name: zf-C3HC4 Pfam Description: Zinc finger, C3HC4 type (RING finger)
MGLSSLPAPSEGVLCVLLVNTVLSISIFKGIVRTILHIVGIHLSSSSSTSPSSPDPSLTAPESFEFHLSPSESYIEEFRSRTPTLRFDSVCCCKQPEHDCSVCLTQFEPESEINRLSCGHLFHKVCLEKWLDYWNITCPLCRTPLMPEDDTPCFQ

SEQ ID NO: 138 - DNA, 462 bp, Populus balsamifera subsp. trichocarpa
  misc_feature (1)..(462): Ceres ANNOT ID no.1525600
atgggtctatcaagtctgccagctccatctgaaggagtattatgtgtgcttttagtaaacactgccttgtcaatttccattgtcaaaggaatagtccgttcaatccttcatattgttggcatccgtttgtcaccatctgcatcactcccatcgtcagataatgctgaagacaccagagagtcgcttgaatttcgtttaagtcccccagagaattacattgaggagttccgaagcaggatgccatcaatccgattcaacacggtgtgcagctgtgaacagcctgaacatgactgctcggtttgcctgacccaatttgagccagaatcggagataaatagcctgtcatgtggccatatctttcataaaatgtgcttggagaagtggttggactattggaacattacatgccctctttgcaggactcctttgctgcctgaagaggatgcatcttgcttttggtga

SEQ ID NO: 139 - protein, 153 aa, Populus balsamifera subsp. trichocarpa
  misc_feature (1)..(153): Ceres ANNOT ID no. 1525600
  misc_feature (1)..(153): Functional Homolog of  Ceres ANNOT ID no. 550729
  misc_feature (98)..(139): Pfam Name: zf-C3HC4 Pfam Description: Zinc finger, C3HC4 type (RING finger)
MGLSSLPAPSEGVLCVLLVNTALSISIVKGIVRSILHIVGIRLSPSASLPSSDNAEDTRESLEFRLSPPENYIEEFRSRMPSIRFNTVCSCEQPEHDCSVCLTQFEPESEINSLSCGHIFHKMCLEKWLDYWNITCPLCRTPLLPEEDASCFW

SEQ ID NO: 140 - DNA, 886 bp, Gossypium hirsutum
  misc_feature (1)..(886): Ceres CLONE ID no.1922929
aagaagcctatcttatttcttggccataaactattaacaagatgccatttaaaaaagaaaaaaaaaccatctttatcaatgttccactgatatcacatccaccagttgaattgcaggttaccagggtttagccattgcttttcatttgaagctctcctccccattgtttttaaggtcatatatttattatatattatcagcacaaaaagaaaaaaatgggtctctcaagtcttccagctccatcagaaggagtgttatgtatactcttggtaaacacagctttatctatatctatagttaaaggcataatccgatcgatccttcacgttgtcggtatccatctcccaccaccatcatcggattacactgaaaatctctcggaatcattcgatttccaccttaatactcctgaaagttacattgaggaattccggagtaggaccccaacaattcatttcggtgctgttgtatgtagctgcaaacggcctcagcacgactgtcaggtttgtctgactcagtttgagccaaaatccgagattaaccacttgtcgtgtggccatctctttcacaaggtgtgtttggaaaaatggttggattattggaatattacatgccctctttgcaggactcccttgttgcctgaagaagaagcttcttgctttttgtaagaagattattatcaagtatattattatgcagagttgaggaattcccgtgtacagcgcggtatataaaagtatactgttatctttatcgagtgttgtcgttacccgcaagtttgtactttgctgtggtgatttgtgttatttgaatcaatgcacatattgttgtctgggttaatgatatgttattatatgcagtctcacaaaaaaaaaaaaaaaaaaaa

SEQ ID NO: 141 - protein, 150 aa, Gossypium hirsutum
  misc_feature (1)..(150): Ceres CLONE ID no. 1922929
  misc_feature (1)..(150): Functional Homolog of  Ceres ANNOT ID no. 550729
  misc_feature (95)..(136): Pfam Name: zf-C3HC4 Pfam Description: Zinc finger, C3HC4 type (RING finger)
MGLSSLPAPSEGVLCILLVNTALSISIVKGIIRSILHVVGIHLPPPSSDYTENLSESFDFHLNTPESYIEEFRSRTPTIHFGAVVCSCKRPQHDCQVCLTQFEPKSEINHLSCGHLFHKVCLEKWLDYWNITCPLCRTPLLPEEEASCFL

SEQ ID NO: 142 - DNA, 1083 bp, Gossypium hirsutum
  misc_feature (1)..(1083): Ceres CLONE ID no.1841236
attgccagaccttgaaaaagcttacaattttttttttatatataatttctgctggaaaaaaacccagttcccttttcagttcttggtaccttggctgaccatttttgtgttaccagggtttagccattacttttcatttgaagctgtcctccccattgtttttaaggtcatatattatatattatcagcacaaaaagaaaaaaatgggtctctcaagtcttccagctccatcagaaggagtgttatgtatactcttggtaaacacagctttatctatatctatagttaaaggcataatccgatcgatccttcacgttgtcggtatccatctcccacaaccaccatcggattacactgaaaatccctcggaagcgaatgatttccaccttaatactcctgaaagttacatcgaggaattccggagtaggaccccaacaattcatttcggtgctgttttatgtagctgcaaacggcctcagcacgactgtcgggtttgtctgactcagtttgagccaaaatccgagattaaccacttgtcgtgtggtcatctctttcacaaggtgtgtttggaaaaatggttggattattggaatattacatgccctctttgcaggactcctttgttgactgaagaagaagcttcttgcttttggtaagaagattattaccaagtatattattatgcagagttgaggaattcccgtgtacagcgcggtatataaaaatatactgttatctttatcattctgggttttgtgataggcaagcgagtgttgtcgttacccgcaagtttgtaccttgctgtggtgatttgtgttatttgaatcaatgcacatattgttgtctgggttaatgatatgttattatatgcagtctcacacttgtttcttgatcatccacatatatatagttcatggagattttgtttaattttttgcctttttatgcaatgggaaagattgaaaattgagttaggaagttgctgggactaaaatctgtttgacaggatctgccttgtaatgaacttagctgttctataaaaaaaaaaaaaaaaaaaaaaaaaaaaaaaaaaaaaaaaaaaaa

SEQ ID NO: 143 - protein, 150 aa, Gossypium hirsutum
  misc_feature (1)..(150): Ceres CLONE ID no. 1841236
  misc_feature (1)..(150): Functional Homolog of  Ceres ANNOT ID no. 550729
  misc_feature (95)..(136): Pfam Name: zf-C3HC4 Pfam Description: Zinc finger, C3HC4 type (RING finger)
MGLSSLPAPSEGVLCILLVNTALSISIVKGIIRSILHVVGIHLPQPPSDYTENPSEANDFHLNTPESYIEEFRSRTPTIHFGAVLCSCKRPQHDCRVCLTQFEPKSEINHLSCGHLFHKVCLEKWLDYWNITCPLCRTPLLTEEEASCFW

SEQ ID NO: 144 - DNA, 894 bp, Gossypium hirsutum
  misc_feature (1)..(894): Ceres CLONE ID no.1931361
attgccagaccttgaaaaagcttacaattttttttttatatataatttctgcaggaaaaaaacccagttcccttttcagttcttggtaccttggctgaccatttttgtgttaccagggtttagccattacttttcatttgaagctgtcctccccattgtttttaaggtcatatattatatattatcagcacaaaaagaaaaaaatgggtctctcaagtcttccagctccatcagaaggagtgttatgtatactcttggtaaacacagctttatctatatctatagttaaaggcataatccgatcgatccttcacgttgtcggtatccatctcccacaaccaccatcggattacactgaaaatccctcggaagcgaatgatttccaccttaatactcctgaaagttacatcgaggaattccggagtaggaccccaacaattcatttcggtgctgttttatgtagctgcaaacggcctcagcacgactgtcgggtttgtctgactcagtttgagccaaaatccgagattaaccacttgtcgtgtggtcatctctttcacaaggtgtgtttggaaaaatggttggattattggaatattacatgccctctttgcaggactcctttgttgactgaagaagaagcttcttgcttttggtaagaagattattaccaagtatattattatgcagagttgaggaattcccgtgtacagcgcggtatataaaaatatactgttatctttatcattctgggttttgtgataggcaagcgagtgttgtcgttacccgcaagtttgtaccttgctgtggtgatttgtgttatttgaatcaatgcacatattgttgtctgggttaatgatatgttattatatgcagtctcacacttgtttcttgatc

SEQ ID NO: 145 - protein, 150 aa, Gossypium hirsutum; identical to SEQ ID NO: 143
  misc_feature (1)..(150): Ceres CLONE ID no. 1931361
  misc_feature (1)..(150): Functional Homolog of  Ceres ANNOT ID no. 550729
  misc_feature (95)..(136): Pfam Name: zf-C3HC4 Pfam Description: Zinc finger, C3HC4 type (RING finger)

SEQ ID NO: 146 - protein, 158 aa, Poncirus trifoliata
  misc_feature (1)..(158): Public GI no. 76446335
  misc_feature (1)..(158): Functional Homolog of  Ceres ANNOT ID no. 550729
  misc_feature (101)..(142): Pfam Name: zf-C3HC4 Pfam Description: Zinc finger, C3HC4 type (RING finger)
MGLASMPSASEGMLCLILMNTAMPISIVKGIFRSILKVVGFQLAESSSTPYSYFASPQVVSAEPYDVNLSPPLSYVEEFRNQNPAIKYETLLHCEDAEHDCSVCLTEFEPQSDINNLSCGHLFHKVCLEKWLDYLNVTCPLCRTPLIPEFEDDPSCFW

SEQ ID NO: 147 - protein, 156 aa, Hevea brasiliensis
  misc_feature (1)..(156): Public GI no. 37901055
  misc_feature (1)..(156): Functional Homolog of  Ceres ANNOT ID no. 550729
  misc_feature (100)..(141): Pfam Name: zf-C3HC4 Pfam Description: Zinc finger, C3HC4 type (RING finger)
MCLSNLPASSEGVICVVVMNTALSISIFKGIVRSVLHIVDNRLAPFSSSSSSILFPDYSDTESFEFPLHSSDDCVRELRSRRPAKRFDAVSSCKQPQHDCPVCLIQFKPDSEINCLSCGHVFHKACLEKWLDYRKVTCPLCKSPVMPEEEDTSSSW

SEQ ID NO: 148 - DNA, 1611 bp, Arabidopsis thaliana
  misc_feature (1)..(1611): Ceres ANNOT ID no. 554970
atgaacaacgttcttcagtttggtctccagagctccgccatatatgtcgccaagtttctggtggtgcctcttaggagtttgagagttggttcatctttcgttggagttggagtgggaacaagaagtttcaacaagaggctaatgtcaaatgctacagctttctctatcaacaacagcaagcgaaaggaactcaagataccaggagcagctattgatcagaattgtcatcagatgggaagtgatactgatagagatgaaatgggaactcttcaagatgatcgaaaggaaattgaggcgatgactgttcaagaacttagatccacgttgaggaaacttggggtacctgtgaaaggacgcaaacaagaacttatctcaactttacgacttcatatggacagcaatttacctgatcaaaaggaaacttcttcgtccacccgttcggatagtgtcaccatcaaaagaaagatcagcaacagggaagagcctactgaagatgaatgcactaactctgaagcttatgacattgaacacggagaaaaaagagtaaaacagtctactgagaaaaacttgaaagctaaagtttctgcgaaagctatcgcgaaagaacagaagtcattgatgagaacaggtaagcagcaaattcagtcaaaagaagaaacatcatcgaccatctctagtgaattactgaaaactgaagaaattatctcatccccgagtcaaagtgaaccgtggactgtacttgctcataagaagcctcagaaggactggaaagcttacaacccaaagacaatgagacctccccctctaccagagggtaccaaatgtgtgaaagttatgacttggaatgttaatggactgagaggattgttgaagtttgagagcttctctgctctgcagcttgcccaaagagaaaattttgacatcttgtgcttgcaggagactaaactccaggtgaaagatgttgaggaaattaagaaaactcttattgatggctatgatcatagtttctggtcctgcagcgtctcaaaacttggctactctggaactgcaataatctcacggataaaaccactctcagttagatatggtactggtctatctggtcatgacacggaagggcgtattgtaactgctgaattcgactccttctacttgataaatacttatgtccctaattccggagatggattaaaaagactgtcatacaggatcgaagaatgggatcgaaccctcagcaatcacatcaaagagctggagaagtctaagcctgtagtcttgacgggtgatctaaactgtgctcatgaagaaattgacatcttcaatcctgcggggaacaaaagaagtgctggttttacaatagaagaaaggcagtcctttggtgcaaacttgttagacaagggatttgtagatacctttagaaaacaacatcctggtgttgtcggttacacttattggggttatcgccatggtggccgcaaaaccaacaaaggatggagactggactacttcttggtgtcccaatcaattgcggccaatgtccatgattcttacatcctccctgatatcaatggaagtgatcattgccccattggccttattctcaagctctga

SEQ ID NO: 149 - protein, 536 aa, Arabidopsis thaliana
  misc_feature (1)..(536): Ceres ANNOT ID no. 554970
  misc_feature (276)..(534): Pfam Name: Exo_endo_phos Pfam Description: Endonuclease/Exonuclease/phosphatase family
  misc_feature (97)..(131): Pfam Name: SAP Pfam Description: SAP domain
MNNVLQFGLQSSAIYVAKFLVVPLRSLRVGSSFVGVGVGTRSFNKRLMSNATAFSINNSKRKELKIPGAAIDQNCHQMGSDTDRDEMGTLQDDRKEIEAMTVQELRSTLRKLGVPVKGRKQELISTLRLHMDSNLPDQKETSSSTRSDSVTIKRKISNREEPTEDECTNSEAYDIEHGEKRVKQSTEKNLKAKVSAKAIAKEQKSLMRTGKQQIQSKEETSSTISSELLKTEEIISSPSQSEPWTVLAHKKPQKDWKAYNPKTMRPPPLPEGTKCVKVMTWNVNGLRGLLKFESFSALQLAQRENFDILCLQETKLQVKDVEEIKKTLIDGYDHSFWSCSVSKLGYSGTAIISRIKPLSVRYGTGLSGHDTEGRIVTAEFDSFYLINTYVPNSGDGLKRLSYRIEEWDRTLSNHIKELEKSKPVVLTGDLNCAHEEIDIFNPAGNKRSAGFTIEERQSFGANLLDKGFVDTFRKQHPGVVGYTYWGYRHGGRKTNKGWRLDYFLVSQSIAANVHDSYILPDINGSDHCPIGLILKL

SEQ ID NO: 150 - DNA, 1455 bp, Populus balsamifera subsp. trichocarpa
  misc_feature (1)..(1455): Ceres ANNOT ID no.1528227
atggctaggtcaaggagcttgaagattggacaactgggttctttgagattaagggtgatgagttctaaacgaggtgtctcgagttcaaccaaatctgctgctgcttcaattgttgatgacaagaaagatagtaaacttaaggggatgagtggtgattgtagtgagaaagttttaatcgaggaaagttgctggaaagtccagtcagttgaatttcaaagtatcaaggatgatccaggaaaaatagaagcgatgacagttcaggaacttagagcaacattgaggaaatttggagtccctgccaaaggtcgtaaaggtgaccttgtatttgctttaaagcatttcatgggtgaaagctctcaggaattagaagagcgtgtttcctttaattctcgggaaaatatttcactgcaaaagaatactaaacgtacatctgatgagagctgcgttgtaagcattaacactgtttcagaggtttctgggtttaaacagagcaagagaaggatgaaacaatcccctgttgaggatgaaattgtcaaagttggtactgaaatagtcactacaaagaggaagctttcaattaaaaccgatgatcttgttactttgcctcaagctgaaccctggacggttctttcacataagaagccacagaaagggtggattccgtataaccccagaaccatgaggcctgcacctctcactgatggaaactcggtgaagctaatgtcttggaatgtcaatgggttaagagcattattgaagtttgagggattctctgcccttgaacttgcccaaagggaaaactttgatgtgttgtgcttgcaagagaccaaactgcaggcaagtgagaaggatgttgattccatcaaacaatgtctgatagatggttatgagaatagcttctggacatgtagcaatgctaaacttggttattctgggactgcaattgtctctcggataaagcccctttctgtctgctatggtctaggcatcccagaccatgatagtgagggacgtgttgtgacagcagagtttgattcattttatttagtaaatacttatgttcctaactctggagatggcttgaaaagactggagcttgaaaagtcaaagcctgtcattttgactggtgatctgaattgtgctcaccaggagatagatattttcaatcccgcaggaaataaaagaagcgctgggtttacagaagaagaaaggcagtcatttgggtcaaactttttatcgaagggacttgtggataccttcagaaaacagcaccctaatgttgttgggtatacctactggggttatcgacatggtggacggaaaactaacaaaggatggcggcttgactactttctcgtgtcggaatccatagcagacaaagttcatgactcctacattgtccctgatgttaatgggagtgatcactgtcctattggccttgttctcaaggtttag

SEQ ID NO: 151 - protein, 484 aa, Populus balsamifera subsp. trichocarpa
  misc_feature (1)..(484): Ceres ANNOT ID no. 1528227
  misc_feature (1)..(484): Functional Homolog of  Ceres ANNOT ID no. 554970
  misc_feature (238)..(482): Pfam Name: Exo_endo_phos Pfam Description: Endonuclease/Exonuclease/phosphatase family
  misc_feature (81)..(115): Pfam Name: SAP Pfam Description: SAP domain
MARSRSLKIGQLGSLRLRVMSSKRGVSSSTKSAAASIVDDKKDSKLKGMSGDCSEKVLIEESCWKVQSVEFQSIKDDPGKIEAMTVQELRATLRKFGVPAKGRKGDLVFALKHFMGESSQELEERVSFNSRENISLQKNTKRTSDESCVVSINTVSEVSGFKQSKRRMKQSPVEDEIVKVGTEIVTTKRKLSIKTDDLVTLPQAEPWTVLSHKKPQKGWIPYNPRTMRPAPLTDGNSVKLMSWNVNGLRALLKFEGFSALELAQRENFDVLCLQETKLQASEKDVDSIKQCLIDGYENSFWTCSNAKLGYSGTAIVSRIKPLSVCYGLGIPDHDSEGRVVTAEFDSFYLVNTYVPNSGDGLKRLELEKSKPVILTGDLNCAHQEIDIFNPAGNKRSAGFTEEERQSFGSNFLSKGLVDTFRKQHPNVVGYTYWGYRHGGRKTNKGWRLDYFLVSESIADKVHDSYIVPDVNGSDHCPIGLVLKV

SEQ ID NO: 152 - protein, 493 aa, Oryza sativa
  misc_feature (1)..(493): Public GI no. 34908948
  misc_feature (1)..(493): Functional Homolog of  Ceres ANNOT ID no. 554970
  misc_feature (233)..(491): Pfam Name: Exo_endo_phos Pfam Description: Endonuclease/Exonuclease/phosphatase family
  misc_feature (76)..(110): Pfam Name: SAP Pfam Description: SAP domain
MPLLLRGGSLFRLYGCGCGLPSANFSPSKLALIRLSLMMAETRATYSRRAASKNTDIKKDDEHVLEKQLRNDPDRLQSMTVKELREITRMMGIPVKGNKKDLVSALMDSLGKERNGKVGTSSVEKIGVSEVPSKRKGASVVVEQNIDSSEVISETPSKRSRAKNKGTAEESSGANVKQSKTSVQKKKLVVQGASVDHEEPWTVLVHKKPQPAWIPYNPKVMRSPSLSKDTKALKILSWNVNGLKALLKSRGFSIHQLAQREDFDILCLQETKMQAKDVEVIKEGLLEGYTHSFWTCSVSKLGYSGTAIISRVKPLSIKYGLGVPDHDTEGRVVTVEFNDFYLLTAYVPNSGDGLKRLTYRVTEWDPSLGNYMKDLEKSKPVILTGDLNCAHQEIDIHDPAGNRRSAGFTIEERESFETNFLSKGFVDTFRKQHPNVVGYSYWGYRHNARKTNKGWRLDYFLVSESIAERVHDSYIIPDISASDHSPLGLVLKL

SEQ ID NO: 153 - protein, 499 aa, Oryza sativa
  misc_feature (1)..(499): Public GI no. 55297696
  misc_feature (1)..(499): Functional Homolog of  Ceres ANNOT ID no. 554970
  misc_feature (239)..(497): Pfam Name: Exo_endo_phos Pfam Description: Endonuclease/Exonuclease/phosphatase family
  misc_feature (87)..(121): Pfam Name: SAP Pfam Description: SAP domain
MPLLLRGGSLFRLYGCGCGLPSANFSPSKLALIRLSLMMAETRATYSRRAASKNTDIKKDDEHVLEKEDVAESKLEIEQLRNDPDRLQSMTVKELREITRMMGIPVKGNKKDLVSALMDSLGKVGTSSVEKIGVSEVPSKRKGASVVVEQNIDSSEVISETPSKRSRAKNKGTAEESSGANVKQSKTSVQKKKLVVQGASVDHEEPWTVLVHKKPQPAWIPYNPKVMRSPSLSKDTKALKILSWNVNGLKALLKSRGFSIHQLAQREDFDILCLQETKMQEKDVEVIKEGLLEGYTHSFWTCSVSKLGYSGTAIISRVKPLSIKYGLGVPDHDTEGRVVTVEFNDFYLLTAYVPNSGDGLKRLTYRVTEWDPSLGNYMKDLEKSKPVILTGDLNCAHQEIDIHDPAGNRRSAGFTIEERESFETNFLSKGFVDTFRKQHPNVVGYSYWGYRHNARKTNKGWRLDYFLVSESIAERVHDSYIIPDISASDHSPLGLVLKL

SEQ ID NO: 154 - protein, 505 aa, Zea mays
  misc_feature (1)..(505): Ceres CLONE ID no. 1158508
  misc_feature (1)..(505): Functional Homolog of  Ceres ANNOT ID no. 554970
  misc_feature (245)..(503): Pfam Name: Exo_endo_phos Pfam Description: Endonuclease/Exonuclease/phosphatase family
  misc_feature (83)..(117): Pfam Name: SAP Pfam Description: SAP domain
MPLLLRGASLLRLCQCTSGLSSVKFSSRVTVLVNLNAMRDGMRATYSRRAEVKKDEQPLTEKEDAAESDLEMERGRSSSPSQLQSMTVKELRELTRRRGISVKGTKKDLVSALMNSMAVEANGEEGKSSVELVSPLEVPLKRKGGASVVVEQKLESSEIISETPNKKRSRTKQKSSKNTTCQEISVTNVKLSKTVVQKETVDGLSPDDDSEPWTILVHKKPEASWIPYNPRTMRPPPLSKDTRALKIMSWNVNGLKALLKSRGFSVQQLAQREDFDVLCLQETKMQEKDIEVIKDTLLDGYTNSFWTCSVSKLGYSGTAIISRVKPLSIKYGLGIPDHDTEGRVVTVEFDDFYLLTAYVPNSGDGLKRLTYRVTEWDPSLGNYMKELEKSKPVILTGDLNCAHQEIDIHDPAGNRRSAGFTNEERESFGTNFLSKGFVDTFRKQHPNVVAYSYWGYRHNARKTNKGWRLDYFLVSESIAEKVHDSYILPDISASDHSPLGLVLKL

SEQ ID NO: 155 - protein, 510 aa, Zea mays
  misc_feature (1)..(510): Ceres CLONE ID no. 1222684
  misc_feature (1)..(510): Functional Homolog of  Ceres ANNOT ID no. 554970
  misc_feature (250)..(508): Pfam Name: Exo_endo_phos Pfam Description: Endonuclease/Exonuclease/phosphatase family
  misc_feature (88)..(122): Pfam Name: SAP Pfam Description: SAP domain
MPLLLRGASLLRLCQCTSGLSSVKFSSRVTVLVNLNAMRDGMRATYSRRAASKNSEVKKDEQPLTEKEDAAESDLEMERGRSSSPSQLQSMTVKELRELTRRRGISVKGTKKDLVSALMNSMAVEANGEEGKSSVELVSPLEVPLKRKGGASVVVEQKLESSEIISETPNKKRSRTKQKSSKNTTCQEISVTNVKLSKTVVQKETVDGLSPDDDSEPWTILVHKKPEASWIPYNPRTMRPPPLSKDTRALKIMSWNVNGLKALLKSRGFSVQQLAQREDFDVLCLQETKMQEKDIEVIKDTLLDGYTNSFWTCSVSKLGYSGTAIISRVKPLSIKYGLGIPDHDTEGRVVTVEFDDFYLLTAYVPNSGDGLKRLTYRVTEWDPSLGNYMKELEKSKPVILTGDLNCAHQEIDIHDPAGNRRSAGFTNEERESFGTNFLSKGFVDTFRKQHPNVVAYSYWGYRHNARKTNKGWRLDYFLVSESIAEKVHDSYILPDISASDHSPLGLVLKL

SEQ ID NO: 156 - DNA, 1482 bp, Arabidopsis thaliana
  misc_feature (1)..(1482): Ceres ANNOT ID no. 568299
atggaatcacaaggaccttctaatggtcatcccatggatatcagcagcaattcaatcccatcgtctgcctgtaatctgtgcggaagagtcgttcaatctgcttccgatgatcttgaaatcttcagcttatgtgtcgactgtaagtttttgttgcttgaagatttcggcactcccgcgcctcccttggctcggcggcagacaattaggaggaggaggatgaggaggaggagaagaacaactaggcacgacagctctgagtctgtcggtgtcggtgatctttcctcccaacaattcacacacttgataagcattgcaagacaaagcctttcaacggttcaagctagtgaggatctacgtgatgacctgcgaactagctcccataccactccaagcggctcgacaagatggagactcttctcagaatctgaaagtgatgattttgacaactttggcgaaaccgaatcaaacgctagctttagcctctacagatttccccatgctgataacgataccatttcttttagtgcttacggtggagagtctgatgcttccacggacaggcatgccgatatctttgttcaaccagatgacaggagcgacattgactttgacactgatatagacccgatgcgcgctggtcttaaccagtggaactcagacgaagaagacagggaatgggaggaaggagcgggtccttctggggttgcaggaacacgctatagaaactatttggcaagtccaagtgagagctacagctccatgactcggtttgattcacctgagttagagagaagctttcgtcaaagaattatagagaggaggcattcgttatctcgcaacatcttcactggtttggaggatttggacttctccccctatgctgcaaatgttggggattatcttgatgagagaggctttgatgaactgcttgagcaacttgctgagtctgacaattcaagaagaggtgcaccacctgcatctgtctcatgcgtcaggaatcttccaagggttatcattgcagaggagcatgtaatgaagggcctagtttgtgcgatctgcaaggagcttttctccctccgcaatgaaaccacgcagcttccgtgtctacatctataccatgctcattgtatcgtaccttggctgagtgcccgtaactcctgcccactctgccgttatgagctcccgacagatgataaagattacgaggagggaaagcggaatgtgctggatgtgagcgaggatagctcctcctctgatgatggtacagaatcgggggaagaggaatatgtagagagaggtgagagcgagtctggtgtgagcagagtcagcagaggaagatggctgtttctggctgctgcaccagttgtgagtctggtgggcgttgtgttggcaatgtggctaagcagcccacacaggaggggtatagcaatctctcatagccaaagggagaacagaaccagaagatggctgccgtttttctga

SEQ ID NO: 157 - protein, 493 aa, Arabidopsis thaliana
  misc_feature (1)..(493): Ceres ANNOT ID no. 568299
  misc_feature (350)..(390): Pfam Name: zf-C3HC4 Pfam Description: Zinc finger, C3HC4 type (RING finger)
MESQGPSNGHPMDISSNSIPSSACNLCGRVVQSASDDLEIFSLCVDCKFLLLEDFGTPAPPLARRQTIRRRRMRRRRRTTRHDSSESVGVGDLSSQQFTHLISIARQSLSTVQASEDLRDDLRTSSHTTPSGSTRWRLFSESESDDFDNFGETESNASFSLYRFPHADNDTISFSAYGGESDASTDRHADIFVQPDDRSDIDFDTDIDPMRAGLNQWNSDEEDREWEEGAGPSGVAGTRYRNYLASPSESYSSMTRFDSPELERSFRQRIIERRHSLSRNIFTGLEDLDFSPYAANVGDYLDERGFDELLEQLAESDNSRRGAPPASVSCVRNLPRVIIAEEHVMKGLVCAICKELFSLRNETTQLPCLHLYHAHCIVPWLSARNSCPLCRYELPTDDKDYEEGKRNVLDVSEDSSSSDDGTESGEEEYVERGESESGVSRVSRGRWLFLAAAPVVSLVGVVLAMWLSSPHRRGIAISHSQRENRTRRWLPFF

SEQ ID NO: 158 - DNA, 834 bp, Arabidopsis thaliana
  misc_feature (1)..(834): Ceres ANNOT ID no. 574716
atgggtcgaaagatggtaaagatgacgaggataacgaacgagaaaacgaggataacgacttacaagaagaggaaagcatgtttgtataagaaagccagtgagttctcaacactctgcggtgtggacacttgtgtcattgtgtacggcccgagcagagcaggggacgaaatggtcatggagcccgagttatggccaaaggatgggagcaaagtccgtgaaatcttaaccaagtacagagacactgcgtcaagcagctgcaccaagacatacaccgtgcaagaatgcttggagaaaaacaacactaaggtggagaaaccgacgattgcgacaaagtatcctacatgggacaaaaagctcgaccagtgttctttaaatgacctctatgcggttttcatggcagtagaaaacaagatccaagaggctacgaataggaatcagacatttcctgacactagttgttggtctaatgaccaacttggtttatgcggttacaatcggcaatgttttgagcagtatcagttgtttcctctgcctactatggattacaacgggctctctttcttcccttttaataaccagatgacctcaaatactgcggaagtgtcttccttctcgaatgtgacagagccgatgatagcgaacgggcaaagcttgttttacgggagttgttcggatggtccatatggtccgatggtacagaggacagcttatatggagccaatacattggggtttaggaaacagtatgttcaacaatgtgaagcagttccaagattatcccttcaggtttgcacaagttaatgatttggaggattcaagtaaactttctatgtga

SEQ ID NO: 159 - protein, 277 aa, Arabidopsis thaliana
  misc_feature (1)..(277): Ceres ANNOT ID no. 574716
  misc_feature (9)..(51): Pfam Name: SRF-TF Pfam Description: SRF-type transcription factor (DNA-binding and dimerisation domain)
MGRKMVKMTRITNEKTRITTYKKRKACLYKKASEFSTLCGVDTCVIVYGPSRAGDEMVMEPELWPKDGSKVREILTKYRDTASSSCTKTYTVQECLEKNNTKVEKPTIATKYPTWDKKLDQCSLNDLYAVFMAVENKIQEATNRNQTFPDTSCWSNDQLGLCGYNRQCFEQYQLFPLPTMDYNGLSFFPFNNQMTSNTAEVSSFSNVTEPMIANGQSLFYGSCSDGPYGPMVQRTAYMEPIHWGLGNSMFNNVKQFQDYPFRFAQVNDLEDSSKLSM

SEQ ID NO: 160 - DNA, 468 bp, Arabidopsis thaliana
  misc_feature (1)..(468): Ceres ANNOT ID no. 829219
atggaccctaaaagttgtgagaattcgagtgatgttaagggtcagaccagtgactctgtatcaaaaaaggtgttgattgaggaagaggaagatgtaaagaaaccacaacagggaaaagaaaatgattcaagaatggccaaagatgttgttagttgcagtagtaacatttcagctcatgttgttcatgaggaagttgcggataatgttactgcggtaagctgcaacgaggcagagagtgatatatcgaaagcaaaggcgaaggagttccacactattgatttgagtggtgtaggagaaagaatctgtaggatttgtcattttggttctgatcaatcacctgaggcttctggtgatgataagtcagtaagtccggagttgattgagattggttgcaaatgtaaaaacgagcttggccttgcacatttccattgcgctgaagcctggttcaagttaagaggaaacaggtaa

SEQ ID NO: 161 - protein, 155 aa, Arabidopsis thaliana
  misc_feature (1)..(155): Ceres ANNOT ID no. 829219
  misc_feature (102)..(155): Pfam Name: zf-C3HC4 Pfam Description: Zinc finger, C3HC4 type (RING finger)
MDPKSCENSSDVKGQTSDSVSKKVLIEEEEDVKKPQQGKENDSRMAKDVVSCSSNISAHVVHEEVADNVTAVSCNEAESDISKAKAKEFHTIDLSGVGERICRICHFGSDQSPEASGDDKSVSPELIEIGCKCKNELGLAHFHCAEAWFKLRGNR

SEQ ID NO: 162 - DNA, 543 bp, Arabidopsis thaliana
  misc_feature (1)..(543): Ceres ANNOT ID no. 830468
atgtcgtcctcctctacccaaaaccaattggagatgcgggattacacgtgtccggaatgtaacataggtcttagggttctctcattgccttccgcttctcctccatactgtcctctatgcaatgtcgcttcttacttcacttcttcgaccccttttgaagtaggtcctaatcctttcgaagacgatgaggaatctcagtttctcgatcccatggaatctcttccgaccattaagatctcatcttcaatgttgtcttccgcttcctcagacgattctgctttaccatgtgccatttgcagagaagatttcgtggttggagaatctgctaggagattgccatgcaaccatttataccataatgattgcattattccttggctcacaagtcataactcgtgccctctctgtcgagttgagctcccggttgcatctagtgaagacgatagtggtctggacatgtggtttgatgctttgaacctagaggacgacttggaggaagaagcgggagtcacgctcgatttggagcaaagtttagacggctaa

SEQ ID NO: 163 - protein, 180 aa, Arabidopsis thaliana
  misc_feature (1)..(180): Ceres ANNOT ID no. 830468
  misc_feature (96)..(136): Pfam Name: zf-C3HC4 Pfam Description: Zinc finger, C3HC4 type (RING finger)
MSSSSTQNQLEMRDYTCPECNIGLRVLSLPSASPPYCPLCNVASYFTSSTPFEVGPNPFEDDEESQFLDPMESLPTIKISSSMLSSASSDDSALPCAICREDFVVGESARRLPCNHLYHNDCIIPWLTSHNSCPLCRVELPVASSEDDSGLDMWFDALNLEDDLEEEAGVTLDLEQSLDG

SEQ ID NO: 164 - DNA, 835 bp, Arabidopsis thaliana
  misc_feature (1)..(835): Ceres ANNOT ID no. 840236
atcactacgctcttcagcactcacaactagacattcttcgtctcgttgatcctgcgaatatattcgattctactagctacatcgatctctggaagaagttgatcatcgaacgaagctagctagctagatggggtctctgatggctggggttgggattcgccggttcttggcgatggcaccaaaggtatatatgcggctacacacacggttcagttactgcttgcagccatgtttatgtattccttttgcttgcagctcgtgtgacgaggaaccggtccctgacaaaggaggaggtggaggctttctggcggcagcgcgggaagccggcgccggaggacggcggcgacgtcacctcgccgcttggctcccctggtcgacctatggagaagagcccgctgggaagctcgcagaggagcaggtcaccggcgtcgtctccggtgtctggcgtacacgaggagacgatcggcgccgccgacgccggcaagagccgggactggtggacgaggagcaactgggccttcctcaacgagccgccgcaggaggagaggccgggaacggcgcacacctacacgccgcagttccacgtcgccgccggcaacgcctgaccggacatgctcgtagagtgtacgcaatactagtagtaccacgtcacgtcacgctgctggaatgcctagggtaggccctactgccttgaccgtaccgcgcggagatgcacaatatgtccatatggggtcatttccctgtcaaatatcccttgtacaatagatgtattgtaaatgtatatgtaagttgcgtatgtattatgtaagtaaaatacagagtgaatttcaaaaac

SEQ ID NO: 165 - protein, 451 aa, Arabidopsis thaliana
  misc_feature (1)..(451): Ceres ANNOT ID no. 840236
  misc_feature (27)..(155): Pfam Name: NAM Pfam Description: No apical meristem (NAM) protein
MGRESVAVVTAPPSATAPGTASVATSLAPGFRFHPTDEELVSYYLKRKVLGQPVRFDAIGEVDIYKHEPWDLAVFSRLKTRDQEWYFYSALDKKYGNGARMNRATNRGYWKATGKDREIRRDILLLGMKKTLVFHSGRAPDGLRTNWVMHEYRLVEYETEKNGNLVQDAYVLCRVFHKNNIGPPSGNRYAPFMEEEWADDEGALIPGIDVKLRLEPPPVANGNDQMDQEIQSASKSLININEPPRETAPLDIESDQQNHHENDLKPEEHNNNNNYDENEETLKREQMEEEERPPRPVCVLNKEAPLPLLQYKRRRQSESNNNSSRNTQDHCSSTTTTVDNTTTLISSSAAATNTAISALLEFSLMGISDKKEKPQQPLRPHKEPLPPQTPLASPEEKVNDLQKEIHQMSVERETFKLEMMSAEAMISILQSRIDALRQENEELKKNNANGQ

SEQ ID NO: 166 - protein, 447 aa, Arabidopsis thaliana
  misc_feature (1)..(447): Public GI no. 8567777
  misc_feature (1)..(447): Functional Homolog of  Ceres ANNOT ID no. 840236
  misc_feature (27)..(155): Pfam Name: NAM Pfam Description: No apical meristem (NAM) protein
MGRESLAVVSSPPSATAPSTAVSATSLAPGFRFHPTDEELVSYYLKRKVLGKPVRFDAIGEVDIYKHEPWDLAVFSKLKTRDQEWYFFSALDKKYGNGARMNRATNKGYWKATGKDREIRRDIQLLGMKKTLVFHSGRAPDGLRTNWVMHEYRLVEYETETNGSLLQDAYVLCRVFHKNNIGPPSGNRYAPFMEEEWADGGGALIPGIDVRVRVEALPQANGNNQMDQEMHSASKDLININELPRDATPMDIEPNQQNHHESAFKPQESNNHSGYEEDEDTLKREHAEEDERPPSLCILNKEAPLPLLQYKRRRQNESNNNSSRNTQDHCSSTITTVDNTTTLISSSAAAATNTAISALLEFSLMGISDKKENQQKEETSPPSPIASPEEKVNDLQKEVHQMSVERETFKLEMMSAEAMISILQSRIDALRQENEELKKKNASGQAS

SEQ ID NO: 167 - protein, 446 aa, Arabidopsis thaliana
  misc_feature (1)..(446): Public GI no. 42572353
  misc_feature (1)..(446): Functional Homolog of  Ceres ANNOT ID no. 840236
  misc_feature (27)..(155): Pfam Name: NAM Pfam Description: No apical meristem (NAM) protein
MGRESLAVVSSPPSATAPSTAVSATSLAPGFRFHPTDEELVSYYLKRKVLGKPVRFDAIGEVDIYKHEPWDLAVFSKLKTRDQEWYFFSALDKKYGNGARMNRATNKGYWKATGKDREIRRDIQLLGMKKTLVFHSGRAPDGLRTNWVMHEYRLVEYETETNGSLLDAYVLCRVFHKNNIGPPSGNRYAPFMEEEWADGGGALIPGIDVRVRVEALPQANGNNQMDQEMHSASKDLININELPRDATPMDIEPNQQNHHESAFKPQESNNHSGYEEDEDTLKREHAEEDERPPSLCILNKEAPLPLLQYKRRRQNESNNNSSRNTQDHCSSTITTVDNTTTLISSSAAAATNTAISALLEFSLMGISDKKENQQKEETSPPSPIASPEEKVNDLQKEVHQMSVERETFKLEMMSAEAMISILQSRIDALRQENEELKKKNASGQAS

SEQ ID NO: 168 - protein, 406 aa, Petunia x hybrida
  misc_feature (1)..(406): Public GI no. 21105736
  misc_feature (1)..(406): Functional Homolog of  Ceres ANNOT ID no. 840236
  misc_feature (35)..(163): Pfam Name: NAM Pfam Description: No apical meristem (NAM) protein
MEQEGAALVIAPPSTAVSTPVATVAKRGVTPPTSLAPGFRFHPTDEELVRYYLRRKACAKPFRFQAVSEIDVYKSEPWELAEFASLKTRDLEWYFFSPVDRKYGNGSRLNRATGKGYWKATGKDRPVRHKSQTIGMKKTLVFHSGRAPDGKRTNWVMHEYRLADEELERAGVVQIAFVLCRIFQKSGLGPPNGDRYAPFIEEEWDDDTPLLIPGGEAEDDVANGDEARVDGNDLDQDALQKAKAPCQSENLLEPRTIPFVCKRERSEDPELSLAQSKRSKHDDPSSSHANDSKDSTTSQQDPPTTMMTTNYSPTLLAFPLLEPIEPKENQPSNALTFDSSNLEKSVPPGYLKFISNLENEILNVSMERETLKIEVMRAQAMINILQSRVDLLNKENEDLRRLVRGG

SEQ ID NO: 169 - DNA, 1794 bp, Arabidopsis thaliana
  misc_feature (1)..(1794): Ceres ANNOT ID no. 844490
atggtgctgtcgaacaagaagctgaagcagaggattcgacaagatttggctgaatcactatctgtctctgtatccgaaacaaatccacaatctcagtctctgaaattgctccttgattcatctagccacaaacccagattgtcgaagagagagaaacgaagaaattgcgaaactttcgctagagaagacgacgaaatcagagagaatgaagttgggaatggtgggtcaagcgagaagactgatacgaagattaaaaagaagagaaagagagacgatgctgtggaagtcgacgagttagaaggagatgaaggaactaaggaagagcaaaaaccccagaagaagaaaaataagaagaagaagaagaagagaaaggtaaacaaaacgccaaagaaggctgaggaaggcaatgtagaagagaaggtgaaggtagaagagattgaagttaatacagacaataaagaagaagatggggttgttcctaacaagttatatgttgggggtattccttatcagagtacagaagatgagattcgtagctactttagaagctgtggagtcatcattaaagttgattgcaagatgcgtcctgaagatggggctttcagtggtattgccttcatcacttttgacactgaagatggcgcaaaacgtgctttggcttttgatagagctgctatgggtgatcgatatttgacaatccagcaatacgtgaaaaccaccaccccttccattccaagaaggaaaacatcttctggtttcgctccagaaatggtggatggctataacagggtatacattgggaatttagcctgggacacaacagagcgtgacatacggaagctcttctctgactgcgtaataaactctgtgcggttgggtaaaaacaaagaaacaggagagtttaaagggtatgcgcatgtggatttcaaggatagtgtgtctgtggcgattgcgctgaagctggatcagcaggttatttgcggaagacctgtcaagatatgttgtgcacttaaagacagaccagctactgatcatacacctggtgaaacgaacaatgctggttcgtacaacatggaagatacttatgctgctgctgatccagtaccggctttagctgggcgtagcgaagttgatgacggaaactactttgcaactacggttagcagcagtaaggtcaaaaggagggtctgttatgagtgtggagaaaagggtcatctttctacagcctgtcccataaagcttcaaaaggctgatgatcaggcaaactcaaagctgggtcaagagactgttgatggtagaccggctatgcaaagctatggtcttccaaagaatagtggtgattcttactacatgaatgagacatacgcttctacaaatgaaacttataatggaggatactcagcatctgctgttggcactggtaaggtcaaaaggaggaactgttatgagtgtggagaaaagggtcatctttctacagcctgtcccataaagcttcaaaacacttctcacacaaactcaacgctggatcaccaaactgttgaggcaggaccgactcaggtaacaagctatagtcttcaaaagaaaacaagagacactgaaaacaatggtggttcgttcatggatgagagctatgctactgttccgatatccattgatgtgacaaatggagctaatgatgcaagcttaacatctgcggttagcactggtaagatcaaaaagagaaactgttacgagtgcggagaaaaaggtcatctttcttcagcttgccctaacaagctgcaaaaacaaggctga

SEQ ID NO: 170 - protein, 597 aa, Arabidopsis thaliana
  misc_feature (1)..(597): Ceres ANNOT ID no. 844490
  misc_feature (264)..(333): Pfam Name: RRM_1 Pfam Description: RNA recognition motif. (a.k.a. RRM, RBD, or RNP domain)
  misc_feature (574)..(591): Pfam Name: zf-CCHC Pfam Description: Zinc knuckle
MVLSNKKLKQRIRQDLAESLSVSVSETNPQSQSLKLLLDSSSHKPRLSKREKRRNCETFAREDDEIRENEVGNGGSSEKTDTKIKKKRKRDDAVEVDELEGDEGTKEEQKPQKKKNKKKKKKRKVNKTPKKAEEGNVEEKVKVEEIEVNTDNKEEDGVVPNKLYVGGIPYQSTEDEIRSYFRSCGVIIKVDCKMRPEDGAFSGIAFITFDTEDGAKRALAFDRAAMGDRYLTIQQYVKTTTPSIPRRKTSSGFAPEMVDGYNRVYIGNLAWDTTERDIRKLFSDCVINSVRLGKNKETGEFKGYAHVDFKDSVSVAIALKLDQQVICGRPVKICCALKDRPATDHTPGETNNAGSYNMEDTYAAADPVPALAGRSEVDDGNYFATTVSSSKVKRRVCYECGEKGHLSTACPIKLQKADDQANSKLGQETVDGRPAMQSYGLPKNSGDSYYMNETYASTNETYNGGYSASAVGTGKVKRRNCYECGEKGHLSTACPIKLQNTSHTNSTLDHQTVEAGPTQVTSYSLQKKTRDTENNGGSFMDESYATVPISIDVTNGANDASLTSAVSTGKIKKRNCYECGEKGHLSSACPNKLQKQG

SEQ ID NO: 171 - DNA, 608 bp, Arabidopsis thaliana
  misc_feature (1)..(608): Ceres CLONE ID no.  1001761
  misc_feature (1)..(608): GEMINI ID 533A9
agaatctctcaattctcttttgtcgatttcgcagtagaagagtcctttcgccgtctccgagaaactcgttgcagcgtcacgaccagttggagaaaatgtcttctagaggaaaaaggaaagacgaagatgtcagagcatcagatgacgaatctgaaacccacgcgccggctaagaaagtcgcaaagccagcagacgattccgaccagtctgacgatatcgtcgtctgcaacatatctaagaataggagagtctctgtaaggaattggaacgggaagatttggattgacattcgtgagttctatgtcaaggacggaaagactttgcctggcaagaaaggtatctctctaagcgtggatcagtggaacactyttcggaaccacgcagaggatatcgagaaggccctctctgacctttcttaggttttaaaacttgtatcattggttgtacgtctattagaatatggctcagttgttttggttgtttttgtagaacaacaccatgttctgctagtgtaagctgcttcaaattagttggtgtatggaatctttcacttttggttcagacaagctttggttggtattaagaatataatgattgctyttttattt

SEQ ID NO: 172 - protein, 107 aa, Arabidopsis thaliana
  misc_feature (1)..(107): Ceres CLONE ID no.  1001761
  misc_feature (11)..(103): Pfam Name: PC4 Pfam Description: Transcriptional Coactivator p15 (PC4)
  misc_feature (1)..(107): GEMINI ID 533A9
  misc_feature (92)..(92): Xaa is any aa, unknown, or other
MSSRGKRKDEDVRASDDESETHAPAKKVAKPADDSDQSDDIVVCNISKNRRVSVRNWNGKIWIDIREFYVKDGKTLPGKKGISLSVDQWNTXRNHAEDIEKALSDLS

SEQ ID NO: 173 - protein, 107 aa, Arabidopsis thaliana
  misc_feature (1)..(107): Public GI no. 28466805
  misc_feature (1)..(107): Functional Homolog of  Ceres CLONE ID no.  1001761
  misc_feature (11)..(103): Pfam Name: PC4 Pfam Description: Transcriptional Coactivator p15 (PC4)
MSSRGKRKDEDVRASDDESETHAPAKKVAKPADDSDQSDDIVVCNISKNRRVSVRNWNGKIWIDIREFYVKDGKTLPGKKGISLSVDQWNTLRNHAEDIEKALSDLS

SEQ ID NO: 174 - protein, 107 aa, Brassica napus
  misc_feature (1)..(107): Ceres CLONE ID no. 955105
  misc_feature (1)..(107): Functional Homolog of  Ceres CLONE ID no.  1001761
  misc_feature (11)..(103): Pfam Name: PC4 Pfam Description: Transcriptional Coactivator p15 (PC4)
MSWRGKRKDEDVRASDDDSETHAPAKKVAKPAESSEESDDIVVCNISKNRRVSVRNWNGKIWIDIREFYVKDGKTLPGKKGISLSVDQWNTLRNHADGIDKALADLS

SEQ ID NO: 175 - protein, 98 aa, Glycine max
  misc_feature (1)..(98): Ceres CLONE ID no. 1620054
  misc_feature (1)..(98): Functional Homolog of  Ceres CLONE ID no.  1001761
  misc_feature (10)..(98): Pfam Name: PC4 Pfam Description: Transcriptional Coactivator p15 (PC4)
MSGKAKRRDDDGASDADSEGHAPPKKSLKKDSDDDPDSITVCEISKNRRVAVRNWKGSIMVDIREFYVKDGKQLPGRKGISLTMDQWNVLRNHVEEID

SEQ ID NO: 176 - protein, 105 aa, Glycine max
  misc_feature (1)..(105): Ceres CLONE ID no. 1617036
  misc_feature (1)..(105): Functional Homolog of  Ceres CLONE ID no.  1001761
  misc_feature (10)..(101): Pfam Name: PC4 Pfam Description: Transcriptional Coactivator p15 (PC4)
MSGKAKRRDDDDASDADSEGHAPPMKSLKKDSDDDPDSVTICEISKNRRVAVRNWKGSIMVDIREFYVKDGKQLPGRKGISLTMDQWNVLRNHVEEIDKAVNENS

SEQ ID NO: 177 - DNA, 686 bp, Arabidopsis thaliana
  misc_feature (1)..(686): Ceres CLONE ID no.  1003205
  misc_feature (1)..(686): GEMINI ID 280D7
atcacataagtctctctcttacattttgaaaccctaatttctcaaaaaaaatgtctgaagttgagtaccggtgctttgtcggcggccttgcctgggccaccaatgatgaagatcttcaaaggacgttctcacagttcggcgacgttatcgattctaagatcattaacgaccgcgagagtggaagatcaaggggattcggattcgtcaccttcaaggacgagaaagccatgagggatgcgattgaagagatgaacggtaaagagctcgatggacgtgtcatcaccgtgaacgaggctcagtcgagaggtagcggcggtggcggaggaggccgtggtggaagcggtggtggttaccgcagcggaggcggtggtggatactcaggaggcggtggcggcggatactcaggaggaggcggtggtggttacgagaggcggtgatggtggaagttacggcggcggtggtggcggctggtaatcaaagatagagttgtttgcgtgctgctgctctgtttttggtttagatttggatttgtgtcaccacttctggtttggttatcgttcgtttggtttacttttttgatgaaacagtttcgtttaagtcttctttgtctggatcgaaatgttaattcgcgtgttgtttactaaatttataacgtttccttttaaccagattcgagattttccctc

SEQ ID NO: 178 - protein, 128 aa, Arabidopsis thaliana
  misc_feature (1)..(128): Ceres CLONE ID no.  1003205
  misc_feature (1)..(128): GEMINI ID 280D7
  misc_feature (8)..(79): Pfam Name: RRM_1 Pfam Description: RNA recognition motif. (a.k.a. RRM, RBD, or RNP domain)
MSEVEYRCFVGGLAWATNDEDLQRTFSQFGDVIDSKIINDRESGRSRGFGFVTFKDEKAMRDAIEEMNGKELDGRVITVNEAQSRGSGGGGGGRGGSGGGYRSGGGGGYSGGGGGGYSGGGGGGYERR

SEQ ID NO: 179 - protein, 129 aa, Glycine max
  misc_feature (1)..(129): Ceres CLONE ID no. 1120014
  misc_feature (1)..(129): Functional Homolog of  Ceres CLONE ID no.  1003205
  misc_feature (9)..(80): Pfam Name: RRM_1 Pfam Description: RNA recognition motif. (a.k.a. RRM, RBD, or RNP domain)
MSGEAEYRCFVGGLAWATADADLERTFSQFGEVIDSKIINDRETGRSRGFGFVTFKDEKSMRDAIEEMNGKELDGRTITVNEAQSRGSGGGGGGRGGGGGYRGGGGGGYGGGGGYGGGGGGYGRRDGGG

SEQ ID NO: 180 - protein, 143 aa, Brassica napus
  misc_feature (1)..(143): Ceres CLONE ID no. 1066826
  misc_feature (1)..(143): Functional Homolog of  Ceres CLONE ID no.  1003205
  misc_feature (9)..(80): Pfam Name: RRM_1 Pfam Description: RNA recognition motif. (a.k.a. RRM, RBD, or RNP domain)
  misc_feature (15)..(15): Xaa is any aa, unknown, or other
MSGEAEYRCFVGGLXWATADADLERTFSQFGEVIDSKIINDRETGRSRGFGFVTFKDEKSMRDAIVEMNGKELDGRTITVNEAQSRGSGGGGGGRGGGGGYRGGGGGGYGGGGGYGGGGGGYGRRDGGGYGSGGGGGYGGRRD

SEQ ID NO: 181 - protein, 85 aa, Brassica napus
  misc_feature (1)..(85): Ceres CLONE ID no. 1110162
  misc_feature (1)..(85): Functional Homolog of  Ceres CLONE ID no.  1003205
  misc_feature (8)..(79): Pfam Name: RRM_1 Pfam Description: RNA recognition motif. (a.k.a. RRM, RBD, or RNP domain)
MSEVEYRCFVGGLAWATGDAELERTFSQFGEVIDSKIINDRETGRSRGFGFVTFKDEKSMKDAIDEMNGKELDGRTITVNEAQSR

SEQ ID NO: 182 - protein, 169 aa, Brassica napus
  misc_feature (1)..(169): Public GI no. 17819
  misc_feature (1)..(169): Functional Homolog of  Ceres CLONE ID no.  1003205
  misc_feature (8)..(79): Pfam Name: RRM_1 Pfam Description: RNA recognition motif. (a.k.a. RRM, RBD, or RNP domain)
MSEVEYRCFVGGLAWATGDAELERTFSQFGEVIDSKIINDRETGRSRGFGFVTFKDEKSMKDAIDEMNGKELDGRTITVNEAQSRGGGGGGGRGGGGYGGRGGGGYGGGGGGYGDRRGGGGYGSGGGGRGGGGYGSGGGGYGGGGGRRDGGGYGGGDGGYGGGSGGGGW

SEQ ID NO: 183 - protein, 157 aa, Glycine max
  misc_feature (1)..(157): Ceres CLONE ID no. 1416673
  misc_feature (1)..(157): Functional Homolog of  Ceres CLONE ID no.  1003205
  misc_feature (8)..(79): Pfam Name: RRM_1 Pfam Description: RNA recognition motif. (a.k.a. RRM, RBD, or RNP domain)
MSEVEYRCFVGGLAWATGDAELERTFSQFGEVIDSKIINDRETGRSRGFGFVTFKDEKSMKDAIDEMNGKELDGRTITVNEAQSRGGGGGGGRGGGGYGGRGGGGYGGGGGGYGDRRGGGGYGSGGAGYGGGGGRRDGGGYGGADGGYGGGSGGGGW

SEQ ID NO: 184 - protein, 133 aa, Glycine max
  misc_feature (1)..(133): Ceres CLONE ID no. 1076411
  misc_feature (1)..(133): Functional Homolog of  Ceres CLONE ID no.  1003205
  misc_feature (8)..(79): Pfam Name: RRM_1 Pfam Description: RNA recognition motif. (a.k.a. RRM, RBD, or RNP domain)
MSEVEYRCFVGGLAWATGDAELERTFSQFGEVIDSKIINDRETGRSRGFGFVTFKDEKSMKDAIDEMNGKELDGRTITVNEAQSRGGGGGGGRGGGGYGGRGGGGYGGGGGGYGDRRGGGGYGSGGGGRGGGG

SEQ ID NO: 185 - protein, 146 aa, Zea mays
  misc_feature (1)..(146): Ceres CLONE ID no. 1465358
  misc_feature (1)..(146): Functional Homolog of  Ceres CLONE ID no.  1003205
  misc_feature (9)..(80): Pfam Name: RRM_1 Pfam Description: RNA recognition motif. (a.k.a. RRM, RBD, or RNP domain)
  misc_feature (135)..(135): Xaa is any aa, unknown, or other
MSAEVEYRCFVGGLAWATGDAELERTFSQFGEVIDSKIINDRETGRSRGFGFVTFKDEKSMRDAIDEMNGKELDGRTITVNEAQSRGSGGGGGRGGGGYGGRGGGGYGGGGGGYGDRRGGGGYGSGGGGRGGGEXGGGGGDVKEWV

SEQ ID NO: 186 - protein, 157 aa, Daucus carota
  misc_feature (1)..(157): Public GI no. 18347
  misc_feature (1)..(157): Functional Homolog of  Ceres CLONE ID no.  1003205
  misc_feature (8)..(79): Pfam Name: RRM_1 Pfam Description: RNA recognition motif. (a.k.a. RRM, RBD, or RNP domain)
MAEVEYRCFVGGLAWATNDESLEQAFSQFGDITDSKIINDRETGRSRGFGFVTFKDEKSMRDAIEGMNGQELDGRNITVNEAQSRGSGGGGGRREGGGGGYGGGGGYGGRREGGGGGGYGGRREGGGGGYGGGGGGYGGRREGGDGGYGGGGGGSRW

SEQ ID NO: 187 - protein, 136 aa, Brassica napus
  misc_feature (1)..(136): Ceres CLONE ID no. 873740
  misc_feature (1)..(136): Functional Homolog of  Ceres CLONE ID no.  1003205
  misc_feature (10)..(81): Pfam Name: RRM_1 Pfam Description: RNA recognition motif. (a.k.a. RRM, RBD, or RNP domain)
  misc_feature (126)..(126): Xaa is any aa, unknown, or other
MASPDVEYRCFVGGLAWATDDRALETAFSQFGDVLDSKIINDRETGRSRGFGFVTFKDEKSMKDAIEGMNGQDLDGRSITVNEAQSRGSGGGGGGRGGGGGGYRSGGGGGYGGGGGGYGGGGGRRXGGYSGGGGGG

SEQ ID NO: 188 - protein, 135 aa, Glycine max
  misc_feature (1)..(135): Ceres CLONE ID no. 1075035
  misc_feature (1)..(135): Functional Homolog of  Ceres CLONE ID no.  1003205
  misc_feature (10)..(81): Pfam Name: RRM_1 Pfam Description: RNA recognition motif. (a.k.a. RRM, RBD, or RNP domain)
  misc_feature (130)..(130): Xaa is any aa, unknown, or other
MASPDVEYRCFVGGLAWATDDRALETAFSQFGDVLDSKIINDRETGRSRGFGFVTFKDEKSMKDAIEGMNGQDLDGRSITVNEAQSRGSGGGGGGRGGGGGGYRSGGGGGYGGGGGGYGGGGGRREGGYXGGGGG

SEQ ID NO: 189 - protein, 138 aa, Brassica napus
  misc_feature (1)..(138): Ceres CLONE ID no. 1083222
  misc_feature (1)..(138): Functional Homolog of  Ceres CLONE ID no.  1003205
  misc_feature (10)..(81): Pfam Name: RRM_1 Pfam Description: RNA recognition motif. (a.k.a. RRM, RBD, or RNP domain)
MASPDVEYRCFVGGLAWATDDRALETAFSQYGDVLDSKIINDRETGRSRGFGFVTFKDEKAMKDAIEGMNGQDLDGRSITVNEAQSRGGGGGGGRGGGGGGYRSGGGGGYGGGGGGYGGGGGRREGGYSGGGGGGYSS

SEQ ID NO: 190 - protein, 118 aa, Arabidopsis thaliana
  misc_feature (1)..(118): Ceres CLONE ID no. 1012773
  misc_feature (1)..(118): Functional Homolog of  Ceres CLONE ID no.  1003205
  misc_feature (10)..(81): Pfam Name: RRM_1 Pfam Description: RNA recognition motif. (a.k.a. RRM, RBD, or RNP domain)
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGYRSGGGGGYSGGGGGW

SEQ ID NO: 191 - protein, 107 aa, Zea mays
  misc_feature (1)..(107): Ceres CLONE ID no. 1385361
  misc_feature (1)..(107): Functional Homolog of  Ceres CLONE ID no.  1003205
  misc_feature (10)..(81): Pfam Name: RRM_1 Pfam Description: RNA recognition motif. (a.k.a. RRM, RBD, or RNP domain)
MASPDVEYRCFVGGLAWATDDRALETAFSQYGDVLDSKIINDRETGRSRGFGFVTFKDEKAMKDAIEGMNGQDLDGRSITVNEAQSRGGGGGGGRGGGGGGYRSGGG

SEQ ID NO: 192 - protein, 166 aa, Sinapis alba
  misc_feature (1)..(166): Public GI no. 1346180
  misc_feature (1)..(166): Functional Homolog of  Ceres CLONE ID no.  1003205
  misc_feature (10)..(81): Pfam Name: RRM_1 Pfam Description: RNA recognition motif. (a.k.a. RRM, RBD, or RNP domain)
MASPDVEYRCFVGGLAWATDDRALETAFSQYGEVLDSKIINDRETGRSRGFGFVTFKDEKSMKDAIEGMNGQDLDGRSITVNEAQSRGSGGGGGGRGGGGGYRSGGGGGYGGGGGGYGGGGREGGYSGGGGGYSSRGGGGGGYGGGGRRDGGEGGGYGGSGGGGGW

SEQ ID NO: 193 - protein, 130 aa, Arabidopsis thaliana
  misc_feature (1)..(130): Ceres CLONE ID no. 1011900
  misc_feature (1)..(130): Functional Homolog of  Ceres CLONE ID no.  1003205
  misc_feature (1)..(130): GEMINI ID 534F12
  misc_feature (10)..(81): Pfam Name: RRM_1 Pfam Description: RNA recognition motif. (a.k.a. RRM, RBD, or RNP domain)
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGYRSGGGGGYSGGGGSYGGGGGRREGGGW

SEQ ID NO: 194 - protein, 156 aa, Nicotiana sylvestris
  misc_feature (1)..(156): Public GI no. 469070
  misc_feature (1)..(156): Functional Homolog of  Ceres CLONE ID no.  1003205
  misc_feature (8)..(79): Pfam Name: RRM_1 Pfam Description: RNA recognition motif. (a.k.a. RRM, RBD, or RNP domain)
MAEVEYRCFVGGLAWATTDQTLGEAFSQFGEILDSKIINDRETGRSRGFGFVTFKDEKAMRDAIEGMNGQDLDGRNITVNEAQSRGSGGGGGGGGYRGGSGGGYGGGGRREGGYGGGGGYGGGRREGGYGGGGGGGYGGGRREGGYGGGSEGNWRS

SEQ ID NO: 195 - DNA, 498 bp, Populus balsamifera subsp. trichocarpa
  misc_feature (1)..(498): Ceres ANNOT ID no. 1450324
atggctgctgaggttgagtacaggtgctttgttggtggcctcgcatgggccactactgaccaatcccttcaagaagcgtttagccagtacggtgaaatcatcgattcgaagattataaacgatcgtgaaactggaagatctcgcggctttggatttgttaccttcaacaacgagaaggcaatgagagatgcgattgatggaatgaacggccaagaccttgatgggcgtaacatcaccgtgaatgaagcacaatcccgcggaagcggcggtggtggcggaggtgggggctacagccgtggaggcggtggcggttacggaggtcgccgtgaaggtggcggaggcggttatagccgtggtggaggtggatacggcggtggtggaggtggatacggcggcggcggtggtggttatggtggtggacgtgaccgtgggtacggtgatggtggatcaaggtattcttccaggggcggatctgatggtggtagctggagggactag

SEQ ID NO: 196 - protein, 165 aa, Populus balsamifera subsp. trichocarpa
  misc_feature (1)..(165): Ceres ANNOT ID no. 1450324
  misc_feature (1)..(165): Functional Homolog of  Ceres CLONE ID no.  1003205
  misc_feature (9)..(80): Pfam Name: RRM_1 Pfam Description: RNA recognition motif. (a.k.a. RRM, RBD, or RNP domain)
MAAEVEYRCFVGGLAWATTDQSLQEAFSQYGEIIDSKIINDRETGRSRGFGFVTFNNEKAMRDAIDGMNGQDLDGRNITVNEAQSRGSGGGGGGGGYSRGGGGGYGGRREGGGGGYSRGGGGYGGGGGGYGGGGGGYGGGRDRGYGDGGSRYSSRGGSDGGSWRD

SEQ ID NO: 197 - DNA, 513 bp, Populus balsamifera subsp. trichocarpa
  misc_feature (1)..(513): Ceres ANNOT ID no. 1460836
atgtctgccgaggttgagtacaggtgctttgttggcggcctcgcttgggccaccactgaccaagtcctccaagaggcttttagccagtacggtgaaatcatcgattcgaagattataaatgaccgtgaaaccggaagatctcgtggttttggatttgtgaccttcggcaatgagaaggcaatgagagatgctattgatggaatgaacggtcaggacctcgatggccgtaacatcaccgtgaacgaagctcaatcccgcggaagtggtggaggtggtggtggcggcggtggttacaaccgcaacagcggtggtggcggttatggaggaggtggacgccgtgaaggcggcggtggttacagccgtggcggaggcggctacggaggcggtggaagcggatatggtagtggtggcggcggcggtggttatggcggtggccgtgaccgtggttatggtgacggtggatctaggtactcttcaaggggtgaatccgaaggtggtagctggaggagttag

SEQ ID NO: 198 - protein, 170 aa, Populus balsamifera subsp. trichocarpa
  misc_feature (1)..(170): Ceres ANNOT ID no. 1460836
  misc_feature (1)..(170): Functional Homolog of  Ceres CLONE ID no.  1003205
  misc_feature (9)..(80): Pfam Name: RRM_1 Pfam Description: RNA recognition motif. (a.k.a. RRM, RBD, or RNP domain)
MSAEVEYRCFVGGLAWATTDQVLQEAFSQYGEIIDSKIINDRETGRSRGFGFVTFGNEKAMRDAIDGMNGQDLDGRNITVNEAQSRGSGGGGGGGGGYNRNSGGGGYGGGGRREGGGGYSRGGGGYGGGGSGYGSGGGGGGYGGGRDRGYGDGGSRYSSRGESEGGSWRS

SEQ ID NO: 199 - protein, 160 aa, Oryza sativa
  misc_feature (1)..(160): Public GI no. 2624326
  misc_feature (1)..(160): Functional Homolog of  Ceres CLONE ID no.  1003205
  misc_feature (10)..(81): Pfam Name: RRM_1 Pfam Description: RNA recognition motif. (a.k.a. RRM, RBD, or RNP domain)
MAAPDVEYRCFVGGLAWATDDRSLEAAFSTFGEILESKIINDRETGRSRGFGFVTFSSEQAMRDAIEGMNGKELDGRNITVNEAQSRRSGGGGGGGYGQRGGGGGYGGGGGYGGGGGGGYASREGGYGGGGGYGGGRGGGGGYGGGYGRGGGNSDGNWRN

SEQ ID NO: 200 - protein, 117 aa, Oryza sativa
  misc_feature (1)..(117): Public GI no. 108863012
  misc_feature (1)..(117): Functional Homolog of  Ceres CLONE ID no.  1003205
  misc_feature (10)..(81): Pfam Name: RRM_1 Pfam Description: RNA recognition motif. (a.k.a. RRM, RBD, or RNP domain)
MAAPDVEYRCFVGGLAWATDDRSLEAAFSTFGEILESKIINDRETGRSRGFGFVTFSSEQAMRDAIEGMNGKELDGRNITVNEAQSRRSGGGGGGGYGQRGGGGGYGGGGGYGGGAP

SEQ ID NO: 201 - protein, 115 aa, Triticum aestivum
  misc_feature (1)..(115): Ceres CLONE ID no. 815584
  misc_feature (1)..(115): Functional Homolog of  Ceres CLONE ID no.  1003205
  misc_feature (8)..(79): Pfam Name: RRM_1 Pfam Description: RNA recognition motif. (a.k.a. RRM, RBD, or RNP domain)
MAETEYRCFVGGLAWATDDNNLQQAFSQYGEILDAKIINDRETGRSRGFGFVTFGSEESMRQAIEEMNGKELDGRNITVNEAQSRRSGGGGGGGGYGGGGGGYGGGGGGYGGQRG

SEQ ID NO: 202 - protein, 112 aa, Triticum aestivum
  misc_feature (1)..(112): Ceres CLONE ID no. 751438
  misc_feature (1)..(112): Functional Homolog of  Ceres CLONE ID no.  1003205
  misc_feature (8)..(79): Pfam Name: RRM_1 Pfam Description: RNA recognition motif. (a.k.a. RRM, RBD, or RNP domain)
MAETEYRCFVGGLAWATDDNNLQQAFSQYGEILDAKIINDRETGRSRGFGFVTFGSEESMRQAIEEMNGKELDGRNITVNEAQSRRSGGGGGGGGYGGQRGGGGGYGGGGGG

SEQ ID NO: 203 - protein, 106 aa, Triticum aestivum
  misc_feature (1)..(106): Ceres CLONE ID no. 924811
  misc_feature (1)..(106): Functional Homolog of  Ceres CLONE ID no.  1003205
  misc_feature (8)..(79): Pfam Name: RRM_1 Pfam Description: RNA recognition motif. (a.k.a. RRM, RBD, or RNP domain)
MAETEYRCFVGGLAWATDDNNLQQAFSQYGEILDAKIINDRETGRSRGFGFVTFGSEESMRQAIEEMNGKELDGRNITVNEAQSRRSGGGGGGGGYGGKHGCRPHP

SEQ ID NO: 204 - protein, 121 aa, Triticum aestivum
  misc_feature (1)..(121): Ceres CLONE ID no. 741793
  misc_feature (1)..(121): Functional Homolog of  Ceres CLONE ID no.  1003205
  misc_feature (8)..(79): Pfam Name: RRM_1 Pfam Description: RNA recognition motif. (a.k.a. RRM, RBD, or RNP domain)
MAETEYRCFVGGLAWATDDHNLQQAFSQYGEILDAKIINDRETGRSRGFGFVTFGSEESMRQAIEEMNGKELDGRNITVNEAQSRRSGGGGGGGGGYGGQGGGGYGQGGGGGYGQGGGGYG

SEQ ID NO: 205 - protein, 108 aa, Triticum aestivum
  misc_feature (1)..(108): Ceres CLONE ID no. 754335
  misc_feature (1)..(108): Functional Homolog of  Ceres CLONE ID no.  1003205
  misc_feature (8)..(79): Pfam Name: RRM_1 Pfam Description: RNA recognition motif. (a.k.a. RRM, RBD, or RNP domain)
MAETEYRCFVGGLAWATDDNNLQQAFSQYGEILDAKIINDRETGRSRGFGFVTFGSEESMRQAIEEMNGKELDGRNITVNEAQSRRSGGGGGGGGYGGQRGGGGGYGG

SEQ ID NO: 206 - protein, 112 aa, Triticum aestivum
  misc_feature (1)..(112): Ceres CLONE ID no. 761865
  misc_feature (1)..(112): Functional Homolog of  Ceres CLONE ID no.  1003205
  misc_feature (8)..(79): Pfam Name: RRM_1 Pfam Description: RNA recognition motif. (a.k.a. RRM, RBD, or RNP domain)
  misc_feature (103)..(103): Xaa is any aa, unknown, or other
MAETEYRCFVGGLAWATDDHNLQQAFSQYGEILDAKIINDRETGRSRGFGFVTFGSEESMRQAIEEMNGKELDGRNITVNEAQSRRSGGGGGGGGYGGQRGGXGGYGGGGGG

SEQ ID NO: 207 - protein, 111 aa, Triticum aestivum
  misc_feature (1)..(111): Ceres CLONE ID no. 785819
  misc_feature (1)..(111): Functional Homolog of  Ceres CLONE ID no.  1003205
  misc_feature (8)..(79): Pfam Name: RRM_1 Pfam Description: RNA recognition motif. (a.k.a. RRM, RBD, or RNP domain)
MAETEYRCFVGGLAWATDDNNLQQAFSQYGEILDAKIINDRETGRSRGFGFVTFGSEESMRQAIEEMNGKELDGRNITVNEAQSRRSGGGGGGGGYGGQRGGGLAAAAVFY

SEQ ID NO: 208 - protein, 93 aa, Triticum aestivum
  misc_feature (1)..(93): Ceres CLONE ID no. 758560
  misc_feature (1)..(93): Functional Homolog of  Ceres CLONE ID no.  1003205
  misc_feature (8)..(79): Pfam Name: RRM_1 Pfam Description: RNA recognition motif. (a.k.a. RRM, RBD, or RNP domain)
MAETEYRCFVGGLAWATDDNNLQQAFSQYGEILDAKIINDRETGRSRGFGFVTFGSEESMRQAIEEMNGKELDGRNITVNEAQSRRRPIPEQE

SEQ ID NO: 209 - protein, 84 aa, Glycine max
  misc_feature (1)..(84): Ceres CLONE ID no. 1467901
  misc_feature (1)..(84): Functional Homolog of  Ceres CLONE ID no.  1003205
  misc_feature (8)..(79): Pfam Name: RRM_1 Pfam Description: RNA recognition motif. (a.k.a. RRM, RBD, or RNP domain)
MAETEYRCFVGGLAWATDDNNLQQAFSQYGEILDAKIINDRETGRSRGFGFVTFGSEESMRQAIEEMNGKELDGRNITVNEAQS

SEQ ID NO: 210 - protein, 105 aa, Triticum aestivum
  misc_feature (1)..(105): Ceres CLONE ID no. 702924
  misc_feature (1)..(105): Functional Homolog of  Ceres CLONE ID no.  1003205
  misc_feature (8)..(79): Pfam Name: RRM_1 Pfam Description: RNA recognition motif. (a.k.a. RRM, RBD, or RNP domain)
  misc_feature (50)..(50): Xaa is any aa, unknown, or other
MAETEYRCFVGGLAWATDDNNLQQAFSQYGEILDAKIINDRETGRSRGFXFVTFGSEESMRQAIEEMNGKELDGRNITVNEAQSRRSGGGGGGGYGGGGGYGGGG

SEQ ID NO: 211 - protein, 109 aa, Triticum aestivum
  misc_feature (1)..(109): Ceres CLONE ID no. 737259
  misc_feature (1)..(109): Functional Homolog of  Ceres CLONE ID no.  1003205
  misc_feature (8)..(79): Pfam Name: RRM_1 Pfam Description: RNA recognition motif. (a.k.a. RRM, RBD, or RNP domain)
MAETEYRCFVGGLAWATDDNNLQQAFSQCGEILDAKIINDRETGRSRGFGFVTFGSEESMRQAIEEMNGKELDGRNITVNEAQSRRSGGGGGGGGGYGGQRGGGGGYGG

SEQ ID NO: 212 - protein, 119 aa, Triticum aestivum
  misc_feature (1)..(119): Ceres CLONE ID no. 867872
  misc_feature (1)..(119): Functional Homolog of  Ceres CLONE ID no.  1003205
  misc_feature (8)..(79): Pfam Name: RRM_1 Pfam Description: RNA recognition motif. (a.k.a. RRM, RBD, or RNP domain)
  misc_feature (91)..(91): Xaa is any aa, unknown, or other
MAETEYRCFVGGLAWATDDHNLQQAFSQYGEILDAKIINDRETGRSRGFGFVTFGSEESMRQAIEEMNGKELDGRNITVNEAQSRRSGGGXGGGGYGGYGGGGGGYGGQRGGGDSGGQW

SEQ ID NO: 213 - protein, 96 aa, Triticum aestivum
  misc_feature (1)..(96): Ceres CLONE ID no. 617713
  misc_feature (1)..(96): Functional Homolog of  Ceres CLONE ID no.  1003205
  misc_feature (8)..(79): Pfam Name: RRM_1 Pfam Description: RNA recognition motif. (a.k.a. RRM, RBD, or RNP domain)
MAETEYRCFVGGLAWATDDHNLQQAFSQYGEILDAKIINDRETGRSRGFGFVTFGSEESMRQAIEEMNGKELDGRNITVNEAQSRRSGGGGRGGGY

SEQ ID NO: 214 - protein, 110 aa, Triticum aestivum
  misc_feature (1)..(110): Ceres CLONE ID no. 756168
  misc_feature (1)..(110): Functional Homolog of  Ceres CLONE ID no.  1003205
  misc_feature (8)..(79): Pfam Name: RRM_1 Pfam Description: RNA recognition motif. (a.k.a. RRM, RBD, or RNP domain)
MAETEYRCFVGGLAWATDDNNLQQAFSQYGEILDAKIINDRETGRSRGFGFVTFGSEESMRQAIEEMNGKELDGRNITVNEAQSRRSGGGGGGGGYGGQRGGDSGGQWRN

SEQ ID NO: 215 - protein, 97 aa, Triticum aestivum
  misc_feature (1)..(97): Ceres CLONE ID no. 731572
  misc_feature (1)..(97): Functional Homolog of  Ceres CLONE ID no.  1003205
  misc_feature (8)..(79): Pfam Name: RRM_1 Pfam Description: RNA recognition motif. (a.k.a. RRM, RBD, or RNP domain)
  misc_feature (72)..(72): Xaa is any aa, unknown, or other
  misc_feature (92)..(92): Xaa is any aa, unknown, or other
MAETEYRCFVGGLAWATDDHNLQQAFSQYGEILDAKIINDRETGRSRGFGFVTFGSEESMRQAIEEMNGKEXDGRNITVNEAQSRRSGGGGXRRRLR

SEQ ID NO: 216 - DNA, 701 bp, Gossypium hirsutum
  misc_feature (1)..(701): Ceres CLONE ID no.1898837
attcacagctctttacaaaatatctgctcctcttagtttccctttttgtcccttgtttatttgatactcccccctcatggctgccgctgatgtcgagttccggtgcttcgtcggagggctcgcatgggccaccgacgaccgggcccttgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacataactgtcaacgaagcccaatcgcgcagaagtggaggcggtggcggaggatttggaggaggaaacggtggttacagccgcggtggaggcggcggcggatatggtggtcgccaaggaggatatggtggcggacgccgtgacggcggatctcgttactcaagaggcggcggtgcatctgaaggcaactggaggtcttaaatttagggtttcaaagtgggcttgggcctatattgttatgggtttggtttgggtttggtagttggtaattctaaagttactctgttactgtttggtttgggttctctcgtttttgatcgatgttgttactgttctcttaaaagcataaaaatggaatgaagtatcttcttttcaaaaaaaaaaaaaaaaaaaa

SEQ ID NO: 217 - protein, 143 aa, Gossypium hirsutum
  misc_feature (1)..(143): Ceres CLONE ID no. 1898837
  misc_feature (1)..(143): Functional Homolog of  Ceres CLONE ID no.  1003205
  misc_feature (10)..(81): Pfam Name: RRM_1 Pfam Description: RNA recognition motif. (a.k.a. RRM, RBD, or RNP domain)
MAAADVEFRCFVGGLAWATDDRALEEAFSAFGEIVESKIINDRETGRSRGFGFVTFRDEKAMRDAIEGMNGQNLDGRNITVNEAQSRRSGGGGGGFGGGNGGYSRGGGGGGYGGRQGGYGGGRRDGGSRYSRGGGASEGNWRS

SEQ ID NO: 218 - DNA, 497 bp, Gossypium hirsutum
  misc_feature (1)..(497): Ceres CLONE ID no.1834630
cttcccccccctttttgtcccttgtttatttgatactcccccctcatggctgccgctgatgtcgagttcctgtgcttcgtcggagggctcgcatgggccaccgacgaccgggcccttgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacataactgtcaacgtttttttttcgcgcagaagtggaggcggtggcggaggatttggaggaggaaacggtggttacagccgcggtggaggcggcggcggatatggtggtcgccaaggaggatatggtggcggacgccgtgaaggtggatacggaaacggtggggggtatggtggaggtggatacggaggtggacgccctgaaggaggatacggtgaccg

SEQ ID NO: 219 - protein, 150 aa, Gossypium hirsutum
  misc_feature (1)..(150): Ceres CLONE ID no. 1834630
  misc_feature (1)..(150): Functional Homolog of  Ceres CLONE ID no.  1003205
  misc_feature (10)..(81): Pfam Name: RRM_1 Pfam Description: RNA recognition motif. (a.k.a. RRM, RBD, or RNP domain)
MAAADVEFLCFVGGLAWATDDRALEEAFSAFGEIVESKIINDRETGRSRGFGFVTFRDEKAMRDAIEGMNGQNLDGRNITVNVFFSRRSGGGGGGFGGGNGGYSRGGGGGGYGGRQGGYGGGRREGGYGNGGGYGGGGYGGGRPEGGYGD

SEQ ID NO: 220 - DNA, 626 bp, Oryza sativa
  misc_feature (1)..(626): Ceres CLONE ID no.  1011900
  misc_feature (1)..(626): GEMINI ID 534F12
  misc_feature: Encodes the peptide sequence at SEQ ID NO. 193
  misc_feature: Encodes the peptide sequence at SEQ ID NO. 221
acatctcactgctcactactctcactgtaatcccttagatcttcttttcaaatttcaatggcgtccggtgatgttgagtatcggtgcttcgttggaggtctagcatgggccactgatgacagagctcttgagactgccttcgctcaatacggcgacgttattgattccaagatcattaacgatcgtgagactggaagatcaaggggattcggattcgtcaccttcaaggatgagaaagccatgaaggatgcgattgagggaatgaacggacaagatctcgatggccgtagcatcactgttaacgaggctcagtcacgaggaagcggtggcggcggaggccaccgtggaggtggtggcggtggataccgcagcggcggtggtggaggttactccggtggaggtggtagctacggaggtggcggcggtagacgcgagggtggaggatggtaattcctttaattaggtttgggattaccaatgaatgttctctctctcgcttgttatgcttctacttggttttgtgtgttctctattttgttctggttctgctttagatttgatgtaacagttcgtgattaggtattttggtatctggaaacgtaatgttaagtcacttgtcattctcc

SEQ ID NO: 221 - protein, 130 aa, Oryza sativa; identical to SEQ ID NO: 193
  misc_feature (1)..(130): Ceres CLONE ID no.  1011900
  misc_feature (1)..(130): GEMINI ID 534F12
  misc_feature (10)..(81): Pfam Name: RRM_1 Pfam Description: RNA recognition motif. (a.k.a. RRM, RBD, or RNP domain)

SEQ ID NO: 222 - protein, 138 aa, Brassica napus; identical to SEQ ID NO: 189
  misc_feature (1)..(138): Ceres CLONE ID no. 1083222
  misc_feature (1)..(138): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)

SEQ ID NO: 223 - protein, 135 aa, Glycine max; identical to SEQ ID NO: 188
  misc_feature (1)..(135): Ceres CLONE ID no. 1075035
  misc_feature (1)..(135): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
  misc_feature (130)..(130): Xaa is any aa, unknown, or other

SEQ ID NO: 224 - protein, 136 aa, Brassica napus; identical to SEQ ID NO: 187
  misc_feature (1)..(136): Ceres CLONE ID no. 873740
  misc_feature (1)..(136): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
  misc_feature (126)..(126): Xaa is any aa, unknown, or other

SEQ ID NO: 225 - protein, 168 aa, Zea mays
  misc_feature (1)..(168): Ceres CLONE ID no. 1444599
  misc_feature (1)..(168): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MASPDVEYRCFVGGLAWATDDRALETAFSQYGDVLDSKIINDRETGRSRGFGFVTFKDEKSMKDAIEGMNGQDLDGRSITVNEAQSRGGGGGGGRGGGGGGYRSGGGGGYGGGGGGYGGGWWKTRGWLQWAVVEVVTPREEVVAVEATVAGVMVVKVEVTEERWWWLV

SEQ ID NO: 226 - protein, 158 aa, Brassica napus
  misc_feature (1)..(158): Ceres CLONE ID no. 965777
  misc_feature (1)..(158): Functional Homolog of  Ceres CLONE ID no.  1011900
  misc_feature (22)..(93): Pfam Name: RRM_1 Pfam Description: RNA recognition motif. (a.k.a. RRM, RBD, or RNP domain)
HILLFTVNLFISMASPDVEYRCFVGGLAWATDERSLETAFSKFGELVDSKIINDRETGRSRGFGFVTFKDEQSMKDAIEGMNGQDLDGRSITVNEAQSRGSGGGGGGRGGGGGYRGGGGGYGGGGGYGGGRREGGYSGGGGGGYSSRGGGGGGYGGGG

SEQ ID NO: 227 - protein, 169 aa, Sinapis alba
  misc_feature (1)..(169): Public GI no. 1346181
  misc_feature (1)..(169): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MASPDVEYRCFVGGLAWATDERSLETAFSQFGELVDSKIINDRETGRSRGFGFVTFKDEKSMKDAIEGMNGQDLDGRSITVNEAQSRGSGAGGGGRGGGGGYRGGGGYGGGGGGYGGGRREGGGYSGGGGGYSSRGGGGGGYGGGGRRDGGGYGGGEGGGYGGGGGGGW

SEQ ID NO: 228 - protein, 95 aa, Brassica napus
  misc_feature (1)..(95): Ceres CLONE ID no. 973585
  misc_feature (1)..(95): Functional Homolog of  Ceres CLONE ID no.  1011900
  misc_feature (13)..(55): Pfam Name: RRM_1 Pfam Description: RNA recognition motif. (a.k.a. RRM, RBD, or RNP domain)
  misc_feature (72)..(72): Xaa is any aa, unknown, or other
MLCYCYFLILKSIINDRETGQSRGFGFVTFKDEKSMKDAIEGMNGQDLDGRSITVNEAQSRGSGGGGGGRGXGGGGYRSGGGGGYGGGGGGYGGG

SEQ ID NO: 229 - protein, 165 aa, Brassica napus
  misc_feature (1)..(165): Ceres CLONE ID no. 1092319
  misc_feature (1)..(165): Functional Homolog of  Ceres CLONE ID no.  1011900
  misc_feature (22)..(93): Pfam Name: RRM_1 Pfam Description: RNA recognition motif. (a.k.a. RRM, RBD, or RNP domain)
THPSLHCKRFISMAAPDVEYRCFVGGLAWATDERSLETAFSKFGELVDSKIINDRETGRSRGFGFVTFKDEQSMKDAIEGMNGQDLDGRSITVNEAQSRGSGGGGGGRGGGGGYRGGGGGGGYGGGGGGYGGGRREGGYSGGGGGYSSRGGGGGGYGGGGRREGG

SEQ ID NO: 230 - protein, 163 aa, Brassica napus
  misc_feature (1)..(163): Ceres CLONE ID no. 945779
  misc_feature (1)..(163): Functional Homolog of  Ceres CLONE ID no.  1011900
  misc_feature (22)..(93): Pfam Name: RRM_1 Pfam Description: RNA recognition motif. (a.k.a. RRM, RBD, or RNP domain)
THPSLHCKPFISMAAPDVEYRCFVGGLAWATDERSLETAFSKFGELVDSKIINDRETGRSRGFGFVTFKDEQSMKDAIEGMNGQDLDGRSITVNEAQSRGSGGGGRGGGGGYRGGGGGGYGGGGGGYGGGRREGGYSGGGGGYSSRGGGGGGYGGGGRREGGG

SEQ ID NO: 231 - protein, 116 aa, Triticum aestivum
  misc_feature (1)..(116): Ceres CLONE ID no. 1053672
  misc_feature (1)..(116): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAPDVEYRCFVGGLAWATDERSLETAFSKFGELVDSKIINDRETGRSRGFGFVTFKDEQSMKDAIEGMNGQDLDGRSITVNEAQSRGSGGGGRGGGGGYRGGGGGGYGGGGGGYG

SEQ ID NO: 232 - protein, 156 aa, Nicotiana sylvestris; identical to SEQ ID NO: 194
  misc_feature (1)..(156): Public GI no. 469070
  misc_feature (1)..(156): Functional Homolog of  Ceres CLONE ID no.  1011900
  misc_feature (8)..(79): Pfam Name: RRM_1 Pfam Description: RNA recognition motif. (a.k.a. RRM, RBD, or RNP domain)

SEQ ID NO: 233 - protein, 126 aa, Arabidopsis thaliana
  misc_feature (1)..(126): Public GI no. 30692254
  misc_feature (1)..(126): Functional Homolog of  Ceres CLONE ID no.  1011900
  misc_feature (8)..(79): Pfam Name: RRM_1 Pfam Description: RNA recognition motif. (a.k.a. RRM, RBD, or RNP domain)
MSEVEYRCFVGGLAWATNDEDLQRTFSQFGDVIDSKIINDRESGRSRGFGFVTFKDEKAMRDAIEEMNGKELDGRVITVNEAQSRGSGGGGGGRGGSGGGYRSGGGGGYSGGGGGGYSGGGGGGGW

SEQ ID NO: 234 - protein, 156 aa, Nicotiana glutinosa
  misc_feature (1)..(156): Public GI no. 2226370
  misc_feature (1)..(156): Functional Homolog of  Ceres CLONE ID no.  1011900
  misc_feature (8)..(79): Pfam Name: RRM_1 Pfam Description: RNA recognition motif. (a.k.a. RRM, RBD, or RNP domain)
MAEVEYRCFVGGLAWATTDQTLGDAFSQYGEILDSKIINDRETGRSRGFGFVTFKDEQAMRDAIEGMNGQDLDGRNITVNEAQSRGSGGGGGGYRGGRGGGGGGYGGGGRREGGYGGGGGGYGGGRREGGYGGGGGYGGGRREGGYGGGSEGNWRN

SEQ ID NO: 235 - protein, 166 aa, Pelargonium x hortorum
  misc_feature (1)..(166): Public GI no. 2267569
  misc_feature (1)..(166): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MASADVEYRCFVGGLAWATDDHALEQAFSQYGEVVESKIINDRETGRSRGFGFVTFSNEKSMNDAIEGMNGQNLDGRNITVNEAQSRGSGGGGGRREGGGGGGYGRREGGGGYSRGGGGGGYGGGGGGYGGGNGGGYGGGREQRGYGDSGGGSRYSRDSDGGNWRS

SEQ ID NO: 236 - protein, 148 aa, Nicotiana sylvestris
  misc_feature (1)..(148): Public GI no. 469071
  misc_feature (1)..(148): Functional Homolog of  Ceres CLONE ID no.  1011900
  misc_feature (8)..(79): Pfam Name: RRM_1 Pfam Description: RNA recognition motif. (a.k.a. RRM, RBD, or RNP domain)
MAEVEYSCFVGGLAWATTDRTLADAFGTYGEVLDSKIINDRETGRSRGFGFVTFKDEKCMRDAIEGMNGQELDGRSITVNEAQARGSGGGGGGYGGGRREGGGGGYGGGGGGYGGGRREGGGGGYGGGRREGGGGGYGGGGYGGGGRY

SEQ ID NO: 237 - protein, 165 aa, Nicotiana sylvestris
  misc_feature (1)..(165): Public GI no. 469072
  misc_feature (1)..(165): Functional Homolog of  Ceres CLONE ID no.  1011900
  misc_feature (8)..(79): Pfam Name: RRM_1 Pfam Description: RNA recognition motif. (a.k.a. RRM, RBD, or RNP domain)
MAEVEYRCFVGGLAWATTDRTLGEAFSQYGEVLESKIINDRETGRSRGFGFVTFGDEKSMRDAIEGMNGQDLDGRNITVNEAQSRGSGGGGGGGGFRGGRREGGGGYGGGGYGGGRREGGGGGYGGGGYGGGRDRGYGGGDRGYGGDGGSRYSRGGGDSDGNWRN

SEQ ID NO: 238 - protein, 129 aa, Glycine max; identical to SEQ ID NO: 179
  misc_feature (1)..(129): Ceres CLONE ID no. 1120014
  misc_feature (1)..(129): Functional Homolog of  Ceres CLONE ID no.  1011900
  misc_feature (9)..(80): Pfam Name: RRM_1 Pfam Description: RNA recognition motif. (a.k.a. RRM, RBD, or RNP domain)

SEQ ID NO: 239 - protein, 144 aa, Arabidopsis thaliana
  misc_feature (1)..(144): Ceres CLONE ID no. 102331
  misc_feature (1)..(144): Functional Homolog of  Ceres CLONE ID no.  1011900
  misc_feature (8)..(79): Pfam Name: RRM_1 Pfam Description: RNA recognition motif. (a.k.a. RRM, RBD, or RNP domain)
MSEVEYRCFVGGLAWATNDEDLQRTFSQFGDVIDSKIINDRESGRSRGFGFVTFKDEKAMRDAIEEMNGKELDGRVITVNEAQSRGSGGGGGGRGGSGGGYRSGGGGGYSGGGGGYSGGGGGGYERRSGGYGSGGGGGGAGNQR

SEQ ID NO: 240 - protein, 169 aa, Arabidopsis thaliana
  misc_feature (1)..(169): Public GI no. 16305
  misc_feature (1)..(169): Functional Homolog of  Ceres CLONE ID no.  1011900
  misc_feature (8)..(79): Pfam Name: RRM_1 Pfam Description: RNA recognition motif. (a.k.a. RRM, RBD, or RNP domain)
MSEVEYRCFVGGLAWATNDEDLQRTFSQFGDVIDSKIINDRESGRSRGFGFVTFKDEKAMRDAIEEMNGKELDGRVITVNEAQSRGSGGGGGGRGGSGGGYRSGGGGGYSGGGGGGYSGGGGGGYERRSGGYGSGGGGGGRGYGGGGRREGGGYGGGDGGSYGGGGGGW

SEQ ID NO: 241 - protein, 169 aa, Arabidopsis thaliana; identical to SEQ ID NO: 240
  misc_feature (1)..(169): Ceres CLONE ID no. 14187
  misc_feature (1)..(169): Functional Homolog of  Ceres CLONE ID no.  1011900
  misc_feature (8)..(79): Pfam Name: RRM_1 Pfam Description: RNA recognition motif. (a.k.a. RRM, RBD, or RNP domain)

SEQ ID NO: 242 - protein, 169 aa, Arabidopsis thaliana
  misc_feature (1)..(169): Ceres CLONE ID no. 13439
  misc_feature (1)..(169): Functional Homolog of  Ceres CLONE ID no.  1011900
  misc_feature (8)..(79): Pfam Name: RRM_1 Pfam Description: RNA recognition motif. (a.k.a. RRM, RBD, or RNP domain)
  misc_feature (168)..(168): Xaa is any aa, unknown, or other
MSEVEYRCFVGGLAWATNDEDLQRTFSQFGDVIDSKIINDRESGRSRGFGFVTFKDEKAMRDAIEEMNGKELDGRVITVNEAQSRGSGGGGGGRGGSGGGYRSGGGGGYSGGGGGGYSGGGGGGYERRSGGYGSGGGGGGRGYGGGGRREGGGYGGGDGGSYGGGGGXW

SEQ ID NO: 243 - protein, 169 aa, Arabidopsis thaliana
  misc_feature (1)..(169): Ceres CLONE ID no. 32548
  misc_feature (1)..(169): Functional Homolog of  Ceres CLONE ID no.  1011900
  misc_feature (8)..(79): Pfam Name: RRM_1 Pfam Description: RNA recognition motif. (a.k.a. RRM, RBD, or RNP domain)
  misc_feature (142)..(142): Xaa is any aa, unknown, or other
MSEVEYRCFVGGLAWATNDEDLQRTFSQFGDVIDSKIINDRESGRSRGFGFVTFKDEKAMRDAIEEMNGKELDGRVITVNEAQSRGSGGGGGGRGGSGGGYRSGGGGGYSGGGGGGYSGGGGGGYERRSGGYGSGGGGGGRXYGGGGRREGGGYGGGDGGSYGGGGGGW

SEQ ID NO: 244 - protein, 157 aa, Daucus carota; identical to SEQ ID NO: 186
  misc_feature (1)..(157): Public GI no. 18347
  misc_feature (1)..(157): Functional Homolog of  Ceres CLONE ID no.  1011900
  misc_feature (8)..(79): Pfam Name: RRM_1 Pfam Description: RNA recognition motif. (a.k.a. RRM, RBD, or RNP domain)

SEQ ID NO: 245 - protein, 130 aa, Arabidopsis thaliana
  misc_feature (1)..(130): Ceres CLONE ID no. 1003147
  misc_feature (1)..(130): Functional Homolog of  Ceres CLONE ID no.  1011900
  misc_feature (8)..(79): Pfam Name: RRM_1 Pfam Description: RNA recognition motif. (a.k.a. RRM, RBD, or RNP domain)
MSEVEYRCFVGGLAWATNDEDLQRTFSQFGDVIDSKIINDRESGRSRGFGFVTFKDEKAMRDAIEEMNGKELDGRVITVNEAQSRGSGGGGGGRGGSGGGYRSGGGGGYSGGGGYGGGDGGSYGGGGGGW

SEQ ID NO: 246 - protein, 178 aa, Prunus avium
  misc_feature (1)..(178): Public GI no. 34851124
  misc_feature (1)..(178): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MASAEIEFRCFVGGLAWATDNDALERAFSPFGEIIESKIINDRETGRSRGFGFVTFSNEKAMRDAIEGMNGQNLDGRNITVNEAQSRGSGGGGGGNGGGYSRGGGGGGYGGGGGYGGGGRREGGGGGYSRGGGGGGYGSGGGGYGGGGRREGGYGGGEGGGARYSRGSGGSEGGSWRS

SEQ ID NO: 247 - protein, 167 aa, Citrus unshiu
  misc_feature (1)..(167): Public GI no. 7024451
  misc_feature (1)..(167): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MASADVEFRCFVGGLAWATTDSSLHEAFSAYGDILESKIINDRETGRSRGFGFVTFRDEKSMRDAIEGMNGQNLDGRNITVNEAQSRGSGGGGGGGYGSRGGGGYGGGGRRESGGGGGYGGSRGYGGGGGGYGGRREGGYSRDGGYGGDGGSRYSRSGASDGGSWRN

SEQ ID NO: 248 - protein, 105 aa, Medicago sativa
  misc_feature (1)..(105): Public GI no. 6273331
  misc_feature (1)..(105): Functional Homolog of  Ceres CLONE ID no.  1011900
  misc_feature (8)..(79): Pfam Name: RRM_1 Pfam Description: RNA recognition motif. (a.k.a. RRM, RBD, or RNP domain)
MADVEDRCFVGGLAWATDNDALEKAFSQYGEIVDSKIINDRETGRSRGFGFVTFANEKSMNDVIEAMNGQDLDGRNITVNQAQSRGSGGGGGGRGGGGYGGGGGG

SEQ ID NO: 249 - protein, 168 aa, Rumex obtusifolius
  misc_feature (1)..(168): Public GI no. 20152613
  misc_feature (1)..(168): Functional Homolog of  Ceres CLONE ID no.  1011900
  misc_feature (9)..(80): Pfam Name: RRM_1 Pfam Description: RNA recognition motif. (a.k.a. RRM, RBD, or RNP domain)
MDAEVEYRCFVGGLAWATDDQSLERAFSNYGQVLESKIINDRETGRSRGFGFVTFSSEQAMRDAIEGMNGQDLDGRNITVNEAQSRGSGGGGGGYRGGGGGGYGGRREGGYNRGGGGGYGGGGGGYGGGGGGYGGGGGGYGGGRREGGYGGGGGDRYARGNSDSDWRN

SEQ ID NO: 250 - protein, 190 aa, Medicago truncatula
  misc_feature (1)..(190): Public GI no. 92874469
  misc_feature (1)..(190): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MGSSDVEYRCFVGGLAWATDSQALEQAFSKFGEITDSKVINDRETGRSRGFGFVTFAEEKSMRDAIEEMNGQDIDGRNITVNEAQSRGSGGGGRGGGGGGYGGGGGYGGGGGGYGGGGGRRDGGYSRSGGGGGYGGGGDRGYGGGGGGGYGGGRDRGYGGGGGDRGYGGGGGGDRYSRGGGADSGGNWRD

SEQ ID NO: 251 - protein, 85 aa, Brassica napus; identical to SEQ ID NO: 181
  misc_feature (1)..(85): Ceres CLONE ID no. 1110162
  misc_feature (1)..(85): Functional Homolog of  Ceres CLONE ID no.  1011900
  misc_feature (8)..(79): Pfam Name: RRM_1 Pfam Description: RNA recognition motif. (a.k.a. RRM, RBD, or RNP domain)

SEQ ID NO: 252 - DNA, 498 bp, Populus balsamifera subsp. trichocarpa; identical to SEQ ID NO: 195
  misc_feature (1)..(498): Ceres ANNOT ID no. 1450324

SEQ ID NO: 253 - protein, 165 aa, Populus balsamifera subsp. trichocarpa; identical to SEQ ID NO: 196
  misc_feature (1)..(165): Ceres ANNOT ID no. 1450324
  misc_feature (1)..(165): Functional Homolog of  Ceres CLONE ID no.  1011900
  misc_feature (9)..(80): Pfam Name: RRM_1 Pfam Description: RNA recognition motif. (a.k.a. RRM, RBD, or RNP domain)

SEQ ID NO: 254 - DNA, 513 bp, Populus balsamifera subsp. trichocarpa; identical to SEQ ID NO: 197
  misc_feature (1)..(513): Ceres ANNOT ID no. 1460836

SEQ ID NO: 255 - protein, 170 aa, Populus balsamifera subsp. trichocarpa; identical to SEQ ID NO: 198
  misc_feature (1)..(170): Ceres ANNOT ID no. 1460836
  misc_feature (1)..(170): Functional Homolog of  Ceres CLONE ID no.  1011900
  misc_feature (9)..(80): Pfam Name: RRM_1 Pfam Description: RNA recognition motif. (a.k.a. RRM, RBD, or RNP domain)

SEQ ID NO: 256 - protein, 161 aa, Hordeum vulgare subsp. vulgare
  misc_feature (1)..(161): Public GI no. 1229138
  misc_feature (1)..(161): Functional Homolog of  Ceres CLONE ID no.  1011900
  misc_feature (8)..(79): Pfam Name: RRM_1 Pfam Description: RNA recognition motif. (a.k.a. RRM, RBD, or RNP domain)
MADVEYRCFVGGLRWATDDQSLQNAFSKYGDVIDSKIITDRETGRSRGFGFVTFASDEAMRQAIEAMNGQDLDGRNITVNEAQSRRSDGGGGFGGGGGGYGGQRREGGGGGYGGGGGGYGGGRSGGGGGYGSRDGGGGGYGGGGGGYGGSRGGSGGGNWRE

SEQ ID NO: 257 - DNA, 1342 bp, Gossypium hirsutum
  misc_feature (1)..(1342): Ceres CLONE ID no.1834392
aaccattcacagctctttacaaaatatctgctcctcttagtttccctttttgtcccttgtttatttgatactcccccctcatggctgccgctgatgtcgagttccggtgcttcgtcggagggctcgcatgggccaccgacgaccgggcccttgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacataactgtcaacgaagcccaatcgcgcagaagtggaggcggtggcggaggatttggaggaggaaacggtggttacagccgcggtggaggcggcggcggatatggtggtcgccaaggaggatatggtggcggacgccgtgaaggtggatacggaaacggtggggggtatggtggaggtggatacggaggtggacgccgtgaaggaggatacggtgacggcggatctcgttactcaagaggcggcggtgcatctgaaggcaactggaggtcttaaatttagggtttcaaagtgggcttgggcctatattgttatgggtttggttaaaaagcccacttaactgaaccttttctgcccccaaaatggcgatttcaacaatccaaaagctcacttcccaaatccaccgtctcccacctgtatcctgccacatcctcacccgatcctccgccaccttgtcctcctccaagaaggttgtcgacaggatcgtcaagctcttcgccatcgacccagaaggccaaaagcgggaggttgtgggcctagccggccacagcttacttcgggccttgactaacagcgggctgattgatccggcgtctcaccggctcgaggagattgatgcttgctccgccgaatgcgaggtcaacatcgcccaggaatggctcgagaagcttccaccccgtacctacgatgaggaatatgtgttggtaaggaattcgaggggtcgtatcttgaacaagcattccaggcttgggtgtcaggtcgtgcttacgcctcagctccaaggtatggttgtcgctgtccccgagcctaagccgtgggatattccataaaaatatatatagaactagacggaagtgagggtgctttctaatgtatttctgttgtttttatgggagtaataataattttggtactctgaaagaaacggatttttttccatgtaatttgggtcgcttcgaagttaaatgcaagttattctatggattttggtgttttaaaaaaaaaaaaaaaaaaaaaaaaaaaaaaaaaaa

SEQ ID NO: 258 - protein, 168 aa, Gossypium hirsutum
  misc_feature (1)..(168): Ceres CLONE ID no. 1834392
  misc_feature (1)..(168): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAADVEFRCFVGGLAWATDDRALEEAFSAFGEIVESKIINDRETGRSRGFGFVTFRDEKAMRDAIEGMNGQNLDGRNITVNEAQSRRSGGGGGGFGGGNGGYSRGGGGGGYGGRQGGYGGGRREGGYGNGGGYGGGGYGGGRREGGYGDGGSRYSRGGGASEGNWRS

SEQ ID NO: 259 - DNA, 1129 bp, Gossypium hirsutum
  misc_feature (1)..(1129): Ceres CLONE ID no.1846800
atcattccagctgctctcatttttctttggaaacaaaaaacaaaaaatagaaaaaataaagagcaagagatatggcaagcgcattctcttataattcttttggattccttctcattcttgtcgcctttagttcattgataaatataagttcagctggtaggcaaattgcccctaaaactagcattgagtttatcagaacatcttgtagttcaacgacttaccctaaactttgttacgaatctctcttaacacaggctagcatgatccaaacaagcccccaactcatcgcccatgcagccctaaacgtgaccctttcaaccgccaagtcaacctcggccttgatggtgaaaaccattcacagctctttacaaaatatctgctcctcttagtttccctttttgtcccttgtttatttgatactcccccctcatggctgccgctgatgtcgagttccggtgcttcgtcggagggctcgcatgggccaccgacgaccgggcccttgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacataactgtcaacgaagcccaatcgcgcagaagtggaggcggtggcggaggatttggaggaggaaacggtggttacagccgcggtggaggcggcggcggatatggtggtcgccaaggaggatatggtggcggacgccgtgaaggtggatacggaaacggtggggggtatggtggaggtggatacggaggtggacgccgtgaaggaggatacggtgacggcggatctcgttactcaagaggcggcggtgcatctgaaggcaactggaggtcttaaatttagggtttcaaagtgggcttgggcctatattgttatgggtttggtttgggtttggtagttggtaattctaaagttactctgttactgtttggtttgggttctctcgtttttgatcgatgttgttactgttctcttaaaagcataaaaatggaatgaagtatcttcttttcaaaaaaaaaaaaaaaaaaaa

SEQ ID NO: 260 - protein, 168 aa, Gossypium hirsutum; identical to SEQ ID NO: 258
  misc_feature (1)..(168): Ceres CLONE ID no. 1846800
  misc_feature (1)..(168): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)

SEQ ID NO: 261 - DNA, 1097 bp, Gossypium hirsutum
  misc_feature (1)..(1097): Ceres CLONE ID no.1884333
aaccattcacagctctttacaaaatatctgctcctcttagtttccctttttgtcccttgtttatttgatactcccccctcatggctgccgctgatgtcgagttccggtgcttcgtcggagggctcgcatgggccaccgacgaccgggcccttgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacataactgtcaacgaagcccaatcgcgcagaagtggaggcggtggcggaggatttggaggaggaaacggtggttacagccgcggtggaggcggcggcggatatggtggtcgccaaggaggatatggtggcggacgccgtgaaggtggatacggaaacggtggggggtatggtggaggtggatacggaggtggacgccgtgaaggaggatacggtgacggcggatctcgttactcaagaggcggcggtgcatctgaaggcaactggaggtcttaaatttagggtttcaaagtgggcttgggcctatattgttatgggtttggtttgggtttggtagttggtaattctaaagttaaccaaatggagtggctttgggcgtgaactaggggaatggggacttgaaagttacttgagtgtaaaacaggtaacagagtatgtctcagatgaacaatggggttggtaccagcctccaaatcaatgaagttcaacatggaaatacaaataatatttactgctctaccaaaaataacggtaaaaaagtgtggagagccaatttgttttcgagtatgtatgtttgtacgtatgttatcccgtcctgttggaggtatgtctatggattttagtttcacgtttatacgtatgtttgcatgtacgtaatccctttgggggctatgtcaatggcattgagtctcgtttgtatgtatattctatattacattttggctgacctgtttggaatgtaagttacgaatgcatgttacctactaaaaaaaaaaaaaaaaaaaa

SEQ ID NO: 262 - protein, 168 aa, Gossypium hirsutum; identical to SEQ ID NO: 258
  misc_feature (1)..(168): Ceres CLONE ID no. 1884333
  misc_feature (1)..(168): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)

SEQ ID NO: 263 - protein, 117 aa, Oryza sativa; identical to SEQ ID NO: 200
  misc_feature (1)..(117): Public GI no. 108863012
  misc_feature (1)..(117): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)

SEQ ID NO: 264 - protein, 162 aa, Oryza sativa
  misc_feature (1)..(162): Public GI no. 108710320
  misc_feature (1)..(162): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAPDVEYRCFVGGLAWATDDRSLEAAFSTYGEILDSKIINDRETGRSRGFGFVTFSSEQSMRDAIEGMNGKELDGRNITVNEAQSRRSGGGGGGYGGGGGGYGGGRGGGGYGGGGGGGYGRREGGYGGGGGYGGGRGGGGGGYGGSRGGGYGGDSGGNWRN

SEQ ID NO: 265 - protein, 196 aa, Oryza sativa
  misc_feature (1)..(196): Public GI no. 108710321
  misc_feature (1)..(196): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAPDVEYRCFVGGLAWATDDRSLEAAFSTYGEILDSKIINDRETGRSRGFGFVTFSSEQSMRDAIEGMNGKELDGRNITVNEAQSRRSGGGGGGYGGGGGGYGGGRGGGGYGGGGGGGYGRREGGYAVAAATAATPAGTGGTDWWGPSWPVILSYPCQNHLIIESSRYRVQWLSRVEKPSIHPSSVRCSSSVMLP

SEQ ID NO: 266 - DNA, 785 bp, Gossypium hirsutum
  misc_feature (1)..(785): Ceres CLONE ID no.1916226
atcgtcaatttcttcattccctctctccctagtgttttccgatatggcttcagctgatgttgagtaccgatgcttcgtcggagggctcgcttgggccaccgatgaccgggctctcgaagaagccttcagtgtgtatggcgagatcgtcgaatcgaagattatcaatgaccgtgaatctggaagatcccgaggctttgggttcgtaactttccgtgacgagaaatctatgagagacgctattgaaggaatgaacggtcagaatcttgacggaaggaacattaccgtaaacgaagcccaatcacgccgaagcggtggaggcggcggtgaaggatacggaggaggaagcggaggctacaaaagaagtggaggaggcggaggatatggtcgccgtgaaggaggctatggaggtggccgtcgtgagggtgtattctggaatggtggaggatatgacggcggaggcggtggtggcggatatggcggaggcggtggcggatatggcggcggtggcggtggtggatatggaggttgacgctgagatggtgggtctcgttactcgaggaggcggagcgtctgatgggagctggaagacttagggtcgtagggttagcatttaagtgggctttgggctttgctttttcagttggatgatgacgtgtttcaaatattggtgctttattgttgttttgtagcagtttggattctctcgtttttgaccgatgtttatgtgacaaaaaacaatggagggaagtatactatcttcttttcaaaaaaaaaaaaaaaaaaaa

SEQ ID NO: 267 - protein, 161 aa, Gossypium hirsutum
  misc_feature (1)..(161): Ceres CLONE ID no. 1916226
  misc_feature (1)..(161): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MASADVEYRCFVGGLAWATDDRALEEAFSVYGEIVESKIINDRESGRSRGFGFVTFRDEKSMRDAIEGMNGQNLDGRNITVNEAQSRRSGGGGGEGYGGGSGGYKRSGGGGGYGRREGGYGGGRREGVFWNGGGYDGGGGGGGYGGGGGGYGGGGGGGYGG

SEQ ID NO: 268 - DNA, 701 bp, Gossypium hirsutum; identical to SEQ ID NO: 216
  misc_feature (1)..(701): Ceres CLONE ID no.1898837

SEQ ID NO: 269 - protein, 143 aa, Gossypium hirsutum; identical to SEQ ID NO: 217
  misc_feature (1)..(143): Ceres CLONE ID no. 1898837
  misc_feature (1)..(143): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)

SEQ ID NO: 270 - protein, 164 aa, Catharanthus roseus
  misc_feature (1)..(164): Public GI no. 6911144
  misc_feature (1)..(164): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MASADVEYRCFVGGLAWATTDQSLSEAFSQYGEILESKIINDRETGRSRGFGFVTFKDEQSMRDAIEGMNGQTLDGRNITVNEAQSRGSGGNGGGGFRGPRRDGGGGGGYGGGRRDGGYGGNGGYGGGRREGGYGGGDRGYGGGGGGGSRYSRGGGASDGNWRN

SEQ ID NO: 271 - DNA, 732 bp, Gossypium hirsutum
  misc_feature (1)..(732): Ceres CLONE ID no.1944006
  misc_feature (654)..(654): n is a, c, t, g, unknown, or other
  misc_feature (655)..(655): n is a, c, t, g, unknown, or other
atttatttctacatcaactgaacgaaagggaaaaggaaccaagagaagaaaaaagaaaataaatttgataagcatttccagaagaacccaaaaaaagaattaagtgcattgaaaagggtgattatattgtcacagttgatccgtgacgcccaaatgaaactatcagcggtgttttcatccagctgttactcatcggcaatcgctaagaacgccttgcaaccaccgtctctcattactctatccgcctccacctttttgccgccgctgtcccgccagctatcttgccgtcatggcgtttcatacaaccgcctttcgtttcgcgggaattcttcattttcttccaccgccgtatccgcctctaaatcggacagtcaatcccaggtgatcctcctcttgtttttggtaaaaaattcaattattttaacaaaatgcttctgaatttaatttcttttggaatttggtgcttgtatgcatacgaacagttaagataggttttcttttttgttagttacgaggttgaattataaattttggagccagatagcaattttacaaatacttctggggccaaatagcagttttacccatatttgaagtagtggccaagaccctgccttgcacctctgctgccgtccctgcttctacgaatagtgnntagagaatgccaagttttaatcttttaaaaaacttcatcgattttgtattttaaacaaataatttttagatattttt

SEQ ID NO: 272 - protein, 168 aa, Gossypium hirsutum
  misc_feature (1)..(168): Ceres CLONE ID no. 1944006
  misc_feature (1)..(168): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAADVEFRCFVGGLAWATDDRALEEAFSAFGEIVESKIINDRETGRSRSFGFVTFRDEKAMRDAIEGMNGQNLDGRNITVNEAQSRRSGGGGGGFGGGNGGYSRGGGGGGYGGRQGGYGGGRREGGYGNGGGYGGGGYGGGRREGGYGDGGSRYSKGGGASEGSWRS

SEQ ID NO: 273 - protein, 160 aa, Catharanthus roseus
  misc_feature (1)..(160): Public GI no. 6911146
  misc_feature (1)..(160): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MASADVEFRCFVGGLAWATTDQSLSEAFSQYGEVLESKVINDRETGRSRGFGFVTFGDEKSMKDAIVGMNGQTLDGRNITVNEAQSRGSGGGGGGGGFRGPRREGGGGYGGGGRRDGGYGGNGGGYGGGRRDGGYGGGDRGYGGGDRYSRGGGSDGNWRN

SEQ ID NO: 274 - DNA, 745 bp, Panicum virgatum
  misc_feature (1)..(745): Ceres CLONE ID no.1773631
gtgctctctcagaggtgggttggcttctcctccccctcttaccaagtcctcggctctagggttttagtgggaagggagatggcggcggcggatgtggagtaccgctgcttcgtcggcggcctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggcggcggcggctacagcggcggtcgtcagggtggctacggcggcggcggcggcggctacggaggcggtggtggctacggcggtggtcgccgtgagggcggctacggcggaggcggtggcggcggtcgccgcgagggcggctacggtggtggtggctacggcagccgcggtgactccggtggtaactggaggaactgatggggtggccctcccgtgctggcagccaagttatcctatatatctattagtgttcgtgtcactgtttgatccgagttacccctgagttttgtccgtgtgttaccgttcgattaggtgttggttcccatgtttaccgttcccgagttgtttccgcaatgaaatgagaagaaaagagtgtccgcaaaaaaaaaaaaaaaaaaaa

SEQ ID NO: 275 - protein, 154 aa, Panicum virgatum
  misc_feature (1)..(154): Ceres CLONE ID no. 1773631
  misc_feature (1)..(154): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAADVEYRCFVGGLAWATDNASLQQAFASYGDVLDSKVITDRETGRSRGFGFVTFSSEQSMLDAIEAMNGKDLDGRNITVNQAQSRGGGGGGYSGGRQGGYGGGGGGYGGGGGYGGGRREGGYGGGGGGGRREGGYGGGGYGSRGDSGGNWRN

SEQ ID NO: 276 - protein, 137 aa, Catharanthus roseus
  misc_feature (1)..(137): Public GI no. 6911142
  misc_feature (1)..(137): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MASADVEFRCFVGGLAWATTDQSLSEAFSQYGEVLESKIINDRETGRSRGFGFVTFGDEKSMKDAIEGMNGQTLDGRNVTVNEAQSRGSGGGGGGGGFRGPRREGGGCYGGGGRRNGGYGGNGGGYGGGRRDGGRRW

SEQ ID NO: 277 - protein, 162 aa, Oryza sativa
  misc_feature (1)..(162): Public GI no. 77557139
  misc_feature (1)..(162): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAPDVEYRCFVGGLAWATDDRSLEAAFSTFGEILESKIINDRETGRSRGFGFVTFSSEQAMRDAIEGMNGKELDGRNITVNEAQSRRSGGGGGGGYGQRGGGGGYGGGGGYGGGGGGGYGQRREGGYGGGGGYGGGRGGGGGYGGGYGSRGGGNSDGNWRN

SEQ ID NO: 278 - DNA, 730 bp, Panicum virgatum
  misc_feature (1)..(730): Ceres CLONE ID no.1954236
tgctctctcagaggtgggttggcttctcctccccctcttaccaagtcctcggctctagggttttagtgggaagggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcctccgagcagtcgatgctcgacgccatcgaagccatgaacggcaaggatctcgacggccgcaacatcaccgtcaaccaggctcagtcccgcggcggcggcggcggcggcggcggcggctatggcggcggtcgtcagggtggctacggcggcggcggcggctacggaggcggtggtggctacggcggtggtcgccgtgagggcggctacggcggaggcggtggcggcggtcgccgcgagggcggctacggtgatggtggctacggcagccgcggtgactccggtggtaactggaggaactgatggggtggccctcccgtgctggcagccaagttatcctatatatctattagtgttcgtgtcactgtttgatccgagttacccctgagttttgttcgtgtgttaccgttcgattaggtgttggttcccatgtttaccgttcccgagttgtttccgcaataaaatgagaagaaaagagtgtccgc

SEQ ID NO: 279 - protein, 156 aa, Panicum virgatum
  misc_feature (1)..(156): Ceres CLONE ID no. 1954236
  misc_feature (1)..(156): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAADVEYRCFVGGLAWATDNASLQQAFASYGDVLDSKVITDRETGRSRGFGFVTFSSEQSMLDAIEAMNGKDLDGRNITVNQAQSRGGGGGGGGGYGGGRQGGYGGGGGYGGGGGYGGGRREGGYGGGGGGGRREGGYGDGGYGSRGDSGGNWRN

SEQ ID NO: 280 - protein, 194 aa, Oryza sativa
  misc_feature (1)..(194): Public GI no. 18103931
  misc_feature (1)..(194): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAPDVEYRCFVGGLAWATDDRSLEAAFSTYGEILESKIINDRETGRSRGFGFVTFSSEQAMRDAIEGMNGKELDGRNITVNEAQSRRSGGGGGGGYGQRGGGGGYGGGGYGGGGGGGGYGQRREAATAVAVATVAAVVAAATVVATAAAAAATPTGTGGTERWGPHGQVIYLSNRATIIIIRSLSSLVLCGTI

SEQ ID NO: 281 - DNA, 1308 bp, Gossypium hirsutum
  misc_feature (1)..(1308): Ceres CLONE ID no.1848150
gtgagcttaacgggagattctagccccgaaagttttgttttttttatgtaatgtagtgttttgatagtgattcttaaattttgatattgaataacttgatgctttgaaatttatgtttttataatatttgttgtcttcttgcttgcagtactaactggaatattcgatatttattgtatttgtacagtgagtcaatgatattatatttaatttaaatctaatttgatctggtatggttcgttcatttataatttcaaagtttctattttttttaatatcgaattggcacaatggatctcgaatatttaatatttaagtttgtagttgtaactttctactggttttctttgttattagtctgaccctacattttgaaggcagcagataattgggtttctattttataagtttgtatagtaattctccttaaaaactaatgaaagcatgatcatcttttgtacctatcttcatctgttttatgcaatttaaattaagggtctccttcataatgttgatagttgattggacagatcaccaattcacagttctctccaaaatatctgctttttcttagttttcctttttgtcccttgtttatttgatatttccccctcatggccgccgctgatgtcgagttccggtccttcgtcggatggctcgcatgggccaccgacgaccgggccctcgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacatcaccgtcaacgaagcccaatcgcgcagaagtggaggcggtggcggaggatttggaggaggaaacggtggttacagccgcggtggaggcggcggcggatatggtggtcgccaaggaggatatggtggcggacgccgtgaaggtggatacggaaatggtggagggtatggtggtggtgggtacggaggtggacgccgtgaaggaggatatggtgacggcggatctcgttactcaaaaggcgcggtgcatctgaaggcagctggaggtcttaagtttaggtttcaaagtgggcttgggcctatattgttatgggtttggtttgtgtttagtagttagtaattttaagtttctctattagtgtttggtttgggttctctcttttttgatcgatgttgttactgttctcttaaaatcataaaaatggaatgaagtatcttttcaaaaaaaaaaaaaaaaaaaa

SEQ ID NO: 282 - protein, 189 aa, Gossypium hirsutum
  misc_feature (1)..(189): Ceres CLONE ID no. 1848150
  misc_feature (1)..(189): Functional Homolog of  Ceres CLONE ID no.  1011900
  misc_feature (11)..(81): Pfam Name: RRM_1 Pfam Description: RNA recognition motif. (a.k.a. RRM, RBD, or RNP domain)
MAAADVEFRSFVGWLAWATDDRALEEAFSAFGEIVESKIINDRETGRSRGFGFVTFRDEKAMRDAIEGMNGQNLDGRNITVNEAQSRRSGGGGGGFGGGNGGYSRGGGGGGYGGRQGGYGGGRREGGYGNGGGYGGGGYGGGRREGGYGDGGSRYSKGAVHLKAAGGLKFRFQSGLGPILLWVWFVFSS

SEQ ID NO: 283 - DNA, 729 bp, Panicum virgatum
  misc_feature (1)..(729): Ceres CLONE ID no.1759817
gtgctctctcagaggtgggttggctcctccttcccctcttaccaagtcctcggctctagggttttagtgggaagggagatggcggcggcggatgtggagtaccgctgcttcgtcggcggtctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccagtctcagtcccgcggcggcggcggcggcggctacggcggcggtcgtcagggtggctacggcggcggcggcggcggctacggaggcggtggtggctacggcggtggtcgccgtgagggcggctacggcggaggcggtggcggcggtcgccgcgagggcggctacggtggtggtggctacggcagccgcggtgactccggtggtaactggaggaactgatggggtggccctcccgtgctggcagccaagttatcctatatatctattagtgttcgtgtcactgtttgatccgagttacccctgagttttgtccgtgtgttaccgttcgattaggtgttggttcccatgtttaccgttcccgagttgtttccgcaatgaaatgagaagaaaagagtgtccgcaatg

SEQ ID NO: 284 - protein, 154 aa, Panicum virgatum
  misc_feature (1)..(154): Ceres CLONE ID no. 1759817
  misc_feature (1)..(154): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAADVEYRCFVGGLAWATDNASLQQAFASYGDVLDSKVITDRETGRSRGFGFVTFSSEQSMLDAIEAMNGKDLDGRNITVNQSQSRGGGGGGYGGGRQGGYGGGGGGYGGGGGYGGGRREGGYGGGGGGGRREGGYGGGGYGSRGDSGGNWRN

SEQ ID NO: 285 - DNA, 641 bp, Panicum virgatum
  misc_feature (1)..(641): Ceres CLONE ID no.1792432
cccgtgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaggccatgaacggcaaggagctcgacggccgcaacatcaccgtcaaccaggcccagtcccgcggcggtggcggcggcggcggcggttacggcggcggtcgccagggaggctacggcggcggcggcgggtacggtggcggcggcgggtacggtggcggcggcggtcgccgtgagggcgggtacggtggcggcggctacgacggtggcggtggcggatacggtggcggtcgccgcgagggcggctacggcggtggtggctacggcagccgcggtgactccggtggcaactggaggaactgatggggtagccctcccgtgctggcagccaagttatcctagatatctattagtgttcgtgttacca

SEQ ID NO: 286 - protein, 165 aa, Panicum virgatum
  misc_feature (1)..(165): Ceres CLONE ID no. 1792432
  misc_feature (1)..(165): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAADVEYRCFVGGLAWATDNASLQQAFASYGDVLDSKVITDRETGRSRGFGFVTFSTEQSMLDAIEAMNGKELDGRNITVNQAQSRGGGGGGGGYGGGRQGGYGGGGGYGGGGGYGGGGGRREGGYGGGGYDGGGGGYGGGRREGGYGGGGYGSRGDSGGNWRN

SEQ ID NO: 287 - protein, 165 aa, Ricinus communis
  misc_feature (1)..(165): Public GI no. 18076086
  misc_feature (1)..(165): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAADIEYRCFVGGLAWATSDKALEEAFSAYGEVLESKIINDRETGRSRGFGFVTFNNEKSMRDAIEGMNGQNLDGRNITVNEAQSRGGGGGGGGGYRNGGGGGYGGGRREGGYGGGGGYSRGGGGYGGGGGGYGGGRDRGYGGGGDGGSRYSRGGGASEGNWRS

SEQ ID NO: 288 - DNA, 555 bp, Panicum virgatum
  misc_feature (1)..(555): Ceres CLONE ID no.1967547
cgtgctctctcagaggtgggttggcttctcctccccctcttaccaagtcctcggctctagggttttagtgggaagggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcctccgagcagtcgatgctcgacgccatcgaagccatgaacggcaaggatctcgacggccgcaacatcaccgtcaaccaggctcagtcccgcggcggcggcggcggcggcggctacggcggcggtcgtcagggtggctacggcggcggcggcggctacggaggcggtggtggctacggcggtggtcgccgtgagggcggctacggcggaggcggtggcggcggtcgccgcgagggtggctacggcagccgcggtgactccggtggtaactggaggaactgatggggtggccctcccgtgctggcagc

SEQ ID NO: 289 - protein, 149 aa, Panicum virgatum
  misc_feature (1)..(149): Ceres CLONE ID no. 1967547
  misc_feature (1)..(149): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAADVEYRCFVGGLAWATDNASLQQAFASYGDVLDSKVITDRETGRSRGFGFVTFSSEQSMLDAIEAMNGKDLDGRNITVNQAQSRGGGGGGGYGGGRQGGYGGGGGYGGGGGYGGGRREGGYGGGGGGGRREGGYGSRGDSGGNWRN

SEQ ID NO: 290 - protein, 162 aa, Solanum commersonii
  misc_feature (1)..(162): Public GI no. 1934994
  misc_feature (1)..(162): Functional Homolog of  Ceres CLONE ID no.  1011900
  misc_feature (9)..(80): Pfam Name: RRM_1 Pfam Description: RNA recognition motif. (a.k.a. RRM, RBD, or RNP domain)
MAAEVEYSCFVGGLAWATTDRTLSDAFSTYGEVVDSKIINDRETGRSRGFGFVTFKDEKSMKEAISGMNGSELDGRNITVNEAQARGSGGGGGGGGGFGGGRRREGGGGGYGGGGGYRGGGGGGYGGGRREGGGGGGYGGGRREGGGGGGYGGGGYGGGDRY

SEQ ID NO: 291 - DNA, 671 bp, Panicum virgatum
  misc_feature (1)..(671): Ceres CLONE ID no.1772920
ctctctcagaggtgggttggcttctcctccccctcttaccaagtcctcggctctagggttttagtgggaagggagatggcggcggcggatgtggagtaccgctgcttcgtcggcggcctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggcggcggcggctacggcggcggtcgtcagggcgggtacggtggcggcggctacgacggtggcggtggcggatacggtggcggtcgccgcgagggcggctacggcggtggtggctacggcagccgcggtgactccggtggcaactggaggaactgatagggtagccctcccgtgctggcagccaagttatcctagatatctattagtgttcgtgttaccatttgatcccgagttaccccagagtttagtgtccgtgttaccgtttgattaggtgttggttcccatgttaccccagagtttagtgtccgtgttaccgtttgattaggtgt

SEQ ID NO: 292 - protein, 140 aa, Panicum virgatum
  misc_feature (1)..(140): Ceres CLONE ID no. 1772920
  misc_feature (1)..(140): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAADVEYRCFVGGLAWATDNASLQQAFASYGDVLDSKVITDRETGRSRGFGFVTFSSEQSMLDAIEAMNGKDLDGRNITVNQAQSRGGGGGGYGGGRQGGYGGGGYDGGGGGYGGGRREGGYGGGGYGSRGDSGGNWRN

SEQ ID NO: 293 - DNA, 606 bp, Panicum virgatum
  misc_feature (1)..(606): Ceres CLONE ID no.1962722
gtgctctctcagaggtgggttggcttttccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaggccatgaacggcaaggagctcgacggccgcaacatcaccgtcaaccaggcccaatcccgcggcggtggcggcggcggcggcggttacggcggcggtcgccagggaggctactgcggccgcggcggcggctacggcggcggtcgccgtgagggcggctacagtggcggcggctacgacggtggcggtggcggatacggcggcggtcgccgcgagggcggctacggcggtggtggctacggcagccgcggtgactccggtggcacctggaggaactaatggggtgcccctcccgtgctgccagccatcctatcctagatagctatagggat

SEQ ID NO: 294 - protein, 158 aa, Panicum virgatum
  misc_feature (1)..(158): Ceres CLONE ID no. 1962722
  misc_feature (1)..(158): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAADVEYRCFVGGLAWATDNASLQQAFASYGDVLDSKVITDRETGRSRGFGFVTFSTEQSMLDAIEAMNGKELDGRNITVNQAQSRGGGGGGGGYGGGRQGGYCGRGGGYGGGRREGGYSGGGYDGGGGGYGGGRREGGYGGGGYGSRGDSGGTWRN

SEQ ID NO: 295 - protein, 162 aa, Oryza sativa
  misc_feature (1)..(162): Public GI no. 2331131
  misc_feature (1)..(162): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAPDVKYRCFVGGLAWATDDRSLEAAFSTYGEILDSKIINDRETGRSLGFGFITFSSEQSMRDAIEGMNGKELDGRNITVNEAQSRRSGGGGGGYGGGGGGYGGGRGGGGYGGGGGGGYGRREGGYGGGGGYGGGRGGGGGGYGGSRGGGYGGDSGGNWRN

SEQ ID NO: 296 - protein, 164 aa, Euphorbia esula
  misc_feature (1)..(164): Public GI no. 2674201
  misc_feature (1)..(164): Functional Homolog of  Ceres CLONE ID no.  1011900
  misc_feature (9)..(80): Pfam Name: RRM_1 Pfam Description: RNA recognition motif. (a.k.a. RRM, RBD, or RNP domain)
MSADIEYRCFVGGLAWATTDQSLQEAFSPYGEILDSKIINDRETGRSRGFGFVTFNNEKSMRDAIQGMNSQELDGRNITVNEAQSRGSGGGGGGGGYSRGGGGGGYGGGGRREGGYGGGGGGYNSRSSGGGGGYGGGRDQGYGGGGGGSRYSRGGGESDGNWKN

SEQ ID NO: 297 - protein, 175 aa, Solanum tuberosum
  misc_feature (1)..(175): Public GI no. 799015
  misc_feature (1)..(175): Functional Homolog of  Ceres CLONE ID no.  1011900
  misc_feature (8)..(79): Pfam Name: RRM_1 Pfam Description: RNA recognition motif. (a.k.a. RRM, RBD, or RNP domain)
MADVEYRCFVGGLAWATTDQTLSDAFSQYAEVVESKIINDRETGRSRGFGFVTFKDEQAMRDAIEGMNRQDLDGRNITVNEAQSRGGVEAGGGRGGGGYGGGRREGGGGGYGGYGGGRREGGGGGGYSGGGGGYGGGRREGGYGGGGGGYGGGDRYSDRSSRGGGGGSSDGNWRN

SEQ ID NO: 298 - protein, 161 aa, Oryza sativa
  misc_feature (1)..(161): Public GI no. 2331133
  misc_feature (1)..(161): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAPDVDYRCFVGGLAWATDNRSLEAAFSTYGEILESKIINDRETGRSRGFGFVTFSSEQAMRDAIEGMNGKELDGRNITVNEAQSRRSGGGGGGGYGQRGGGGGYGGGGYGGGGGGGGYGQRREGGYGGGGGYGGGRGGGGYGGGYGSRGGGNSDGNWRN

SEQ ID NO: 299 - DNA, 634 bp, Panicum virgatum
  misc_feature (1)..(634): Ceres CLONE ID no.1959885
agtgctctctcagaggtgggttggcttctcctccccctcttaccaagtcctcggctctagggttttagtgggaagggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggcggcggctacggcggcggtcgtcaaggtggctacggcggcggcggcggctacggaggcggtggtggcggtggtggctacggcggtggtcgccgtgagggcggctacggcggaggcggtagcggcggtcgccgcgagggcggctacggtggtggtggctacggcagccgcggtgactccggtggtaactggaggaactgatggggtggccctcccgtgctggcagccaagttatcctatattcgtgtcactgtttgatccgagttacccctgagttttgtccgtgtg

SEQ ID NO: 300 - protein, 155 aa, Panicum virgatum
  misc_feature (1)..(155): Ceres CLONE ID no. 1959885
  misc_feature (1)..(155): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAADVEYRCFVGGLAWATDNASLQQAFASYGDVLDSKVITDRETGRSRGFGFVTFSSEQSMLDAIEAMNGKDLDGRNITVNQAQSRGGGGGYGGGRQGGYGGGGGYGGGGGGGGYGGGRREGGYGGGGSGGRREGGYGGGGYGSRGDSGGNWRN

SEQ ID NO: 301 - DNA, 497 bp, Gossypium hirsutum; identical to SEQ ID NO: 218
  misc_feature (1)..(497): Ceres CLONE ID no.1834630

SEQ ID NO: 302 - protein, 150 aa, Gossypium hirsutum; identical to SEQ ID NO: 219
  misc_feature (1)..(150): Ceres CLONE ID no. 1834630
  misc_feature (1)..(150): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)

SEQ ID NO: 303 - DNA, 715 bp, Panicum virgatum
  misc_feature (1)..(715): Ceres CLONE ID no.1810211
ctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaagccatgaacggcaaggagctcgacggccgcaacatcaccgtcaaccaggcccaatcccgcggcggtggcggcggcggcggcggttacggcggcggtcgccagggaggctacggcggcggcggcggtcgccgtgagggcggctacggtggcggcggctacgacggtggcggtggcggatacggcggcggtcgccgcgagggcggctacggcggtggtggctacggcagccgcggtgactccggtggcaactggaggaactaatggggtggccctcccgtgctggcagccaagttatcctagatatctattagtgttcgtgttaccatttgatccgagttaccccagagtttagtgtccgtccgtgttacctgttggttcccgaatccccaatctcgcaaaccccaatctcggcgccaccgccgccgcccgcgatgtctcgcc

SEQ ID NO: 304 - protein, 153 aa, Panicum virgatum
  misc_feature (1)..(153): Ceres CLONE ID no. 1810211
  misc_feature (1)..(153): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAADVEYRCFVGGLAWATDNASLQQAFASYGDVLDSKVITDRETGRSRGFGFVTFSTEQSMLDAIEAMNGKELDGRNITVNQAQSRGGGGGGGGYGGGRQGGYGGGGGRREGGYGGGGYDGGGGGYGGGRREGGYGGGGYGSRGDSGGNWRN

SEQ ID NO: 305 - DNA, 541 bp, Panicum virgatum
  misc_feature (1)..(541): Ceres CLONE ID no.1905168
ccccgtgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaagccatgaacggcaaggagctcgacggccgcaacatcaccgtcaaccaggcccaatcccgcggcggtggcggcggcggcggcggttacggcggcggtcgccagggaggctacggcggcggcggcggtcgccgtgagggcggctacggtggcggcggctacgacggtggcggtggcggatacggcggcggtcgccgcgagggcggctacagggctgctggctcctgcatccgcgggatctccggtgggtactggaggggcta

SEQ ID NO: 306 - protein, 153 aa, Panicum virgatum
  misc_feature (1)..(153): Ceres CLONE ID no. 1905168
  misc_feature (1)..(153): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAADVEYRCFVGGLAWATDNASLQQAFASYGDVLDSKVITDRETGRSRGFGFVTFSTEQSMLDAIEAMNGKELDGRNITVNQAQSRGGGGGGGGYGGGRQGGYGGGGGRREGGYGGGGYDGGGGGYGGGRREGGYRAAGSCIRGISGGYWRG

SEQ ID NO: 307 - DNA, 545 bp, Panicum virgatum
  misc_feature (1)..(545): Ceres CLONE ID no.1888162
ccgtgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaagccatgaacggcaaggagctcgacggccgcaacatcaccgtcaaccaggcccaatcccgcggcggtggcggcggcggcggcggcggcggttaccgcggcggtcgccagggaggctacggcggcggcggcggtcgctacggcggcggtcgccgtgagggcggctacggtggcggctcctactaccgtggcggcggcagataccgcggcggtctccgcgagggcggctacggcggtggtggctacggcacccgcgttgactccggtgg

SEQ ID NO: 308 - protein, 155 aa, Panicum virgatum
  misc_feature (1)..(155): Ceres CLONE ID no. 1888162
  misc_feature (1)..(155): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAADVEYRCFVGGLAWATDNASLQQAFASYGDVLDSKVITDRETGRSRGFGFVTFSTEQSMLDAIEAMNGKELDGRNITVNQAQSRGGGGGGGGGGYRGGRQGGYGGGGGRYGGGRREGGYGGGSYYRGGGRYRGGLREGGYGGGGYGTRVDSG

SEQ ID NO: 309 - protein, 165 aa, Euphorbia esula
  misc_feature (1)..(165): Public GI no. 2645699
  misc_feature (1)..(165): Functional Homolog of  Ceres CLONE ID no.  1011900
  misc_feature (9)..(80): Pfam Name: RRM_1 Pfam Description: RNA recognition motif. (a.k.a. RRM, RBD, or RNP domain)
MSADIEYRCFVGGLAWATTDQSLQEAFSPYGEILDSKIINDRETGRSRGFGFVTFNNEKSMRDAIQGMNSQELDGRNTTVNEAQSRGNGRSGGGGGYSRGGGGGGYGSGGGRRERGYGGGGGGYNSISTGGSGGYGGGRDQGYGSGGGGSRYSTGGGESDGNWRN

SEQ ID NO: 310 - protein, 153 aa, Oryza sativa
  misc_feature (1)..(153): Public GI no. 108710322
  misc_feature (1)..(153): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAPDVEYRCFVGGLAWATDDRSLEAAFSTYGEILDSKIINDRETGRSRGFGFVTFSSEQSMRDAIEGMNGKELDGRNITVNEAQSRRSGGGGGGYGGGGGGYGGGGGGGYGRREGGYGGGGGYGGGRGGGGGGYGGSRGGGYGGDSGGNWRN

SEQ ID NO: 311 - protein, 155 aa, Picea glauca
  misc_feature (1)..(155): Public GI no. 4704605
  misc_feature (1)..(155): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MASADVEFRCFVGGLAWSTDDRSLQEAFSPYGEVVESKIISDRETGRSRGFGFVTFNDEQSMRDAIDAMNGKMLDGRSITVNPAQSRGNGGGGGGGGSRGYRGGGGGGGYGGSRDRGDRGYGGGGGGYGGGGGGYGGGGGSRYGGGGSEGGSWRR

SEQ ID NO: 312 - protein, 160 aa, Oryza sativa; identical to SEQ ID NO: 199
  misc_feature (1)..(160): Public GI no. 2624326
  misc_feature (1)..(160): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)

SEQ ID NO: 313 - protein, 170 aa, Sorghum bicolor
  misc_feature (1)..(170): Public GI no. 10799202
  misc_feature (1)..(170): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAADVEYRCFVGGLAWATNNETLEHAFANFGQVLDSKVITDRETGRSRGFGFVTFSSEQSMLDAIENMNGKELDGRNITVNQAQSRGGGGGGGGYGGGGGGYGGRREGGGYGGGGGGYGGRREGGGGYGGGGYGGGGGGYGGRREGGGGYGGGGGYGGNRGDSGGNWRN

SEQ ID NO: 314 - DNA, 601 bp, Panicum virgatum
  misc_feature (1)..(601): Ceres CLONE ID no.1966343
ctagggttttagtccgaagaagaaggggagctatggcggcggcggacgtggagtaccgttgcttcgtcggcggcctcgcctgggccaccaacaacgactccctccagcacgccttcgcctcctacggcgaggtcctcgactccaaggtcatcaccgaccgtgagacggggaggtctcgtggcttcggcttcgtcaccttctcctcagagcagtcgatgctcgacgccatcgaggcaatgaacggcaaggagctcgacggccgcaacatcaccgtcaaccaggcccagtcccgcggcggcggtggtggtggcggctacggtggcggtcgcggcggtggcggctacggcggtggtggtggctacggaggaggcggcggtggctacggcggccgtcgcgagggcggatacggcggcggcggtggctacggaggcagcggtggtggcggctacggcggtcgccgcgagggcggctacggcggtggtggtggctacggcagccgcggtgactccggtggcaactggaggaactgatggggtggcccttccgtgctggcaaccaagttatcctagttttctattagtgtccgtttgatcccgagtta

SEQ ID NO: 315 - protein, 165 aa, Panicum virgatum
  misc_feature (1)..(165): Ceres CLONE ID no. 1966343
  misc_feature (1)..(165): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAADVEYRCFVGGLAWATNNDSLQHAFASYGEVLDSKVITDRETGRSRGFGFVTFSSEQSMLDAIEAMNGKELDGRNITVNQAQSRGGGGGGGYGGGRGGGGYGGGGGYGGGGGGYGGRREGGYGGGGGYGGSGGGGYGGRREGGYGGGGGYGSRGDSGGNWRN

SEQ ID NO: 316 - protein, 107 aa, Lolium perenne
  misc_feature (1)..(107): Public GI no. 90265701
  misc_feature (1)..(107): Functional Homolog of  Ceres CLONE ID no.  1011900
  misc_feature (7)..(78): Pfam Name: RRM_1 Pfam Description: RNA recognition motif. (a.k.a. RRM, RBD, or RNP domain)
MAEEYRCFVGGLAWATNDQSLEQAFSQFGEITDCKIINDRETGRSRGFGFVTFSSSESMKNAIEGMNGQDLDGRNITVNEAQSRSGGGGGGYSRGGGGGDSGGNWRN

SEQ ID NO: 317 - DNA, 788 bp, Panicum virgatum
  misc_feature (1)..(788): Ceres CLONE ID no.1767411
tgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaagccatgaacggcaaggagctcgacggccgcaacatcaccgtcaaccaggcccaatcccgcggcggtggcggcggcggcggcggcggcggttacggcggcggtcgccagggaggctacggcggcggcggcggcggctacggcggcggtcgccgtgagggcggctacggtagcggcggctacgacggtggcggtggcggatacggcggcggtcgccgcgagggcggctacggcggtggtggctacggcagccgcggtgactccggtggcaactggaggaactaatggggtggccctcccgtgctggcagccaagttatcctatatatctattagtgttcgtgttaccatttgatccgagttaccccagagtttagtgtccgtgttacctgttggttcccatgttaccgttcccgagttgtttccgcaatgaaatgagaagaaaagagtgagcaaggtttttgttcgcatctcttgctgtgctctgatttggttttaaaaaaaaaaaaaaaaaaa

SEQ ID NO: 318 - protein, 160 aa, Panicum virgatum
  misc_feature (1)..(160): Ceres CLONE ID no. 1767411
  misc_feature (1)..(160): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAADVEYRCFVGGLAWATDNASLQQAFASYGDVLDSKVITDRETGRSRGFGFVTFSTEQSMLDAIEAMNGKELDGRNITVNQAQSRGGGGGGGGGGYGGGRQGGYGGGGGGYGGGRREGGYGSGGYDGGGGGYGGGRREGGYGGGGYGSRGDSGGNWRN

SEQ ID NO: 319 - protein, 181 aa, Cryptomeria japonica
  misc_feature (1)..(181): Public GI no. 90704785
  misc_feature (1)..(181): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MASADVEFRCFVGGLSWSTDDRSLKDAFTAFGEVMDSKVVSDRETGRSRGFGFVTFMDEQSMRDAIEGMNGRDLDGRNITVNRAQARGGGGGGGGGGGGYRGGGGGSGGYGGGGSGGYESRRSGGGGSGGGGYSGGGRERSERGYGGGSRNGGGYGGYSGGGGGGSRYGGGGVSDDGGWRS

SEQ ID NO: 320 - DNA, 758 bp, Panicum virgatum
  misc_feature (1)..(758): Ceres CLONE ID no.1789498
gtgctctctcagaggtgggttggcttctcctccccctcttaccaagtcctcggctctagggttttagtgggaagggagatggcggccgcggatgtggagtaccgctgcttcgtcggcggcctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggtggcggcggcggctacggcggcggtcgtcagggtggctacggcggcggcggcggcggctacggaggcggtggtggcggtggtggctacggcggtggtcgccgtgagggcagctacggcggaggcgatggcggcggtcgccgcgagggcggctacggtggtggtggctacggcagccgcggtgactccggtggtaactggaggaactgatgacttggccctcccgtgctggcagccaagttatcctatatatctattagtgttcgtgttaccatttgatccgagttaccccagagtttagtgtccgtgttacctgttggttcccatgttaccgttcccgagttgtttccgcaatgaaatgagaagaaaagagtgagcaaggtttttgttcgcaaaaaaaaaaaaaaaaaaaa

SEQ ID NO: 321 - protein, 158 aa, Panicum virgatum
  misc_feature (1)..(158): Ceres CLONE ID no. 1789498
  misc_feature (1)..(158): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAADVEYRCFVGGLAWATDNASLQQAFASYGDVLDSKVITDRETGRSRGFGFVTFSSEQSMLDAIEAMNGKDLDGRNITVNQAQSRGGGGGGGYGGGRQGGYGGGGGGYGGGGGGGGYGGGRREGSYGGGDGGGRREGGYGGGGYGSRGDSGGNWRN

SEQ ID NO: 322 - DNA, 770 bp, Panicum virgatum
  misc_feature (1)..(770): Ceres CLONE ID no.1768120
tgctctctcagaggtgggttggcttctccccctcttaccaagtcctcggttctagggttttagttggaaggggagatggcggcggcggatgtggagtaccgctgcttcgtcggcgacctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaggccatgaacggcaaggagctcgacggccgcaacatcaccgtcaaccaggcccagtcccgcggcggtggcggcggcggcggcggttacggcggcggtcgccagggagactacggcggcggcggcgggtacggtggcggcggcggtcgccgtgagggcgggtacggtggcggcggctacgacggtggcggtggcggatacggcggcggtcgccgcgagggcggctacggcggtggtggctacggcagccgcggtgactccggtggcaactggaggaactgatggggtagccctcccgtgctggcagccaagttatcctagatatctattagtgttcgtgttaccatttgatcccgagttaccccagagtttagtgtccgtgttaccgtttgattaggtgttggttcccatgttaccgttcccgagttgtttccgcaatgaaatgagaagaaaagagtgagcaaggtttttgttcgcaaaaaaaaaaaaaaaaaaaa

SEQ ID NO: 323 - protein, 159 aa, Panicum virgatum
  misc_feature (1)..(159): Ceres CLONE ID no. 1768120
  misc_feature (1)..(159): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAADVEYRCFVGDLAWATDNASLQQAFASYGDVLDSKVITDRETGRSRGFGFVTFSTEQSMLDAIEAMNGKELDGRNITVNQAQSRGGGGGGGGYGGGRQGDYGGGGGYGGGGGRREGGYGGGGYDGGGGGYGGGRREGGYGGGGYGSRGDSGGNWRN

SEQ ID NO: 324 - DNA, 738 bp, Panicum virgatum
  misc_feature (1)..(738): Ceres CLONE ID no.1762613
cgtgctctctcagaggtgggttgacttctcctccccctcttaccaagtcctcggctctagggttttagtgggaagggagatggcggccgcggatgtggagtaccgctgcttcgtcggcggcctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggtggcggcggcggctacggcggcggtcgtcagggtggctacggcggcggcggcggcggctacggaggcggtggtggcggtggtggctacggcggtggtcgccgtgagggcggctacggcggaggcggtggcggcggtcgccgcgagggcggctacggtggtggtggctacggcagccgcggtgactccggtggtaactggaggaactgatggggtggccctcccgtgctggcagccaagttatcctatatatctattagtgttcgtgtcactgtttgatccgagttacccctgagttttgtccgtgtgttaccgttcgattaggtgttggttcccatgtttaccgttcccgagttgtttccgcaatgaaatgagaagaaaagagtgtccgg

SEQ ID NO: 325 - protein, 158 aa, Panicum virgatum
  misc_feature (1)..(158): Ceres CLONE ID no. 1762613
  misc_feature (1)..(158): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAADVEYRCFVGGLAWATDNASLQQAFASYGDVLDSKVITDRETGRSRGFGFVTFSSEQSMLDAIEAMNGKDLDGRNITVNQAQSRGGGGGGGYGGGRQGGYGGGGGGYGGGGGGGGYGGGRREGGYGGGGGGGRREGGYGGGGYGSRGDSGGNWRN

SEQ ID NO: 326 - protein, 168 aa, Sorghum bicolor
  misc_feature (1)..(168): Public GI no. 21625
  misc_feature (1)..(168): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAADVEYRCFVGGLAWATNNETLEQAFANFGQVIDSKVITDRETGRSRGFGFVTFSSEQSMLDAIENMNGKELDGRNITVNQAQSRGGGGGGGGYGGGGGGYGGREGGGYGGGGGGYGGRREGGGGYGGGGYGGGGGGYGGREGGGGYGGGGGYGGNRGDSGGNWRN

SEQ ID NO: 327 - DNA, 762 bp, Panicum virgatum
  misc_feature (1)..(762): Ceres CLONE ID no.1767462
gtgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaagccatgaacggcaaggagctcgacggccgcaacatcaccgtcaaccaggcccaatcccgcggcggtggcggcggcggcggcggcggcggttacggcggcggtcgccagggaggctacggcggcggcggcggcggctacggcggcggtcgccgtgagggcggctacggtggcggcggctacgacggtggcggtggcggatacggcggcggtcgccgcgagggcggctacggcggtggtggctacggcagccgcggtgactccggtggcaactggaggaactaatggggtggccctcccgtgctggcagccaagttatcctagatatctattagtgttcgtgttaccatttgatccgagttaccccagagtttagtgtccgtgttacctgttggttcccatgttaccgttcccgagttgtttccgcaatgaaatgagaagaaaagagtgagcaaggtttttgttcgcaaaaaaaaaaaaaaaaaaaa

SEQ ID NO: 328 - protein, 160 aa, Panicum virgatum
  misc_feature (1)..(160): Ceres CLONE ID no. 1767462
  misc_feature (1)..(160): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAADVEYRCFVGGLAWATDNASLQQAFASYGDVLDSKVITDRETGRSRGFGFVTFSTEQSMLDAIEAMNGKELDGRNITVNQAQSRGGGGGGGGGGYGGGRQGGYGGGGGGYGGGRREGGYGGGGYDGGGGGYGGGRREGGYGGGGYGSRGDSGGNWRN

SEQ ID NO: 329 - DNA, 781 bp, Panicum virgatum
  misc_feature (1)..(781): Ceres CLONE ID no.1721386
ccccgtgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaagccatgaacggcaaggagctcgacggccgcaacatcaccgtcaaccaggcccaatcccgcggcggtggcggcggcggcggcggcggcggttacggcggcggtcgccagggaggctacggcggcggcggcggcggctacggcggcggtcgccgtgagggcggctacggtggcggcggctacgacggtggcggtggcggatacggcggcggtcgccgcgagggcggctacggcggtggtggctacggcagccgcggtgactccggtggcaactggaggaactaatggggtggccctcccgtgctggcagccaagttatcctatatatctattagtgttcgtgttaccatttgatccgagttaccccagagtttagtgtccgtgttacctgttggttcccatgttaccgttcccgagttgtttccgcaatgaaatgagaagaaaagagtgagcaaggtttttgttcgcatctcttgctgtgccaaaaaaaaaaaaaaaaaaaa

SEQ ID NO: 330 - protein, 160 aa, Panicum virgatum; identical to SEQ ID NO: 328
  misc_feature (1)..(160): Ceres CLONE ID no. 1721386
  misc_feature (1)..(160): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)

SEQ ID NO: 331 - DNA, 660 bp, Panicum virgatum
  misc_feature (1)..(660): Ceres CLONE ID no.1821019
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
cccgtgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaagccatgaacggcaaggagctcgacggccgcaacatcaccgtcaaccaggcccaatcccgcggcggtggcggcggcggcggcggcggcggttacggcggcggtcgccagggaggctacggcggcggcggcggcggctacggcggcggtcgccgtgagggcggctacggtggcggcggctacgacggtggcggtggcggatacagcggcggtcgccgcgagggcggctacggcggtggtggctacggcacccgcgcagcgcgaaccagcgacagagatcgacatggccgccgccgcctcctcctccgccgtnnncggcctcgccggcgccgccctcgccagccggccggcattctccaccagcttcgtgcggggcgggcggg

SEQ ID NO: 332 - protein, 193 aa, Panicum virgatum
  misc_feature (1)..(193): Ceres CLONE ID no. 1821019
  misc_feature (1)..(193): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
  misc_feature (171)..(171): Xaa is any aa, unknown, or other
MAAADVEYRCFVGGLAWATDNASLQQAFASYGDVLDSKVITDRETGRSRGFGFVTFSTEQSMLDAIEAMNGKELDGRNITVNQAQSRGGGGGGGGGGYGGGRQGGYGGGGGGYGGGRREGGYGGGGYDGGGGGYSGGRREGGYGGGGYGTRAARTSDRDRHGRRRLLLRRXRPRRRRPRQPAGILHQLRAGRA

SEQ ID NO: 333 - DNA, 573 bp, Panicum virgatum
  misc_feature (1)..(573): Ceres CLONE ID no.1959598
gtgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgcgagacggggaggtcccgcgggttcggcttcgtcaccttctcacccgagcagtcgatgctcgacgccatcgaggccatgaacggcaaggagctcgacggccgcaacatcaccgttaaccaggcccagtcccgtggcggtggcggtggcggtggcggtggcggtggcggcggcggttacggcggcggtcgccagggaggctaccgcggcggccgcggccgcggcggctactgcggcggtcgccgtgagggcggctactgtggcggccgctacgacggtggcggcggcggatactgcgccggccgccgccagggcggctactgcggtggtggctactgcagccgcggtgactccggtggtaactggaggat

SEQ ID NO: 334 - protein, 165 aa, Panicum virgatum
  misc_feature (1)..(165): Ceres CLONE ID no. 1959598
  misc_feature (1)..(165): Functional Homolog of  Ceres CLONE ID no.  1011900
  misc_feature (10)..(81): Pfam Name: RRM_1 Pfam Description: RNA recognition motif. (a.k.a. RRM, RBD, or RNP domain)
MAAADVEYRCFVGGLAWATDNASLQQAFASYGDVLDSKVITDRETGRSRGFGFVTFSPEQSMLDAIEAMNGKELDGRNITVNQAQSRGGGGGGGGGGGGGGYGGGRQGGYRGGRGRGGYCGGRREGGYCGGRYDGGGGGYCAGRRQGGYCGGGYCSRGDSGGNWR

SEQ ID NO: 335 - protein, 162 aa, Physcomitrella patens
  misc_feature (1)..(162): Public GI no. 21388658
  misc_feature (1)..(162): Functional Homolog of  Ceres CLONE ID no.  1011900
  misc_feature (9)..(80): Pfam Name: RRM_1 Pfam Description: RNA recognition motif. (a.k.a. RRM, RBD, or RNP domain)
MAGGEEFRCFVGGLAWATTDGRLEGAFRPFGEVVQSKVISDRETGRSRGFGFVTFADENSMNAAIKEMNGQELDGRNITVNQAQSRGGGGGGGGGGGGYGRREQGGGGYGGGYGGSRGGGDREGSGYGGSRGGGYGGGGGGGYGGRGGPSSGNWRNDRQPEY

SEQ ID NO: 336 - DNA, 1585 bp, Arabidopsis thaliana
  misc_feature (1)..(1585): Ceres CLONE ID no.  104839
  misc_feature (1)..(1585): GEMINI ID 536B6
aatatttatagattttcactcggcctctgtctctatctgtctcgccttttttatttttcccaacagaaatcaattcaatttttgttgttgttcttattcttttccattgttgtttttcttttctaggatgattttttttttgtttcattcatgggtttcagttcagttttcagagattcttctcgtgattgccccttttattttgttttgaaagtcacaacaatggtcacgttttgatcggaaacttaatttgagatccatgataaaaattggaactttcttatgttgagatcattaacaacaatttgtgcgtgatgggttgttctaaatgtagaattttgtttgatcatcgttgggttttgaaagaagagcaatgagcaattatgcagccgggctcggtaaacctggctcaggtaaaaggagaatcagagatcttttaaatcaacctgataaccgagtctgcgctgattgtggcgcttctgttcctaaatgggccaaatatcagagtattcatttgcttaaaagttgcggtgtgcacagaagcctcggcactcagattttaaaggttttgtctgtgacacttgatgaatgatcagatgaggaagtcgattccatgattgaaactggaggaaatgcgtctgctaattcaatttatgaagcttttgtacctgacacatgctctaagcctggacctgatgttaatcatgaccagcgtatgagattcattaggtaagatttgaaaccatctgtgttgaaatctgaatctatgccttctcttcccttgaactcgcaaagcccgaccgccttctctatagaaaaatcattcatcaaagcaaagtcatcttctaagaatgtcctggacttgcgggtcatgatgagcttcttaggtgttttttgctctttaactatttctccagtctcttctgcagcttcaataggatggtgtgatacttggggctgatacacgggcaactgaagggcctattgttgctgatacaaactgtgggaagattcactacatggcaccaaacatttactgttgattttgtttacactgagaaatgggtttatctttggtggatgattagtgaaacttgaggagagaataattttacacgttttagttaaaaatggcagcttcaagcggctctggtttggaaggccctctacgtttgcatgtcgctggcgactgaaaccagcgacatcgaccaaaagttgttcgtttgcatgtcgctggatcaacgaccaaaagtagcgagagtcgccaggatttattctgtttttcgctcttgactttatcagctgaggaggggtaaataagtatagacatggaggaagacatggatctaacagaagatgatttcagaaatgtgtctggccagttttcagggcaagcatcgatagtggaggttggggatgctgtgtatgtgagagtcgaaaccgtgaaagtagatgttagttgtatcattattcttctttttattgttggaggttgctaatgcttgtgttacttaaacacctctgcttcgagtatagtttctacaatcatttgctccaagacttgaatgcttgtgattatgttctc

SEQ ID NO: 337 - protein, 56 aa, Arabidopsis thaliana
  misc_feature (1)..(56): Ceres CLONE ID no.  104839
  misc_feature (1)..(56): GEMINI ID 536B6
MEEDMDLTEDDFRNVSGQFSGQASIVEVGDAVYVRVETVKVDVSCIIILLFIVGGC

SEQ ID NO: 338 - DNA, 1137 bp, Arabidopsis thaliana
  misc_feature (1)..(1137): Ceres CLONE ID no.  105162
  misc_feature (1)..(1137): GEMINI ID 555H5
acacaaacccactgaacattcaaatgtctcgttctcttgtcttcttcttcctctttcttgtcttggtcgtcccttgtctctcccatggaaccggaggagaccacgacgacgatgaggctccgcacgttaagagttccgatctcaaatccaaatccttaatctccgtcaagatcgcatgtcttgtcatcatctttgtcctcacgttcataagcggtgtatctccttatttcttgaaatggagccaagggtttttggttcttggtacacaattcgccggaggcgtgtttcttgcaaccgccttgatgcatttcttgtcggacgctgatgagacgtttcgtgatttgttgacggcggaaggagagtcggagccatctccggcttacccatttgcttatatgttggcttgtgctggttttatgttgaccatgcttgctgattcggtcatcgctcatatctactcaaagacccaaaacgatttggagcttcaaggagaagacaaatcgaatcagaggtcagcaacaactgaaacttcgattggagatagcattctattgatcgtagctctctgttttcactctgtcttcgaaggcatagctattggtatttcagagactaaatcagatgcttggagagctctctggacaataacactccataagatatttgcagcgattgcaatgggaatagctcttctccgtatgatccctgaccgtcctttattctcctcaatcacttattctttcgcattcgccatctcgagcccaattggtgttgccatcgggatagtcatcgatgcaacgactcaagggtccatcgcggattggatattcgcattgtcgatgagcttggcgtgtggggtatttgtgtatgtatctgtgaaccatttgttggcaaaagggtatcgaccaaacaagaaagttcatgttgatgagcctcgttataagtttttggctgtgttgtttggagttgttgtcattgccattgttatgatatgggacacttgaaaaacactacaattgtcccaaaatactgattagatttttctggtttgcaaagaaagcttgttgatttttgtatgtttatagcatgtagcaatcctcgttttgtaatgtactttgtacttttgtagcatcaaag

SEQ ID NO: 339 - protein, 326 aa, Arabidopsis thaliana
  misc_feature (1)..(326): Ceres CLONE ID no.  105162
  misc_feature (1)..(326): GEMINI ID 555H5
  misc_feature (45)..(322): Pfam Name: Zip Pfam Description: ZIP Zinc transporter
MSRSLVFFFLFLVLVVPCLSHGTGGDHDDDEAPHVKSSDLKSKSLISVKIACLVIIFVLTFISGVSPYFLKWSQGFLVLGTQFAGGVFLATALMHFLSDADETFRDLLTAEGESEPSPAYPFAYMLACAGFMLTMLADSVIAHIYSKTQNDLELQGEDKSNQRSATTETSIGDSILLIVALCFHSVFEGIAIGISETKSDAWRALWTITLHKIFAAIAMGIALLRMIPDRPLFSSITYSFAFAISSPIGVAIGIVIDATTQGSIADWIFALSMSLACGVFVYVSVNHLLAKGYRPNKKVHVDEPRYKFLAVLFGVVVIAIVMIWDT

SEQ ID NO: 340 - protein, 326 aa, Arabidopsis thaliana
  misc_feature (1)..(326): Public GI no. 20147287
  misc_feature (1)..(326): Functional Homolog of  Ceres CLONE ID no.  105162
  misc_feature (45)..(322): Pfam Name: Zip Pfam Description: ZIP Zinc transporter
MSRSLVFFFLFLVLVVPCLSHGTGGDHDDDEASHVKSSDLKSKSLISVKIACLVIIFVLTFISGVSPYFLKWSQGFLVLGTQFAGGVFLATALMHFLSDADETFRGLLTAEGESEPSPAYPFAYMLACAGFMLTMLADSVIAHIYSKTQNDLELQGEDKSNQRSATTETSIGDSILLIVALCFHSVFEGIAIGISETKSDAWRALWTITLHKIFAAIAMGIALLRMIPDRPLFSSITYSFAFAISSPIGVAIGIVIDATTQGSIADWIFALSMSLACGVFVYVSVNHLLAKGYRPNKKVHVDEPRYKFLAVLFGVVVIAIVMIWDT

SEQ ID NO: 341 - protein, 354 aa, Arabidopsis thaliana
  misc_feature (1)..(354): Public GI no. 8778308
  misc_feature (1)..(354): Functional Homolog of  Ceres CLONE ID no.  105162
  misc_feature (45)..(350): Pfam Name: Zip Pfam Description: ZIP Zinc transporter
MSRSLVFFFLFLVLVVPCLSHGTGGDHDDDEASHVKSSDLKSKSLISVKIACLVIIFVLTFISGVSPYFLKWSQGFLVLGTQFAGGVFLATALMHFLSDADETFRGLLTAEGESEPSPAYPFAYMLACAGFMLTMLADSVIAHIYSKTQNDLELQGTKSFELVNLNQELELCCVESFVLYFVSGEDKSNQRSATTETSIGDSILLIVALCFHSVFEGIAIGISETKSDAWRALWTITLHKIFAAIAMGIALLRMIPDRPLFSSITYSFAFAISSPIGVAIGIVIDATTQGSIADWIFALSMSLACGVFVYVSVNHLLAKGYRPNKKVHVDEPRYKFLAVLFGVVVIAIVMIWDT

SEQ ID NO: 342 - DNA, 1180 bp, Gossypium hirsutum
  misc_feature (1)..(1180): Ceres CLONE ID no.1853694
atataaccgtaaaaaactgaattcaagcacagtctctcaatgaagctctcacgttttctctttttcttctttctctacctctctcttttcatctctgtcacctgccacgggggcagtcatgctgacggtgatgatgatgatgatgacaaggcaggtgaaaggaatgaacctcatgacctacgatccaaatccttgattctggtcaaggtatggtgcttgattctagtgtttgtagggacgttcgtaggtggtgtgtcaccctattttctaaagtggaaccagggttttttggtgctgggaacacagttcgccggtggggtttttcttgggacagccatgatgcatttcttgagtgatgcgaatgaaacttttggagacttgacgactaaagaataccctttagcctttatgttggcatgtgctggatatttgttgactatgctagctgattgtgtgatttcttatgtgtacgggaaagggaagaattcatgtaacaatggtgatttggagcttcaaggggctgagcggagcaaaacgaatcctcatggtcaaggcgatccaccagttggtaatggcactgatacgacatgtgcgcagtcttcatctctcacatctgcaagttctttcggggatagcgttctgttgatcgttgcattgtgcttccattcggtctttgagggcatagcaattggagttgcagaaactgaagctgatgcttggaaagccttgtggacaatctccttgcacaagatatttgcggcgatcgcaatggggatagcactgctccgaatgatcccggatcgtccattgttgtcgtgcatcgcctatgcatttgcatttgccatttcaagtcctgttggggtagccattgggatcgtaatagatgccacaactcagggtgctgtagcagactggatctttgccatatcaatggggttagcctgtggagtgttcatctacgtatcgataaaccatctgctggctaaaggctacgcaccccagaagacggtttcagtcaacagaccccatcacaagttcttgtctgtcttgttaggtgttggggtgatcgctgtagtaatgatctgggacacttgaaagtatattcaactttttgaactgatttctcaaagtttatctgaccaataaatattgatggactgaaaaaaaaaaaaaaaaaaaa

SEQ ID NO: 343 - protein, 351 aa, Gossypium hirsutum
  misc_feature (1)..(351): Ceres CLONE ID no. 1853694
  misc_feature (1)..(351): Functional Homolog of  Ceres CLONE ID no.  105162
  misc_feature (52)..(347): Pfam Name: Zip Pfam Description: ZIP Zinc transporter
MKLSRFLFFFFLYLSLFISVTCHGGSHADGDDDDDDKAGERNEPHDLRSKSLILVKVWCLILVFVGTFVGGVSPYFLKWNQGFLVLGTQFAGGVFLGTAMMHFLSDANETFGDLTTKEYPLAFMLACAGYLLTMLADCVISYVYGKGKNSCNNGDLELQGAERSKTNPHGQGDPPVGNGTDTTCAQSSSLTSASSFGDSVLLIVALCFHSVFEGIAIGVAETEADAWKALWTISLHKIFAAIAMGIALLRMIPDRPLLSCIAYAFAFAISSPVGVAIGIVIDATTQGAVADWIFAISMGLACGVFIYVSINHLLAKGYAPQKTVSVNRPHHKFLSVLLGVGVIAVVMIWDT

SEQ ID NO: 344 - DNA, 978 bp, Populus balsamifera subsp. trichocarpa
  misc_feature (1)..(978): Ceres ANNOT ID no. 1494468
atgtctcgctctctcctcttcctctctctcttcctctctctcctccttctaacagccgggcacagtggccacaacgacgatgacgaagccgacgccgacgccgacggtgacaccacaaaaattaatctccgttcgaaatccttaatcctggttaagatatggtgcttgatactgatctttattggcactttcattggtggggtgtccccctattttttgaagtggaacgaggggttcttggtgttagggactcagtttgctagcggtgtgtttctggggactgctttgatgcacttcttgagcgatgcaaatgagacctttgaggatttgacaaaaaaggagtacccttttgctttcatgttggcctgtgctggctatttgttgacgatgcttgcggattctatcatttctcatgtttatagcaaagatgtggtcagtcaggctaatggtggcgatgtagagcttcaagatgctgcctctgcaaaatccactctctcaactgccagttcatttggggacagcattttgttaatatttgcgttgtgtttccactctgtcttcgagggcattgcaataggagttgcaaagacaaatgccgatgcctggaaagctttatggactatcactttgcataagatatttgcagcaatcgcaatgggtatagctctccttcgaatgatcccagatcgcccctgtgtatcatgtgttgcctatgctttcgcatttgccatttcaagtcctgttggcgtggccattgggattataattgatgccacaactcagggtcctgtggcagactggatctttgccatatcaatgggactggcatgtggtgtgttcatctatgtatcaattaaccatctttcaaccaagggttaccttccccagagatcagttttagttgatacgccactttacaagttcttggccgtatcattggggatcggggtaattgctgttgtgatgatatgggactga

SEQ ID NO: 345 - protein, 325 aa, Populus balsamifera subsp. trichocarpa
  misc_feature (1)..(325): Ceres ANNOT ID no. 1494468
  misc_feature (1)..(325): Functional Homolog of  Ceres CLONE ID no.  105162
  misc_feature (48)..(322): Pfam Name: Zip Pfam Description: ZIP Zinc transporter
MSRSLLFLSLFLSLLLLTAGHSGHNDDDEADADADGDTTKINLRSKSLILVKIWCLILIFIGTFIGGVSPYFLKWNEGFLVLGTQFASGVFLGTALMHFLSDANETFEDLTKKEYPFAFMLACAGYLLTMLADSIISHVYSKDVVSQANGGDVELQDAASAKSTLSTASSFGDSILLIFALCFHSVFEGIAIGVAKTNADAWKALWTITLHKIFAAIAMGIALLRMIPDRPCVSCVAYAFAFAISSPVGVAIGIIIDATTQGPVADWIFAISMGLACGVFIYVSINHLSTKGYLPQRSVLVDTPLYKFLAVSLGIGVIAVVMIWD

SEQ ID NO: 346 - DNA, 1125 bp, Populus balsamifera subsp. trichocarpa
  misc_feature (1)..(1125): Ceres ANNOT ID no. 1441572
atgtctcgctctctcctcttcctctctctcttcctctctctcctccttctaacagccgggcacagtggccacaacgacgatgacgaagccgacgccgacgccgacggtgacaccacaaaaattaatctccgttcgaaatccttaatcctggttaagatatggtgcttgatactgatctttattggcactttcattggtggggtgtccccctattttttgaagtggaacgaggggttcttggtgttagggactcagtttgctagcggtgtgtttctggggactgctttgatgcacttcttgagcgatgcaaatgagacctttgaggatttgacaaaaaaggagtacccttttgctttcatgttggcctgtgctggctatttgttgacgatgcttgcggattctatcatttctcatgtttatagcaaagatgtggtcagtcaggctaatggtggcgatgtagagcttcaagggggtgttctgcagggaaaaagaagccacaccagcagttcccagtcacattttcagatgcacaatggtacagatgctgcctctgcaaaatccactctctcaactgccagttcatttggggacagcattttgttaatatttgcgttgtgtttccactctgtcttcgagggcattgcaataggagttgcaaagacaaatgccgatgcctggaaagctttatggactatcactttgcataagatatttgcagcaatcgcaatgggtatagctctccttcgaatgatcccagatcgcccctgtgtatcatgtgttgcctatgctttcgcatttgccatttcaagtcctgttggcgtggccattgggattataattgatgccacaactcagggtcctgtggcagactggatctttgccatatcaatgggactggcatgtggtgtgttcatctatgtatcaattaaccatctttcaaccaagggttaccttccccagagatcagttttagttgatacgccactttacaagttcttggccgtatcattggggatcgggagcatgggtggtggtagaatacaagctctgtcacaagctattactaggaaaaactatgttttgccagattggcaggacacaatctataggtacatgcatcattaa

SEQ ID NO: 347 - protein, 374 aa, Populus balsamifera subsp. trichocarpa
  misc_feature (1)..(374): Ceres ANNOT ID no. 1441572
  misc_feature (1)..(374): Functional Homolog of  Ceres CLONE ID no.  105162
  misc_feature (48)..(346): Pfam Name: Zip Pfam Description: ZIP Zinc transporter
MSRSLLFLSLFLSLLLLTAGHSGHNDDDEADADADGDTTKINLRSKSLILVKIWCLILIFIGTFIGGVSPYFLKWNEGFLVLGTQFASGVFLGTALMHFLSDANETFEDLTKKEYPFAFMLACAGYLLTMLADSIISHVYSKDVVSQANGGDVELQGGVLQGKRSHTSSSQSHFQMHNGTDAASAKSTLSTASSFGDSILLIFALCFHSVFEGIAIGVAKTNADAWKALWTITLHKIFAAIAMGIALLRMIPDRPCVSCVAYAFAFAISSPVGVAIGIIIDATTQGPVADWIFAISMGLACGVFIYVSINHLSTKGYLPQRSVLVDTPLYKFLAVSLGIGSMGGGRIQALSQAITRKNYVLPDWQDTIYRYMHH

SEQ ID NO: 348 - protein, 350 aa, Medicago truncatula
  misc_feature (1)..(350): Public GI no. 38036140
  misc_feature (1)..(350): Functional Homolog of  Ceres CLONE ID no.  105162
  misc_feature (51)..(346): Pfam Name: Zip Pfam Description: ZIP Zinc transporter
MSFSLRTFFFLSLLLLLFFSSVSSHGGHDDDADIDADSDSEAPHNLRSKSLILTKVYCLIVIFFATFIAGVSPYVLRWNEGFLILGTQFAGGVFLGTALMHFLSDANETFGDLTDKEYPFAYMLACAGYLITMLADCVISSLLEKPNHGAGADVEGQGVDKGRSNGVNSQSQYQSSAGTNDADLAPSSSIGDTVYIFIYVYIIALCAHSVFEGLAIGVSVTKADAWKALWTICLHKIFAAIAMGIALLRMVPNRPLLSCAAYAFAFAISSPIGVAIGIVLDSTTQGHVADWIFAISMGLACGVFIYVSINHLFAKGYVPHKHSKADSAYMKFLAVSLGIGVIAVVMIWDT

SEQ ID NO: 349 - protein, 349 aa, Glycine max
  misc_feature (1)..(349): Ceres CLONE ID no. 1649800
  misc_feature (1)..(349): Functional Homolog of  Ceres CLONE ID no.  105162
  misc_feature (51)..(345): Pfam Name: Zip Pfam Description: ZIP Zinc transporter
MSPSFCTSLFLFTLSLLFFLFFSLSVSAHSGHHDDGDADSDATPDLRARPLILAKVWCLIVIFIATFVSGVSPYILKWNEGFLVLGTQFAGGVFLGTAMMHFLSDANETFGDLTQKEYPFAFMLACAGYLMTLLADAVISSLFNNMGRHAQDVQGQGADVNKLSSNGVTSQSQHRSHDANHHLASPALGYVHSVGDTVLLIVALCAHSVFEGLAIGVAETKADAWKALWTICLHKIFAAIAMGIALLRMIPDRPLVSCAVYAFAFAISSPIGVAIGIILDATTQGHVADWIFAISMGLACGVFIYVSVNHLLAKGYMPHRPTKVDSAYFKFLAVFLGVGVIAVVMIWDT

SEQ ID NO: 350 - protein, 359 aa, Zea mays
  misc_feature (1)..(359): Ceres CLONE ID no. 984060
  misc_feature (1)..(359): Functional Homolog of  Ceres CLONE ID no.  105162
  misc_feature (55)..(355): Pfam Name: Zip Pfam Description: ZIP Zinc transporter
MARATNAHHHRLRLLLCLSLAAAAWAHGGGGDSDADADADGGAAARPDLRARSLVEAKLWCLAVVFVGTLLGGVSPYFMRWNEAFLALGTQFAGGVFLGTALMHFLSDANETFGDLLPDSGYPWAFMLACAGYVVTMLADVAISYVVSRSQGRSTGTAATGGSDAGLEEGKMRTTNGTRSEPTPADAHGSDHSAASILRNASTIGDSVLLIVALCFHSVFEGIAIGIAETKADAWKALWTISLHKIFAAIAMGIALLRMLPNRPLLSCFAYAFAFAISSPVGVGIGIIIDATTQGRVADWIFAVSMGLATGIFVYVSINHLLSKGYRPQRPVAVDTPVGRWLAVVFGVAVIAVVMIWDT

SEQ ID NO: 351 - protein, 358 aa, Oryza sativa
  misc_feature (1)..(358): Public GI no. 31872116
  misc_feature (1)..(358): Functional Homolog of  Ceres CLONE ID no.  105162
  misc_feature (57)..(354): Pfam Name: Zip Pfam Description: ZIP Zinc transporter
MAGGRGARASLHLHLAWLCAFATTAWAHGGGGGGGDSDADADGGGEGKPDLRARGLVAAKLWCLAVVFAGTLAGGVSPYFMRWNDAFLALGTQFAGGVFLGTAMMHFLADANETFADLLPGTAYPFAFMLACAGYVLTMLADCAISFVVARGGGRTEPAAAAGAGLEEGKLSSTNGNASDPPAADAAAQDHSVASMLRNASTLGDSVLLIAALCFHSVFEGIAIGVAETKADAWKALWTISLHKIFAAIAMGIALLRMLPDRPFLSCFGYAFAFAVSSPVGVGIGIVIDATTQGRVADWIFAVSMGLATGIFIYVSINHLLSKGYTPLRPVAADTPAGRLLAVVLGVAVIAVVMIWDT

SEQ ID NO: 352 - DNA, 1418 bp, Panicum virgatum
  misc_feature (1)..(1418): Ceres CLONE ID no.1816624
ctaccatctcccggtccggccaacacccgccacaacccctcccacacgccacgccatggcccgcgccaccaccgcccggcacctcctcctcctcctctgcctctccctcggcgcggccaccgcgcgggcgcacggcgggggcggggacgcggacgcggacgcgggcggcggctccccggcgcccgacctgcgcgcgcgcggcctggttgcggccaagctgtggtgcctggccgtggtgttcgcgggcacgctgctcggcggggtgtccccctacttcctgcgctggaacgaggcgttcctcgcgctgggcacgcagttcgccggcggggtcttcctcggcacggcgctcatgcacttcctcagcgacgccgacgagacgttcggggacctgctccccgacagcggctacccctgggcgttcatgctcgcctgcgccggctacgtcgtcaccacgctcgccgacgtcgtcatctcccacgtcgtctcgcggggccgcgccgccgctggttccggcgccggcggcgacggtgaaggccttgaggagggcaaggtgagcaccacaaatggcaccagctctgagccacacccagctgatgcgcacggatctgatcactcggttgcatcaatgctgcgcaacgcgagcaccctcggagatagcgttctgctcatcgccgccctctgctttcactccgtcttcgagggcatcgccatcggagtcgctgagacgaaggctgacgcgtggaaggcgctgtggaccatcagcctgcacaagatcttcgcggcgatcgccatgggcatcgcgctgctccggatgctcccgaaccgcccgctcctctcctgcttcgcctacgccttcgcgttcgccatctcgagccccatcggcgtcggcgtcggcatcgtcatcgacgccaccacgcagggccgggtggccgactggatattcgccgtctccatgggcctcgccacgggcatcttcgtctacgtctccatcaaccacctcctctccaaggggtacaagccccagaggcccgtcgccgttgacacgccggtcagcaggtggcttgccgtggtgctcggcgtggccgtcatcgccgttgtcatgatatgggacacctgatgtgactatgtgacagagagagacatgggattgttatgcacagtttggggcgtttggttcttgcaggagggagcgagggacttctcttacattatagattatagtaggggcgatgagaattgccttgacccggtgaaaggggaaaggaataaaacatacagttccaactgaggtcttgtttagtgcataaattttaccctgtaaatgtcacatcgaatatgccagtacacatttgaagtattaaaagtagactaattacaaaataaattatatattccatcaaaaaaaaaaaaaaaaaaaa

SEQ ID NO: 353 - protein, 353 aa, Panicum virgatum
  misc_feature (1)..(353): Ceres CLONE ID no. 1816624
  misc_feature (1)..(353): Functional Homolog of  Ceres CLONE ID no.  105162
  misc_feature (51)..(349): Pfam Name: Zip Pfam Description: ZIP Zinc transporter
MARATTARHLLLLLCLSLGAATARAHGGGGDADADAGGGSPAPDLRARGLVAAKLWCLAVVFAGTLLGGVSPYFLRWNEAFLALGTQFAGGVFLGTALMHFLSDADETFGDLLPDSGYPWAFMLACAGYVVTTLADVVISHVVSRGRAAAGSGAGGDGEGLEEGKVSTTNGTSSEPHPADAHGSDHSVASMLRNASTLGDSVLLIAALCFHSVFEGIAIGVAETKADAWKALWTISLHKIFAAIAMGIALLRMLPNRPLLSCFAYAFAFAISSPIGVGVGIVIDATTQGRVADWIFAVSMGLATGIFVYVSINHLLSKGYKPQRPVAVDTPVSRWLAVVLGVAVIAVVMIWDT

SEQ ID NO: 354 - DNA, 1326 bp, Arabidopsis thaliana
  misc_feature (1)..(1326): Ceres CLONE ID no.  110419
  misc_feature (1)..(1326): GEMINI ID 554A9
aactctcatcttcttttctctttctttttcctctttctccattgcttgttgattgatgatcttgaagcaaggatcatgaggttccttcacagatttctgttggaggatatgcccaaagaaaccttttcggactctctctgtaaaaataattgcatccaagagttgaaaactctaggatactgttcatcctattgtcttgacgagtgtccttccatctgcgagatcgtcgtaatttcaggtctttcaccacctgcagagatccaccacgacgacaacttaaagaggatcttgatcatctctgcttcatctatcatcacaactctgtttctccttactttacttgttctctgcttcaagttttactataggaggagaagatcaataacaacatcaagaagatggagtatggaagaagctaggaattgggattttgatggaccagcacctgttattgttgatcatccgatttggcatatcagaaccatagggttgaatccaacggttataagttccatcaaagtttgtcagtatagtaaaaaagatggtgttgtggaaggaactgattgctccgtttgtttaagcgaattcgaagaagaagagacgcttagattgttaccaaagtgtaaacatgcttttcatctttattgtattgatacttggcttagatcacacaccaattgtccgcttagtcgtgctcctatcgttgaggccaacacaatgattgatgatcatagtgaggggctagaggagataagtgtgatgattccagaagaaaatggagatgataccgatgaagaaatcgaggaagaaagagatggctttgttagtaatattagtagagatcatggtgagtcacaacaacagcgagtgagacgatcagtgtcgttggattcgttatcgggtttaagggtaagtgaagttgttgtgggtagagaaaaggagaagttgaagagaggcaataatattggatctgggaggtcaagtttattgaagagatctatctcttacagtggaaagtagtactagctagcttcagtgctaataataaaaacaagaagtccataaagtaagtaagtttcttgaagaagaaaatcaaatcaaacccaacaacatataggttgtattcatatgtatgaaggtgatataagattacgattatcaaagctagtcactcttgtaaagttaaaagagagttttgacaacttctactactctgcttagatactctggatttgtggattaagtataaatatacaccaaacttcgttttgtatgttacttatttattgttcctcaagaaataccatctggattttaattattttt

SEQ ID NO: 355 - protein, 314 aa, Arabidopsis thaliana
  misc_feature (1)..(314): Ceres CLONE ID no.  110419
  misc_feature (1)..(314): GEMINI ID 554A9
  misc_feature (164)..(204): Pfam Name: zf-C3HC4 Pfam Description: Zinc finger, C3HC4 type (RING finger)
MRFLHRFLLEDMPKETFSDSLCKNNCIQELKTLGYCSSYCLDECPSICEIVVISGLSPPAEIHHDDNLKRILIISASSIITTLFLLTLLVLCFKFYYRRRRSITTSRRWSMEEARNWDFDGPAPVIVDHPIWHIRTIGLNPTVISSIKVCQYSKKDGVVEGTDCSVCLSEFEEEETLRLLPKCKHAFHLYCIDTWLRSHTNCPLSRAPIVEANTMIDDHSEGLEEISVMIPEENGDDTDEEIEEERDGFVSNISRDHGESQQQRVRRSVSLDSLSGLRVSEVVVGREKEKLKRGNNIGSGRSSLLKRSISYSGK

SEQ ID NO: 356 - DNA, 1133 bp, Arabidopsis thaliana
  misc_feature (1)..(1133): Ceres CLONE ID no.  110428
  misc_feature (1)..(1133): GEMINI ID 539A7
actttctctttgttttctttctaacctctttccacgaaaagtcacgatgggagataccgcagaggatcaggacgaccgagctatgatggaagctgaaggagtaacgagcttctccgaacttcttatgttctctgacggcgttctcagctcctcttccgaccaccaacctgagggtaatgtcggcgatggtggagaagacagtttaggttttgtattctccggcaaaactggctcaagaatgctctgttttagtggaggctatcaaaacgacgacgagtcactcttcctagaaccttctgttccaacctccggagtctctgatcttgacccttcatgcattaagattgattgcaggaactcaaacgacgcgtgtacggtcgataaatctactaaatcatcaaccaagaagagaaccggaacgggtaatgggcaagagtcggatcaaaatcgaaaaccgggcaagaaagggaaacgaaatcaagataaatcatcagttggaattgcaaaggtcaggaaagaaaggttaggggaaagaattgcagcgttgcagcagttggtttctccatacggcaagacagatgcagcttctgtgttgcatgaagcgatgggttacatcaaattcttacaagatcagattcaagtcctttgctctccttatctaatcaaccattctcttgacggtggagttgtcaccggagatgtaatggcggcgatgaaagcgaaagacttgagaagcagaggattatgtctagtacctgtctcatccaccgtacacgtggaaaattccaacggtgctgatttctggtcacctgctactatgggtcacactacgtcaccttcgttacctcaaggattttaattaaacggtcgtaggctgatatatattagtagtattttagtagccttttttcttgggttttgtttttggctgaagaactattactagtaaatgttacacccagacatttttttgggattatctgggtggtataaaaaggttggaatcttttgtgtttgtaaaattagattgtctaagttttcttaaagtttctttgatgtcactgtcacagttgcgacgagtagtgatggtacttactgaaaggctaagcttattcacgctcttaaagttttgc

SEQ ID NO: 357 - protein, 270 aa, Arabidopsis thaliana
  misc_feature (1)..(270): Ceres CLONE ID no.  110428
  misc_feature (1)..(270): GEMINI ID 539A7
MGDTAEDQDDRAMMEAEGVTSFSELLMFSDGVLSSSSDHQPEGNVGDGGEDSLGFVFSGKTGSRMLCFSGGYQNDDESLFLEPSVPTSGVSDLDPSCIKIDCRNSNDACTVDKSTKSSTKKRTGTGNGQESDQNRKPGKKGKRNQDKSSVGIAKVRKERLGERIAALQQLVSPYGKTDAASVLHEAMGYIKFLQDQIQVLCSPYLINHSLDGGVVTGDVMAAMKAKDLRSRGLCLVPVSSTVHVENSNGADFWSPATMGHTTSPSLPQGF

SEQ ID NO: 358 - protein, 270 aa, Arabidopsis thaliana
  misc_feature (1)..(270): Public GI no. 11994473
  misc_feature (1)..(270): Functional Homolog of  Ceres CLONE ID no.  110428
MGDTAEDQDDRAMMEAEGVTSFSELLMFSDGVLSSSSDHQPEGNVGDGGEDSLGFVFSGKTGSRMLCFSGGYQNDDESLFLEPSVPTSGVSDLDPSCIKIDCRNSNDACTVDKSTKSSTKKRTGTGNGQESDQNRKPGKKGKRNQEKSSVGIAKVRKERLGERIAALQQLVSPYGKTDAASVLHEAMGYIKFLQDQIQVLCSPYLINHSLDGGVVTGDVMAAMKAKDLRSRGLCLVPVSSTVHVENSNGADFWSPATMGHTTSPSLPQGF

SEQ ID NO: 359 - protein, 265 aa, Zea mays
  misc_feature (1)..(265): Ceres CLONE ID no. 1444428
  misc_feature (1)..(265): Functional Homolog of  Ceres CLONE ID no.  110428
MGDTADDQAMVEAPGVPSFSELLMLSDGFLSSSEDHRREINGGDGGEDSFGFVFSGTSGSKMLCFSGDCQNGDESLFQEPSFPSGVSVSDPSSCTINTCKNSNDTCTDERSIKSSNKKRTGSGNGQNMDHNQKPSKKCKKNQDKSTVGIAKVRKERLGERIAALQQLVSPYGKTDAASVLHEAMGYIKFLQDQIQVLCSPYLINYSLDGGAVTGDVTPGKKVRDLRSRGLCLAPVSSTVHVENSNGADLWSPATASMGHTMSPSQ

SEQ ID NO: 360 - DNA, 1164 bp, Arabidopsis thaliana
  misc_feature (1)..(1164): Ceres CLONE ID no.  112098
  misc_feature (1)..(1164): GEMINI ID 533H2
atgacccatattctcttgactcgtgaggttaaatgtaaatcactttagaatataaaaacgtaccttgtcagttttgagactcaaaaggacttgaaatattgaaatccctattctttacgcgtactcgagatttttcgctcttgagagaatcacttcgacaatgtcggtaacggctgctttcattgattcggatcaaactcagcacaacattcttatggattcccaatcaactgtctccggtgtgaaaactgtcaagattagcaatgtttcactaattgtttctaagaaagatgtcaaagagttcttttctttctctggtgacattcaatacgtcgagatgcgaagtgagacacaagagagtcaggtcgcatatgttacttttaaggattcacaaggagctgaaactgcaatgctcttaacgggagctgtcattgcagatcttcgtgttagtataactcctgctgttaactatcagctaccaccagaagcccttgcacttgactcggaacattcgtttaatggtttttctgtcaagaaagctgaagatgtggtgaacatcatggtgggaagaggttatgctcttggaaaagacgccatggagaaagccaaagcatttgatgacagacacaacttgatctcaaacgcttctgcaaccattgcatcgcttgacgataagatgggtctgagcgaaaagctaagcataggaacaactgtggttaatgagaagttgagagatatcgatgagcgatatcaggtgagggagataacgaaatctgctttagcagctgctgaagagacagcahtcagtgcaagaacggctttaatggcaaacccttatgtatcaagtggagcttcgtggttttcaaacgcgtttggcgcagtgacaaaggcggttaaagagaaagttgagaatggaggagaaggaagaaaggagatcatcacacttgatccctcttcacccaaagttcctgctgtagttcctgttaagctcggttgatgcagatctcatcaaaccaatcggatctcgactaaattctttgataggtttgttgttcatatatatgctttcgtatgctaaagaaaagataaaaagacataaaccatgaaaggtgttgttacattcaaccagcatttgttcctctcttgaaagagattattaagatt

SEQ ID NO: 361 - protein, 278 aa, Arabidopsis thaliana
  misc_feature (1)..(278): Ceres CLONE ID no.  112098
  misc_feature (31)..(98): Pfam Name: RRM_1 Pfam Description: RNA recognition motif. (a.k.a. RRM, RBD, or RNP domain)
  misc_feature (1)..(278): GEMINI ID 533H2
  misc_feature (215)..(215): Xaa is any aa, unknown, or other
MSVTAAFIDSDQTQHNILMDSQSTVSGVKTVKISNVSLIVSKKDVKEFFSFSGDIQYVEMRSETQESQVAYVTFKDSQGAETAMLLTGAVIADLRVSITPAVNYQLPPEALALDSEHSFNGFSVKKAEDVVNIMVGRGYALGKDAMEKAKAFDDRHNLISNASATIASLDDKMGLSEKLSIGTTVVNEKLRDIDERYQVREITKSALAAAEETAXSARTALMANPYVSSGASWFSNAFGAVTKAVKEKVENGGEGRKEIITLDPSSPKVPAVVPVKLG

SEQ ID NO: 362 - protein, 278 aa, Arabidopsis thaliana
  misc_feature (1)..(278): Public GI no. 21593120
  misc_feature (1)..(278): Functional Homolog of  Ceres CLONE ID no.  112098
  misc_feature (31)..(98): Pfam Name: RRM_1 Pfam Description: RNA recognition motif. (a.k.a. RRM, RBD, or RNP domain)
MSVTAAFIDSDQTQHNILMDSQSTVSGVKTVKISNVSLIVSKKDVKEFFSFSGDIQYVEMRSETQESQVAYVTFKDSQGAETAMLLTGAVIADLRVSITPAVNYQLPPEALALDSEHSFNGFSVKKAEDVVNIMVGRGYALGKDAMEKAKAFDDRHNLISNASATIASLDDKMGLSEKLSIGTTVVNEKLRDIDERYQVREITKSALAAAEETAISARTALMANPYVSSGASWFSNAFGAVTKAVKEKVENGGEGRKEIITLDPSSPKVPAVVPVKLG

SEQ ID NO: 363 - protein, 278 aa, Arabidopsis thaliana; identical to SEQ ID NO: 362
  misc_feature (1)..(278): Ceres CLONE ID no. 38780
  misc_feature (1)..(278): Functional Homolog of  Ceres CLONE ID no.  112098
  misc_feature (31)..(98): Pfam Name: RRM_1 Pfam Description: RNA recognition motif. (a.k.a. RRM, RBD, or RNP domain)

SEQ ID NO: 364 - protein, 278 aa, Arabidopsis thaliana; identical to SEQ ID NO: 362
  misc_feature (1)..(278): Ceres CLONE ID no. 36337
  misc_feature (1)..(278): Functional Homolog of  Ceres CLONE ID no.  112098
  misc_feature (31)..(98): Pfam Name: RRM_1 Pfam Description: RNA recognition motif. (a.k.a. RRM, RBD, or RNP domain)

SEQ ID NO: 365 - protein, 279 aa, Arabidopsis thaliana
  misc_feature (1)..(279): Public GI no. 30697598
  misc_feature (1)..(279): Functional Homolog of  Ceres CLONE ID no.  112098
  misc_feature (31)..(98): Pfam Name: RRM_1 Pfam Description: RNA recognition motif. (a.k.a. RRM, RBD, or RNP domain)
MSVTAAFIDSDQTQHNILMDSQSTVSGVKTVKISNVSLIVSKKDVKEFFSFSGDIQYVEMRSETQESQVAYVTFKDSQGAETAMLLTGAVIADLRVSITPAVNYQLPPEALALDSQEHSFNGFSVKKAEDVVNIMVGRGYALGKDAMEKAKAFDDRHNLISNASATIASLDDKMGLSEKLSIGTTVVNEKLRDIDERYQVREITKSALAAAEETAISARTALMANPYVSSGASWFSNAFGAVTKAVKEKVENGGEGRKEIITLDPSSPKVPAVVPVKLG

SEQ ID NO: 366 - protein, 279 aa, Arabidopsis thaliana
  misc_feature (1)..(279): Public GI no. 30697595
  misc_feature (1)..(279): Functional Homolog of  Ceres CLONE ID no.  112098
  misc_feature (32)..(99): Pfam Name: RRM_1 Pfam Description: RNA recognition motif. (a.k.a. RRM, RBD, or RNP domain)
MISPQAAFIDSDQTQHNILMDSQSTVSGVKTVKISNVSLIVSKKDVKEFFSFSGDIQYVEMRSETQESQVAYVTFKDSQGAETAMLLTGAVIADLRVSITPAVNYQLPPEALALDSEHSFNGFSVKKAEDVVNIMVGRGYALGKDAMEKAKAFDDRHNLISNASATIASLDDKMGLSEKLSIGTTVVNEKLRDIDERYQVREITKSALAAAEETAISARTALMANPYVSSGASWFSNAFGAVTKAVKEKVENGGEGRKEIITLDPSSPKVPAVVPVKLG

SEQ ID NO: 367 - protein, 268 aa, Zea mays
  misc_feature (1)..(268): Ceres CLONE ID no. 1376604
  misc_feature (1)..(268): Functional Homolog of  Ceres CLONE ID no.  112098
  misc_feature (13)..(80): Pfam Name: RRM_1 Pfam Description: RNA recognition motif. (a.k.a. RRM, RBD, or RNP domain)
MDSQPTTSPVKTVKISNVSLNVSKKDLNEFFSFSGDIHYIEMRSETQETQLAYVTFKDPQGAETAMLLTGAVIADHRVSITPAVNYDLPPEALALDSQEYSFNGFTVKKAEHVVSTMMERGYAVGKDAMEKAKAFDDRHNLVSNASATIASLDNKMGLSEKLSIGTTVVNEKLREVDERYQVREITKSALAAAEERAISAGTALMANPYVSSGASWLSNAFGAVTKAVRAEDGGEGRKEIVQLDDTSPKAPAVVPVNSVDTDFTKPSF

SEQ ID NO: 368 - protein, 310 aa, Glycine max
  misc_feature (1)..(310): Ceres CLONE ID no. 463184
  misc_feature (1)..(310): Functional Homolog of  Ceres CLONE ID no.  112098
  misc_feature (34)..(101): Pfam Name: RRM_1 Pfam Description: RNA recognition motif. (a.k.a. RRM, RBD, or RNP domain)
MSAMVEHTDQRAEAIPQSTAAPNWTIHVSDIKTVKVSNISLVTFKKDIEEFFSFSGDIRYIEMQRESGHTQVAYVTFKDTQGADTAVLLTGSKIGDLYVTITPVEKYQLPPEALPSSPTNQSPDAVKKAEDVMSTMLAKGFILGKDAINKAKAFDEHHQLTSNASSTVASIDRKIGLSDKLSFGTAVFNGKVREMDERYQLSEMTKSAMAAAEQKASSAGSAIMSNPYVKSGASWFSSAFTAIAKAAEDVSTMTKEKVEQAVVERNEIIYGERKGTVDEFAKTHLEEASDIGPAVVPVNSDDDRKLATIL

SEQ ID NO: 369 - DNA, 1274 bp, Arabidopsis thaliana
  misc_feature (1)..(1274): Ceres CLONE ID no.  112194
  misc_feature (1)..(1274): GEMINI ID 539E6
aaaatcaaagaagttgacaacaacaacaaaaaatccaaagagaaaacgtatgagttgcttaaaccataaacctcaagctcaaaattttatcaaccttataaagtttcgttttctcgagattttgaatcttttcagctaaaaaagatcacagctttttgcgttttctggatgagtttgagataagagaagatgaagattcagtgtaacgtttgtgaggcggcggaagcgacggttctatgttgcgccgacgaggctgctctttgttgggcttgcgatgagaaaattcacgccgctaataaactcgccggaaaacatcagagagtccctctctctgcctctgcctcttccatacccaaatgtgacatttgtcaggaagcatctggattcttcttttgtctgcaagatagagctttgctatgtaggaaatgtgatgttgcaatccacactgtgaatcctcatgtttcagctcaccagagatttsttctcactggaatcaaagttggtcttgaatctatagacactggtccttctactaaatcctcacctaccaatgatgataaaaccatggagaccaaaccttttgttcaatctatacctgagcctcaaaagatggccttcgatcatcatcatcaccagcagcagcaggaacagcaggaaggagttataccgggaactaaagtcaatgatcagacatcgacaaagcttcctctcgtaagtagcggatcaactactggaagcattcctcagtggcaaatagaggagattttcgggctaaccgactttgatcagagctatgaatacatggagaataatggatcatctaaggcggatactagtagacgaggagattcagacagttcttcgatgatgagatctgcagaagaagatggagaagataacaataactgcttgggaggtgagacatcatgagcggttccacagattcagtctccacctacagcgtctggtctaaactggcctaagcattttcaccaccactctgtgtttgttccggacataacttcttcaactccttataccggttcatccccgaatcaaagggttgggaaacggcggcgacggttctagcatttgtaattatcttttagccgcttgagaaaagagattggcagctttctcagtagatgtaagatcacataaatgatttggaaacttgtaatgtagtgatctgtgagagtcggtgttctttgttagctgaaaaaacaaaaagatgtttatttggttgaagattataaggggttaaattactaagc

SEQ ID NO: 370 - protein, 246 aa, Arabidopsis thaliana
  misc_feature (1)..(246): Ceres CLONE ID no.  112194
  misc_feature (1)..(47): Pfam Name: zf-B_box Pfam Description: B-box zinc finger
  misc_feature (1)..(246): GEMINI ID 539E6
  misc_feature (98)..(98): Xaa is any aa, unknown, or other
MKIQCNVCEAAEATVLCCADEAALCWACDEKIHAANKLAGKHQRVPLSASASSIPKCDICQEASGFFFCLQDRALLCRKCDVAIHTVNPHVSAHQRFXLTGIKVGLESIDTGPSTKSSPTNDDKTMETKPFVQSIPEPQKMAFDHHHHQQQQEQQEGVIPGTKVNDQTSTKLPLVSSGSTTGSIPQWQIEEIFGLTDFDQSYEYMENNGSSKADTSRRGDSDSSSMMRSAEEDGEDNNNCLGGETS

SEQ ID NO: 371 - DNA, 461 bp, Arabidopsis thaliana
  misc_feature (1)..(461): Ceres CLONE ID no.  113443
  misc_feature (1)..(461): GEMINI ID 110E9
  misc_feature (1)..(461): GEMINI ID 555E8
atcacttacttaacatactaagagagttattagaacttgcaaaaaatggcttccaaggctttgattctgttaggtctcttctcagttcttctcgtcgtctccgaagtgtctgccgcaaggcaatcgggcatggtgaagccagagagtgaggaaactgtgcaacctgaaggttatggcggtggccacggaggacatggtggtcacggagggggaggaggccacggacatggaggacacaacggaggtggaggaggacaccacggaggaggaggccacgggctaaacgaacctgttcagactaagccgggtgtttaaaactatataatatcttcactaccatgcatgattgcatatatatatatacgcttatgtattatctatatgcctataaataaaccatggtgagtttgtaacgcagtgccttcagaaatgttcggaataaatttccataatattagtat

SEQ ID NO: 372 - protein, 36 aa, Arabidopsis thaliana
  misc_feature (1)..(36): Ceres CLONE ID no.  113443
  misc_feature (1)..(36): GEMINI ID 110E9
  misc_feature (1)..(36): GEMINI ID 555E8
MAVATEDMVVTEGEEATDMEDTTEVEEDTTEEEATG

SEQ ID NO: 373 - DNA, 1535 bp, Arabidopsis thaliana
  misc_feature (1)..(1535): Ceres CLONE ID no.  113639
  misc_feature (1)..(1535): GEMINI ID 553E12
accaattcacactctcccaaatctctcttctttaaatacaacaaaaaaaaaaatcacagagacatagagagaagaagaaacagagactccaaaaaaatgatgatggagactagagatccagctattaagcttttcggtatgaaaatcccttttccgtcggtttttgaatcggcagttacggtggaggatgacgaagaagatgactggagcggcggagatgacaaatcaccagagaaggtaactccagagttatcagataagaacaacaacaactgtaacgrcaacagttttaacaattcgaaacccgaaaccttggacaaagaggaagcgacatcaactgatcagatagagagtagtgagacgcctgaggataatcagcagacgacacctgatggtaaaaccctgaagaaaccgactaagattctgccgtgtccgagatgtaaaagcatggagaccaagttctgttattacaacaactacaacataaaccagcctcgtcatttctgcaaggcttgtcagagatattggactgctggagggactatgaggaatgttcctgtgggggcaggacgtcgtaagaacaaaagctcatcttctcattaccgtcacatcactatttccgaggctcttgaggctgcgaggcttgatccgggtttgcaggcaaacacaagggtcttgagttttggtctcgaagctcatcagcagcatgttgctcctatggcacctgtgatgaagctacaaggagatcaaaaggtctcaaacggagctaggaacgggtttcatgggttagcggatcaacggcttgtagctcgggtagagaatggagatgactgctcaagcggatcctctgtgaccacctctaacaatcactcagtggatgaatcaagagcacaaagcggcagaattgttgaaccacaaatgaacaacaataacaacatgaatggttatgcttgcatcccaggtgttccatggccttacacgtggaatccagcgatgcccccaccaggtttttacccgcctccagggtatccaatgccgttttacccttactggaccatcccaatgatatcaccgtcaccgcatcaatcctcatcgcctatcagccaaaaggattcaaatacaaactctcccactctcggaaaacgctcgagagatgaagaatcatcgaaaagggacagtgagacagagcgaaaacagaggaccgggtgcattctggtcccgaaaacgttgagaatagatgatcctaacgaagcagcaaagagctcgatatggacaacattgggaatcaagaacgaggcgatgtgcaaagccggtggtatgttcaaagggtttgatcataagacaaagatgtataacaacgacaaagccgagaactcccctgttctttctgctaaccctgctgctctatcaagatcacacaatttccatgaacagatttagagttacatatgtatatgtatatatgtatgattgattgtatgtatagatgatattggagaatgatgagtttttgagaatcaaactcttttcttctt

SEQ ID NO: 374 - protein, 447 aa, Arabidopsis thaliana
  misc_feature (1)..(447): Ceres CLONE ID no.  113639
  misc_feature (105)..(167): Pfam Name: zf-Dof Pfam Description: Dof domain, zinc finger
  misc_feature (1)..(447): GEMINI ID 553E12
  misc_feature (62)..(62): Xaa is any aa, unknown, or other
MMMETRDPAIKLFGMKIPFPSVFESAVTVEDDEEDDWSGGDDKSPEKVTPELSDKNNNNCNXNSFNNSKPETLDKEEATSTDQIESSETPEDNQQTTPDGKTLKKPTKILPCPRCKSMETKFCYYNNYNINQPRHFCKACQRYWTAGGTMRNVPVGAGRRKNKSSSSHYRHITISEALEAARLDPGLQANTRVLSFGLEAHQQHVAPMAPVMKLQGDQKVSNGARNGFHGLADQRLVARVENGDDCSSGSSVTTSNNHSVDESRAQSGRIVEPQMNNNNNMNGYACIPGVPWPYTWNPAMPPPGFYPPPGYPMPFYPYWTIPMISPSPHQSSSPISQKDSNTNSPTLGKRSRDEESSKRDSETERKQRTGCILVPKTLRIDDPNEAAKSSIWTTLGIKNEAMCKAGGMFKGFDHKTKMYNNDKAENSPVLSANPAALSRSHNFHEQI

SEQ ID NO: 375 - protein, 436 aa, Glycine max
  misc_feature (1)..(436): Ceres CLONE ID no. 562894
  misc_feature (1)..(436): Functional Homolog of  Ceres CLONE ID no.  113639
  misc_feature (80)..(142): Pfam Name: zf-Dof Pfam Description: Dof domain, zinc finger
MEEHEDEGDKDTRVENVTKEELEADPPLDAEETKISGTSPEAIVNPKTPSIEEETAKSKGGKSEKEQGDAANSQEKTLKKPDKVLPCPRCKSMDTKFCYYNNYNVNQPRYFCKACQRYWTAGGTMRNVPVGAGRRKNKNSTSHYRHITISEALQAARIDAQNGTHLPTLKGNGRVLSFGLDAHAPICDSMASLMNLGEKKALNGTRNGFHHGFEDQRLPVPCKSGENGDDSSTTSSITISSPKGENNKSTFQQQPLPQNHGFLPQVPCIPGVPWPYTWNSPVPPPALFPSGFPLPFYPATFWNCGMPGNWNVPWFSSSSPASNLKSPSSSPNSPTLGKHSRDSDMIKQDSLHKEEASTPRNGSVLVPKTLRIDDPSEAAKSSIWATLGIKNESVSGGAMFKAFQSKKGEKNHVEASPMLMANPAALSRSLNFHENS

SEQ ID NO: 376 - DNA, 1362 bp, Populus balsamifera subsp. trichocarpa
  misc_feature (1)..(1362): Ceres ANNOT ID no. 1503065
atgttggagccaaaagacccggctattaagctgtttgggaagactattcaagactcggtggaaaaaagcctgactgagaaacaggaagatggagtttcacccgtggctactgaagagccttcaaatccagatgcaacctcagggacaagtgaaaaccctaaaacaccttccattgagaaggagagtgaaggattgcaaacttcaaggacagaagaagaagatagtgatacaagtaattcgccagaaaagaccctgaaaaaacctgataagatccttccatgcccccgctgtaatagcatggacaccaagttctgttactacaacaattacaacgtgaaccaaccccgacacttctgcaagaattgtcagagatattggacagctgggggaaccatgaggaatgtgcctgtgggtgctggtcgtcgcaaaaacaagaactcagcttctcattatcgtcacataaccattcctgaagctcttcagaatgttcgagctgatgttccaaatggagtctaccatccttcaatgaaaactaatggaacagtgctaacctttggctctgacacacctcttcatgaatcaatggcttctgtattgaaccttgcagataaaacaacgcggaattgcacaagaaacgggtctcataaacctgatgcagtgaggattccagtttcttatggaagtggagaaaacggtgatgaccattctaatggatcttcagtcacagtgtcaaattcaattgatgaggcaggcaaaagcatgtcgaaagaatcagctatgcagaattgtcagggctttccccctgagataccatgttttcctggagttccctggccttacccttggaattcagctcaatggagctccccattacccccacctgccttttgccctcccggttttcctatgccattctatcctgcagcagcatactggggttgcaccgtaccaggtgcttggaatatcccttggcttcctcagccatcttctcccaagcaaacctcctcgagctctggcccaaactctccaaccctagggaaacattcaagggatgaaaacatgctcaaatctagcaactctgaagaaggggagtcggcaaaagaaaataacactgaaagatgcctttggatcccaaaaacgctcaggattgttgacccaggtgaagctgcaaaaagctctatatggacgactctggggattaagaatgataagcctgacttgattggtgggcgaggactgtttaaggcgtttgattcaaaggtcgaaaagaatcatgaagccgaaacctctccagtcttacaagctaatcctgcagcattgtctagatcactcaaatttcaggagagctcgtattttgggtag

SEQ ID NO: 377 - protein, 453 aa, Populus balsamifera subsp. trichocarpa
  misc_feature (1)..(453): Ceres ANNOT ID no. 1503065
  misc_feature (1)..(453): Functional Homolog of  Ceres CLONE ID no.  113639
  misc_feature (87)..(149): Pfam Name: zf-Dof Pfam Description: Dof domain, zinc finger
MLEPKDPAIKLFGKTIQDSVEKSLTEKQEDGVSPVATEEPSNPDATSGTSENPKTPSIEKESEGLQTSRTEEEDSDTSNSPEKTLKKPDKILPCPRCNSMDTKFCYYNNYNVNQPRHFCKNCQRYWTAGGTMRNVPVGAGRRKNKNSASHYRHITIPEALQNVRADVPNGVYHPSMKTNGTVLTFGSDTPLHESMASVLNLADKTTRNCTRNGSHKPDAVRIPVSYGSGENGDDHSNGSSVTVSNSIDEAGKSMSKESAMQNCQGFPPEIPCFPGVPWPYPWNSAQWSSPLPPPAFCPPGFPMPFYPAAAYWGCTVPGAWNIPWLPQPSSPKQTSSSSGPNSPTLGKHSRDENMLKSSNSEEGESAKENNTERCLWIPKTLRIVDPGEAAKSSIWTTLGIKNDKPDLIGGRGLFKAFDSKVEKNHEAETSPVLQANPAALSRSLKFQESSYFG

SEQ ID NO: 378 - DNA, 1385 bp, Arabidopsis thaliana
  misc_feature (1)..(1385): Ceres CLONE ID no.  115358
  misc_feature (1)..(1385): GEMINI ID 555F8
aaacctttctcttctctgctaacgagaaaacaaaagctatcgtctttgctactactactactgctattattacattgaatcctttgtgttcttcttcttcagctgctactttgttcgagtgctttcttacatgccgtcggagattgttgacaggaaaaggaagtctcgtggaacacgagatgtagctgagattctaaggcaatggagagagtacaatgagcagattgaggcagaatcttgtatcgatggtggtggtccaaaatcaatccgaaagcctcctccaaaaggttcgaggaagggttgtatgaaaggtaaaggtggacctgaaaacgggatttgtgactatagagaagttagacagaggagatggggtaaatgggttgctgagatccgtgagccagacggaggtgctaggttgtggctcggtactttctccagttcatatgaagctgcattggcttatgacgaggcggccaaagctatatatggtcagtctgccagactcaatcttcccgagatcacaaatcgctcttcttcgactgctgccactgccactgtgtcaggctcggttactgcattttctgatgaatctgaagtttgtgcacgtgaggatacaaatgcaagttcaggttttggtcaggtgaaactagaggattgtagcgatgaatatgttctcttagatagttctcagtgtattaaagaggagctgaaaggaaaagaggaagtgagggaagaacataacttggctgttggttttggaattggacaggactcgaaaagggagactttggatgcttggttgatgggaaatggcaatgaacaagaaccattggagtttggtgtggatgaaacgtttgatattaatgagctattgggtatattaaacgacaacaatgtgtctggtcaagagacaatgcagtatcaagtggatagacacccaaatttcagttaccaaacgcagtttccaaattctaacttgctcgggagcctcaaccctatggagattgctcaaccaggagttgattatggatgtccttatgtgcagcccagtgatatggagaactatggtattgatttagaccatcgcaggttcaatgatcttgacatacaggacttggattttggaggagacaaagatgttcatggatctacataagatttcaaatttcgtttgactgtcctaagtttgtgattctgctccgagacggtgtagctgttactagctagaagctgcccttctttgaagctactgatactttctgatattaatggttgtgagacgtagtacatgtagttaggtaatgtaggacaagttcaaatatgattccttctttctttttcttgtgaatacatatgacatatgaagaagttcaaacgttgggtcc

SEQ ID NO: 379 - protein, 341 aa, Arabidopsis thaliana
  misc_feature (1)..(341): Ceres CLONE ID no.  115358
  misc_feature (1)..(341): GEMINI ID 555F8
  misc_feature (70)..(121): Pfam Name: AP2 Pfam Description: AP2 domain
MPSEIVDRKRKSRGTRDVAEILRQWREYNEQIEAESCIDGGGPKSIRKPPPKGSRKGCMKGKGGPENGICDYREVRQRRWGKWVAEIREPDGGARLWLGTFSSSYEAALAYDEAAKAIYGQSARLNLPEITNRSSSTAATATVSGSVTAFSDESEVCAREDTNASSGFGQVKLEDCSDEYVLLDSSQCIKEELKGKEEVREEHNLAVGFGIGQDSKRETLDAWLMGNGNEQEPLEFGVDETFDINELLGILNDNNVSGQETMQYQVDRHPNFSYQTQFPNSNLLGSLNPMEIAQPGVDYGCPYVQPSDMENYGIDLDHRRFNDLDIQDLDFGGDKDVHGST

SEQ ID NO: 380 - DNA, 1705 bp, Arabidopsis thaliana
  misc_feature (1)..(1705): Ceres CLONE ID no.  115366
  misc_feature (1)..(1705): GEMINI ID 552H11
atcttctacggacagcttctttctctttcctctctgatttttcttttctctttctacctttttcttttttttattttctttcttttttttgttagtttttttttttctttcttcatctcgttaacgatatagtacctgaaccctagcgaaaatcaaaaattgtctaggagaaacaaacagagatatctttctttctttttatcagtggggaaaaaaaatgcagaatccgagactgaagcaacatcagcagcaacaacaacaacaagctatgatgcagcaacaagctctgatgcagcaacactctctttaccatcctggtgttttggctcctcctcagttagagcctgttccaagtggaaaccttcctcctggttttgatcccagtacttgccgtagcgtgtatgttggaaacatccatacacaggtcacagagcctttgcttcaagagatttttacaagcactggccctgttgaaagcagtaaactcatcagaaaggataagtcatcatatggatttgttcactactttgatcgaagatccgctgctctggctatactgtctctgaacggaaggcatctgtttggacagcctatcaaagtcaattgggcgtatgccactggtcagagggaagatacatcaagtcatttcaacatttttgttggagatctcagtccagaggtcactgatgcaacattatatcaaagcttttctgtcttttccagttgttcggatgcgagagttatgtgggaccaaaaaactgggcgctcgagaggctttgggtttgtttccttccgcaatcaacaggatgctcaaactgccattaatgagatgaatggtaagtggttaagtagcagacaaatcagatgcaactgggccacgaagggcgctacttctggtgatgataagctcagttctgatggaaaaagtgttgtggaacttacaactggctcatcagaggatggtaaagagacattaaatgaggaaacacctgaaaataattctcagtttaccactgtttatgtgggaaaccttgctccagaggtaactcagcttgatctacaccgttacttccatgctcttggcgctggagttattgaggaggtccgtgtccaacgagacaaaggctttggtttcgtgagatataacactcatcccgaagctgctcttgctattcagatgggtaacactcagccttacctctttaacagacagataaagtgctcatggggaaacaagccaactccaccaggtacagcctcaaacccacttcccccacctgccccagctccagttcctggtctatctgcagctgatctcctaaactatgagaggcaattggcacttagcaagatggcaagtgtgaatgcgttaatgcatccacagggtcaacaccctctaaggcaggctcatggaataaatgccgctggagcaactgcagccatgtatgatggtggctttcagaatgtagccgccgcacagcaactcatgtactatcagtaataaacctcagatcgtggcgccgatctcaagtttcaatctctttgctttttctctttttttttgtttgtctagaacttgtttgtgtgtgtctgtttgtctctcacttaagttatctatataaagttttatctgcagttgtatgattagttatgtattcccatggattgtaagacaagcgaattacattcaataaaagggatttgg

SEQ ID NO: 381 - protein, 427 aa, Arabidopsis thaliana
  misc_feature (1)..(427): Ceres CLONE ID no.  115366
  misc_feature (1)..(427): GEMINI ID 552H11
  misc_feature (146)..(217): Pfam Name: RRM_1 Pfam Description: RNA recognition motif. (a.k.a. RRM, RBD, or RNP domain)
MQNPRLKQHQQQQQQQAMMQQQALMQQHSLYHPGVLAPPQLEPVPSGNLPPGFDPSTCRSVYVGNIHTQVTEPLLQEIFTSTGPVESSKLIRKDKSSYGFVHYFDRRSAALAILSLNGRHLFGQPIKVNWAYATGQREDTSSHFNIFVGDLSPEVTDATLYQSFSVFSSCSDARVMWDQKTGRSRGFGFVSFRNQQDAQTAINEMNGKWLSSRQIRCNWATKGATSGDDKLSSDGKSVVELTTGSSEDGKETLNEETPENNSQFTTVYVGNLAPEVTQLDLHRYFHALGAGVIEEVRVQRDKGFGFVRYNTHPEAALAIQMGNTQPYLFNRQIKCSWGNKPTPPGTASNPLPPPAPAPVPGLSAADLLNYERQLALSKMASVNALMHPQGQHPLRQAHGINAAGATAAMYDGGFQNVAAAQQLMYYQ

SEQ ID NO: 382 - protein, 425 aa, Zea mays
  misc_feature (1)..(425): Ceres CLONE ID no. 1376400
  misc_feature (1)..(425): Functional Homolog of  Ceres CLONE ID no.  115366
  misc_feature (152)..(223): Pfam Name: RRM_1 Pfam Description: RNA recognition motif. (a.k.a. RRM, RBD, or RNP domain)
MQNPRLKQQQQQQQQQQQAMMQQALMQQHHSLYHPSLMAPPPPPPQMEPLPSGNLPPGFDPTTCRSVYAGNIHTQVTEVLLQEIFASTGPVESCKLIRKDKSSYGFVHYFDRRSAGLAIMSLNGRHLFGQPIKVNWAYATGQREDTSSHFNIFVGDLSPDVTDAALFESFSAFNTCSDARVMWDQKTGRSRGFGFVSFRNQQDAQNAINEMNGKWLSSRQIRCNWATKGATFGDDKHSSDGKSVVELTNGSEDGREISITNEEAPENNPQYTTVYVGNLAPEVTQLDLHRLFHTLGAGVIEEVRVQRDKGFGFVRYNTHDEAALAIQMGNSQPFLFNRQIKCSWGNKPTPIGTASNPLPPPAPVAVPGLSPMDLLAYERQLALAKMHPQAQHSLRHANAAGASAAMYDGGFQNVAAAHQQLMYYQ

SEQ ID NO: 383 - protein, 426 aa, Arabidopsis thaliana
  misc_feature (1)..(426): Public GI no. 13194792
  misc_feature (1)..(426): Functional Homolog of  Ceres CLONE ID no.  115366
  misc_feature (150)..(221): Pfam Name: RRM_1 Pfam Description: RNA recognition motif. (a.k.a. RRM, RBD, or RNP domain)
MQNQRLIKQQQQQQQQQHQQAMIQQAMMQQHPSLYHPGVMAPPQMEPLPSGNLPPGFDPTTCRSVYAGNIHTQVTEILLQEIFASTGPIESCKLIRKDKSSYGFVHYFDRRCASMAIMTLNGRHIFGQPMKVNWAYATGQREDTSSHFNIFVGDLSPEVTDAALFDSFSAFNSCSDARVMWDQKTGRSRGFGFVSFRNQQDAQTAINEMNGKWVSSRQIRCNWATKGATFGEDKHSSDGKSVVELTNGSSEDGRELSNEDAPENNPQFTTVYVGNLSPEVTQLDLHRLFYTLGAGVIEEVRVQRDKGFGFVRYNTHDEAALAIQMGNAQPFLFSRQIRCSWGNKPTPSGTASNPLPPPAPASVPSLSAMDLLAYERQLALAKMHPQAQHSLRQAGLGVNVAGGTAAMYDGGYQNVAAAHQQLMYYQ

SEQ ID NO: 384 - protein, 430 aa, Arabidopsis thaliana
  misc_feature (1)..(430): Public GI no. 30695647
  misc_feature (1)..(430): Functional Homolog of  Ceres CLONE ID no.  115366
  misc_feature (150)..(225): Pfam Name: RRM_1 Pfam Description: RNA recognition motif. (a.k.a. RRM, RBD, or RNP domain)
MQNQRLIKQQQQQQQQQHQQAMIQQAMMQQHPSLYHPGVMAPPQMEPLPSGNLPPGFDPTTCRSVYAGNIHTQVTEILLQEIFASTGPIESCKLIRKDKSSYGFVHYFDRRCASMAIMTLNGRHIFGQPMKVNWAYATGQREDTSSHFNIFVGDLSPEVTDAALFDSFSAFNSCSSYYRDARVMWDQKTGRSRGFGFVSFRNQQDAQTAINEMNGKWVSSRQIRCNWATKGATFGEDKHSSDGKSVVELTNGSSEDGRELSNEDAPENNPQFTTVYVGNLSPEVTQLDLHRLFYTLGAGVIEEVRVQRDKGFGFVRYNTHDEAALAIQMGNAQPFLFSRQIRCSWGNKPTPSGTASNPLPPPAPASVPSLSAMDLLAYERQLALAKMHPQAQHSLRQAGLGVNVAGGTAAMYDGGYQNVAAAHQQLMYYQ

SEQ ID NO: 385 - protein, 426 aa, Arabidopsis thaliana
  misc_feature (1)..(426): Ceres CLONE ID no. 148506
  misc_feature (1)..(426): Functional Homolog of  Ceres CLONE ID no.  115366
  misc_feature (150)..(221): Pfam Name: RRM_1 Pfam Description: RNA recognition motif. (a.k.a. RRM, RBD, or RNP domain)
MQNQRLIKQQQQQQQQQHQQAMIQQAMMQQHPSLYHPGVMAPPQMEPLPSGNLPPGFDPTTCRSVYAGNIHTQVTEILLQEIFASTGPIESCKLIRKDKSSYGFVHYFDRRCASMAIMTLNGRHIFGQPMKVNWAYATGQREDTSSHFNIFVGDLSPEVTDAALFDSFSAFNSCSDARVMWDQKTGRSRGFGFVSFRNQQDAQTAINEMNGKWVSSRQIRCNWATKGATFGEDKHSSDEKSVVELTNGSSEDGRELSNEDAPENNPQFTTVYVGNLSPEITQLDLHRLFYTLGAGVIEEVRVQRDKGFGFVRYNTHDEAALAIQMGNAQPFLFSRQIRCSWGNKPTPSGTASNPLPPPAPASVPSLSAMDLLAYERQLALAKMHPQAQHSLRQAGLGVNVAGGTAAMYDGGYQNVAAAHQQLMYYQ

SEQ ID NO: 386 - DNA, 1694 bp, Gossypium hirsutum
  misc_feature (1)..(1694): Ceres CLONE ID no.1834350
aggcctttttttttcttcctctttcattttttttccttttctcgaggtccccttacacttcgaaccctagcagaggagaagaagagaataaaaagggttcttttctcacataccaaacatacagatttgtttttccttgaaaatcgccgaggaaaaatgcagcacctgaggctgaagcaacagcaacaagccctgatgcaacaagctctcctccaacaacagtctctctatcaccctggcatcttagctcctccacagatagagccaatcccaagtggaaatctgcctcctggttttgatccaagtacttgccgcagtgtgtatgtgggaaacatccattcacaagtgactgaaccactacttcaagaggtttttgcaagtacaggtcctgttgaaggttgcaagcttatcagaaaggaaaagtcatcatatggattcgtccactactttgatcgtcgatcagctgctctcgctatattgtctctaaatggaaggcatttatttggacagcctgtcaaggtcaattgggcatatgctagtggtcagagagaggatacatcaggtcattttaacatttttgtaggggatctcagtcctgaggttactgatgcaatgctgtatgcatgcttttctgtctatcacagttgttcggatgcgagggttatgtgggatcagaaaactgggcgttcaagaggatttgggtttgtttcattccgcagtcagcaggatgcacaaagcgcaattaatgacttaagtggaaagtggcttggcagtcgacagatccgttgtaactgggcaacaaaaggtgctggtagcaacgatgacaagcaaagctctgatgccaaaagtgtcgttgaacttaccaatggttcatcagaggatggtaaagagaccaccaataatgaggctcccgagaataatcctcaatatactactgtttatgtgggcaatcttgctccagaggtcacccaacttgaactccactgtcacttccacgcacttggtgctggggtgattgaggaggttcgggtccagcgtgacaaaagctttggctttgtgagatacagtactcatactggggcagctttggctattcagatggggaacactcagtcatttttatgtggcaagcaaattaagtgctcttggggcagcaaacctacaccaccggggacaagttcaaacccacttcccccacctgcagctgcacctttaccgggcctttcagcgattgacctattagcttatgaaaggcaacttgccatgagcaaaatgggtggcgttcatgctctaatgcaccctcagggacagcatcctctgaagcaagcagcaattggagtgggtgctgctggagcaagccaggctatatatgatggtgggttccagaatgttgctgctgcccagcagctattgtactatcagtaataaagatagtttgtgtgataatgcaggttttatttgagtccttaagcataagatttaggaggcttttttttagcagtgaagctgcatcctgcttttatctatagcatatgtttgcctattgtatccatctttacttatgtttattgagttttaaacacgactaggaaagctttttaatgtattctctcctatatgtttgatacggtaccgactgtttcattggatatatataaagcatatttatagcagaaaaaaaaaaaaaaaaaaaa

SEQ ID NO: 387 - protein, 422 aa, Gossypium hirsutum
  misc_feature (1)..(422): Ceres CLONE ID no. 1834350
  misc_feature (1)..(422): Functional Homolog of  Ceres CLONE ID no.  115366
  misc_feature (140)..(211): Pfam Name: RRM_1 Pfam Description: RNA recognition motif. (a.k.a. RRM, RBD, or RNP domain)
MQHLRLKQQQQALMQQALLQQQSLYHPGILAPPQIEPIPSGNLPPGFDPSTCRSVYVGNIHSQVTEPLLQEVFASTGPVEGCKLIRKEKSSYGFVHYFDRRSAALAILSLNGRHLFGQPVKVNWAYASGQREDTSGHFNIFVGDLSPEVTDAMLYACFSVYHSCSDARVMWDQKTGRSRGFGFVSFRSQQDAQSAINDLSGKWLGSRQIRCNWATKGAGSNDDKQSSDAKSVVELTNGSSEDGKETTNNEAPENNPQYTTVYVGNLAPEVTQLELHCHFHALGAGVIEEVRVQRDKSFGFVRYSTHTGAALAIQMGNTQSFLCGKQIKCSWGSKPTPPGTSSNPLPPPAAAPLPGLSAIDLLAYERQLAMSKMGGVHALMHPQGQHPLKQAAIGVGAAGASQAIYDGGFQNVAAAQQLLYYQ

SEQ ID NO: 388 - protein, 419 aa, Arabidopsis thaliana
  misc_feature (1)..(419): Public GI no. 21553830
  misc_feature (1)..(419): Functional Homolog of  Ceres CLONE ID no.  115366
  misc_feature (141)..(212): Pfam Name: RRM_1 Pfam Description: RNA recognition motif. (a.k.a. RRM, RBD, or RNP domain)
MQRLKQQQQQQQVMMQQALMQQQSLYHPGLLAPPQIEPIPSGNLPPGFDPSTCRSVYVGNIHIQVTEPLLQEVFAGTGPVESCKLIRKEKSSYGFVHYFDRRSAGLAILSLNGRHLFGQPIKVNWAYASGQREDTSSHFNIFVGDLSPEVTDAMLFTCFSVYPTCSDARVMWDQKTGRSRGFGFVSFRNQQDAQTAIDEITGKWLGSRQIRCNWATKGATSGEDKQSSDSKSVVELTSGVSEDGKDTTNGEAPENNAQYTTVYVGNLAPEVSQVDLHRHFHSLGAGVIEEVRVQRDKGFGFVRYSTHVEAALAIQMGNTHSYLSGRQMKCSWGSKPTPAGTASNPLPPPAPAPIPGFSASDLLAYERQLAMSKMAGMNPMMHHPQGQHAFKQAAMGATGSNQAIYDGGYQNAQQLMYYQ

SEQ ID NO: 389 - protein, 422 aa, Glycine max
  misc_feature (1)..(422): Ceres CLONE ID no. 518274
  misc_feature (1)..(422): Functional Homolog of  Ceres CLONE ID no.  115366
  misc_feature (144)..(215): Pfam Name: RRM_1 Pfam Description: RNA recognition motif. (a.k.a. RRM, RBD, or RNP domain)
MQNHRLKQQQQQQQQALMQQALLQQQSLYHPGLLAPPQIEPYPSGNLPPGFDPSTCRSVYVGNIHTQVTEPLLQEVFSGTGPVEGCKLIRKDKSSYGFIHYFDRRSAALAILSLNGRHLFGQPIKVNWAYASGQREDTSGHYNIFVGDLSPEVTDATLFACFSVYPSCSDARVMWDQKTGRSRGFGFVSFRNQQDAQSSINDLTGKWLGSRQIRCNWATKGAGGNEEKQNSDAKSVVELTNGSSEDGKETSNSDAPENNPQYTTVYVGNLAPEVTQLDLHRHFHALGAGVMEEVRVQRDKGFGFVRYSTHAEAALAIQMGNAQSLLCGKPIKCSWGSKPTPPGTASNPLPPPAAASLPGLSATDLLAYERQLAISKMGGVHALMHPQGQHHLKQAAAIGASQAIYDGGFQNVAAAQQMMYYQ

SEQ ID NO: 390 - DNA, 1656 bp, Gossypium hirsutum
  misc_feature (1)..(1656): Ceres CLONE ID no.1836485
aggggcctcttctctttttccagttttcttcttcttttttcttttttttttttttccttttttttttcttctctcactttctcgaggcctccatttttgaaccctagctggagaaaaaaaacgtaattttcttggaaaccaaacacttcgattaatttatctccagtcaatcgccaagaaaaaaaatgcagcaccagaggctgaagcaacagcaacaagccttgatgcaacaagctcttcttcaacagcagtctctctatcatcccggcatattagctcctcctcagatagagccaattcccagtggaaatctgcctgctggttttgatccaagcacttgccgcagtgtgtatgtgggaaatatccatacacaagtgactgaaccactacttcaagaggtttttgcaagtactggccctgttgaaggttgcaagcttgtcagaaaggaaaagtcatcgtatggattcgtccactacttcgatcgcagatcagctgctcttgctatattgtctctaaatggaaggcatttgtttggacagcctatcaaggtcaattgggcatatgctagtggtcagagagaggatacatcaggtcactttaacatttttgttggggatctcagtcctgaggttactgatgcaatgctgtttgcatgcttttcagtctatcccagttgttcggatgcaagggttatgtgggatcagaaaactgggcgttcaagaggatttgggtttgtttcattccgtaaccagcaggaagcacaaagtgcaattaatgacttaagtggaaagtggctcggcagtcggcagattcgttgtaattgggcaacaaagggtgctagtagcaatgatgacaagcagagctctgatgccaaaagtgtggtggaacttaccaatggctcatctgaggatggtaaagagacaaccaatactgaggctcctgagaataatcctcaatatactactgtttatgtgggcaatcttgcttcagaggtcacccaacttgaactccatcgtcatttccatgctcttggtgctggggtgatagaggaggttcgggtccagcgtgataaggcctttggctttgtgagatacagtactcatgctgaggcagctttggctattcagatggggaatgctcagtcatatctatgcggcaagcaaataaagtgttcttggggcagcaagcctacaccaccagggacaagctccaatccacttcccccacccgcagcaccattacctggtctttcagccactgaccttttagcttacgaacgacaacttgccatgagcaagatgggtggagttcatgctctaatgcacccacagggacagcatcctctgaagcaggcagcaatgggggtgggtgctgctggagcaagccaggctatatatgatggtggatacccgaatgttgctgctgcccagcagctaatgtactatcagtaacatataaagaaataagtggttgtgtggtaatatccttatttcctgtatttgcaggtttttaatttgagttctaaataggagaaggctttttaaatgtattttcccttggatagcagtgaggctgcatgccatcctgctttttatctttatatagcatatgtttgtcgattgtatcaatcgtacgtaaaaaaaaaaaaaaaaaaaa

SEQ ID NO: 391 - protein, 421 aa, Gossypium hirsutum
  misc_feature (1)..(421): Ceres CLONE ID no. 1836485
  misc_feature (1)..(421): Functional Homolog of  Ceres CLONE ID no.  115366
  misc_feature (140)..(211): Pfam Name: RRM_1 Pfam Description: RNA recognition motif. (a.k.a. RRM, RBD, or RNP domain)
MQHQRLKQQQQALMQQALLQQQSLYHPGILAPPQIEPIPSGNLPAGFDPSTCRSVYVGNIHTQVTEPLLQEVFASTGPVEGCKLVRKEKSSYGFVHYFDRRSAALAILSLNGRHLFGQPIKVNWAYASGQREDTSGHFNIFVGDLSPEVTDAMLFACFSVYPSCSDARVMWDQKTGRSRGFGFVSFRNQQEAQSAINDLSGKWLGSRQIRCNWATKGASSNDDKQSSDAKSVVELTNGSSEDGKETTNTEAPENNPQYTTVYVGNLASEVTQLELHRHFHALGAGVIEEVRVQRDKAFGFVRYSTHAEAALAIQMGNAQSYLCGKQIKCSWGSKPTPPGTSSNPLPPPAAPLPGLSATDLLAYERQLAMSKMGGVHALMHPQGQHPLKQAAMGVGAAGASQAIYDGGYPNVAAAQQLMYYQ

SEQ ID NO: 392 - protein, 417 aa, Solanum tuberosum
  misc_feature (1)..(417): Public GI no. 82400162
  misc_feature (1)..(417): Functional Homolog of  Ceres CLONE ID no.  115366
  misc_feature (141)..(212): Pfam Name: RRM_1 Pfam Description: RNA recognition motif. (a.k.a. RRM, RBD, or RNP domain)
MQNQRLKQQQQQALMQQALLQQQSLYHPGLLAPPQIEPIPSGNLPPGFDPSTCRSVFVGNIHPQVTEPLLQEVFSSTGLVEGCKLIRKEKSSYGFIHYYDRRSAALAIVSLNGRHLFGQPIKVNWAFASGQREDTSSHFNIFVGDLSPEVTDAMLFACFSVYPGCSDARVMWDQKTGRSRGFGFVSFRNQQDAQSAINDLTGKWLGSRQIRCNWATKGANSNDDKQSSDAKSVVELTNGSSEDGKEAANSDAPENNPQYTTVYVGNIAPEVTQLDLHRYFHALGAGVIEEIRIQRDKGFGFVRYNTHAEAALAIQMGNTHSVLGGRQIKCSWGNKPTPPGTTSNPLPPPAPTPLGISATDLLAYERQLAMSKMGGVPGLMGQYPLKQASMGMASGASQAIYDGGFQNVAAQQLMYYQ

SEQ ID NO: 393 - DNA, 1293 bp, Populus balsamifera subsp. trichocarpa
  misc_feature (1)..(1293): Ceres ANNOT ID no. 1446310
atgcaacagcagaggcttaaacagcaacaacaggcactgatgcaacaagctcttctccaacagcagtcaatttaccatcctggtctcctcgctcctcctcagattgagccaattccaagtggaaatctgcctcctggttttgatccaagtacttgccgcagtgtgtacgtgggaaacatccacactcaggtaactgaacccctcctccaagaggtttttgcgagtactggtcctgttgaaggatgcaagcttatcagaaaagaaaagtcatcctatggatttattcactactttgatcgccgagcagctgcgcttgctatattatctcttaatggaaggcatctatttggtcagcctatcaaagttaactgggcatatgctagtggtcagagggaagacacatcaggtcacttcaacatttttgttggagatcttagtcctgaggttactgatgcaacattgtatgcctgcttttctgtttatcccagttgttcagatgcaagggttatgtgggatcagaagactgggcgttcaagagggtttgggtttgtttccttccgaaatcaacaggatgcccagagcgcgataaatgacctaacaggaaagtggcttggcagtagacagattcgttgcaactgggcatctaaaggtgctggttccaatgaagacaaacaaagttctgattcaaaaagtgtggtggaactaacaattggcacatcagaggatggcatggaggcaccaaataatgaggctcctgaaaacaatcctcagtataccactgtttatgtgggcaatctttctccagaggcaagaaacttttcttcctatctgcatgtaactcagcctgttctccaccgccatttccatgttcttggtgctggagttattgaggaggtccgagtccagagagacaagggttttgggtttgtgaggttcagtactcatgctgaggcagctgtagctattcagatgggaaatgcccaatcacttctttgtggtaaacaaataaagtgctcatggggtagcaagcccactccgccagggacaagctcaaatccactacccccacctgctgctgcccctttgcctgggatctcagctacagatatcttggcatatgagaggcagctagcattgagcaagatgggtggtgtccatgcctttatgcctcctcatgggcagcttcctctaaaacaagcagctatgggaatgggtgccggagcaagccaggcaatatatgatggtggtttccagaatgttgctgctgcccagcaactcatgtactatcagtaa

SEQ ID NO: 394 - protein, 430 aa, Populus balsamifera subsp. trichocarpa
  misc_feature (1)..(430): Ceres ANNOT ID no. 1446310
  misc_feature (1)..(430): Functional Homolog of  Ceres CLONE ID no.  115366
  misc_feature (140)..(211): Pfam Name: RRM_1 Pfam Description: RNA recognition motif. (a.k.a. RRM, RBD, or RNP domain)
MQQQRLKQQQQALMQQALLQQQSIYHPGLLAPPQIEPIPSGNLPPGFDPSTCRSVYVGNIHTQVTEPLLQEVFASTGPVEGCKLIRKEKSSYGFIHYFDRRAAALAILSLNGRHLFGQPIKVNWAYASGQREDTSGHFNIFVGDLSPEVTDATLYACFSVYPSCSDARVMWDQKTGRSRGFGFVSFRNQQDAQSAINDLTGKWLGSRQIRCNWASKGAGSNEDKQSSDSKSVVELTIGTSEDGMEAPNNEAPENNPQYTTVYVGNLSPEARNFSSYLHVTQPVLHRHFHVLGAGVIEEVRVQRDKGFGFVRFSTHAEAAVAIQMGNAQSLLCGKQIKCSWGSKPTPPGTSSNPLPPPAAAPLPGISATDILAYERQLALSKMGGVHAFMPPHGQLPLKQAAMGMGAGASQAIYDGGFQNVAAAQQLMYYQ

SEQ ID NO: 395 - protein, 406 aa, Nicotiana plumbaginifolia
  misc_feature (1)..(406): Public GI no. 6996560
  misc_feature (1)..(406): Functional Homolog of  Ceres CLONE ID no.  115366
  misc_feature (136)..(207): Pfam Name: RRM_1 Pfam Description: RNA recognition motif. (a.k.a. RRM, RBD, or RNP domain)
MMQQQRLKQQQQQALMQQSLYHPGLLAPPQIEPILSGNLPPGFDSSTCRSVYVGNIHPQVTEPLLQEVFASTGPLEGCKLIRKDKSSYGFVDYFDRRSAALAIVTLNGRHLFGQPIKVNWAYASAQREDTSNHYNIFVGDLSPEVTDATLFACFSVYTSCSDARVMWDQKTGRSRGFGFVSFRNQQEAQSAINDLNGKWLGSRQIRCNWAAKGAGAVGEQNSDAKSVVELTSGTSDDGQEKVVNEDAPENNPQYTTVYVGNLAPEVTSVDLHRHFHALGAGVIEDVRIQRDKGFGFVRYSSHAEAARAIQLGNARLLFGKPVKCSWGSKPTPPGSSSNPLPPPAIGQIPGLSAMDLAAYQRQLALAKMAGAQAFMQPQGQRIGAPGQGIYDGGYGGIASTQPPMYF

SEQ ID NO: 396 - protein, 441 aa, Oryza sativa
  misc_feature (1)..(441): Public GI no. 77551976
  misc_feature (1)..(441): Functional Homolog of  Ceres CLONE ID no.  115366
  misc_feature (166)..(237): Pfam Name: RRM_1 Pfam Description: RNA recognition motif. (a.k.a. RRM, RBD, or RNP domain)
MQHQQRMKQAAAAAQQQQMMQQALLMQQQQAAAVAAAAQQQQAPLFPPHHPHPGLLAAPQIEPIVSGNLPPGFDSSTCRSVYVGNIHLQVTDSLLHEVFQSIGPVEGCKLIRKEKSSFGFVDYYDRRSAAIAIVSLNGRQLFGQPIKVNWAYASTQREDTSGHFNIFVGDLCPEVTDAALFAFFAGFTSCSDARVMWDQKTGRSRGFGFVSFRNQQDAQNAINELNGKWLGNRQVRCNWATKGANAGEEKQNTDSKGMIELTNGSSEGGKDNANEDGPENNPQYTTVYVGNLPHDVNSNDVHRFFHSLGVGSIEEVRVTRDKGFGFVRYSTHEEAALAIQTGNGQLIGGRQIKCSWGSKPTPPGTASAPLPPPAPAPFNPGMSATDLLAYERTLALSKMAANPALMSQHAALKQAAAMGMGAGASQAIYDGGYQSANAVFY

SEQ ID NO: 397 - protein, 403 aa, Oryza sativa
  misc_feature (1)..(403): Public GI no. 108864589
  misc_feature (1)..(403): Functional Homolog of  Ceres CLONE ID no.  115366
  misc_feature (128)..(199): Pfam Name: RRM_1 Pfam Description: RNA recognition motif. (a.k.a. RRM, RBD, or RNP domain)
MQHQQRMKQAAAAAQQQQMMQQIEPIVSGNLPPGFDSSTCRSVYVGNIHLQVTDSLLHEVFQSIGPVEGCKLIRKEKSSFGFVDYYDRRSAAIAIVSLNGRQLFGQPIKVNWAYASTQREDTSGHFNIFVGDLCPEVTDAALFAFFAGFTSCSDARVMWDQKTGRSRGFGFVSFRNQQDAQNAINELNGKWLGNRQVRCNWATKGANAGEEKQNTDSKGMIELTNGSSEGGKDNANEDGPENNPQYTTVYVGNLPHDVNSNDVHRFFHSLGVGSIEEVRVTRDKGFGFVRYSTHEEAALAIQTGNGQLIGGRQIKCSWGSKPTPPGTASAPLPPPAPAPFNPGMSATDLLAYERTLALSKMAANPALMSQHAALKQAAAMGMGAGASQAIYDGGYQSANAVFY

SEQ ID NO: 398 - protein, 402 aa, Medicago truncatula
  misc_feature (1)..(402): Public GI no. 92891800
  misc_feature (1)..(402): Functional Homolog of  Ceres CLONE ID no.  115366
  misc_feature (133)..(197): Pfam Name: RRM_1 Pfam Description: RNA recognition motif. (a.k.a. RRM, RBD, or RNP domain)
MLPQKFRQNPMIEQHSLYQHPALITPQIEPILSGNLPPGFDSSTCRSVYVGNIHPQVSEPLLQELFSSAGALEGCKLIRKEKSSYGFVDYFDRSSAAIAIVTLNGRNIFGQSIKVNWAYTRGQREDTSGHFHIFVGDLSPEVTDATLYACFSAYSSCSDARVMWDQKTGRSRGFGFEAQSAINDLTGKWLGSRQIRCNWATKGANMNGENQSSESKSVVELTSGTSEEAQEMTSDDSPEKNPQYTTVYVGNLAPEARIHTVTSVDLHHHFHALGVGTIEDVRVQRDKGFGFVRYSTHGEAALAIQMGNTRFLFGKPIKCSWGSKPTPPGTASTPLPPPASTHVPVPGFSPAGLALYERQLALSKMNEAHAVKRAAMGMGALGAGYGAGFPNVATTQHLMYYQ

SEQ ID NO: 399 - DNA, 1812 bp, Panicum virgatum
  misc_feature (1)..(1812): Ceres CLONE ID no.1790416
gcgcggctcctcccttcttcttctcttcccccctcggcttcgaggggtttttttctctttgtttctttccttttttttttctttttttttattttttttcttttcgttttttttggttcctcctccccgtcggggttttcggccccgacgaaaccctaataaccggcggggggcaatcgccggcggcatgcaccagcagcggatgaagcaggccgcagcggcggcggcggcgcagcagcagcagctgatgcagcaggcgctgctcctgcagcagcagcagcagcagcagcagcaggcgcagccgcccttgttccccgggcaccacccgcaccccggcctcctcgccgcgccgcagatagagcccatagttagcggaaaccttcctcctgggtttgattcaagtacatgccgcagcgtgtatgttggcaatatccatcttcaagtgacggacacgttactgcatgaagtcttccaaagtattggtccagtagaaggttgcaagctcatcagaaaagaaaagtcgtcttttggtttcattgactactatgaccgccgatctgctgcactagcaattttatctctcaacggcaaaccactgtatggtcagccaataaaagttaattgggcatatacaagtactcagagggaggatacatcaggtcattttaatatttttgttggggatctttgcccagaaatcactgatgctgctctatttgcctttttttctggatactctacctgctcagatgctagggttatgtgggaccagaaaacaggacgatccagagggttcggttttgtttctttcaggaatcagcaggatgctcaaaatgcgataaatgacttgaatgggaagtggcttggcaaccgtcaaattcgttgcaattgggcgacgaaaggcgctaatgcttgtgatgaaaaacaaagtgtggacaccaaggtggaccagacaaatggttcatcagaagctggaaaggagaattcaaatgaagatggtcctgaaaataacccactttttaccactgtttatgttggtggtcttcctcatgaggccaccaacaatgatgtgcacctgtttttccattcacttggggctggctcaatcgaggaggtccgtgtgacacgtgacaagggctttggctctgtgaggtacagcacccatgaggaagctgcactagcaattcagatgggcaatggccaactgattggcgggaggccgataaggtgctcctggggaaacaagccaactccaccggggacagcatcttcgccgctcccccctccggcaccatctccattccccaccggcgcgtccgcaactgacctcctggcttaccagcgcctggccctgagcaagattgccgcgaacccatccctaatgggccagcacgccctgaagcaggctgcactggggatggacgccggggccagccaggctatctatgatggcggctaccctggcatcaacgctgcggccggcacacagcagcagcagcaacagcagctcatgtacttctagagtgacagctatcttatgaggcggcagctacctgtctctgcaggaggaaggcgaagatgatgccccagttacagccccccatatatacatatactagtagtatcatagtaatcaagccttaccaggaccttcttttatttacctttaatctttcgttacaccatctaagtaacttgtcctgtatgccggctctctatatatatatactcaccaccgtagaacacatatatgtatttctagagacatggaaaccaagtctgggtgggtgtcaaaaaaaaaaaaaaaaaaaa

SEQ ID NO: 400 - protein, 424 aa, Panicum virgatum
  misc_feature (1)..(424): Ceres CLONE ID no. 1790416
  misc_feature (1)..(424): Functional Homolog of  Ceres CLONE ID no.  115366
  misc_feature (142)..(213): Pfam Name: RRM_1 Pfam Description: RNA recognition motif. (a.k.a. RRM, RBD, or RNP domain)
MQQALLLQQQQQQQQQAQPPLFPGHHPHPGLLAAPQIEPIVSGNLPPGFDSSTCRSVYVGNIHLQVTDTLLHEVFQSIGPVEGCKLIRKEKSSFGFIDYYDRRSAALAILSLNGKPLYGQPIKVNWAYTSTQREDTSGHFNIFVGDLCPEITDAALFAFFSGYSTCSDARVMWDQKTGRSRGFGFVSFRNQQDAQNAINDLNGKWLGNRQIRCNWATKGANACDEKQSVDTKVDQTNGSSEAGKENSNEDGPENNPLFTTVYVGGLPHEATNNDVHLFFHSLGAGSIEEVRVTRDKGFGSVRYSTHEEAALAIQMGNGQLIGGRPIRCSWGNKPTPPGTASSPLPPPAPSPFPTGASATDLLAYQRLALSKIAANPSLMGQHALKQAALGMDAGASQAIYDGGYPGINAAAGTQQQQQQQLMYF

SEQ ID NO: 401 - DNA, 1732 bp, Panicum virgatum
  misc_feature (1)..(1732): Ceres CLONE ID no.1754564
cccgttggggttttccgccccgacgaaaccctaataaccggcggggggcgatcgccggcggcatgcaccagcagcggatcaagcaggcggcggcggcggccgccgtggcggcgcagcagcagcagcagctgatgcagcaggcgctgctcctgcagcagcagcagcaggcgcagccgcccttgttcccggggcaccacccgcaccccggcctcctcgacgcgccgcagatagaacccatagttagcggaaaccttcctcctgggtttgattcaagtacatgccgcagcgtgtatgttggcaatatccatcttcaagtgacggacacgttactgcaggaagtcttccaaagtattggtccagtagaaggttgcaagctcatcagaaaagaaaagtcatcttttggtttcatcgactactatgaccgccgatctgctgcactagcaattttatctctcaacggcaaacaactgtatggtcagccaataaaagtcaattgggcatatacaagtactcagagggaggacacatcaggccattttaatatttttgttggggatctttgcccagaaatcactgatgctgctctatttgcctttttctctggatactctacctgctcagatgctagggttatgtgggaccagaaaacaggacgatccagagggttcggttttgtttctttcaggaatcagcaggatgctcaaaatgcaataaatgacttaaatgggaagtggcttggcaaccgtcaaattcgttgcaattgggcgacaaaaggtgctaatgctggtgaagagaaacaaagtgtggacaccaaggtggaccagacaaatggttcatcagaagctggaaaggagaatttaaatgaagatggtcctgaaaataacccactttttaccactgtttatgttggtggtcttcctcatgaggccaccaacaatgatgtgcacctgttttttcattcacttggggttggctcaattgaggaggtccgtgtaacacgtgacaaaggctttggctttgtgaggtacagcacccatgaggaagctgcattggcaattcagatgggcaatggccaactgattggcgggagacccataaggtgctcctggggaaacaaaccaactccaccggggacagcatcttcgccgctcccccctcctgcaccatctgcattccccaccggcgtgtcggcaactgacttcctggcctaccagcgcctggccctgagcaagattgccgcgaacccagccttaatgggccagcacgccctgaagcaggctgcgctggggatggacgctggggccagccaggctatctacaatggcggcttcccaggtgtcaatgctgctgccactgccgctgcccagcagcagcagcagcagcagcagctcatgtacttctagagtgacgactggcgcatgataagccagctacctgtctctgcaagaggaaggcgaggatgatccccagttacagccccccatatacatatactagagtatcatagtagatgacgccttaccaggatctttttttatttacctaatcttttgttacaccatctaagtaacttgccctgtatgtcagctatatatattttcaccaccgtagaacatatgtatttgagagacatggaaaccaagtctgggtgggtgtcaccccggcattctagtataattttctgtgtttagatcatcgtattttctgtgtttaaaaaaaaaaaaaaaaaaaa

SEQ ID NO: 402 - protein, 446 aa, Panicum virgatum
  misc_feature (1)..(446): Ceres CLONE ID no. 1754564
  misc_feature (1)..(446): Functional Homolog of  Ceres CLONE ID no.  115366
  misc_feature (161)..(232): Pfam Name: RRM_1 Pfam Description: RNA recognition motif. (a.k.a. RRM, RBD, or RNP domain)
MHQQRIKQAAAAAAVAAQQQQQLMQQALLLQQQQQAQPPLFPGHHPHPGLLDAPQIEPIVSGNLPPGFDSSTCRSVYVGNIHLQVTDTLLQEVFQSIGPVEGCKLIRKEKSSFGFIDYYDRRSAALAILSLNGKQLYGQPIKVNWAYTSTQREDTSGHFNIFVGDLCPEITDAALFAFFSGYSTCSDARVMWDQKTGRSRGFGFVSFRNQQDAQNAINDLNGKWLGNRQIRCNWATKGANAGEEKQSVDTKVDQTNGSSEAGKENLNEDGPENNPLFTTVYVGGLPHEATNNDVHLFFHSLGVGSIEEVRVTRDKGFGFVRYSTHEEAALAIQMGNGQLIGGRPIRCSWGNKPTPPGTASSPLPPPAPSAFPTGVSATDFLAYQRLALSKIAANPALMGQHALKQAALGMDAGASQAIYNGGFPGVNAAATAAAQQQQQQQQLMYF

SEQ ID NO: 403 - protein, 449 aa, Triticum aestivum
  misc_feature (1)..(449): Ceres CLONE ID no. 703017
  misc_feature (1)..(449): Functional Homolog of  Ceres CLONE ID no.  115366
  misc_feature (163)..(234): Pfam Name: RRM_1 Pfam Description: RNA recognition motif. (a.k.a. RRM, RBD, or RNP domain)
  misc_feature (446)..(446): Xaa is any aa, unknown, or other
MQQRMKQAAAVAAQQQQQMMQQALLMHQHQQQQQAAAAVPPMFPPHHAHPGLLAAPHIEPIVSGNLPPGFDSSTCRSVYVGNIHLQVTDSLLHEVFQSIGPVEGCKLIRKEKSSFGFVDYYDRRYAALAIVSLNGRQLFGQPIKVNWAYASTQREDTSGHFNIFVGDLCPEVTDAALFAFFSAYSTCSDARVMWDQQTGRSRGFGFVSFRNQQDAQTSINELNGKWLGNRQIRCNWATKGANAGEEKQSTDSKGVVELINGSSEAGKENANEDGPENNPQYTTVYVGNLPHDINSNDVHRFFHLLGAGSIEEVRVTRDKGFGFVRYSTHEEAARAIQTGNGQLIGGRQIKCSWGSKPTPPGTASAPLPPPALAPYTPGVSAVDLISYERSLALSKMAANPALMGQVAALRQAAMGMGTGASQAIFDGSFQSVNPQQQQQQQQQQQXMYY

SEQ ID NO: 404 - DNA, 831 bp, Arabidopsis thaliana
  misc_feature (1)..(831): Ceres CLONE ID no.  116968
  misc_feature (1)..(831): GEMINI ID 533C4
atattcacataataataatgttcaataatacaacaacctccttcggctccggccccggcatcgtcgtcgtcccaactcccgccacaacagttcccaccaccgacttccccggtaccaccatcacttccaactccaccttcattatcatcggacctccaccaccgttcccagctcctccccggagcatcgaccttactcctctcaaactaatcttcgtcgtcatcgccttcgtcgccgttcccgctttagtttacgctctcttcttcaacggcccatgttcttcctcccgccgcaactcctcttcttcccgcaccagctcttcctccgacgatacacctcacgccaccgtcgacaccccgccgatcaccgagaccaccgtaacttcggaatccggagggaaattccacaaagatacacattctaaagagattggaaacgagtgctccgtgtgtctcatggtgttcaccgacagcgatgaactccggcaactaagcgagtgtaaacacgcgttccacgtgttatgtattgagacgtggcttaaggatcatcctaattgtcccatttgtcgaactgacgtctccgttaaacaacaaaccgaagctcccaacgttcccgttaacgttaacggaaacgtgaatcgcagcggcggaaaccgtcgcgtttcggccactagtagagatgacgattggcgtcaaggtttacctgatgcttctagtttagtttgaattttttatttaataaaatttatttctctgtttttttccacagatttttaaagatatttttgtaaacaaattacgtcaatttcgaaaaaattatgtccgttaaatt

SEQ ID NO: 405 - protein, 235 aa, Arabidopsis thaliana
  misc_feature (1)..(235): Ceres CLONE ID no.  116968
  misc_feature (1)..(235): GEMINI ID 533C4
  misc_feature (142)..(183): Pfam Name: zf-C3HC4 Pfam Description: Zinc finger, C3HC4 type (RING finger)
MFNNTTTSFGSGPGIVVVPTPATTVPTTDFPGTTITSNSTFIIIGPPPPFPAPPRSIDLTPLKLIFVVIAFVAVPALVYALFFNGPCSSSRRNSSSSRTSSSSDDTPHATVDTPPITETTVTSESGGKFHKDTHSKEIGNECSVCLMVFTDSDELRQLSECKHAFHVLCIETWLKDHPNCPICRTDVSVKQQTEAPNVPVNVNGNVNRSGGNRRVSATSRDDDWRQGLPDASSLV

SEQ ID NO: 406 - DNA, 1137 bp, Arabidopsis thaliana
  misc_feature (1)..(1137): Ceres CLONE ID no.  117643
  misc_feature (1)..(1137): GEMINI ID 15D9
  misc_feature (1)..(1137): GEMINI ID 554D2
aactcacaccactccattgcccattgctctgtgtactttgcttctttaggagaaagaaagcacaaggggcaaaatcggaaagattatcatggccgacggtagtactagttcttcggagtccactaccgcctgcggtggaagcggcacaagaagagagattatgctgttcggagtcagggttgtgcttgacccgatgagaaagtgcgtgagtttgaacaatctgtctgactatgaacagacggcggagactccaaagatcgacggcgaagatagagatgaacaagatatgaacaaaaccccggccggttacgcctcggcggatgaagctcttcccatgtcttcttctaacggcaaatcgagaggaaacgaggagttccatggactgaagaagaacacaagctgttcttgcttgggctgcagagagtcggtaaaggagattggaaaggaatatcaagaaactttgtcaagaccagaacctctacacaagttgctagtcatgctcagaaatacttcctcaggcgaagtaatcttaaccgtcgccgccgaagatctagcctttttgacatgactactgatacggtcatacccatggaagaagatcaccaagtgcttatacaggagaacacatctcaatcatcttctcctgtaccggaaatcaacaacttctctatacatccggttatgcaagtctttcccgagttcccggtaccaacagggaatcaatcatacggacagcttacttcatcgaatctcatcaatttggttccattaacttttcagtcaagtccagcaccgctttctctcaacctctcactagcttcatctaatcttaatgaaccatctccttcaatgcatccagcattcaacacgattggagtcgcttagagcttatcctaaaggtgaaaatctgcaacacaccctgtttgtttctttgctgtacagataggtcttgactttgttataaaaaaattcgtcaaatttatgtatttggctaaaaaaaatctgttgaaaagaagaataataaacagagtttggagataggacttaagtggggttttagggttcataatcatcctgtgtttttccttccatgtttggaagttgttgtaatactctctaagttcattcgtgtggatc

SEQ ID NO: 407 - protein, 159 aa, Arabidopsis thaliana
  misc_feature (1)..(159): Ceres CLONE ID no.  117643
  misc_feature (1)..(159): GEMINI ID 15D9
  misc_feature (1)..(159): GEMINI ID 554D2
MADGSTSSSESTTACGGSGTRREIMLFGVRVVLDPMRKCVSLNNLSDYEQTAETPKIDGEDRDEQDMNKTPAGYASADEALPMSSSNGKSRGNEEFHGLKKNTSCSCLGCRESVKEIGKEYQETLSRPEPLHKLLVMLRNTSSGEVILTVAAEDLAFLT

SEQ ID NO: 408 - DNA, 1185 bp, Arabidopsis thaliana
  misc_feature (1)..(1185): Ceres CLONE ID no.  118001
  misc_feature (1)..(1185): GEMINI ID 532H3
caataacaacactttcgatgacttcggctttgactctggtttcttaggacaacaattccatggaaatcatcaatctccgaactcgatgaatttcactggcttaaaccactcagtaccggattttcttccagctccggaaaacagctctggatcatgtggattgagtcctctgttctcgaacagagcaaaggttttaaaaccgttacaggtaatggcttcatctggctcgcagccaactctgtttcagaaacgagctgcaatgcgtcagagttcgactagcaaatcagagagttcttctgaaatgaggaaatcgagctacgagagagagattgacgatactagtaccggaatcatcgatatctctggattgaattacgaatctgatgaccataatactaataacaacaaaggtaagaagaaaggaatgcctgcaaagaaccttatggctgagagaagaagaaggaagaagcttaatgataggctttacatgcttagatcagttgttcccaagatcagcaaaatggatagagcatcaatacttggagatgctattgattacctcaaagagcttttacaaagaatcaacgatcttcataccgaactcgaatctactccaccgagttcttcaagcttgcatccgttaacaccgactccacaaacgctgtcttaccgtgttaaggaagagttgtgtccatcttcctccttgccaagccctaaaggccagcaaccaagagttgaggttagattaagagaaggaaaggcagtgaacattcacatgttctgtggacgtagaccaggtcttttactttccaccatgagagctttggataacttaggattggatgttcaacaagctgtgattagctgtttcaacggttttgctttggatgttttccgcgctgagcaatgtcaagaagaccatgacgtgttacctgaacaaatcaaagcagtgcttttagatacagcaggttacgctggtttggtttgattgcgaagcagaaggaagcatctgtgtggaacagagctagatctaagtccttgttctgttttagtcagcaattttcttacttagtttcatcatttttaatcagtgtattgaagatgataactacttaattttagcttcgaaaacatgtgtttcgagtacaatagtttcaacctttgagcaaaatgccattgtttctc

SEQ ID NO: 409 - protein, 300 aa, Arabidopsis thaliana
  misc_feature (1)..(300): Ceres CLONE ID no.  118001
  misc_feature (1)..(300): GEMINI ID 532H3
  misc_feature (116)..(163): Pfam Name: HLH Pfam Description: Helix-loop-helix DNA-binding domain
MNFTGLNHSVPDFLPAPENSSGSCGLSPLFSNRAKVLKPLQVMASSGSQPTLFQKRAAMRQSSTSKSESSSEMRKSSYEREIDDTSTGIIDISGLNYESDDHNTNNNKGKKKGMPAKNLMAERRRRKKLNDRLYMLRSVVPKISKMDRASILGDAIDYLKELLQRINDLHTELESTPPSSSSLHPLTPTPQTLSYRVKEELCPSSSLPSPKGQQPRVEVRLREGKAVNIHMFCGRRPGLLLSTMRALDNLGLDVQQAVISCFNGFALDVFRAEQCQEDHDVLPEQIKAVLLDTAGYAGLV

SEQ ID NO: 410 - DNA, 1308 bp, Arabidopsis thaliana
  misc_feature (1)..(1308): Ceres CLONE ID no.  118756
  misc_feature (1)..(1308): GEMINI ID 532C4
tctttttgcgtctctcttctaacattccttccttgccgatatttcagctcacgacgagaaaaatctcaccgttcacgctatatacatctatttgcagggatttgatttcgtagaagtggttttgggaaacactgagatgagtaatcatcacacggtcgtatatgttaatggattggttcgaccggttctcgcggaggctgagtatagtatgagaacagagtctccggcggataatgcaattgatatctacgacggagatactacggagaatgaggaggaggatccactgatttcttccgcggagtgtcggatttgtcaggatgaatgtgatattaagaatcttgagagtccttgtgcttgcaatggcagcttaaagtatgctcacagaaaatgtgttcaacgttggtgtaatgaaaagggaaacactatatgcgaaatctgtcatcagccataccaagctggatatacctctccaccaccaccaccacaatctgaagaaactactattgacattggtggaggatggagaatctcgggtttggatttagatgatccacgtctcttagcaatagcagaagctgaacgtcagattttagaatcagaatatgatgattatacagcttcagataccagtggagctgcatttttccgctctgctgctttaatattgatgactcttcttctattgcgacatgcactgactataccagattattcagatagtgaagatgatgatccttcttcaatactttctcttttcttactccgagctgccagttttcttcttccttgctacatcatggcatcagccatcagtatcctgcatcgccgtagacagagacaggaagcagcggacttggccactcggtttgcgttggtgctcagctcgcgccaacctagacccgtgattaattatttgtcaatggagccatgattttatagttccactctaagagtttcaggtgtatatgcttttcaaatatttcatcagaaaaaagattcatgaactgctgttaaaagagtggtttacaatttggtagcaacaagaaccatcacaagatctacatgatggtccttctgaatcagctttcttacaaacaaggagtgtcctaacttagtgcagagtttttttttttacaagtattcgattctaagaaagattgtgtatgtagattaaagagtttctgattctgtagcattaagattttcaataacactcgattgagagatgagcatttcactttttaggtaaagaaaaacgagacacataatttgtaatctgtgtaaataaatttgttttttgttccg

SEQ ID NO: 411 - protein, 265 aa, Arabidopsis thaliana
  misc_feature (1)..(265): Ceres CLONE ID no.  118756
  misc_feature (1)..(265): GEMINI ID 532C4
  misc_feature (57)..(102): Pfam Name: zf-C3HC4 Pfam Description: Zinc finger, C3HC4 type (RING finger)
MSNHHTVVYVNGLVRPVLAEAEYSMRTESPADNAIDIYDGDTTENEEEDPLISSAECRICQDECDIKNLESPCACNGSLKYAHRKCVQRWCNEKGNTICEICHQPYQAGYTSPPPPPQSEETTIDIGGGWRISGLDLDDPRLLAIAEAERQILESEYDDYTASDTSGAAFFRSAALILMTLLLLRHALTIPDYSDSEDDDPSSILSLFLLRAASFLLPCYIMASAISILHRRRQRQEAADLATRFALVLSSRQPRPVINYLSMEP

SEQ ID NO: 412 - DNA, 1493 bp, Arabidopsis thaliana
  misc_feature (1)..(1493): Ceres CLONE ID no.  119460
  misc_feature (1)..(1493): GEMINI ID 534F6
atacttttattttcatttcctttaactgcatagttcttcctcaaattgctcatacctttgcttctctttctttctttattcaacctcttatttcttcttcagcaccaacgtgtatctgcagtaaacacctatccatcgatcgatctcctcaaaaagttattgttttcttgaaggatttttcttgttcttgatcaagcatacatatatatagatggtggaagaaggcggcgtagttgtgaatcaaggaggagatcaggaggtggtggatttgcctccggggtttcggtttcaccctactgatgaagagataataactcactacctcaaagagaaggtcttcaacatccgatttaccgcggcagcgattggtcaagccgacctcaacaagaacgagccatgggatctaccaaagattgcaaagatgggggagaaggagttttactttttctgccagagggatcggaagtatccgaccgggatgaggacgaaccgtgcgaccgtgtctggttattggaaggcgaccgggaaggacaaggagatctttagaggcaaaggttgtcttgttgggatgaagaaaacacttgttttctatacaggaagagctcctaaaggtgaaaagaccaattgggttatgcatgaatatcgtcttgatggaaaatattcttatcataacctccccaaaaccgcaagggatgaatgggtggtgtgtagggtttttcacaagaacgctcctagtactacaatcactactacaaaacaactctcaaggattgattctcttgataacattgatcatctcttagacttctcatctctccctcctctcatagatccgggtttcttgggtcaacccggcccaagcttctccggtgcccgtcaacaacacgatctcaaacctgttctccaccatcctacaaccgcaccagtcgacaacacttaccttcctacccaagctctcaatttcccttaccactcggtccataattccggatctgatttcggctacggggcaggttcaggcaataataacaaaggtatgatcaagttggagcattctcttgtgagtgtgtctcaagaaaccggtttgagttccgatgtgaacacaaccgcaacgccagagatatcttcttatccaatgatgatgaatccggcaatgatggatggtagcaagtcagcgtgtgatggtcttgatgacttgatcttctgggaagatttatatactagctaaatttgggaaaaggttatttgttaattgtgattgaagagtggcatattgattactcgtctagtgtttttaatcgtgtaattagttcgtatataatatacatgtacataagatcattaggtttattaggcattggactttagttcggtgattgcttacctagtttttagcttgagaaaaaaaggctgtcattggggttatgtttctttgtgattaacttgtacatatatacatttaaattattcgtatggtttatttcgtttaaatt

SEQ ID NO: 413 - protein, 338 aa, Arabidopsis thaliana
  misc_feature (1)..(338): Ceres CLONE ID no.  119460
  misc_feature (1)..(338): GEMINI ID 534F6
  misc_feature (20)..(147): Pfam Name: NAM Pfam Description: No apical meristem (NAM) protein
MVEEGGVVVNQGGDQEVVDLPPGFRFHPTDEEIITHYLKEKVFNIRFTAAAIGQADLNKNEPWDLPKIAKMGEKEFYFFCQRDRKYPTGMRTNRATVSGYWKATGKDKEIFRGKGCLVGMKKTLVFYTGRAPKGEKTNWVMHEYRLDGKYSYHNLPKTARDEWVVCRVFHKNAPSTTITTTKQLSRIDSLDNIDHLLDFSSLPPLIDPGFLGQPGPSFSGARQQHDLKPVLHHPTTAPVDNTYLPTQALNFPYHSVHNSGSDFGYGAGSGNNNKGMIKLEHSLVSVSQETGLSSDVNTTATPEISSYPMMMNPAMMDGSKSACDGLDDLIFWEDLYTS

SEQ ID NO: 414 - DNA, 1252 bp, Arabidopsis thaliana
  misc_feature (1)..(1252): Ceres CLONE ID no.  119790
  misc_feature (1)..(1252): GEMINI ID 553E10
  misc_feature (499)..(499): n is a, c, t, g, unknown, or other
  misc_feature (560)..(560): n is a, c, t, g, unknown, or other
  misc_feature (573)..(573): n is a, c, t, g, unknown, or other
aacataaattaagtttttttttgtccttttctgcctttacctttccttctactcccgaaaaagcactgactttgctctgtttccttcgttcacacagagaaagagagaaatcttctgagcgaaattctgacaaaagagatgatggaatgggataatcagctacaacccaataaccatcactcttctaatcttcaagggatcgacgttaatggcggctccggcgccggaggaggaatgtacgtgaaggtgatgaccgatgagcagtatgaaactctcaggaaacagattgctatttacggcaccatttgtgagcgtcttgttgagatgcataaaactctcactgctcaacaagatcttgcaggagggagaatgggaggactatatgcagaccccaatgatgtcatctttaggtcataagatgacagctagacagaggtggactcctacgccagtccagcttcagattctggaacgtatattcgatcaaggcacgggaacncccgagcaagcagaagatcaaagacataacagaagagcttgagcccacacgggcagattgnttgaacaaaatgnctataactgggttccagaacccgacgtgctcgatccaagagggaagcagcatgggtggaggtctttcttggaaawaaaataaatggkgaagtctgaggtagagactgaagttgaagcattgaatgagaagagagtagtgaggccagagagtcttcttggtcttccagatggaaatagcaacaataatgggttagggacaacaacagcaacaacttactgctcctaggcctgaagatctttgctttcagagccctgagattagctcagaccttcacttgctagatgttctatcaaacccaagggatgagcatcttgttggaaagatgggactggcggaaagttacaacctttatgatcatgttgaagattatggcatgtcaggctgattgaatacaagctgaggaaacttctaattatcagagagatcaatgaaatggatttggtagtcagtcataagcagtattagacttttgtttttcttaaattgtttctttcagggcttattaaagaaacaagtagtttatcttattaatcattttcagagaaacatttacatggattgttgaatcgtcttgtgatgcttgctttgataatttctgcattcagaacgatttttacatccttaaatgaattatactgtaagaaataaaaaaattccaagagaaaaacatttcaattc

SEQ ID NO: 415 - protein, 92 aa, Arabidopsis thaliana
  misc_feature (1)..(92): Ceres CLONE ID no.  119790
  misc_feature (1)..(92): GEMINI ID 553E10
MMEWDNQLQPNNHHSSNLQGIDVNGGSGAGGGMYVKVMTDEQYETLRKQIAIYGTICERLVEMHKTLTAQQDLAGGRMGGLYADPNDVIFRS

SEQ ID NO: 416 - DNA, 614 bp, Arabidopsis thaliana
  misc_feature (1)..(614): Ceres CLONE ID no.  12256
  misc_feature (1)..(614): GEMINI ID 535G9
atgtccgagtgaacaaatcccgccaaagatacgaagagactggttgtgaaatcaaagaagcattcaaaagctcgttatctaaagattctgcgaagatgagtactatgaaattttgtcgcgaatgtaataacattctatatcccaaggaagacaaggagcaatcaatcctcctctatgcgtgccgtaattgtgatcaccaggaagcagcagataacaattgtgtttacagaaacgaggttcatcactctgtaagtgaacaaactcagatcctatctgacgttgcttccgacccaactcttccacgtaccaaggctgtgcgatgcgccaagtgtcaacacggtgaagctgtcttcttccaggccacggctagaggcgaagaaggaatgactctgtttttcgtttgctgcaacccgaactgtagtcaccgttggagagaatagattgatagaagactacatttttcaaatgtaacgtgtatttgtgttccgctttatgagttttatacaattcaatttggagttttctgtgtaaaaatatgaatactatgagactgttctcgggtttcttgaattgtttcagggtcttttatgatcattttggtttttatgtgggtc

SEQ ID NO: 417 - protein, 114 aa, Arabidopsis thaliana
  misc_feature (1)..(114): Ceres CLONE ID no.  12256
  misc_feature (1)..(114): GEMINI ID 535G9
  misc_feature (4)..(58): Pfam Name: RNA_POL_M_15KD Pfam Description: RNA polymerases M/15 Kd subunit
MSTMKFCRECNNILYPKEDKEQSILLYACRNCDHQEAADNNCVYRNEVHHSVSEQTQILSDVASDPTLPRTKAVRCAKCQHGEAVFFQATARGEEGMTLFFVCCNPNCSHRWRE

SEQ ID NO: 418 - protein, 114 aa, Brassica napus
  misc_feature (1)..(114): Ceres CLONE ID no. 976830
  misc_feature (1)..(114): Functional Homolog of  Ceres CLONE ID no.  12256
  misc_feature (4)..(58): Pfam Name: RNA_POL_M_15KD Pfam Description: RNA polymerases M/15 Kd subunit
  misc_feature (53)..(53): Xaa is any aa, unknown, or other
MSTMKFCRECNNILYPKEDKEQSILLYACRNCDHQEAADNNCVYRNEVHHSVXEQTQILSDVASDPTLPRTKAVRCAKCQHGEAVFFQATARGEEGMTLFFVCCNPNCGHRWRE

SEQ ID NO: 419 - protein, 114 aa, Brassica napus
  misc_feature (1)..(114): Ceres CLONE ID no. 966126
  misc_feature (1)..(114): Functional Homolog of  Ceres CLONE ID no.  12256
  misc_feature (4)..(58): Pfam Name: RNA_POL_M_15KD Pfam Description: RNA polymerases M/15 Kd subunit
MSTMKFCRECNNILYPKEDREQSILLYACRNCDHQEAADDNCVYRNEVHHSVSEQTQILSDVASDPTLPRTKAVRCAKCQHGEAVFFQATARGEEGMTLFFVCCNPNCGHRWRE

SEQ ID NO: 420 - protein, 114 aa, Arabidopsis thaliana
  misc_feature (1)..(114): Public GI no. 46359779
  misc_feature (1)..(114): Functional Homolog of  Ceres CLONE ID no.  12256
  misc_feature (4)..(58): Pfam Name: RNA_POL_M_15KD Pfam Description: RNA polymerases M/15 Kd subunit
MSTMKFCRECNNILYPKEDKEQKILLYACRNCDHQEVADNSCVYRNEVHHSVSERTQILTDVASDPTLPRTKAVRCSKCQHREAVFFQATARGEEGMTLFFVCCNPNCGHRWRE

SEQ ID NO: 421 - protein, 114 aa, Medicago truncatula
  misc_feature (1)..(114): Public GI no. 87240462
  misc_feature (1)..(114): Functional Homolog of  Ceres CLONE ID no.  12256
  misc_feature (4)..(58): Pfam Name: RNA_POL_M_15KD Pfam Description: RNA polymerases M/15 Kd subunit
MSTMKFCRECNNILYPKEDREQKILLYACRNCDHQEAADNFCVYRNEIHHSVAERTQVLQDVAADPTLPRTKAVRCVQCNHGEAVFFQATARGEEGMTLFFVCCNPNCGHRWRD

SEQ ID NO: 422 - protein, 114 aa, Oryza sativa
  misc_feature (1)..(114): Public GI no. 77556133
  misc_feature (1)..(114): Functional Homolog of  Ceres CLONE ID no.  12256
  misc_feature (4)..(58): Pfam Name: RNA_POL_M_15KD Pfam Description: RNA polymerases M/15 Kd subunit
MSTMKFCRECNNILYPKEDRDQKILLYACRNCDHQEVADNNCVYRNVVHHSAGEFTQVLQDVAGDPTLPRTKAVRCAVCGHGEAVFFQATARGEEGMTLFFVCCNPSCGHRWRE

SEQ ID NO: 423 - protein, 114 aa, Zea mays
  misc_feature (1)..(114): Ceres CLONE ID no. 305612
  misc_feature (1)..(114): Functional Homolog of  Ceres CLONE ID no.  12256
  misc_feature (4)..(58): Pfam Name: RNA_POL_M_15KD Pfam Description: RNA polymerases M/15 Kd subunit
MSTMKFCRECNNILYPKEDREQKVLLYACRNCDHQEVADNNCVYRNVVHHSAGEFTQVLQDVAGDPTLPRTKSVRCSSCGHGEAVFFQATARGEEGMTLFFVCCNPSCGNRWRE

SEQ ID NO: 424 - protein, 114 aa, Triticum aestivum
  misc_feature (1)..(114): Ceres CLONE ID no. 686862
  misc_feature (1)..(114): Functional Homolog of  Ceres CLONE ID no.  12256
  misc_feature (4)..(58): Pfam Name: RNA_POL_M_15KD Pfam Description: RNA polymerases M/15 Kd subunit
MSAMKFCRECNNILYPKEDRDQKVLLFACRNCDHQEVADNNCVYRNVVHHSAGEFTQVLQDVAGDPTLPRTKEVRCAVCGHGEAVFFQATARGEEGMTLFFVCCNPSCGHRWRE

SEQ ID NO: 425 - protein, 110 aa, Glycine max
  misc_feature (1)..(110): Ceres CLONE ID no. 1113246
  misc_feature (1)..(110): Functional Homolog of  Ceres CLONE ID no.  12256
  misc_feature (4)..(58): Pfam Name: RNA_POL_M_15KD Pfam Description: RNA polymerases M/15 Kd subunit
MSAMKFCRECNNILYPKEDRDQKVLLFACRNCDHQEVADNNCVYRNVVHHSAGEFTQVLQDVAGDPTLPRTKEVRCAVCGHGEAVFFQATARGEEGMTLFFVCCNPSCGH

SEQ ID NO: 426 - protein, 114 aa, Glycine max
  misc_feature (1)..(114): Ceres CLONE ID no. 676701
  misc_feature (1)..(114): Functional Homolog of  Ceres CLONE ID no.  12256
  misc_feature (4)..(58): Pfam Name: RNA_POL_M_15KD Pfam Description: RNA polymerases M/15 Kd subunit
MSAMKFCRECNNILYPKEDRDQKVLLFACRNCDHQEVADNFCVYRNEIHHSVGERTQVLQDVAADPTLPRTKSVRCSQCNHGEAVFFQATARGEEGMTLFFVCCNPNCGHRWRD

SEQ ID NO: 427 - protein, 114 aa, Triticum aestivum
  misc_feature (1)..(114): Ceres CLONE ID no. 727529
  misc_feature (1)..(114): Functional Homolog of  Ceres CLONE ID no.  12256
  misc_feature (4)..(58): Pfam Name: RNA_POL_M_15KD Pfam Description: RNA polymerases M/15 Kd subunit
MSAMKFCRECNNILYPKEEKERKVLLFACRNCEHQEVAGDNCVYRNIVHHEAGERTQVLQDVASDPTLPRTKDVRCAACGHGEAVFFQATARGEEGMTLFFVCCNPSCGNRWRE

SEQ ID NO: 428 - protein, 114 aa, Zea mays
  misc_feature (1)..(114): Ceres CLONE ID no. 218484
  misc_feature (1)..(114): Functional Homolog of  Ceres CLONE ID no.  12256
  misc_feature (4)..(58): Pfam Name: RNA_POL_M_15KD Pfam Description: RNA polymerases M/15 Kd subunit
MSTMKFCRECNNILYPKEDRDRRTLFFACRNCEHQEVSDNNCVYRNEVHHTAGERTQVLQDVASDPTLPRTKTVRCNLCGHGEAVFFQAAARGEEGMTLFFVCCSPDCGHRWRE

SEQ ID NO: 429 - protein, 114 aa, Zea mays; identical to SEQ ID NO: 428
  misc_feature (1)..(114): Ceres CLONE ID no. 342112
  misc_feature (1)..(114): Functional Homolog of  Ceres CLONE ID no.  12256
  misc_feature (4)..(58): Pfam Name: RNA_POL_M_15KD Pfam Description: RNA polymerases M/15 Kd subunit

SEQ ID NO: 430 - protein, 114 aa, Oryza sativa
  misc_feature (1)..(114): Public GI no. 108705695
  misc_feature (1)..(114): Functional Homolog of  Ceres CLONE ID no.  12256
  misc_feature (4)..(58): Pfam Name: RNA_POL_M_15KD Pfam Description: RNA polymerases M/15 Kd subunit
MSTMKFCRECNNILYPKEEKDRRLLLFACRNCEHQEVSESKCVYRNEVAHAAGERTQVLQDVASDPTLPRTKTVRCAACGHGEAVFFQATARGEEGMTLFFVCCNLTCAHRWRE

SEQ ID NO: 431 - DNA, 1291 bp, Arabidopsis thaliana
  misc_feature (1)..(1291): Ceres CLONE ID no.  123804
  misc_feature (1)..(1291): GEMINI ID 533H4
atccaaaactctctcagtcatggctcttcttcgtcttcctggcatttccctccaaattctaggtcacaaatcaaaccagaagaaccctaatcccaatgttgccttcaccaatcactctctctctttatctactccttcactatgtcgtctccatcgtcacgcgacgtttccagactcaattccagcaaaatccagaaacctcacttcgtacttctccaccacaacacaagagatttctaaaaccagattgattgctcagaatgttccatggacatctacacctgaagatattagatcgttgttcgagaagtacgggagtgttatcgacattgagatgtctatgcataagaaggaaagaaatagaggtttggtgttcattgaaatggcttctcctgaagaagctgcaacagctcttaaatctcttgaatcgtgtgaatatgagggtcgtcgtttgaaggtagactatgcaaagaccaaaaagaagaagacatatgcgccgcgtgagacgccttcaccagtgcctacattcaatttgtttgttgcaaacttggcatttgaagcaagggccaagcatcttaaggagttctttgatgcagacactggtaatgttgtctccactgaagttatattccatgaaaatccaaggaggtcgagtggttacgggtttgtctctttcaaaaccaagaaacaggccgaggcagcgcttattgagttccaaggaaaggattttttgggaaggccaatccgattagctaaaagcaaacagtttgtgaagttgcaagcaaaagaagggttgcagccaccagaggaggaagcagaggaggaaccatctcagtctgagacaatgacccaagagcacgaaactccggctgcataaaacttagaagtcttcgttgcaggatcattgttggagatattggaattgacgaagaagcttcgagcttttaggtctttattcttcttagtttttgaccaacaagaggagtgggtacatacaagtagtacctaccttgagtaaatggtggagaggtaagaagtacaagaccgattttgttagaactgaaaactagtaagagacaggtattaccaaacgtcagtatcagaccagatcaaatctcaagaaacaaactcatgtggctcctacgaaacttgctttgttcagttaaacacaatgcttctttgtttgtcatctactttcgattacttgtttgcgtttgttatatgcttagtgtgtaacttcatatatgaacccgtactcttaagaaagttatgttagtaatttgtaaaacgc

SEQ ID NO: 432 - protein, 285 aa, Arabidopsis thaliana
  misc_feature (1)..(285): Ceres CLONE ID no.  123804
  misc_feature (1)..(285): GEMINI ID 533H4
  misc_feature (172)..(244): Pfam Name: RRM_1 Pfam Description: RNA recognition motif. (a.k.a. RRM, RBD, or RNP domain)
MALLRLPGISLQILGHKSNQKNPNPNVAFTNHSLSLSTPSLCRLHRHATFPDSIPAKSRNLTSYFSTTTQEISKTRLIAQNVPWTSTPEDIRSLFEKYGSVIDIEMSMHKKERNRGLVFIEMASPEEAATALKSLESCEYEGRRLKVDYAKTKKKKTYAPRETPSPVPTFNLFVANLAFEARAKHLKEFFDADTGNVVSTEVIFHENPRRSSGYGFVSFKTKKQAEAALIEFQGKDFLGRPIRLAKSKQFVKLQAKEGLQPPEEEAEEEPSQSETMTQEHETPAA

SEQ ID NO: 433 - protein, 315 aa, Glycine max
  misc_feature (1)..(315): Ceres CLONE ID no. 670908
  misc_feature (1)..(315): Functional Homolog of  Ceres CLONE ID no.  123804
  misc_feature (184)..(256): Pfam Name: RRM_1 Pfam Description: RNA recognition motif. (a.k.a. RRM, RBD, or RNP domain)
MALLRLVCLPSTNQLSTQPHSHSQSTSFSFLRKTPHSQPINFSLSSFHFPRLSLITTKQTLNLTPTHSSTSEQQTEEPLVSEEEFSRTRLLAQNVPWTSTPEDIRTLFEKHGKVLEVELSMYKKNRNRGLAFVEMGSPEEALEALNNLESYEFEGRVIKVNYARPKKEKTAPPPVKPKVVTFNLFVANLSYEASSKDLKEFFDLGTGRVVSAEVVYRDNPRRPSGYGFVSFKSKKEAEAALAEFQGKVFMGRPIRVDRGRRFVQQPGDGSAKSEDTPSELSVNGAEAPQPAEGSAKSEDTPSELSVNGEEADKAD

SEQ ID NO: 434 - protein, 301 aa, Glycine max
  misc_feature (1)..(301): Ceres CLONE ID no. 614500
  misc_feature (1)..(301): Functional Homolog of  Ceres CLONE ID no.  123804
  misc_feature (170)..(242): Pfam Name: RRM_1 Pfam Description: RNA recognition motif. (a.k.a. RRM, RBD, or RNP domain)
MALLRLVCLTSTNQLSTQSTSFSFLRKTPHSQYIHINPSSFHFPRLSLIATTLTHAQQQTQQADPVVAEEEFSRTRLLAQNVPWTSTPEDIRSLFEKHGKVLQVELSMYKKNRNRGLAFVEMGSPEEALEALNNLESYEFEGRVIKVNYARPKKEKTPPPVKPKVVTFNLFVANLSYEASAKDLKEFFDSGTGKVVSAEVVYRDNPRRPSGYGFVSYKSKKEAEAALAEFQGKIFMGRPIRVDRGRRFVQQPGDGSAKSEDTPSDLSVNGAKAQQPAEGSAKSEDTPSELSVNGEEADKVD

SEQ ID NO: 435 - DNA, 1528 bp, Arabidopsis thaliana
  misc_feature (1)..(1528): Ceres CLONE ID no.  124496
  misc_feature (1)..(1528): GEMINI ID 539H7
tttttttctctaacagatctgtggatcttaacacttctctaatgcttataatgacgagatctaagcatgagaaggaagagataagaagctcatgacaagaatctgaagaaaattaaatttgtttttcacttatcgccgccattgttgttctacactgagcttagacagttgacacctgtaatccaaaattcaaaagtttatcactgcaacatactcaggctttttacttaattatcatagctctgataaagtatgagagtagcgttacaatggaggttgacgaagacattgagttacaaaaacatcaagaacaacaaagcagaaagctacaaagattctcagaggacaacactggactaatgaggaattggaacaatccatcgtctcgtatcattagggtttcacgagcttctggtggcaaagatagacatagcaaagtgttaacatcaaaaggtttaagagatcgaagaatacgtctctcagttgctacagcaatccagttctatgatcttcaagatcgtcttggatttgatcagccaagtaaagctgttgaatggttaatcaatgcagcttctgattcaatcactgatcttcctttgcttaacacaaattttgatcatcttgatcagaatcagaatcagaccaaatctgcttgtagtagtggaacatctgagagttcgctgttgtcgttatcaagaacagagattcgtgggaaagcaagagagagagctagagaaagaacagctaaagacagagataaagatttgcagaatgctcatagctcattcactcagcttctcactggtggttttgaccaacaaccgagtaaccggaattggaccggtggttctgattgctttaacccggttcagctgcaaataccaaactcttcctctcaagagccaatgaatcacccattctcctttgtacctgattacaactttggaatctcttcttcttcttctgccattaatggtggttacagtagtagggggacccttcagtccaattcacaatctctctttctgaataacaacaacaacattactcaaaggtcatcgatttcttcgtcttcttcttcctcttctccaatggatagtcaaagcatttcctttttcatggctacacctccacctcttgaccaccataaccaccagcttccggagacttttgatggtcggctatatctttattacggcgaaggaaaccggagctctgatgacaaggcaaaggaaaggagatagtaaaaacaaaatgcttcctttcatctctccccaatcttggagtggaagtgtaatttgtgggaagacgatgtttgtgcagccctgagcatgtatatgaatcctccattgcaatcataagccaggttgattgtatgttcagaccgcgaggaattgtttttgtttgatgagaaacatgtgttatgtaatgaatcatatatatgtctctatatgtgttcatgttcattgtcataaactttgtccgaaactcggaccaatgttttcaggtcatcctcattctgttggct

SEQ ID NO: 436 - protein, 324 aa, Arabidopsis thaliana
  misc_feature (1)..(324): Ceres CLONE ID no.  124496
  misc_feature (1)..(324): GEMINI ID 539H7
  misc_feature (36)..(241): Pfam Name: TCP Pfam Description: TCP family transcription factor
MEVDEDIELQKHQEQQSRKLQRFSEDNTGLMRNWNNPSSRIIRVSRASGGKDRHSKVLTSKGLRDRRIRLSVATAIQFYDLQDRLGFDQPSKAVEWLINAASDSITDLPLLNTNFDHLDQNQNQTKSACSSGTSESSLLSLSRTEIRGKARERARERTAKDRDKDLQNAHSSFTQLLTGGFDQQPSNRNWTGGSDCFNPVQLQIPNSSSQEPMNHPFSFVPDYNFGISSSSSAINGGYSSRGTLQSNSQSLFLNNNNNITQRSSISSSSSSSSPMDSQSISFFMATPPPLDHHNHQLPETFDGRLYLYYGEGNRSSDDKAKERR

SEQ ID NO: 437 - DNA, 1465 bp, Arabidopsis thaliana
  misc_feature (1)..(1465): Ceres CLONE ID no.  125917
  misc_feature (1)..(1465): GEMINI ID 539F7
gcaagatgtgttcaatcggagtaactgctctctgttctccggctaaatttcatcatcgccgggaacaatcactgatttttactccgacccatttgcgtaattcaaatgggttccaatttcggtggagaaagtcccgacctttcgctcccagactcgcccaacccgacaatttcgctccgccgctccctctcatacgctcttcgacgtctcttctttcttccaaggatttcgttcagatgctggcgagaaaaggccgccattttacttgttgggtcgtttgtctttctagggttctgctcttcgaaacctgctttagcgctacccactgcaaaygtagtctcccaggcagagttagaggacgagaaaatgttcgagaagcttctggaaaatgagccagagaacatggaggctatgaaggctgttgtgtataagaagatgaggagaggggaaaatgaagatgctgtgaaatatgttgagaagctgatgaaattagagcctcatgaagttgagtggaagcttttagaagcgctttgctatgaaacaatgggggaattgagcaaagccaagagattgtataaggatattctcaaagaacaacctcttttgatcagagctttgcacggtcttgctatggtaatgcataagactcatgacacctctgtctttgatatgctcattgaagctatggaagttgctcgacaaggaaaccgagtaaccgaggagagaaacatacaagtcttgattggtcaaatgcatattgtggagggtcaatttgaagaaggtctaaagatatttcaacagatggtgaatgataatcctcgagattttcgaccttacctttgccagggcatagtgtatagcttaatggataaaamagaggaagcagcacaacagtttgagatctattggagtcttgtacctggagaattcccacaaaagggatttctcgacgatgttgccttggctgctcaagcaaaatcccgagaacggcttcaaaacacattcaaagctaaatttactcaggggagataattgaaagcttcatcagcagttcaaagttttcttcttgaggtttgcagtgcccactcatgtaatcacattttggtcatgttacagttacatgacatatgtttataaagaatatcaggtatgaaatgttaacatgtgtcggggttaaagaaaaaaaacgctttcgagcaggcagagtttgtggctgcatgtagaaccgagaagaagatggtgcttttttgttgttttgttttgtttttgcagtcatgctagtgatttctctcaggtgcataataatcagwcgtgaamgmttacgacttccttgtcattcgtagagataytatacaactgytttttctgctgtctatcggtcatacgattgttgatacatctcttccaccaacagtagcaattttttttgtcagaaaaaaaacctatcataatcattcttgraarg

SEQ ID NO: 438 - protein, 308 aa, Arabidopsis thaliana
  misc_feature (1)..(308): Ceres CLONE ID no.  125917
  misc_feature (134)..(167): Pfam Name: TPR_2 Pfam Description: Tetratricopeptide repeat
  misc_feature (1)..(308): GEMINI ID 539F7
  misc_feature (76)..(76): Xaa is any aa, unknown, or other
  misc_feature (257)..(257): Xaa is any aa, unknown, or other
MGSNFGGESPDLSLPDSPNPTISLRRSLSYALRRLFFLPRISFRCWREKAAILLVGSFVFLGFCSSKPALALPTAXVVSQAELEDEKMFEKLLENEPENMEAMKAVVYKKMRRGENEDAVKYVEKLMKLEPHEVEWKLLEALCYETMGELSKAKRLYKDILKEQPLLIRALHGLAMVMHKTHDTSVFDMLIEAMEVARQGNRVTEERNIQVLIGQMHIVEGQFEEGLKIFQQMVNDNPRDFRPYLCQGIVYSLMDKXEEAAQQFEIYWSLVPGEFPQKGFLDDVALAAQAKSRERLQNTFKAKFTQGR

SEQ ID NO: 439 - DNA, 1071 bp, Populus balsamifera subsp. trichocarpa
  misc_feature (1)..(1071): Ceres ANNOT ID no. 1456569
atgggttcaataaaaacattctctccatgctccccaccctcacattttcagaatttgaaatcgtcaaaaaactgtaactcctcaacttctttgaagccactactatgttccatgaatccactcaacatccacagcaggcacaaactgcacatctcatcaaatatctgttctaagtcaccatttcctcagatacccacttcaagtatctccaaaaaaaacaacaatttcaccagttttttgtctgagaaggtgctggtttcccttgttggggccttcatttttattggttcttttggtttaaatactaggcaaagtttggcacttccggctcaaacaagtggtggtagtgtgaatttagagggaaagagagatgcccagatggagaaaagtgaggacgaggagatgtatgagaaggttttggagaaggagccaaggaatgtggaggcattgaaggtggttctgcatgggaagatgaggagaggacagactaaagaggctgtgaagtatgttgggaggttgattgagatcgagcccgaggaagttgaatggaggcttttggaggcactttgttatgagatgatggggcaattgaacaaggctaaaaggttgttcaacgaaatcttggaagagagaccacttttgcttagagctttgcacggtttagcactggttatgcacaaaaatcttgaaggtcctgctgtctttgagatgctgaataaagctctagaagttgcccatcgtgaaaaaagagtaactgaggagagaaacattagaattctaattgcgcaaatgcatgttgtcaagggggattttgaggaggctttgaagaaatttcaaggcctggttagcgacaacccacgagattttcgaccttatctttgccagggaataatatacagtctgttggatagaaaagaagaagctgcagaacagtttgagacatatcggagtcttgtgcctgaagaatttccacaaaggatatttcttgatgatgttgtattggaagcaaaaaccaagtccagggagcggtttcaaaaggagtttcaagctgaattctcgtacaggaagtaa

SEQ ID NO: 440 - protein, 319 aa, Populus balsamifera subsp. trichocarpa
  misc_feature (1)..(319): Ceres ANNOT ID no. 1456569
  misc_feature (1)..(319): Functional Homolog of  Ceres CLONE ID no.  125917
  misc_feature (144)..(177): Pfam Name: TPR_2 Pfam Description: Tetratricopeptide repeat
MNPLNIHSRHKLHISSNICSKSPFPQIPTSSISKKNNNFTSFLSEKVLVSLVGAFIFIGSFGLNTRQSLALPAQTSGGSVNLEGKRDAQMEKSEDEEMYEKVLEKEPRNVEALKVVLHGKMRRGQTKEAVKYVGRLIEIEPEEVEWRLLEALCYEMMGQLNKAKRLFNEILEERPLLLRALHGLALVMHKNLEGPAVFEMLNKALEVAHREKRVTEERNIRILIAQMHVVKGDFEEALKKFQGLVSDNPRDFRPYLCQGIIYSLLDRKEEAAEQFETYRSLVPEEFPQRIFLDDVVLEAKTKSRERFQKEFQAEFSYRK

SEQ ID NO: 441 - DNA, 1071 bp, Populus balsamifera subsp. trichocarpa
  misc_feature (1)..(1071): Ceres ANNOT ID no. 1450998
atgggttcaattaaaacattctctgcttaccctccatcatcacaatttcagaatttgaaattgtcaaaagattgcttcttcttcaatccactaaaacccccactatgttccttcaatccactcaacatccacaacaggcacagactacgcatatcctcaaaacactcttgtatgtcaccctttcctcaaatactcacttctagtctctccaagacaaactacaaattcaccaattttttgtccgagaaggttttggtttcccttgttggggcattcatttttattggttcttttggtttaaatactaggcaaagtttggcgcttcctgctcaaacaactggtcctagtgtgaatttagaggaaaagagagatgcccatatggagaaaagtgaggatgaggagatgtttgagaaggttttggagatggagccaaggaatgtggaggcattgaaggtcgttgtgcatgggaaaatgaggagaggacagactaaagaggctgtgaagtatgtcgagaggttgattgatattgagcctgagcaagttgaatggaggcttttggaggcactttgttatgagatgatggggcagttgagtaaggctaaaacgttgttcaaggaaatcttgatagagagacctcttttgcttagagctttgcacggtctggcattggtgatgcacaaaagtcttgaaggtccagctgtctttgagatgctgaataaagctctggaagttgcccgtcgtgaaaaaagagtcactgaggagagaaacattagaattctaattgcacaaatgcttgttgtcaagggggaattggaggaagctttgaagaaatttcaaggtctggttagtgacaacccacgagattttcggccttatctttgccagggaataatatacagtctgttgggtagaaaagaagcagctgcggaacattttgaaacgtatcagagccttgtgccagatgaatttccacaaaggatgtttcttgatgatgttgtattggaagcgaaaaccaagtcccgggaatggtttcaggaggagtgtcaagctgaatcctcatacaagaaataa

SEQ ID NO: 442 - protein, 299 aa, Populus balsamifera subsp. trichocarpa
  misc_feature (1)..(299): Ceres ANNOT ID no. 1450998
  misc_feature (1)..(299): Functional Homolog of  Ceres CLONE ID no.  125917
  misc_feature (232)..(265): Pfam Name: TPR_2 Pfam Description: Tetratricopeptide repeat
MSPFPQILTSSLSKTNYKFTNFLSEKVLVSLVGAFIFIGSFGLNTRQSLALPAQTTGPSVNLEEKRDAHMEKSEDEEMFEKVLEMEPRNVEALKVVVHGKMRRGQTKEAVKYVERLIDIEPEQVEWRLLEALCYEMMGQLSKAKTLFKEILIERPLLLRALHGLALVMHKSLEGPAVFEMLNKALEVARREKRVTEERNIRILIAQMLVVKGELEEALKKFQGLVSDNPRDFRPYLCQGIIYSLLGRKEAAAEHFETYQSLVPDEFPQRMFLDDVVLEAKTKSREWFQEECQAESSYKK

SEQ ID NO: 443 - protein, 333 aa, Medicago truncatula
  misc_feature (1)..(333): Public GI no. 92873189
  misc_feature (1)..(333): Functional Homolog of  Ceres CLONE ID no.  125917
MASTATTTLFISSEFKPNLPNSLLLPRIRICNKPLSISLQPSKFRATHLSLCNCSRTPLTPSTIFSPQTTLTNFISQKISFFLIGSFIFVACFSRKPAFAVSVPSVDSAEILEEKILEKDSRNVEALKVIVYGKIRRGKCKEAEKFVKRLIDEEPNEVEWRLLLALCYETMGYLSKAKGLYLEILENWPLFVRALHGLAMVMHKNKEGPAVFEMLNKAVELAINENKVTEERNIKILTAQMRVVQGDLEEGLKRCQDLIDQNPRDFRPYLCQGIIYSLLDKKEEAAKQFETYQALVPEEFPQRGFLDDITLAAKGTSPVQFQKEFRNQFSDQK

SEQ ID NO: 444 - DNA, 834 bp, Arabidopsis thaliana
  misc_feature (1)..(834): Ceres CLONE ID no.  14203
  misc_feature (1)..(834): GEMINI ID 532G6
aataaaaatacagattctctcttcttagaaccatcaccgattcgaacagatctaataaatcgtttttttcaccagatttttttcgccggagtttgttttgatccattctgttatggcggaagaacacagacttcaagaaccacgattatgtgctaacaattgtggcttcttcggaagcacagctacacaaaatctctgttccaaatgttttcgagatcttcaacatcaagaacaaaactcttccaccgccaaacatgctcttacccaatccttagccgccgttggcgctgctgcgtcttcctccgtgtcgccaccgcctccgcctccagctgattcgaaagaaatcgttgaagcgaaatcagagaaacgagcggcggctgaaccggaggaggcggatggtccgccgcaagatccgaagcggtgtttgacttgtcggcggcgcgtgggaatcacggggtttcggtgtaggtgtggtttcgttttctgcgggacgcataggtacgcggagcaacatgaatgttcgtttgatttcaagcggatggggaaggataagatcgctaaagcgaatccgattgtgaaagctgataagcttgagaagatttgactttgttgtttgttgtttgttgttgttgctttggttttgtgcgtttgaatgaaacacacatgaagaagaaagagcaagaaacaaacatgtcaatgtaaatttaagctttatttgatgatttcttcagtttggttattaaatttgcttattattgatttgattgttccgtttgatgatcttgtagaaggcttaagtcgtattatcaatgtgtagaatttggatttggttgg

SEQ ID NO: 445 - protein, 163 aa, Arabidopsis thaliana
  misc_feature (1)..(163): Ceres CLONE ID no.  14203
  misc_feature (1)..(163): GEMINI ID 532G6
  misc_feature (10)..(34): Pfam Name: zf-A20 Pfam Description: A20-like zinc finger
  misc_feature (104)..(144): Pfam Name: zf-AN1 Pfam Description: AN1-like Zinc finger
MAEEHRLQEPRLCANNCGFFGSTATQNLCSKCFRDLQHQEQNSSTAKHALTQSLAAVGAAASSSVSPPPPPPADSKEIVEAKSEKRAAAEPEEADGPPQDPKRCLTCRRRVGITGFRCRCGFVFCGTHRYAEQHECSFDFKRMGKDKIAKANPIVKADKLEKI

SEQ ID NO: 446 - protein, 169 aa, Glycine max
  misc_feature (1)..(169): Ceres CLONE ID no. 1021029
  misc_feature (1)..(169): Functional Homolog of  Ceres CLONE ID no.  14203
  misc_feature (10)..(34): Pfam Name: zf-A20 Pfam Description: A20-like zinc finger
  misc_feature (110)..(150): Pfam Name: zf-AN1 Pfam Description: AN1-like Zinc finger
MSEEHRLQEPRLCANDCGFFGNTATQNLCSKCFRDLKHEQENSSTAKNALKQTLAACVASSSVSSPPPPPPPADLTSDLKEVNTENPGKRAASEPEEEEEQKPPQDPKRCLTCRRRVGITGFRCRCGFVFCGTHRYAEQHECTFDFKRVGKEKIAKANPIVKAEKLEKI

SEQ ID NO: 447 - protein, 169 aa, Brassica napus
  misc_feature (1)..(169): Ceres CLONE ID no. 974951
  misc_feature (1)..(169): Functional Homolog of  Ceres CLONE ID no.  14203
  misc_feature (10)..(34): Pfam Name: zf-A20 Pfam Description: A20-like zinc finger
  misc_feature (110)..(150): Pfam Name: zf-AN1 Pfam Description: AN1-like Zinc finger
  misc_feature (62)..(62): Xaa is any aa, unknown, or other
  misc_feature (169)..(169): Xaa is any aa, unknown, or other
MSEEHRLQEPRLCANDCGFFGNTATQNLCSKCFRDLKHEQENSSTAKNALKQTLAACVASSXVSSPPPPPPPADLTSDLKEVNTENPGKRAASEPEEEEEQKPPQDPKRCLTCRRRVGITGFRCRCGFVFCGTHRYAEQHECTFDFKRVGKEKIAKANPIVKAEKLEKX

SEQ ID NO: 448 - DNA, 480 bp, Populus balsamifera subsp. trichocarpa
  misc_feature (1)..(480): Ceres ANNOT ID no. 1460527
atggcagaagaacaacaccgatgccaagaaccacgtctctgcgtaaacaactgcggtttttttggaagcccagcaactcaaaatctgtgttctaaatgttatggtgatcttcgtcaatcacagcccctgaatcagctcctagccccatcatcatctgcttctgtttcttccttttcatccccaaccgtcgatgttataaagaaccagatagctcccgtgttggtggtggaaggtgatgaaaaaggggagtttaaggctgaacctacggttgtggttccacagcagaagccaaataggtgcttgacgtgtaggaggcgcgtagggttgacgggatttaattgcaggtgtggtatggtgttttgtggaacgcataggtacccagaacaacatgattgtgagtttgattttaagagcttaggtaaagaacagatcgctaaggctaatcctgttgttaagggtgagaagcttcaaaggatttaa

SEQ ID NO: 449 - protein, 159 aa, Populus balsamifera subsp. trichocarpa
  misc_feature (1)..(159): Ceres ANNOT ID no. 1460527
  misc_feature (1)..(159): Functional Homolog of  Ceres CLONE ID no.  14203
  misc_feature (100)..(140): Pfam Name: zf-AN1 Pfam Description: AN1-like Zinc finger
  misc_feature (11)..(35): Pfam Name: zf-A20 Pfam Description: A20-like zinc finger
MAEEQHRCQEPRLCVNNCGFFGSPATQNLCSKCYGDLRQSQPLNQLLAPSSSASVSSFSSPTVDVIKNQIAPVLVVEGDEKGEFKAEPTVVVPQQKPNRCLTCRRRVGLTGFNCRCGMVFCGTHRYPEQHDCEFDFKSLGKEQIAKANPVVKGEKLQRI

SEQ ID NO: 450 - DNA, 951 bp, Gossypium hirsutum
  misc_feature (1)..(951): Ceres CLONE ID no.1853189
atttttcctcgtttactttatcttcttctttccattctgattataataagatttgggtttcgttttcctgtgaaactctcgtctctggtaaattttccctcggttttttttgggggtttatttttatttgtcatgaacctatggctttttatttgatttctgttaaacggggggtttttttttataggtttgaaaggagattgaaaaaatatggctgaagaacatagatgtcaagcaccacagttatgtgccaacaactgtggattcttcggaagcccaacgactcaaaatctctgttctaaatgttatcgcgatcttcaacttaaagaacaacaatcttcctctgccaaacaagcctttaatcacactttagttccttcgtcgtcttcattgccatcgtcatcatcggcccgatcttcgttttcggcatccttgccggcgaaggaggaaccatcggcgggaacgaaggaaacgaaggtggtggaggaggaggaagttcaggttacgccaaacagatgcttgagttgcaagaaacgcgtggggctcacggggttcaagtgcaggtgcgggatggttttttgtgggatccataggtaccctgaacaacatgcttgtgcttttgatttcaaagggatgggaaaacaacaaatcgccaaagctaatcctcttgttaagggtgagaagcttcaaaaaatataaataaaattgactgaaggaaaaaaaagggggggggatgggtttttttccgattgtgtctgtcaaatttaagaatctgggtcatcggaaaactgatgaaatttagattgatgatgggatctagccggtcggtggccggtcaagcagtaggaagtgttttaggtggttgtcgttgttgcctataaatggtataattcacgttttcttaaattatatcgtcaatgttggttttccgaaaaaaaaaaaaaaaaaaaa

SEQ ID NO: 451 - protein, 162 aa, Gossypium hirsutum
  misc_feature (1)..(162): Ceres CLONE ID no. 1853189
  misc_feature (1)..(162): Functional Homolog of  Ceres CLONE ID no.  14203
  misc_feature (10)..(34): Pfam Name: zf-A20 Pfam Description: A20-like zinc finger
  misc_feature (103)..(143): Pfam Name: zf-AN1 Pfam Description: AN1-like Zinc finger
MAEEHRCQAPQLCANNCGFFGSPTTQNLCSKCYRDLQLKEQQSSSAKQAFNHTLVPSSSSLPSSSSARSSFSASLPAKEEPSAGTKETKVVEEEEVQVTPNRCLSCKKRVGLTGFKCRCGMVFCGIHRYPEQHACAFDFKGMGKQQIAKANPLVKGEKLQKI

SEQ ID NO: 452 - protein, 170 aa, Medicago truncatula
  misc_feature (1)..(170): Public GI no. 92896423
  misc_feature (1)..(170): Functional Homolog of  Ceres CLONE ID no.  14203
  misc_feature (11)..(35): Pfam Name: zf-A20 Pfam Description: A20-like zinc finger
  misc_feature (111)..(151): Pfam Name: zf-AN1 Pfam Description: AN1-like Zinc finger
MAEEHRCQAAQRLCANNCGFFGSPAMQDLCSKCYRDLQMKEQRSSSAKLVLNQTLIPQQSNSSSLDTGIIHPSSTSPSVMIVSSSTPTVELVAAAAGPSEAEPPKVQPNRCGTCRRRVGLTGFKCRCGLTLCGTHRYPEQHGCGFDFKGMGREEIKKANPVVKGEKLNKI

SEQ ID NO: 453 - DNA, 569 bp, Gossypium hirsutum
  misc_feature (1)..(569): Ceres CLONE ID no.1853430
ccttctgattataataagatttgggtttcgttatcctctgaaactctcgtctctggtttgaaaggagattgaaaaaatatggctgaagaacatagatgtcaagcaccacagttatgtgccaacaactgtggatttttcggaagcccgacgactcaaaatctctgctctaaatgttatcgcgatcttcaacttaaagaacaacaatcttcctctgccaaacaagcctttaatcacactttcgttccttcgtcgtcttcattgccatcgtcatcatcggcccgatcttcgttttcggcatccttgccggtggaggatgaaccatcggcgggaacgaaggaaacgaaggtggtggagggggaggaagttcaggttacgccaaacagatgcttgagttgcaagaaacgcgtggggctcacggggttcaagtgcaggtgcgggatggttttttgtgggatccataggtaccctgaacaacatgcttgtacttttgatttcaaagggatgggaaaacaacaaatcgccaaagctaatcctcttgttaagggtgagaagcttcaaaaaatataaat

SEQ ID NO: 454 - protein, 162 aa, Gossypium hirsutum
  misc_feature (1)..(162): Ceres CLONE ID no. 1853430
  misc_feature (1)..(162): Functional Homolog of  Ceres CLONE ID no.  14203
  misc_feature (10)..(34): Pfam Name: zf-A20 Pfam Description: A20-like zinc finger
  misc_feature (103)..(143): Pfam Name: zf-AN1 Pfam Description: AN1-like Zinc finger
MAEEHRCQAPQLCANNCGFFGSPTTQNLCSKCYRDLQLKEQQSSSAKQAFNHTFVPSSSSLPSSSSARSSFSASLPVEDEPSAGTKETKVVEGEEVQVTPNRCLSCKKRVGLTGFKCRCGMVFCGIHRYPEQHACTFDFKGMGKQQIAKANPLVKGEKLQKI

SEQ ID NO: 455 - protein, 157 aa, Musa acuminata
  misc_feature (1)..(157): Ceres CLONE ID no. 1734621
  misc_feature (1)..(157): Functional Homolog of  Ceres CLONE ID no.  14203
  misc_feature (11)..(35): Pfam Name: zf-A20 Pfam Description: A20-like zinc finger
  misc_feature (98)..(138): Pfam Name: zf-AN1 Pfam Description: AN1-like Zinc finger
MAEEQRCQEGHRLCANNCGFLGSPATLNLCPKCYRDHRLKEEQQRQDASHAANVAAAEKPPHASSSASVVASPAGNARGPPALASPAVAAAAAGPSRCAMCRKRVGLTGFRCRCGATHCGAHRHAEQHSCTFDFKAAGREAITRANPVVKADKLNRI

SEQ ID NO: 456 - protein, 154 aa, Oryza sativa
  misc_feature (1)..(154): Public GI no. 50909195
  misc_feature (1)..(154): Functional Homolog of  Ceres CLONE ID no.  14203
  misc_feature (12)..(36): Pfam Name: zf-A20 Pfam Description: A20-like zinc finger
  misc_feature (94)..(134): Pfam Name: zf-AN1 Pfam Description: AN1-like Zinc finger
MAEEQRWQEGCHRLCANNCGFFGSPATLDLCSKCYRDRQGRESTAPVVVAAAASACPATHPSSPSSSSCPAFLPSSTAAEAGVVVAAVAKASRCASCRKRVGLTGFACRCGGTFCGAHRYPERHACGFDFKAAGRDAIARANPLIKGDKLKDKI

SEQ ID NO: 457 - protein, 137 aa, Gossypium hirsutum
  misc_feature (1)..(137): Public GI no. 66271037
  misc_feature (1)..(137): Functional Homolog of  Ceres CLONE ID no.  14203
  misc_feature (10)..(34): Pfam Name: zf-A20 Pfam Description: A20-like zinc finger
  misc_feature (103)..(130): Pfam Name: zf-AN1 Pfam Description: AN1-like Zinc finger
MAEEHRCQAPQLCANNCGFFGSPTTQNLCSECYRGLQLKEQQSSSAKQAFNHTLVPSSSSLPSSSSARSSFSASLPAKEEPSAGTKETKVVEEEEVQVTPNRCLSCKKRVGLTGFKCRCGMVFCGIHRYPGTTCLCF

SEQ ID NO: 458 - DNA, 504 bp, Populus balsamifera subsp. trichocarpa
  misc_feature (1)..(504): Ceres ANNOT ID no. 1450673
atggcagaagaacaacacagatgccaagaacaacgactctgcgtaaacaactgcggcttttatgggagccaagcaacagaaaatctttgttccaagtgttaccgtgatcttcatcaatcacagcccttgaatcatcagctgctaaacccatcatcatcatcggctgcttctgtttcctcctttgcatccccagccgttgatgttctaaaagtcaacaccaaccagaaagctcctgttgtggtggtgggagatgataaaaaagatgaggtaaaggcaggagagcctgcggctgggaagcagcagcagcataagccaaataggtgcttgacgtgtaggaggcgcgtggggttgacggggttcaagtgcaggtgtggtatggtgttttgtggaacacataggtacccggaacagcatgattgcgaatttgattttaagagtttagggaaacaacagattgctaaggctaatcccgttgttaagggagagaaactccaaaaaatttaa

SEQ ID NO: 459 - protein, 167 aa, Populus balsamifera subsp. trichocarpa
  misc_feature (1)..(167): Ceres ANNOT ID no. 1450673
  misc_feature (1)..(167): Functional Homolog of  Ceres CLONE ID no.  14203
  misc_feature (108)..(148): Pfam Name: zf-AN1 Pfam Description: AN1-like Zinc finger
  misc_feature (11)..(35): Pfam Name: zf-A20 Pfam Description: A20-like zinc finger
MAEEQHRCQEQRLCVNNCGFYGSQATENLCSKCYRDLHQSQPLNHQLLNPSSSSAASVSSFASPAVDVLKVNTNQKAPVVVVGDDKKDEVKAGEPAAGKQQQHKPNRCLTCRRRVGLTGFKCRCGMVFCGTHRYPEQHDCEFDFKSLGKQQIAKANPVVKGEKLQKI

SEQ ID NO: 460 - DNA, 909 bp, Arabidopsis thaliana
  misc_feature (1)..(909): Ceres CLONE ID no.  1480
  misc_feature (1)..(909): GEMINI ID 532B12
aatataaaccacatatcctctcctccatatcttaacaatttcatagcaaaccctaaaattgagaaagagatagagagagaaagatgggtagaggaaagatcgagataaagaggatagagaacgcaaacaacagagtggtgacgttctcaaagaggaggaatggattggtgaagaaggctaaagagatcacagttctttgtgatgcaaaagttgccctcataatctttgcaagtaatggtaagatgattgattactgttgtccttccatggatcttggtgctatgttggaccaataccagaagttatctggcacaaactatgggatgctaagcatgagaaccttagcaatgagattgataggatcaagaaagagaatgatagcttacaactggagctcaggcatttgaagggagaagatatacagtctctcaacttgaaaaatctgatggctgtcgagcacgccattgaacatggcctcgacaaagtccgagaccaccagatggagatccttatatcaaaaaggagaaatgagaagatgatggcggaggagcaacggcaactcactttccagctgcaacaacaggagatggctatagcaagcaacgcaagaggaatgatgatgagagatcatgatgggcagtttggatatagagtgcaaccgattcagccaaatcttcaggaaaagattatgtctttggtcatcgattgatcatcgagattttataatctcatcctgatcaactcctatctataatatcgtggtctttagtttgtctttatcaatctgtgtgtcttaatctcgagcaacatatatactcgctatcagactttttacttaagctatatgtgtgttgtttgcttatgacctctatgtattggttgtgttgtgtgcttaaacgtttcgaactc

SEQ ID NO: 461 - protein, 107 aa, Arabidopsis thaliana
  misc_feature (1)..(107): Ceres CLONE ID no.  1480
  misc_feature (1)..(107): GEMINI ID 532B12
  misc_feature (9)..(59): Pfam Name: SRF-TF Pfam Description: SRF-type transcription factor (DNA-binding and dimerisation domain)
MGRGKIEIKRIENANNRVVTFSKRRNGLVKKAKEITVLCDAKVALIIFASNGKMIDYCCPSMDLGAMLDQYQKLSGTNYGMLSMRTLAMRLIGSRKRMIAYNWSSGI

SEQ ID NO: 462 - protein, 112 aa, Brassica napus
  misc_feature (1)..(112): Ceres CLONE ID no. 1067639
  misc_feature (1)..(112): Functional Homolog of  Ceres CLONE ID no.  1480
  misc_feature (71)..(112): Pfam Name: K-box Pfam Description: K-box region
  misc_feature (9)..(59): Pfam Name: SRF-TF Pfam Description: SRF-type transcription factor (DNA-binding and dimerisation domain)
  misc_feature (111)..(111): Xaa is any aa, unknown, or other
MGRGKIEIKRIENANNRVVTFSKRRNGLVKKAKEITVLCDAKVALIVFASNGKMTDYCCPSMDLGAMLDQYQKLSGKKLWDAKHENLSNEIDRIKKENDNLQLELRHLKGXD

SEQ ID NO: 463 - protein, 141 aa, Brassica napus
  misc_feature (1)..(141): Ceres CLONE ID no. 1068473
  misc_feature (1)..(141): Functional Homolog of  Ceres CLONE ID no.  1480
  misc_feature (71)..(141): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENVNNRVLTFSKRRNGLVKKAKEITVLCDAKVALIVFASNGKMTDYCCPSMDLGAMLDQYQKLSGNKLWDAKHENLSNEIDKIKKENDSLQLELRHLKGEDIQSLNLKNLMAVEHAVEHGLDKVRDHQME

SEQ ID NO: 464 - DNA, 932 bp, Arabidopsis thaliana
  misc_feature (1)..(932): Ceres CLONE ID no.  1492
  misc_feature (1)..(932): GEMINI ID 532H11
aagccaaagccacatagaagaaaaaaaaaagaacattcacgtctctctcgtttttttggccgacgacgatcgctgaattgactgccggagattcctttaatcgtcagattctcgttgagggataatgaatcctgaatatgactatctgttcaagcttctgcttattggtgattctggtgttggaaaatcatgcttgcttctaagatttgctgatgattcttacctggatagctacataagcaccattggtgttgactttaaaattcgcacagttgagcaggacggaaagaccatcaaactccagatctgggacacagcaggccaagaacgtttcaggacaatcactagcagctactacagaggagctcatgggatcattgtcacttatgatgtcacagacctagagagcttcaacaacgtcaaacaatggctgaatgaaattgaccgttacgctagcgaaaatgtgaacaagctactggttgggaacaagaacgatctcacttcacagaaagttgtatccactgagacagctaaggcttttgcagatgaacttgggatcccattcttggaaacaagtgctaaaaatgcaaccaatgtggaagaagctttcatggctatgactgctgcaattaagacaagaatggctagccaaccagctggaggtgccaagccaccaacggtccagatccgtggacagccagtgaaccagcaatcaggctgttgttcttcttgattcaattagtcaccactcctctttcgatcatcacaccattatgatcatttgtttgcattgcatgttagacttctccaaattaacaactctttggatccttttgcttgtttttcatttgctttcttttgatccgattcttttctgatgtacgttgaagtttgaaacccataacttctatatagtaaaaggtcttttatgc

SEQ ID NO: 465 - protein, 202 aa, Arabidopsis thaliana
  misc_feature (1)..(202): Ceres CLONE ID no.  1492
  misc_feature (1)..(202): GEMINI ID 532H11
  misc_feature (10)..(171): Pfam Name: Ras Pfam Description: Ras family
MNPEYDYLFKLLLIGDSGVGKSCLLLRFADDSYLDSYISTIGVDFKIRTVEQDGKTIKLQIWDTAGQERFRTITSSYYRGAHGIIVTYDVTDLESFNNVKQWLNEIDRYASENVNKLLVGNKNDLTSQKVVSTETAKAFADELGIPFLETSAKNATNVEEAFMAMTAAIKTRMASQPAGGAKPPTVQIRGQPVNQQSGCCSS

SEQ ID NO: 466 - protein, 203 aa, Brassica oleracea
  misc_feature (1)..(203): Public GI no. 89257443
  misc_feature (1)..(203): Functional Homolog of  Ceres CLONE ID no.  1492
  misc_feature (10)..(171): Pfam Name: Ras Pfam Description: Ras family
MNPEYDYLFKLLLIGDSGVGKSCLLLRFADDSYLDSYISTIGVDFKIRTVEQDGKTIKLQIWDTAGQERFRTITSSYYRGAHGIIVTYDVTDQESFNNVKQWLNEIDRYASENVNKLLVGNKNDLTSQKVVSTETAQAFADELGIPFLETSAKNATNVEEAFMAMTAAIKTRMASQPSGGAKPPTVQIRGQPVNQQQSGCCSS

SEQ ID NO: 467 - protein, 123 aa, Brassica napus
  misc_feature (1)..(123): Ceres CLONE ID no. 1128644
  misc_feature (1)..(123): Functional Homolog of  Ceres CLONE ID no.  1492
  misc_feature (6)..(121): Pfam Name: Ras Pfam Description: Ras family
  misc_feature (4)..(4): Xaa is any aa, unknown, or other
MTIXFKLLLIGDSGVGKSCLLLRFADDSYLDSYISTIGVDFKIRTVEQDGKTIKLQIWDTAGQERFRTITSSYYRGAHGIIVTYDVTDQESFNNVKQWLNEIDRYASENVNKLLVGNKCDLTS

SEQ ID NO: 468 - protein, 202 aa, Cicer arietinum
  misc_feature (1)..(202): Public GI no. 4586580
  misc_feature (1)..(202): Functional Homolog of  Ceres CLONE ID no.  1492
  misc_feature (10)..(171): Pfam Name: Ras Pfam Description: Ras family
MNPEYDYLFKLLLIGDSGVGKSCLLLRFADDSYLDSYISTIGVDFKIRTVEQDGKTIKLQIWDTAGQERFRTITSSYYRGAHGIIVVYDVTDQESFNNVKQWLNEIDRYASENVNKLLVGNKCDLAANKVVSSETAKAFADEIGIPFMETSAKNATNVEQAFMAMAAEIKNRMASQPANNARPPTVQIRGQPMNQKSGCCST

SEQ ID NO: 469 - DNA, 1035 bp, Gossypium hirsutum
  misc_feature (1)..(1035): Ceres CLONE ID no.1835140
aacaattctggctctttattatttatgacaacgatacgcaaacacgtagcttttgcttcttcgaattctcctccatctcacggtaacaagatctcccttcccctctctttctctccggcggcgatctcaaatcaccggtaaatcgcaccgtaacgcccgattactcgtcacctctgtgatctccgctgacacctcgtggtttcagtttattctaactcttcgccatcatgaatcctgaatatgattatctctttaagcttttgcttattggtgattctggtgttgggaaatcatgtctacttttgaggtttgctgatgattcatatctggatagctacatcagtaccattggtgttgactttaaaatccgtactgtggaacaggatggaaaaaccatcaaactccaaatttgggacactgctggccaagaacgctttaggacaatcactagtagctattatcgtggggctcacggtatcatagttgtttatgacgtgacagaccaagagagtttcaacaatgtcaagcaatggctaaacgaaattgaccgctatgccagtgacaatgtgaacaaacttttggttgggaacaagtgtgatctaacagcaaacaaagttgtgtcatatgagacagctaaagcttttgctgatgaaattgggattcccttcttggaaacaagtgcaaaggatgccactaatgttgaagaggctttcatggccatggctgcttcaatcaagaataggatggctagccaaccaggcatgaacaatgcgagacctccaacggtgaatatcaaaggacagcctgttaaccagaactctggttgctgctcttcttaaatgaaaatttagttttagttggtccatgtgatgatatttgtccttttgtgttatttgttgcatgtagttgggggaaaaaaaaactagtcttatttttatttcatttgatagtaaaagatggttctacatgatttttatattcttatctttttttgttatattaaatactcaattctaaaaaaaaaaaaaaaaaaaa

SEQ ID NO: 470 - protein, 203 aa, Gossypium hirsutum
  misc_feature (1)..(203): Ceres CLONE ID no. 1835140
  misc_feature (1)..(203): Functional Homolog of  Ceres CLONE ID no.  1492
  misc_feature (10)..(171): Pfam Name: Ras Pfam Description: Ras family
MNPEYDYLFKLLLIGDSGVGKSCLLLRFADDSYLDSYISTIGVDFKIRTVEQDGKTIKLQIWDTAGQERFRTITSSYYRGAHGIIVVYDVTDQESFNNVKQWLNEIDRYASDNVNKLLVGNKCDLTANKVVSYETAKAFADEIGIPFLETSAKDATNVEEAFMAMAASIKNRMASQPGMNNARPPTVNIKGQPVNQNSGCCSS

SEQ ID NO: 471 - protein, 203 aa, Oryza sativa
  misc_feature (1)..(203): Public GI no. 50911379
  misc_feature (1)..(203): Functional Homolog of  Ceres CLONE ID no.  1492
  misc_feature (10)..(171): Pfam Name: Ras Pfam Description: Ras family
MNPEYDYLFKLLLIGDSGVGKSCLLLRFADDSYLDSYISTIGVDFKIRTVEQDGKTIKLQIWDTAGQERFRTITSSYYRGAHGIIIVYDVTDQESFNNVKQWLNEIDRYASDNVNKLLVGNKSDLTANKVVSSETAKAFADEMGIPFMETSAKNATNVEQAFMAMAASIKDRMASQPAAANARPPTVQIRGQPVNQKTSCCSS

SEQ ID NO: 472 - DNA, 621 bp, Populus balsamifera subsp. trichocarpa
  misc_feature (1)..(621): Ceres ANNOT ID no. 1538756
atggaaagaaaaaaaaaaaaactatgtgattttgatttatttttttgcagcgattatttgttcaagcttttgcttattggagattctggtgtcggaaaatcatgtctacttctgagttacatcagtaccattggagtggactttaaaatccgtactgtggaacaggatggaaaaacaatgaaactccaaatttgggacacagctggacaagagcgttttaggacaatcacaagcagttactatcgtggagctcatggaatcattgttgtttatgatgtcacagatcaagagagcttcaacaatgttaaacaatggttgagtgaaattgaccgttatgcaagtgaaaatgtgaacaagcttctagttggaaacaagagcgatctcacagctaacaaagtcgtctcctatgagacagcaaaggcatttgcggatgaaattgggatccctttcattgagacaagcgcaaaaaattccaccaatgttgagcaggccttcatggctatggccgcagagatcaagaacaggatggcaagccagccagccatgaacaacgcaaggcccccaacagtgcagattcgaggacagcctgtgaaccagaattctggctgctgctcatcttag

SEQ ID NO: 473 - protein, 206 aa, Populus balsamifera subsp. trichocarpa
  misc_feature (1)..(206): Ceres ANNOT ID no. 1538756
  misc_feature (1)..(206): Functional Homolog of  Ceres CLONE ID no.  1492
  misc_feature (22)..(174): Pfam Name: Ras Pfam Description: Ras family
MERKKKKLCDFDLFFCSDYLFKLLLIGDSGVGKSCLLLSYISTIGVDFKIRTVEQDGKTMKLQIWDTAGQERFRTITSSYYRGAHGIIVVYDVTDQESFNNVKQWLSEIDRYASENVNKLLVGNKSDLTANKVVSYETAKAFADEIGIPFIETSAKNSTNVEQAFMAMAAEIKNRMASQPAMNNARPPTVQIRGQPVNQNSGCCSS

SEQ ID NO: 474 - DNA, 1043 bp, Gossypium hirsutum
  misc_feature (1)..(1043): Ceres CLONE ID no.1840642
atagtcatactctcttttgtcccgtcttttcagtctctgccttttcatttcctttctctcaatcttacctccgttgattgctttttgccaatcggcgtgagatcttgctgatctgtcgccggaactttcatttagattccggcgatcgcatcgatctttttttttttcttttaatctttatgctacaatgaatcccgaatatgactacctgttcaagcttctgcttattggagattctggtgttggaaaatcttgtcttcttttgagatttgctgatgattcatatgtagaaagctacataagcaccattggggttgattttaaaatacgtactgtggagcaggatgggaaaaccattaaacttcaaatttgggatactgctggacaagaacggtttaggacaatcactagtagctactaccgtggtgcccatggcataataatcgtttatgatgtgacagaccaagaaagcttcaacaatgtcaagcagtggctgagtgaaattgatcgctatgctagtgataacgttaacaaactactggttggaaacaagtgtgaccttacagctaataaagttgtgtcatacgaaacagccaaggcatttgcagatgaaattggcataccttttttggaaaccagtgcaaaagatgccacaaatgttgaacaagctttcatggccatggctgcctctgtcaaagatagaatggcaagccaaccaacggcaaacaatgcaaagcctccaacagtacagatccgaggtcagcctgttgcacagcagagtggctgctgctcttcctaatgtaaaggttaatgatgtattaggaagctatctttcttatgcagtatgctgcctttcgtggcatgtaagattacttgtttcttaactccataggtttaatgaacttattatttcttcggaccgacctcattagaggatctaattcatttctgcatacttgttaatgtgaagggcttgtgcactgtatgattgttggttaaataataggtgttctttctcaaagcaaaaaaaaaaaaaaaaaaaa

SEQ ID NO: 475 - protein, 203 aa, Gossypium hirsutum
  misc_feature (1)..(203): Ceres CLONE ID no. 1840642
  misc_feature (1)..(203): Functional Homolog of  Ceres CLONE ID no.  1492
  misc_feature (10)..(171): Pfam Name: Ras Pfam Description: Ras family
MNPEYDYLFKLLLIGDSGVGKSCLLLRFADDSYVESYISTIGVDFKIRTVEQDGKTIKLQIWDTAGQERFRTITSSYYRGAHGIIIVYDVTDQESFNNVKQWLSEIDRYASDNVNKLLVGNKCDLTANKVVSYETAKAFADEIGIPFLETSAKDATNVEQAFMAMAASVKDRMASQPTANNAKPPTVQIRGQPVAQQSGCCSS

SEQ ID NO: 476 - protein, 203 aa, Nicotiana tabacum
  misc_feature (1)..(203): Public GI no. 311907
  misc_feature (1)..(203): Functional Homolog of  Ceres CLONE ID no.  1492
  misc_feature (10)..(171): Pfam Name: Ras Pfam Description: Ras family
MNPEYDYLFKLLLIGDSGVGKSCLLLRFADDTYLESYISTIGVDFKIRTVEQDGKTIKLQIWDTAGQERFRTITSSYYRGAHGIIVVYDVTDQESFNNVKQWLSEIDRYASDGVNKILVGNKSDLTANRVVSYETAKAFADEIGIPFLETSAKDATNVEQAFMAMTSAIKNRMASQPANNSAKPPTVNIRGQPVTQSGGCCSS

SEQ ID NO: 477 - DNA, 664 bp, Gossypium hirsutum
  misc_feature (1)..(664): Ceres CLONE ID no.1932400
tgtatttattgtatttctctctgactcagctttcactatttcaggctctctctctcttgcgtgtcgttttcatttcaacctctgccttcttttccattatttttcacccttgtttccatcttctttccgctgacttctcgggtaaatcggtactagatctctgtggtctattgccggaattttcgttcggattccggcgaccccagtcttcgatcctattttctcttcaatccagaatgaatcccgagtatgactatctgttcaaacttttgcttattggagattctggtgttggaaagtcttgtctccttttgagatttgctgatgattcatacatagatagttacataagcaccattggggtagattttaaaatacgcactgtggagcaggatgggaagaccattaaacttcaaatttgggacactgctggacaagaacgatttaggacaatcactagcagctactaccgtggggctcatggcataattgttgtttatgatgtgacagaccaagaaagcttcaacaatgtcaagcagtggctgaatgatattgatcgttatgctagtgataatgttaacaaactactggttggaaacaagtgtgatcttacagaaaacaaagtcgtgtcatacgagaccgctaaggcatttgcagatgaagt

SEQ ID NO: 478 - protein, 203 aa, Gossypium hirsutum
  misc_feature (1)..(203): Ceres CLONE ID no. 1932400
  misc_feature (1)..(203): Functional Homolog of  Ceres CLONE ID no.  1492
  misc_feature (10)..(171): Pfam Name: Ras Pfam Description: Ras family
MNPEYDYLFKLLLIGDSGVGKSCLLLRFADDSYIDSYISTIGVDFKIRTVEQDGKTIKLQIWDTAGQERFRTITSSYYRGAHGIIVVYDVTDQESFNNVKQWLNEIDRYASDNVNKLLVGNKCDLTENKVVSYETAKAFADEVGIPFMETSAKDSMNVEQAFMAMAASIKDRMASQPAMNNARPPTVQIQGQAVAQKSGCCSS

SEQ ID NO: 479 - protein, 203 aa, Lycopersicon esculentum
  misc_feature (1)..(203): Public GI no. 1053067
  misc_feature (1)..(203): Functional Homolog of  Ceres CLONE ID no.  1492
  misc_feature (10)..(171): Pfam Name: Ras Pfam Description: Ras family
MNPEYDYLFKLLLIGDSGVGKSCLLLRFADDSYLDSYISTIGVDFKIRTVEQDGKTIKLQIWDTAGQERFRTITSSYYRGAHGIIIVYDITDQESFNNVKQWLSEIDRYASENVNKLLVGNKSDLNDNRAVSYDTAKAFADEIGIPFMEASAKSATNVEQAFMAMAAEIKNRMATQPASNNAKPPTVQIRGQPVNQKNGCCSS

SEQ ID NO: 480 - protein, 203 aa, Triticum aestivum
  misc_feature (1)..(203): Ceres CLONE ID no. 727613
  misc_feature (1)..(203): Functional Homolog of  Ceres CLONE ID no.  1492
  misc_feature (10)..(171): Pfam Name: Ras Pfam Description: Ras family
MNPEYDYLFKLLLIGDSGVGKSCLLLRFADDSYLDSYISTIGVDFKIRTVEQDGKTIKLQIWDTAGQERFRTITSSYYRGAHGIIIVYDVTDQDSFNNVKQWLNEIDRYASENVNKLLVGNKCDLADKRAVSYETAKAFADEIGIPFMETSAKNALNVEQAFMAMAASIKDRMASQPAANNARPATVQIRGQPVEQKASCCSS

SEQ ID NO: 481 - protein, 203 aa, Oryza sativa
  misc_feature (1)..(203): Public GI no. 34914060
  misc_feature (1)..(203): Functional Homolog of  Ceres CLONE ID no.  1492
  misc_feature (10)..(171): Pfam Name: Ras Pfam Description: Ras family
MNPEYDYLFKLLLIGDSGVGKSCLLLRFADDSYLESYISTIGVDFKIRTVEQDGKTIKLQIWDTAGQERFRTITSSYYRGAHGIIVVYDVTDQESFNNVKQWLNEIDRYASENVNKLLVGNKCDLAENRVVSYEAGKALADEIGIPFLETSAKDATNVEKAFMTMAGEIKNRRMASQPATNASKPATVQMRGQPVAQQSSCCS

SEQ ID NO: 482 - DNA, 1015 bp, Gossypium hirsutum
  misc_feature (1)..(1015): Ceres CLONE ID no.1834939
gctgactcccagcctcttgcgtttgcgtgtcttctcatctctgctttttccccctttttatctttcttcttctttttcttcttcttcttcttcttcttcttactccagccgactttttccggcaaaacggtgtcagatctttgtgatctatagccggaagtttcatttcgagttcgacgatctcatccttcgatctttccactttcttcagcctaccatgaatcccgaatatgactatcttttcaagctacttcttattggagattccggtgttggaaaatcttgccttcttttgagatttgctgatgattcatatgtagaaagttacataagcaccattggggttgattttaaaatacgcactgtggagcaggatgggaagaccattaaacttcaaatttgggacactgctggtcaagaaagatttaggacaattactagcagctactaccgtggggctcatggcataataattgtttatgatgtgacagaccaagaaagcttcaataacgttaggcaatggctgagtgaaattgatcgctatgctagtgataatgttaacaaaatactggttggaaacaagtgtgatcttacagcgaataaagttgtgtcatacgaaacaggcaaggcacttgcagatgaagttggcataccttttatggaaactagtgcaaaagattcaactaatgtggaacaggctttcatggccatggctgcttccatcaaggacagaatggcaagccaaccagccatgaacaatgcaaagcctccaacggtacaaatccgaggacagcctgttgcacaaaagggtggctgctgctcttcctaaaaaatggaatgatgagttagcaggaagctctctctatttcctctgcagtgtgctgctgccagttgcagcacggtgtgtaaggttcaagtgttttcttaacctcatcagtgttccaaacttatttcatatgaacaaaacctcagaagtagaggatataattcatttcaaaaaaaaaaaaaaaaaaaa

SEQ ID NO: 483 - protein, 203 aa, Gossypium hirsutum
  misc_feature (1)..(203): Ceres CLONE ID no. 1834939
  misc_feature (1)..(203): Functional Homolog of  Ceres CLONE ID no.  1492
  misc_feature (10)..(171): Pfam Name: Ras Pfam Description: Ras family
MNPEYDYLFKLLLIGDSGVGKSCLLLRFADDSYVESYISTIGVDFKIRTVEQDGKTIKLQIWDTAGQERFRTITSSYYRGAHGIIIVYDVTDQESFNNVRQWLSEIDRYASDNVNKILVGNKCDLTANKVVSYETGKALADEVGIPFMETSAKDSTNVEQAFMAMAASIKDRMASQPAMNNAKPPTVQIRGQPVAQKGGCCSS

SEQ ID NO: 484 - protein, 203 aa, Chlamydomonas reinhardtii
  misc_feature (1)..(203): Public GI no. 2500073
  misc_feature (1)..(203): Functional Homolog of  Ceres CLONE ID no.  1492
  misc_feature (10)..(171): Pfam Name: Ras Pfam Description: Ras family
MNPEYDYLFKLLLIGDSGVGKSCLLLRFADDTYTESYISTIGVDFKIRTVELDGKVIKLQIWDTAGQERFRTITSSYYRGAHGIIVVYDVTDQESFNNVKQWLNEIDRYASENVNKLLVGNKSDLTSKKVVEYSVAKAFADEIGIPFLETSAKNATNVEQAFMTMAAEIKNRMASQPIPTKAGGPVVRPQEGKPINSKSSSCC

SEQ ID NO: 485 - protein, 258 aa, Arabidopsis thaliana
  misc_feature (1)..(258): Public GI no. 5902803
  misc_feature (1)..(258): Functional Homolog of  Ceres CLONE ID no.  1492
  misc_feature (65)..(226): Pfam Name: Ras Pfam Description: Ras family
MNFNLLHYWAFAHIIIQGPNTESPPLVNRERKSEKRERDLWLCIARCSSSHRSKTMNPEYDYLFKLLLIGDSGVGKSCLLLRFSDDSYVESYISTIGVDFKIRTVEQDGKTIKLQIWDTAGQERFRTITSSYYRGAHGIIIVYDVTDEESFNNVKQWLSEIDRYASDNVNKLLVGNKSDLTENRAIPYETAKAFADEIGIPFMETSAKDATNVEQAFMAMSASIKERMASQPAGNNARPPTVQIRGQPVAQKNGCCST

SEQ ID NO: 486 - DNA, 665 bp, Panicum virgatum
  misc_feature (1)..(665): Ceres CLONE ID no.1785552
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
attactggtccccatttccacatcggacgtggcnnnngcnnnnagagcaggagcagccccccgctccgccgccatgaaccccgagtatgactacctcttcaagctgctgctcatcggggactcgggcgtcgggaagtcttgcctgctgctgaggtttgcggatgattcgtatctggaaagctatatcagtaccattggtgttgattttaaaatccgcactgttgagcaagatgggaagacaataaagctgcagatttgggacactgctggccgagagcgctttacgaccatcacaagcagctactaccgtggagctcatggcatcattgtcgtgtatgatgtgactgaccaggagaacttcaacaatgtcaagcagtggctgaatgaaattgacaggtacgccagtgaaaatgtgaacaagcttttggtggggaacaagtgcgacttggctgagagcagagtagtttcttataaggctggcaaggcccttgctgatgagatagggataccgttcctggagactagtgccaaggatgcaacgaatgtggagaaggcattcatgaccatggcaggagagataaagaacaggatggcaagtcaaccagctgctagtggtgctagcaggcctgcaacagtacaaatgcggggtcagcctgttgctcagc

SEQ ID NO: 487 - protein, 197 aa, Panicum virgatum
  misc_feature (1)..(197): Ceres CLONE ID no. 1785552
  misc_feature (1)..(197): Functional Homolog of  Ceres CLONE ID no.  1492
  misc_feature (10)..(171): Pfam Name: Ras Pfam Description: Ras family
MNPEYDYLFKLLLIGDSGVGKSCLLLRFADDSYLESYISTIGVDFKIRTVEQDGKTIKLQIWDTAGRERFTTITSSYYRGAHGIIVVYDVTDQENFNNVKQWLNEIDRYASENVNKLLVGNKCDLAESRVVSYKAGKALADEIGIPFLETSAKDATNVEKAFMTMAGEIKNRMASQPAASGASRPATVQMRGQPVAQ

SEQ ID NO: 488 - protein, 203 aa, Volvox carteri
  misc_feature (1)..(203): Public GI no. 401686
  misc_feature (1)..(203): Functional Homolog of  Ceres CLONE ID no.  1492
  misc_feature (10)..(171): Pfam Name: Ras Pfam Description: Ras family
MNPEYDYLFKLLLIGDSGVGKSCLLLRFADDTYTESYISTIGVDFKIRTVELDGKVIKLQIWDTAGQERFRTITSSYYRGAHGIIVVYDVTDQESFNNVKQWLAEIDRYASENVNKLLVGNKSDLTGKKVVDYQAAKAFADEIGIPFLETSAKNATNVEQAFMTMAAEIKNRMASQPVPPKPGGPVVRPTEGKPINNKSSSCC

SEQ ID NO: 489 - DNA, 1182 bp, Arabidopsis thaliana
  misc_feature (1)..(1182): Ceres CLONE ID no.  156298
  misc_feature (1)..(1182): GEMINI ID 555C11
atcatcaatagcgaaaagtcgcttcttttttcttcttccaaaatctttacttttgtgaaaccgaagagataagacgtggagaaaagcagacgtctctgttgtttgtttttgattcatcgggttctaaggatttgtctgtttccaagacacaaactttggattctcttctcttcctgttcgtcttctcttgtcttgatccttttgttatcatcatcatctcttcatcgagagaagagagacgagattagggatttaagttaaggaggatgtattatcagttgaccaagtcttcttacagagactctttgaagattctggaggctgatattgagcacgccaatggactggctgctgagattccaatgggaaagagcggtgtgcgacttcagatgaaattggtgtgcagcaatttggctccattcttcatattcctgctacaatggatggatttctcatgtctgcttccaagatattttgatttcttccacatactcatatacaaggtacgtgctgatgggcggtggaatcgatctaggtacggaaggaaagctacgattagggagttttacggtgttatattaccatcacttgagcgacttcatatcaactttgctgacttaccggacgaaagcttgtggtatccgaatccaaaagccatcaccaagaagcagtatgacattgaaggtagcagatacatgaatagcattgacttggaaagagaagacgaatgcgggatttgcttagagccttgcaccaaaatggtgttgccaaactgttgtcatgccatgtgcatcaaatgttaccgtaactggaacacaaagtcggagtcatgcccgttttgtcgtggcagcatcaagagagtgaactcagaggatctgtgggtgctaacttgcgatgaagatgtggtggatccagagacggtcaccaaagaggatcttcttcggttctacctccacatcaatagccttcctaaggattatccagaagcggccttcttagtctacaacgagtacttgatatgattttatcccgaaacataaatacgggtgtacagagggagagagtgatcccagacctttgattaagtgtacataagaatctggtgatccattaatgttccttcgttttcgattatgatttatgaagattgtcataatcttaatgtgtaccccttttattatc

SEQ ID NO: 490 - protein, 251 aa, Arabidopsis thaliana
  misc_feature (1)..(251): Ceres CLONE ID no.  156298
  misc_feature (1)..(251): GEMINI ID 555C11
  misc_feature (155)..(192): Pfam Name: zf-C3HC4 Pfam Description: Zinc finger, C3HC4 type (RING finger)
MYYQLTKSSYRDSLKILEADIEHANGLAAEIPMGKSGVRLQMKLVCSNLAPFFIFLLQWMDFSCLLPRYFDFFHILIYKVRADGRWNRSRYGRKATIREFYGVILPSLERLHINFADLPDESLWYPNPKAITKKQYDIEGSRYMNSIDLEREDECGICLEPCTKMVLPNCCHAMCIKCYRNWNTKSESCPFCRGSIKRVNSEDLWVLTCDEDVVDPETVTKEDLLRFYLHINSLPKDYPEAAFLVYNEYLI

SEQ ID NO: 491 - DNA, 741 bp, Populus balsamifera subsp. trichocarpa
  misc_feature (1)..(741): Ceres ANNOT ID no. 1512948
atgcattatcagttgagcaactcatcttaccaagactccctcaaagtcttggaggctgatatccagcatgccaatgctttggctgctgcaattccaaggggcaaggatggagcgcgtctgcagatgaaattagtttacaatcgctgggcacctctccttttctttttgctacaacggatagattgttcatgcatttgcctactccctagatatctaaatttctttcatgtatatagcgatggtagacctagcctatctaagcacggaaggaaagcaacaattcgggaattctacggtgttatatcaccgtctcttcaacggcttcatagtaacttagaagagttggaagatgttaagggagataattctggcatggagagtttgtgcaaaaataaggtggaaggagataacaagcttgccaatattgatttagagagggaagatgaatgtggaatttgtttggagccctgcaccaaaatggtactgcctaattgctgtcatgcaatgtgcatcaaatgctaccgcaactggaacacgaggtcagagtcctgcccattttgccgtggcagcttaaagagagttaactcggaagacctatgggttctcacttgtaacaatgaagttgttgacacaaaagcggtttccaaagaggatttgtcgcgcttctatctctacgtcaatagcttgccaaaagattatcacgattcccttttcttaatgtattacgagtacctaatatga

SEQ ID NO: 492 - protein, 246 aa, Populus balsamifera subsp. trichocarpa
  misc_feature (1)..(246): Ceres ANNOT ID no. 1512948
  misc_feature (1)..(246): Functional Homolog of  Ceres CLONE ID no.  156298
  misc_feature (150)..(187): Pfam Name: zf-C3HC4 Pfam Description: Zinc finger, C3HC4 type (RING finger)
MHYQLSNSSYQDSLKVLEADIQHANALAAAIPRGKDGARLQMKLVYNRWAPLLFFLLQRIDCSCICLLPRYLNFFHVYSDGRPSLSKHGRKATIREFYGVISPSLQRLHSNLEELEDVKGDNSGMESLCKNKVEGDNKLANIDLEREDECGICLEPCTKMVLPNCCHAMCIKCYRNWNTRSESCPFCRGSLKRVNSEDLWVLTCNNEVVDTKAVSKEDLSRFYLYVNSLPKDYHDSLFLMYYEYLI

SEQ ID NO: 493 - DNA, 750 bp, Populus balsamifera subsp. trichocarpa
  misc_feature (1)..(750): Ceres ANNOT ID no. 1459679
atggagatgatgcattatcagttgagcaactcatcttaccaagactccctcaaagtcttggaggctgatatccagcatgccaatgctttggctgctgcaattccaaggggcaaggatggagcgcgtctgcagatgaaattagtttacaatcgctgggcacctctccttttctttttgctacaacggatagattgttcatgcatttgcctactccctagatatctaaatttctttcatgtatatagcgatggtagacctagcctatctaagcacggaaggaaagcaacaattcgggaattctacggtgttatatcaccgtctcttcaacggcttcatagtaacttagaagagttggaagatgttaagggagataattctggcatggagagtttgtgcaaaaataaggtggaaggagataacaagcttgccaatattgatttagagagggaagatgaatgtggaatttgtttggagccctgcaccaaaatggtactgcctaattgctgtcatgcaatgtgcatcaaatgctaccgcaactggaacacgaggtcagagtcctgcccattttgccgtggcagcttaaagagagttaactcggaagacctatgggttctcacttgtaacaatgaagttgttgacacaaaagcggtttccaaagaggatttgtcgcgcttctatctctacgtcaatagcttgccaaaagattatcacgattcccttttcttaatgtattacgagtacctaatatga

SEQ ID NO: 494 - protein, 246 aa, Populus balsamifera subsp. trichocarpa; identical to SEQ ID NO: 492
  misc_feature (1)..(246): Ceres ANNOT ID no. 1459679
  misc_feature (1)..(246): Functional Homolog of  Ceres CLONE ID no.  156298
  misc_feature (150)..(187): Pfam Name: zf-C3HC4 Pfam Description: Zinc finger, C3HC4 type (RING finger)

SEQ ID NO: 495 - DNA, 765 bp, Populus balsamifera subsp. trichocarpa
  misc_feature (1)..(765): Ceres ANNOT ID no. 1463114
atggagatgatgtgttatcagctgagcaactcatcttaccaagattcccttaaagttttggaggctgatatccagcatgctaatgctttggctgctgcaattccaaaggacaagggtggagcacgcctgcggatgaaattagcttacaatcactgggctcctctctttttctttctgctacaaagaatagattgttcttatttttgcctgctccccagatatctaaatttctttcatgtactagtatataaggtgtatactgatggtagaccaggcctatctaagcatggaaggaaagcaacagttcaggaattctatggtgttatattgccgtatcttcaacggcttaatagtaacttagaagagatgggggatgttaagggagagaattatggcatggagagtttgggcaaaaagaaggtggaaggagataacaggcttgccaatattgatttagagagggaagatgaatgtggaatttgtttggagccctgcaccaaaatggtcttgcctaactgttgtcatgcaatgtgcatcaaatgctaccgcaattggaacacaaggtcggagtcctgccctttttgccgtggcagcttaaagagagttaactcggaagacttgtgggttctcacttgtaacagtgaagttgttgacacaaaagcgatttccaaagaggatttgttgcggttctacctctacatcaacagcttgccaaaagattatcctgatgctcttttcttagtgtattatgagtacctaatatga

SEQ ID NO: 496 - protein, 251 aa, Populus balsamifera subsp. trichocarpa
  misc_feature (1)..(251): Ceres ANNOT ID no. 1463114
  misc_feature (1)..(251): Functional Homolog of  Ceres CLONE ID no.  156298
  misc_feature (155)..(192): Pfam Name: zf-C3HC4 Pfam Description: Zinc finger, C3HC4 type (RING finger)
MCYQLSNSSYQDSLKVLEADIQHANALAAAIPKDKGGARLRMKLAYNHWAPLFFFLLQRIDCSYFCLLPRYLNFFHVLVYKVYTDGRPGLSKHGRKATVQEFYGVILPYLQRLNSNLEEMGDVKGENYGMESLGKKKVEGDNRLANIDLEREDECGICLEPCTKMVLPNCCHAMCIKCYRNWNTRSESCPFCRGSLKRVNSEDLWVLTCNSEVVDTKAISKEDLLRFYLYINSLPKDYPDALFLVYYEYLI

SEQ ID NO: 497 - protein, 256 aa, Glycine max
  misc_feature (1)..(256): Ceres CLONE ID no. 659211
  misc_feature (1)..(256): Functional Homolog of  Ceres CLONE ID no.  156298
  misc_feature (160)..(197): Pfam Name: zf-C3HC4 Pfam Description: Zinc finger, C3HC4 type (RING finger)
MEMMAYQFTRLPYSDSLKLLEADIQHANALAAAIPRAKGGTLLQMKLVYNHLAPLFLLLLQWMKCSCTCFLHRYLDLFHIVVYKVHDDGRSNVASHGRKASIRDFYAVILPSLERLLGSLEKLDICKKSHSSIDGISYGKKMMEGDGKLINIDLEREDECGICLEPCTKMVLPNCCHAMCIKCYRKWNTRSESCPFCRGSLRRVNSEDLWVLTCNEDVVDAETVSKEDLLRFYLYINSLPKDHPDALFLMYYEYLI

SEQ ID NO: 498 - protein, 259 aa, Medicago truncatula
  misc_feature (1)..(259): Public GI no. 92877546
  misc_feature (1)..(259): Functional Homolog of  Ceres CLONE ID no.  156298
  misc_feature (163)..(200): Pfam Name: zf-C3HC4 Pfam Description: Zinc finger, C3HC4 type (RING finger)
MAMMPYYLSRLPYQDSLQILEADIQQANSLAAAIPRARGGTLIKMKLVCNQLAPLLLLFLQWMDCSCAAFLHSYLNLFHILIYKEPNDGRSNMSTRGRKATIKDFYAVILPSLQRLHGSFDDTMETCEEGNTSLEGSSCGNKVIEFEGDGKLTNVDLQREDECGICLEPCTKMVLPNCCHAMCIKCYRKWNRKSESCPFCRGSLRRVNSEDLWVLTCDEDVVDAETVSKEDLLRFYLYINKLPKDNPDALFLMYYEYLI

SEQ ID NO: 499 - protein, 258 aa, Glycine max
  misc_feature (1)..(258): Ceres CLONE ID no. 1662905
  misc_feature (1)..(258): Functional Homolog of  Ceres CLONE ID no.  156298
  misc_feature (162)..(199): Pfam Name: zf-C3HC4 Pfam Description: Zinc finger, C3HC4 type (RING finger)
MAMIPYHLCRLPYQDSLKALEADIQHANALAAAIPRAKGGTLLQMKLVYNHLAPLFLLFLQWMDCSCAGFLHRYLNLFHILVYKVHNDGRSIMSTHGRKATIGDFYAVILPSLQRLHGSLEKLEVVEEEEGQSSIEGPSYGKKVIEGVKLTTNVDLQREDECGICLEPCTKMVLPGCCHAMCIKCYRKWNRKSESCPFCRGSLRRVNSEDLWVLTCNDDVVDAETVSKEDLLRFYLYISKLPKDHPDALFLMYYEYLI

SEQ ID NO: 500 - DNA, 1183 bp, Panicum virgatum
  misc_feature (1)..(1183): Ceres CLONE ID no.1831324
atcggcctttccgtctccacaagcttcgcctgctctgctccggccccctccgccccctttggccctttcttgactccctctctctctccgcacaaggaaagctccgagctttctctctctacccggagggagaagcgaggaagccggcgccgcctgttggcgctgggggctggcagctgcccgcgctccaaggaatcgagttcttggagggccgtccgttccatggcggcgcagcggggcgacctggggcggcagctcccgctgagaggccccctcaaggccctagaggccgacatacaccacgccaacgccatggcggatgccattcagaggaactatggtggagcatgcgtgcagatgaggctgtcgttcagctccctggctccattcttcctgtacctcgtccagtggctggattgcggatgctgctacgctcttcccagttatttaggactctttcacattctcatatgcaaggtttatgcagatggggatagctcggtgtcaacatatgaaaggcgggcaagccttagggaattctacgcaatcatctatcctattctgcagcagcttgagagtagtctgattgagagggacctgaaagggaagggtcgatgcaaagatatagtgagtaggaggcgtatggaggattggaaaaggctttctggcaaggatgtagaaagggaggatgaatgtggaatttgcatggagacatgcaccaagatggtcctgcctaattgcagtcatgcaatgtgcataaaatgctatagggactggtataaaagatcagaatcttgccctttctgccgaggaagcctcaaaagaatccgctcaagagacctttgggtacttacaaactacaatgatgtcattgaccccgcaaatttagaaagagaaaatgtgaggcagttctatagttatattgacagcttgcctcttatacttcctgataatattttctttttctattatgattacctaatataatccagaagcaccatacattgaatgtgtaaattgtgaaatcagatgaaattaacgtagttcttctttggtagatgaaaggcattcctttctttgaccaacatgcatttgtatttacttgtagcgtagcaatgtaacactaacagaacagtgaataaaatttgtaggtgatattcattaaaaaaaaaaaaaaaaaaaa

SEQ ID NO: 501 - protein, 254 aa, Panicum virgatum
  misc_feature (1)..(254): Ceres CLONE ID no. 1831324
  misc_feature (1)..(254): Functional Homolog of  Ceres CLONE ID no.  156298
  misc_feature (158)..(195): Pfam Name: zf-C3HC4 Pfam Description: Zinc finger, C3HC4 type (RING finger)
MAAQRGDLGRQLPLRGPLKALEADIHHANAMADAIQRNYGGACVQMRLSFSSLAPFFLYLVQWLDCGCCYALPSYLGLFHILICKVYADGDSSVSTYERRASLREFYAIIYPILQQLESSLIERDLKGKGRCKDIVSRRRMEDWKRLSGKDVEREDECGICMETCTKMVLPNCSHAMCIKCYRDWYKRSESCPFCRGSLKRIRSRDLWVLTNYNDVIDPANLERENVRQFYSYIDSLPLILPDNIFFFYYDYLI

SEQ ID NO: 502 - protein, 253 aa, Zea mays
  misc_feature (1)..(253): Ceres CLONE ID no. 398632
  misc_feature (1)..(253): Functional Homolog of  Ceres CLONE ID no.  156298
  misc_feature (157)..(194): Pfam Name: zf-C3HC4 Pfam Description: Zinc finger, C3HC4 type (RING finger)
MAQRGELGRQLPLRGPLKALEADIHHANAMADAIQRNYGGACVQMRLSFSSLAPLFLYFIQWLDCGCCYALPSYLGLFHILICKVYADGDSSVSTYERRASLREFYAIIYPILQQLESSLIERDLKGKGRCKDIVSRRRMEDWKKVSGRDVEREDECGICMEACTKMVLPNCSHAMCIKCYRDWYKRSESCPFCRGSLKRIRSTDLWVLTNSNDVIDPAHLEKENVRHFYSYIDSLPLILPDSIFFFYYEYLL

SEQ ID NO: 503 - DNA, 1048 bp, Arabidopsis thaliana
  misc_feature (1)..(1048): Ceres CLONE ID no.  156373
  misc_feature (1)..(1048): GEMINI ID 554D10
tttttaaaaaacttctccttcttgttccgtctgcttctctccatctccttccatatctattgttctctctctcttcatgcccgaacgcatcgggtctcaaaaaccattgatacagacatcgatccttgtcaactagtactgatctataaatcttataaaaatctgtagagatatggccgccgcagccgtttcctctaaccctcgcaccgttgaagagatcttcaaagattattccgctcgtcgtgccgctcttcttcgtgctctcactaaagatgttgatgatttttactctcaatgcgatccggaaaaggagaatttgtgtttgtacggacaccctaatgagtcatgggaagtgaatctaccagcagaggaagtgcctccggagctacctgagcctgctcttggtatcaatttcgctagagatggtatgcagaggaaagattggctttctcttgttgctgttcacagtgattgttggttgctctctgtttctttctactttggagctcgtcttaatcgcaatgagaggaagcggttattcagtctgatcaacgatctcccaactctcttcgatgtagtgactggtaggaaagccatgaaagacaacaagccaagctcggactcaggaagcaaatccagaaatggcactaagagatcaatagacgggcagacaaagagctcaacaccgaaactaatggaagagagctatgaggaggaggaagaagaagacgagcatggagacactctctgtggaagctgtggaggtcattacacaaatgaggagttctggatttgctgtgatgtttgtgaacgttggtaccatggaaaatgcgtcaagataactccggctaaagcagagagcatcaagcagtataaatgcccgccttgctgtgcaaagaaaggaagacagtgatgctgatcaattgatgatgatgatgatgatgatctctcagagagactctggttctcatgttttaatcaatatgttaatcaactttttttcttttcttctctttttttctttaaccttcttaattttaaagctttc

SEQ ID NO: 504 - protein, 246 aa, Arabidopsis thaliana
  misc_feature (1)..(246): Ceres CLONE ID no.  156373
  misc_feature (1)..(246): GEMINI ID 554D10
  misc_feature (192)..(242): Pfam Name: PHD Pfam Description: PHD-finger
MAAAAVSSNPRTVEEIFKDYSARRAALLRALTKDVDDFYSQCDPEKENLCLYGHPNESWEVNLPAEEVPPELPEPALGINFARDGMQRKDWLSLVAVHSDCWLLSVSFYFGARLNRNERKRLFSLINDLPTLFDVVTGRKAMKDNKPSSDSGSKSRNGTKRSIDGQTKSSTPKLMEESYEEEEEEDEHGDTLCGSCGGHYTNEEFWICCDVCERWYHGKCVKITPAKAESIKQYKCPPCCAKKGRQ

SEQ ID NO: 505 - protein, 245 aa, Zea mays
  misc_feature (1)..(245): Ceres CLONE ID no. 1393778
  misc_feature (1)..(245): Functional Homolog of  Ceres CLONE ID no.  156373
  misc_feature (191)..(241): Pfam Name: PHD Pfam Description: PHD-finger
MAAVSSNPRTVEEIFKDYTARRSALLRALTKDVDDFYSQCDPEKENLCLYGHPNESWEVNLPAEEVPPELPEPALGINFARDGMQRKDWLSLVAVHSDCWLLSVSFYFGARLNRNERKRLFSLINDLPTLFDVVTGRKPIKDNKPSSDSGSKSRNGTKRSIEGQTKSPTPRPMEESYEDEEEEEDEHGDTLCGICGGNYTQDEFWICCDVCERWYHGKCVKITPAKADSIKQYKCPPCCAKKGRQ

SEQ ID NO: 506 - protein, 241 aa, Arabidopsis thaliana
  misc_feature (1)..(241): Public GI no. 21536795
  misc_feature (1)..(241): Functional Homolog of  Ceres CLONE ID no.  156373
  misc_feature (187)..(237): Pfam Name: PHD Pfam Description: PHD-finger
MAAESSNPRTVEEIFKDFSGRRSGFLRALSVDVDKFYSLCDPEMENLCLYGHPNGTWEVNLPAEEVPPELPEPALGINFARDGMQRKDWLSLVAVHSDCWLLSVSSYFGARLNRNERKRLFSLINDLPTLFEVVTGRKPIKDGKPSMDLGSKSRNGVKRSIEGQTKSTPKLMEESYEDEDDEHGDTLCGSCGGNYTNDEFWICCDVCERWYHGKCVKITPAKAESIKQYKCPSCCTKKGRQ

SEQ ID NO: 507 - DNA, 702 bp, Populus balsamifera subsp. trichocarpa
  misc_feature (1)..(702): Ceres ANNOT ID no. 1518013
atggcgtcccctcgcactgtagaagagatcttcaaagattacaacgcccgtcgctctgccctcgttcgcgctctcactattgaggctgatgaagtctaccttcaatgcgatccagaaaaagagaatttgtgtctgtatggacatccaaacgagtcctgggaagtgactctgccagcagaggaagttccgccagagctccctgagccggcgttgggcattaattttgccagagatggaatgacgcgtaaagactggctttctcttgttgctgtgcacagtgacagttggttgctttcagtgggattctactttggtgcacgacttaatcgcaacgaaaggaagcgactgtttagcatggtaaatgatctgcccaccctctttgaaattgtgaccgggaggaaaccagtagaagataagcctagtgctgacggtggtagcaaatccaggaataacacaaagagatcaactgatggacaggcaagaagcaattccaagttaagttacgtggaggatgaagatgagcatggggacaccctttgcgggagctgtggagggaactacaatgctgatgagttttggattggttgtgacatttgtgaacgatggtaccatggaaagtgtgtgaagataacaccagcaaaagctgaaagcatcaagcagtacaaatgcccttcttgcagcacaaagaaatctaggcactaa

SEQ ID NO: 508 - protein, 233 aa, Populus balsamifera subsp. trichocarpa
  misc_feature (1)..(233): Ceres ANNOT ID no. 1518013
  misc_feature (1)..(233): Functional Homolog of  Ceres CLONE ID no.  156373
  misc_feature (179)..(229): Pfam Name: PHD Pfam Description: PHD-finger
MASPRTVEEIFKDYNARRSALVRALTIEADEVYLQCDPEKENLCLYGHPNESWEVTLPAEEVPPELPEPALGINFARDGMTRKDWLSLVAVHSDSWLLSVGFYFGARLNRNERKRLFSMVNDLPTLFEIVTGRKPVEDKPSADGGSKSRNNTKRSTDGQARSNSKLSYVEDEDEHGDTLCGSCGGNYNADEFWIGCDICERWYHGKCVKITPAKAESIKQYKCPSCSTKKSRH

SEQ ID NO: 509 - DNA, 714 bp, Populus balsamifera subsp. trichocarpa
  misc_feature (1)..(714): Ceres ANNOT ID no. 1511533
atggcttccatactcacaagccctcgcactgtagaagagatcttcaaagattacagcgctcgtcgctctgccctcgttcgtgctctcactatcgaagccgatgaagtttacattcaatgcgatccagaaaaagaaaatctgtgcttgtatggacatccaactgagtcctgggaggtgaccctgccagctgaggaagttcccccggagctccctgagcctgctttgggcattaattttgccagggatgggatgagtcgtaaagattggctctctcttgtggctgtccatagtgactgttggttgctttccatggcattctactttggtgcacgacttaatcgcaacgacaggaagcgattgtttagcatgataaatgatctgcccaccctctttgaaattgtaactgggaggaaaccagcagaagacaaacctagtgcagaaagcggcagcaaatccaggaataacacaaagagatcaatagatggacaggcgagaagtaattccaagttaagttatgtggaggatgaagacgagcatggagacaccatttgtgggagctgtgcagggaactacaatgccgatgagttttggattggttgtgacatctgtgaacgatggtaccatggaaaatgtgtgaagataacaccagcaaaagcagaaagtatcaagcagtacaaatgcccttcttgcagcacaaagaagtccaggcactaa

SEQ ID NO: 510 - protein, 237 aa, Populus balsamifera subsp. trichocarpa
  misc_feature (1)..(237): Ceres ANNOT ID no. 1511533
  misc_feature (1)..(237): Functional Homolog of  Ceres CLONE ID no.  156373
  misc_feature (183)..(233): Pfam Name: PHD Pfam Description: PHD-finger
MASILTSPRTVEEIFKDYSARRSALVRALTIEADEVYIQCDPEKENLCLYGHPTESWEVTLPAEEVPPELPEPALGINFARDGMSRKDWLSLVAVHSDCWLLSMAFYFGARLNRNDRKRLFSMINDLPTLFEIVTGRKPAEDKPSAESGSKSRNNTKRSIDGQARSNSKLSYVEDEDEHGDTICGSCAGNYNADEFWIGCDICERWYHGKCVKITPAKAESIKQYKCPSCSTKKSRH

SEQ ID NO: 511 - protein, 239 aa, Glycine max
  misc_feature (1)..(239): Ceres CLONE ID no. 477995
  misc_feature (1)..(239): Functional Homolog of  Ceres CLONE ID no.  156373
  misc_feature (185)..(235): Pfam Name: PHD Pfam Description: PHD-finger
MEMASTPRTVEEIFKDYTARRTAIVRALSQDVDEFYGLCDPDKENLCLYGHPNETWEVTLPAEEVPPELPEPALGINFARDGMNRRDWLSLVAVHSDSWLLSVAFYLGARLNRNERKRLFSLINDLPTVFEVVTERKPVKDKPTADSGSKSRGSTKRSSDGQVKSNPKFADDGYEDEDDEHSETLCGSCGGNYNADEFWIGCDICERWFHGKCVKITPAKAESIKQYKCPSCSLRRGRP

SEQ ID NO: 512 - protein, 239 aa, Glycine max
  misc_feature (1)..(239): Ceres CLONE ID no. 1170863
  misc_feature (1)..(239): Functional Homolog of  Ceres CLONE ID no.  156373
  misc_feature (185)..(235): Pfam Name: PHD Pfam Description: PHD-finger
MDMASSPRTVEEIFKDYGARRTAVIRALTHDVDEFYGLCDPDKDNLCLYGHPNEAWEVTLPAEEVPPELPEPALGINFARDGMNRRDWLSLVAVHSDSWLVSVAFYLGARLNRNERKRLFSLINDLPSVFEVVTDRKPVKDKPTADSGSKSRGSAKRSSDEQVKSNPKFVDEGYEEDEDEHNETLCGSCGGNYNADEFWICCDICERWFHGKCVKITPAKAESIKQYKCPSCSLRRGRP

SEQ ID NO: 513 - protein, 245 aa, Lycopersicon esculentum
  misc_feature (1)..(245): Public GI no. 45387429
  misc_feature (1)..(245): Functional Homolog of  Ceres CLONE ID no.  156373
  misc_feature (189)..(239): Pfam Name: PHD Pfam Description: PHD-finger
MATNSSSHSPRTVEEIFKDFSARHAAVLRALTTDVEDFYSQCDPERDNLCLYGHPNESWEVAVPAEEVPPELPEPVLGINFARDGMERRDWLSLVAMHTDSWLLSVAFYFGARLNRNERSRVFTLINDLPTVFEAVTGRKPLKDKPSVDSGKKSKNNAKREKQMKANQRLQEESDDEDEGNEDEHEETLCGSCGTNGNEDEFWIGCDMCEKWYHGKCVKITPAKAQSIKEYRCPSCSNKRAKHMA

SEQ ID NO: 514 - protein, 244 aa, Oryza sativa
  misc_feature (1)..(244): Public GI no. 34900462
  misc_feature (1)..(244): Functional Homolog of  Ceres CLONE ID no.  156373
  misc_feature (189)..(239): Pfam Name: PHD Pfam Description: PHD-finger
MEMAAPVSPAPRTVEDIFKDFSGRRAGLVRALTVDVDEFYGFCDPEKENLCLYGHPNGRWEVALPAEEVPPELPEPALGINFARDGMHRRDWLSLVAVHSDSWLLSVAFFFGARLNGNERKRLFSLINDHPTVLEALSDRKHGRDNKSGADNGSKSRHSGKRANDVQTKTSRPAVVDDGYDEEEHSETLCGTCGGRYNANEFWIGCDICERWFHGKCVRITPAKAEHIKHYKCPDCSSSKKSRQ

SEQ ID NO: 515 - DNA, 1094 bp, Panicum virgatum
  misc_feature (1)..(1094): Ceres CLONE ID no.1826835
aactcctgtgtgccccgtcggccgcagcagctgcccgtccccgccgcctccggccgagcacgccgccgccaccgcctccggccgagcacgccgccgccaccgcctccggccgagcacgccgccgccaccgccggcgagggcgcgcgtcgacggcccgtccctttcgcatggatatgacccccgcgtccgtctcgtccaacccgcgctcggtcgaggaaatctacaaggacttctccggccgccgcgccggcctcgtccgcgccctcacctccgatgtggacgatttctacagctcctgcgacccagataaggagaatttgtgcctgtacggcctccccagcgggacctgggcggtggcgccgccagcggaggaggtgccgccggagatgccggagccggcgctcggtatcaacttcgcgcgggacggcatgcaacgccgggactggctctcactcgtcgcagtccactccgactcgtggctcatttccgtcgccttcttcttcggcgcacgcctcaacgccaacgatcggaagcgcttattcagtatggtcagtgatcttccatccgtctttgaagcattctcagacaggaaacacggcagagataggtctggcgttgatagcagcggcaagtctagacactcgtcaaagagaggaagcgacggccacgtgaagaattctagagcagcagctcctgctgccaaacagtacgatgatgatgatgacgaagacgacgaggagcacaccgagaccttttgcgggacctgcggtggcctgtacaattcgaacgagttctggatcggctgcgacatctgcgagaggtggttccatggcaagtgcgtgcggattacccccgctcgagcggaccacataaagcactacaagtgcccggactgcagctcgaagaaaatgaggcagtagtagtgggggggcgtctgatctgatcaaaaccatactcctgttgtctgtccgcagctagcagatgtgaattcgttttagaaacgttgttgtggtgttgtgtggtggtgataggaagaggcagaggacagaatagatacatgctcgttgctcgttcaaaaaaaaaaaaaaaaaaaa

SEQ ID NO: 516 - protein, 248 aa, Panicum virgatum
  misc_feature (1)..(248): Ceres CLONE ID no. 1826835
  misc_feature (1)..(248): Functional Homolog of  Ceres CLONE ID no.  156373
  misc_feature (194)..(244): Pfam Name: PHD Pfam Description: PHD-finger
MTPASVSSNPRSVEEIYKDFSGRRAGLVRALTSDVDDFYSSCDPDKENLCLYGLPSGTWAVAPPAEEVPPEMPEPALGINFARDGMQRRDWLSLVAVHSDSWLISVAFFFGARLNANDRKRLFSMVSDLPSVFEAFSDRKHGRDRSGVDSSGKSRHSSKRGSDGHVKNSRAAAPAAKQYDDDDDEDDEEHTETFCGTCGGLYNSNEFWIGCDICERWFHGKCVRITPARADHIKHYKCPDCSSKKMRQ

SEQ ID NO: 517 - DNA, 1199 bp, Arabidopsis thaliana
  misc_feature (1)..(1199): Ceres CLONE ID no.  157740
  misc_feature (1)..(1199): GEMINI ID 539F5
aactttatagttaaagttatcaattattcgaaaacaaagctggatttttgttttgtcccttaaaccagcatgatcaagaacttaagtaatatgaagaatgacaatcagaaacgtgaaaaatgttgcgagtacatcgaagctctcgaagaagaacgtcgcaagatcaatgttttccaacgcgagcttcctctttgcgtagagctcgtgactcaagcgattgaggcgtataagagggagatatcagggacgtcgacggataacttatacggacagtcggagtgctcagagcagaccaccggagaatgtgggcgcatcttggatctgttcataccaatcaaacactcttcgacctccatagaagaagaggttgatgacaaagatgatgatgatgaagaacaccagtctcatgaaaccgacatagattttgatgacaagaacatgaaatctgaatggctcaagtcggttcagctctggaaccaatccgacgcagttgtttctaataatagacaggatcgctcacaagaaaagacagagacgctggtagagttgataaaaataaacgatgaagcagcgaagaaaaacaacaacataaaatcaccggtgactactagcgatggtggcagtggcggtggcggtggcagaagagggcagagaaagaataggcggtgttggtcgcaagagttacacagacgcttcttgaacgctcttaaacaacttggtggccctcatgtagctacgccgaaacagataagagatataatgaaggttgatgggttaacaaatgatgaagtcaaaagtcatttacagaaatataggctgcatgcaagacggccaagccaaacaacaccgaacaacagaaactctcaaacgcaacatttcgtggtggttggtggaatatgggtcccacagactaaccattcaacggccaacgcagtcaacgccgtcgcatcgggtgagaccaccaccgggatttatgggcctatggtcagttcgttgccgtccgagtggccgaggcattccaattttggtaggaagatttcggaagatagatcaagatgctctaacaacggattttttcggtgtagctcaccagctatgtcttgttctactcgtacaaagacgaaagatgcaaaaataatatcataaatttaatttttgattatttattaagagaaaaaagttatagacattaatattgc

SEQ ID NO: 518 - protein, 358 aa, Arabidopsis thaliana
  misc_feature (1)..(358): Ceres CLONE ID no.  157740
  misc_feature (1)..(358): GEMINI ID 539F5
  misc_feature (198)..(249): Pfam Name: Myb_DNA-binding Pfam Description: Myb-like DNA-binding domain
MIKNLSNMKNDNQKREKCCEYIEALEEERRKINVFQRELPLCVELVTQAIEAYKREISGTSTDNLYGQSECSEQTTGECGRILDLFIPIKHSSTSIEEEVDDKDDDDEEHQSHETDIDFDDKNMKSEWLKSVQLWNQSDAVVSNNRQDRSQEKTETLVELIKINDEAAKKNNNIKSPVTTSDGGSGGGGGRRGQRKNRRCWSQELHRRFLNALKQLGGPHVATPKQIRDIMKVDGLTNDEVKSHLQKYRLHARRPSQTTPNNRNSQTQHFVVVGGIWVPQTNHSTANAVNAVASGETTTGIYGPMVSSLPSEWPRHSNFGRKISEDRSRCSNNGFFRCSSPAMSCSTRTKTKDAKIIS

SEQ ID NO: 519 - DNA, 1640 bp, Arabidopsis thaliana
  misc_feature (1)..(1640): Ceres CLONE ID no.  158240
  misc_feature (1)..(1640): GEMINI ID 531B2
ggagagtaacatcgagacaaagaagaaaagctaaaaaagagaaccccaaagaatcgaatatttattatttcgccccgaagattctatttctgatcatttacacccctaaaaagagtagagctttcgtgaagccaccatgtgtggaggagctataatctccgatttcatacctccgccgaggtccctccgcgtcactaacgagtttatctggccggatctgaaaaacaaagtgaaagcttcaaagaagagatcgaataagcgatccgatttcttcgatcttgacgatgatttcgaagctgatttccaagggtttaaggatgactcggcttttgactgcgaagacgatgatgatgtcttcgtcaatgttaagcctttcgtcttcaccgcaactactaagcccgtagcttccgctttcgtctccactggtatatatttggtaggttcagcatatgccaagaaaactgtagagtccgctgagcaagctgagaaatcttctaagaggaagaggaagaatcagtaccgagggattaggcagcgtccttggggaaaatgggctgcggagatccgtgatccgagaaaaggctcccgagaatggcttggaacattcgacactgctgaggaagcagcaagagcttatgatgctgcagcacgcagaatccgtggcacgaaagctaaggtgaattttcccgaggagaagaaccctagcgtcgtatcccagaaacgtcctagtgctaagactaataatcttcagaaatcagtggctaaaccaaacaaaagcgtaactttggttcagcagccaacacatctgagtcagcagtactgcaacaactcctttgacaactcttttggtgatatgagtttcatggaagagaagcctcagatgtacaacaatcagtttgggttaacaaactcgttcgatgctggaggtaacaatggataccagtatttcagttccgatcagggcagtaactccttcgactgttctgagttcgggtggagtgatcacggccctaaaacacccgagatctcttcaatgcttgtcaataacaacgaagcatcatttgttgaagaaaccaatgcagccaagaagctcaaacctaactctgatgagtcagacgatctgatggcataccttgacaacgccttgtgggacaccccactagaagtgaaagccatgcttggcgcagatgctggtgctgtgactcaggaagaggaaaacccagtggagctatggagcttagatgagatcaatttcatgctggaaggagacttttgaagtgatcgatggttccttagtttgtaaataaagctgtgttggattttgctgttgggggatggtacaagtcacacctcaagctctatgcattggtatctcatgagcctctcttccatagagagtttctcttttaattttgtcgaaataaaaaaggtgtgatgaagtaaatagaggtataataatatctatctattaagtcttgttttgttctttcatttttgtatttcttttctatttaaaagacagtttattagtcttctgagctctctttttgatctttgttatagcgtatcatcaccctcgaaagtgtaatgttttgtacccccaaacttgtttagcattataataaagtctctttggaact

SEQ ID NO: 520 - protein, 379 aa, Arabidopsis thaliana
  misc_feature (1)..(379): Ceres CLONE ID no.  158240
  misc_feature (1)..(379): GEMINI ID 531B2
  misc_feature (126)..(177): Pfam Name: AP2 Pfam Description: AP2 domain
MCGGAIISDFIPPPRSLRVTNEFIWPDLKNKVKASKKRSNKRSDFFDLDDDFEADFQGFKDDSAFDCEDDDDVFVNVKPFVFTATTKPVASAFVSTGIYLVGSAYAKKTVESAEQAEKSSKRKRKNQYRGIRQRPWGKWAAEIRDPRKGSREWLGTFDTAEEAARAYDAAARRIRGTKAKVNFPEEKNPSVVSQKRPSAKTNNLQKSVAKPNKSVTLVQQPTHLSQQYCNNSFDNSFGDMSFMEEKPQMYNNQFGLTNSFDAGGNNGYQYFSSDQGSNSFDCSEFGWSDHGPKTPEISSMLVNNNEASFVEETNAAKKLKPNSDESDDLMAYLDNALWDTPLEVKAMLGADAGAVTQEEENPVELWSLDEINFMLEGDF

SEQ ID NO: 521 - protein, 327 aa, Lycopersicon esculentum
  misc_feature (1)..(327): Public GI no. 37538128
  misc_feature (1)..(327): Functional Homolog of  Ceres CLONE ID no.  158240
  misc_feature (114)..(165): Pfam Name: AP2 Pfam Description: AP2 domain
MCGGSIISDYIDPSRTSRRLTAEFLWGRFDLGKKQKNPNNYHSKAKHLRSEVVDDFEADFQDFKELSDDEDVQVDVKPFAFSASKHSTGSKSLKTVDSDKDAAADKSSKRKRKNQYRGIRQRPWGKWAAEIRDPRKGVRVWLGTFNTAEEAAKAYDIEARRIRGKKAKVNFPDEAPAPASRHTVKVNPQKVLPEESLYSLQSDSAIMNSVEDDHYDSFGFFEEKPMTKQYGYENGSSASADTGFGSFVPSAGGDIYFNSDVGSNSFECSDFGWGEPCSRTPEISSVLSAAIECNEAQFVEDANSQKKLKSCTNNPVADDGNPRYYGT

SEQ ID NO: 522 - protein, 385 aa, Trifolium pratense
  misc_feature (1)..(385): Public GI no. 84453218
  misc_feature (1)..(385): Functional Homolog of  Ceres CLONE ID no.  158240
  misc_feature (121)..(172): Pfam Name: AP2 Pfam Description: AP2 domain
MCGGAIISDFIPAAAAVGGSRRVTADILWPNLRKTGSKKSSFLLDDDFEAGFRQFKDDSDFDEDEDEDDDEGLLVGVKGFTFAASNNKSSRNFSRGSAGAKSVASKSNEQAEKESKRKRKNQYRGIRQRPWGKWAAEIRDPRKGVRVWLGTFNTAEEAARAYDAEARRIRGKKAKVNFPDEAPNASSKRLKTNPDNQLLNKNLNSFKPNGNNKMFNFSENMENFYSPMDQVEQKPLVNNQYGAADIGAFTGNGVHLAPADVNAYFSSEHSSNSFDYSDLCWGEQGPKTPEISSVFSAPLEAEPQMNMQSNNSQDMLPMQAESAKTLSEELADIESQLKFFENSFDDNWSDASLASLLGADVTQDAGNTMNLWSFDDLPSIAGGVF

SEQ ID NO: 523 - DNA, 940 bp, Arabidopsis thaliana
  misc_feature (1)..(940): Ceres CLONE ID no.  15990
  misc_feature (1)..(940): GEMINI ID 531A8
acattttcagctgctcataaaccctaaaaatcctctctttttctcaaccttgattcttagccatggagttctggggaattgaagttaaatcaggaaagccagttacagtgactcctgaagaaggcattcttatccacgtttctcaggcatcgcttggagaatgtaaaaacaagaagggagagtttgtgcctttacatgtaaaggttgggaaccagaacttggttctgggaactctatcgactgagaacatccctcagcttttctgtgatttggtattcgacaaggagtttagctttctcacacttggggaaaaggaagtgtttactttgttggatacaaaactcccaacattgagccacaaggctattctgaggaagaagaggaagaagaggaagaagttcctgctgccgttactgctagtgggaatgctgccaaggctgtagctaaaccaaaggctaagcctgcagaagtgaagccagctgttgatgatgaagaggatgagtctgattctgacggaatggatgaagatgattctgatggtgaggattctgaggaagaagagcctacacctaagaagcctgcatcaagcaagaagagagctaatgaaactacccctaaagcacctgtgtcagcaaagaaggcgaaagtagcagttactcctcagaaaacagatgagaagaagaaaggtggaaaggctgcaaaccagagcccaaagtcggccagtcaagtctcatgtggttcatgcaagaagactttcaactcagggaatgcacttgagtctcacaacaaggccaagcacgctgctgccaagtgaagtggtttcttattagagcttatgatttctatggaattttgcctgtagtctttatgaaaccttcagatttccttatattttcttttgataacaagagtcttaatgaaagagagccagttggagtct

SEQ ID NO: 524 - protein, 98 aa, Arabidopsis thaliana
  misc_feature (1)..(98): Ceres CLONE ID no.  15990
  misc_feature (1)..(98): GEMINI ID 531A8
MDEDDSDGEDSEEEEPTPKKPASSKKRANETTPKAPVSAKKAKVAVTPQKTDEKKKGGKAANQSPKSASQVSCGSCKKTFNSGNALESHNKAKHAAAK

SEQ ID NO: 525 - DNA, 971 bp, Arabidopsis thaliana
  misc_feature (1)..(971): Ceres CLONE ID no.  16284
  misc_feature (1)..(971): GEMINI ID 533G9
agcactataccatatctcttttttcttccgtttttcccacacattgtctctacctttccctttttcagatttgaccctttgttttcaaaagaaacgatttttagtagccgccggggaatcaggagaatggtgtctccggagaatacgaactggcttagtgattaccctttgattgaaggtgctttctctgatcagaaccccactttcccttggcagatagatggctcagctactgtcagtgttgaagtggatggcttcctttgtgatgcagatgtgatcaaagaaccaagttcaaggaagaggatcaaaactgaatcttgcactggttctaactcgaaagcttgtagggagaaacaaagacgtgatagactaaatgacaagtttacggagttgagttccgtattggaacctgggagaactccaaaaacagacaaggttgctattatcaatgatgcaattcgcatggtgaatcaagcaagagatgaagcgcagaaactaaaggacttgaactcaagcctccaggagaaaatcaaggagttgaaggatgagaagaacgagctgcgtgatgagaaacagaagcttaaggtcgagaaggagagaatcgatcagcaactgaaagctattaagacacagcctcagcctcaaccttgtttcttaccaaatccgcaaacactctctcaagctcaagctcctggaagcaagcttgtccctttcacaacttatcccggctttgcaatgtggcaattcatgcctcctgctgctgttgatacctcacaggaccatgtccttcgtcctccagttgcttaaagctgctgcttctctctactactattaacggttctgtaagattacttcttacgcgcttttttctgatgtaatgattctcacattctgtgattggtgacataaccactgcaacttaaaatgtaaaattgaaataagcttgcactaaaaatcaaatctcattgtgc

SEQ ID NO: 526 - protein, 226 aa, Arabidopsis thaliana
  misc_feature (1)..(226): Ceres CLONE ID no.  16284
  misc_feature (1)..(226): GEMINI ID 533G9
  misc_feature (67)..(118): Pfam Name: HLH Pfam Description: Helix-loop-helix DNA-binding domain
MVSPENTNWLSDYPLIEGAFSDQNPTFPWQIDGSATVSVEVDGFLCDADVIKEPSSRKRIKTESCTGSNSKACREKQRRDRLNDKFTELSSVLEPGRTPKTDKVAIINDAIRMVNQARDEAQKLKDLNSSLQEKIKELKDEKNELRDEKQKLKVEKERIDQQLKAIKTQPQPQPCFLPNPQTLSQAQAPGSKLVPFTTYPGFAMWQFMPPAAVDTSQDHVLRPPVA

SEQ ID NO: 527 - protein, 225 aa, Brassica napus
  misc_feature (1)..(225): Ceres CLONE ID no. 976709
  misc_feature (1)..(225): Functional Homolog of  Ceres CLONE ID no.  16284
  misc_feature (70)..(121): Pfam Name: HLH Pfam Description: Helix-loop-helix DNA-binding domain
  misc_feature (175)..(175): Xaa is any aa, unknown, or other
  misc_feature (183)..(183): Xaa is any aa, unknown, or other
  misc_feature (188)..(188): Xaa is any aa, unknown, or other
  misc_feature (190)..(190): Xaa is any aa, unknown, or other
  misc_feature (221)..(221): Xaa is any aa, unknown, or other
MVFPENTNWLSDYPLLIDGVFSHHSPTFPWQIDGSATTVSVEEVDGFLCDSDVIKEPGSKKRVKSESNAGPSSKACREKQRRDKLNDKFTELSSILEPGRAPKTDKVAIINDAIRMVNQARDEAQRLKDLNSNLQEKIKELKDEKNELRDEKQKLKTEKDRIEQQLKAINTQPCXLPNPPTLXQAQAXGXKLVPFTTYPGFAMWQFMPPAAVDTSQDHVLXPPVA

SEQ ID NO: 528 - DNA, 1066 bp, Arabidopsis thaliana
  misc_feature (1)..(1066): Ceres CLONE ID no.  17402
  misc_feature (1)..(1066): GEMINI ID 554B3
aagactctgttttttcccaagatgtctggtttcctcttttgtttcgtccaaatctctactttttagggatcttgtccttctcttttctgctgattaaaaccctcgaatttgctccaattcgacgcgaaaaagggcattgagatggtgaatggagaatcatcaactagtacgtcttactctgataataacaatgacacaaatgatcaaggaggagactttgaatgtaacatttgtttcgaactagctcaagatccgattgtcactctctgtggccatctcttttgctggccttgcttataccgttggcttcaccaccattcacattctcaagaatgtccggtttgtaaagccgtggttcaagacgataagcttgttcctctttacggtagaggcaagaaccagactgacccgagatcaaaacgttatccgggtttacggattcctaaccgaccaacaggtcaaagacctgagactgctgctcctcctcctcagcctgaagctgcgagtaattttttcaactacggtattggtttgatgggtggaattatgccgatgatggcgactacgaggtttgggaatttcagtatggggtttggtggtttgttaccttctttgtttaactttcagtttcatggatttcatgatgctacgctttatggttcaacaccgggttatccttacggtggttatcataacggtttccgtggagttcctcctcgtggacaagagcgtcctatggctcgtggaggaaaccaaagtgatgcatttctgaagaatatcctcttttttgttggaatctgtgtggtgatatttctcatctggtgaaaacgaatcacatttggtgtatttccaggtatgatcaaacttacttacttggtgcaagttgtgtatgtaaatatggtaatagctgagtgtacttgtctgctatttcgacgttgttattgtatttttgttttgaagatgaaccatgagtctacaagcttttttacacaactcttttgttgcttttgtgttttgtctaagcatcttatgaaaactagttgtgaaataaatggtgcgtgttatg

SEQ ID NO: 529 - protein, 227 aa, Arabidopsis thaliana
  misc_feature (1)..(227): Ceres CLONE ID no.  17402
  misc_feature (1)..(227): GEMINI ID 554B3
  misc_feature (28)..(68): Pfam Name: zf-C3HC4 Pfam Description: Zinc finger, C3HC4 type (RING finger)
MVNGESSTSTSYSDNNNDTNDQGGDFECNICFELAQDPIVTLCGHLFCWPCLYRWLHHHSHSQECPVCKAVVQDDKLVPLYGRGKNQTDPRSKRYPGLRIPNRPTGQRPETAAPPPQPEAASNFFNYGIGLMGGIMPMMATTRFGNFSMGFGGLLPSLFNFQFHGFHDATLYGSTPGYPYGGYHNGFRGVPPRGQERPMARGGNQSDAFLKNILFFVGICVVIFLIW

SEQ ID NO: 530 - protein, 164 aa, Glycine max
  misc_feature (1)..(164): Ceres CLONE ID no. 1432566
  misc_feature (1)..(164): Functional Homolog of  Ceres CLONE ID no.  17402
  misc_feature (26)..(66): Pfam Name: zf-C3HC4 Pfam Description: Zinc finger, C3HC4 type (RING finger)
MEKGESTSTSYSDTNGSNEPDHDFECNICFELAQDPIVTLCGHLFCWPCLYRWLHHHSHSQECPVCKALVQDDKLVPLYGRGKNQTDPRTKRYPGMRIPNRPAGQRPETASPPPQQPQNDAASNFFNYGIGLMGGFMPMATTRIGNFSFGVGGLLPSLFNFQFH

SEQ ID NO: 531 - protein, 181 aa, Glycine max
  misc_feature (1)..(181): Ceres CLONE ID no. 1500962
  misc_feature (1)..(181): Functional Homolog of  Ceres CLONE ID no.  17402
  misc_feature (26)..(66): Pfam Name: zf-C3HC4 Pfam Description: Zinc finger, C3HC4 type (RING finger)
MEKGESTSTSYSDTNGSNEPDHDFECNICFELAQDPIVTLCGHLFCWPCLYRWLHHHSHSQECPVCKALVQDDKLVPLYGRGKNQTDPRTKRYPGMRIPNRPAGQRPETASPPPQQPQNDAASNFFNYGIGLMGGFMPMATTRIGNFSFGVGGLLPSLFNFQFHGFPDAALYGTAPGYPFG

SEQ ID NO: 532 - protein, 227 aa, Zea mays
  misc_feature (1)..(227): Ceres CLONE ID no. 1387733
  misc_feature (1)..(227): Functional Homolog of  Ceres CLONE ID no.  17402
  misc_feature (26)..(66): Pfam Name: zf-C3HC4 Pfam Description: Zinc finger, C3HC4 type (RING finger)
MEKGESTSTSYSDTNGSNEPDHDFECNICFELAQDPIVTLCGHLFCWPCLYRWLHHHSHSQECPVCKALVQDDKLVPLYGRGKNQTDPRTKRYPGMRIPNRPAGQRPETASPPPQQPQNDAASNFFNYGIGLMGGFMPMATTRIGNFSFGVGGLLPSLFNFQFHGFPDAALYGTAPGYPFGGYHNGFRGVPGGNNEPTAPVGGHPSDAALKNILIVVGICVFFFLLL

SEQ ID NO: 533 - protein, 227 aa, Zea mays
  misc_feature (1)..(227): Ceres CLONE ID no. 1408748
  misc_feature (1)..(227): Functional Homolog of  Ceres CLONE ID no.  17402
  misc_feature (26)..(66): Pfam Name: zf-C3HC4 Pfam Description: Zinc finger, C3HC4 type (RING finger)
MEKGESTSTSYSDTNGSNEPDHDFECNICFELAQDPIVTLCGHLFCWPCLYRWLHHHSHSQECPVCKALVQDDKLVPLYGRGKNQTDPRTKRYPGMRIPNRPAGQRPETASPPPQQPQNDAASNFFNYGIGLMGGFMPMATTRIGNFSFGVGGLLPSLFNFQFHGFPDAALYGTAPGYPFGGYHNGFRGVPGGNNEPTAPGGGHPSDAALKNILIVVGICVFFFLLL

SEQ ID NO: 534 - DNA, 690 bp, Gossypium hirsutum
  misc_feature (1)..(690): Ceres CLONE ID no.1834915
attcccgaaattacctaatttccattcaataaccttctcccttgactctcatcaatctactcttttgattctcaggaatggcgagtggttttggtgaatcaacaagcatgcctccaccaagtccatcttgctcgagcagtaataatgctaacgatgctggtgattttgaatgcaatatttgctttgaattggctcaagatccaatcgtcacactttgtggtcatctcttctgctggccatgtctctatagatggttgcaccatcactcgcattctcaagaatgtccggtttgcaaggccctgatacaagaggaaaaacttgttcccctttatggcagggggaaaaacaagactgacccgcgctctaaatcgtattcgggcatggaaatcccaaaccgcccagctgggcaaaggccggctactgctcctcctccacccccggaaacaaatcagtttgcaaattatgggtttggattgatgggcagttttgttccgatggcaaccgcaaggatcggtaacttcaccatgggttttggaggcctattgccatccttgtttaatattcattttcatggatttccagatgctacggtgtatggaacaacttcagggtttccttatgggttcaatacatttcacggtggtgttgctcatgggtttccccagctgacgacacgagggcagcagcctg

SEQ ID NO: 535 - protein, 204 aa, Gossypium hirsutum
  misc_feature (1)..(204): Ceres CLONE ID no. 1834915
  misc_feature (1)..(204): Functional Homolog of  Ceres CLONE ID no.  17402
  misc_feature (32)..(72): Pfam Name: zf-C3HC4 Pfam Description: Zinc finger, C3HC4 type (RING finger)
MASGFGESTSMPPPSPSCSSSNNANDAGDFECNICFELAQDPIVTLCGHLFCWPCLYRWLHHHSHSQECPVCKALIQEEKLVPLYGRGKNKTDPRSKSYSGMEIPNRPAGQRPATAPPPPPETNQFANYGFGLMGSFVPMATARIGNFTMGFGGLLPSLFNIHFHGFPDATVYGTTSGFPYGFNTFHGGVAHGFPQLTTRGQQP

SEQ ID NO: 536 - DNA, 995 bp, Gossypium hirsutum
  misc_feature (1)..(995): Ceres CLONE ID no.1841007
attcccgaaattacctaatttccattcaataaccttctcccttgactctcatcaatctactcttttgattctcaggtatataaggaatggcgagtggttttggtgaatcaacaagcatgcctccaccaagtccatcttgctcgagcagtaataatgctaacgatgctggtgattttgaatgcaatatttgctttgaattggctcaagatccaatcgtcacactttgtggtcatctcttctgctggccatgtctctatagatggttgcaccatcactcgcattctcaagaatgtccggtttgcaaggccctgatacaagaggaaaaacttgttcccctttatggcagggggaaaaacaagactgacccgcgctctaaatcgtattcgggcatggaaatcccaaaccgcccagctgggcaaaggccggctactgctcctcctccacccccggaaacaaatcagtttgcaaattatgggtttggattgatgggcagttttgttccgatggcaaccgcaaggatcggtaacttcaccatgggttttggaggcctattgccatccttgtttaatattcattttcatggatttccagatgctacggtgtatggaacaacttcagggtttccttatgggttcaatacatttcacggtggtgttgctcatgggtttccccagctgacgacacgagggcagcagcctgataatgttttgaagaatcttctgttgttgattggggtgtttgtcgtcctcgctttgctttattggtgaaatagttcagcatttaagctgttatccagtgttggatattcagtgtctgtagatataccagcagcactggcgaatgattatgtttgggcttgagaaaaagttgtctatatgaatgatactgtcatttttgtttctttttagcatcagcaacaactcaaaccagtgttaatgttcaccttttcaaaataaaaacaagtgaaagttcctcaaaaaaaaaaaaaaaaaaaa

SEQ ID NO: 537 - protein, 216 aa, Gossypium hirsutum
  misc_feature (1)..(216): Ceres CLONE ID no. 1841007
  misc_feature (1)..(216): Functional Homolog of  Ceres CLONE ID no.  17402
  misc_feature (22)..(62): Pfam Name: zf-C3HC4 Pfam Description: Zinc finger, C3HC4 type (RING finger)
MPPPSPSCSSSNNANDAGDFECNICFELAQDPIVTLCGHLFCWPCLYRWLHHHSHSQECPVCKALIQEEKLVPLYGRGKNKTDPRSKSYSGMEIPNRPAGQRPATAPPPPPETNQFANYGFGLMGSFVPMATARIGNFTMGFGGLLPSLFNIHFHGFPDATVYGTTSGFPYGFNTFHGGVAHGFPQLTTRGQQPDNVLKNLLLLIGVFVVLALLYW

SEQ ID NO: 538 - DNA, 1133 bp, Gossypium hirsutum
  misc_feature (1)..(1133): Ceres CLONE ID no.1836048
aacgttttccccactgctcaattacttattttctgctttgcaatttacaatttattaaaaatatataaataataaattatgtagaaatttgaaaaccctcgattcttccctaaatttgcccaacttcccattaataataactctctttcctcgactccctaaaaaaataaacagaaataattaacgaaaattgatccaatcagttccttcaatacccaggaatggggagcggttttggggaatcaacaagcagactacccccaagtccgccttgctcgggtagtactgataatgctaacgatgccggtggttttgaatgcaatatctgcttcgagttagctcaagacccgatcgtcactctttgcggtcacctcttttgttggccgtgtctatacagatggttacaccatcactgtcattgccatgaatgccctgtttgcaaagccctcatacaagaggaaaaactcgttcctctttatggtaggggcaaaaaccataccgatccacgttcaaaattgtatcccggcatggaaatccctaaccgtcccacagggcaaagaccggcaactgctcctcctcctcccccagaagccaatccatttggcaattacaggtttggactaatgggaggtttcgttccaatggcaaccaccaggatcggtaacttcacaatggggtttggaggcttattgccatcattgtttaacatccagtcccatggattcccagatgctactgtttacggaacaacttcggggttccctttcgggtacaatacagttcatggcagtcatcctcatgggtttccccagccaccaaccactcgaggacagcaagcagataacgtgttgaagaatcttcttttgttgatcggggtcttcgtagtccttgctctgctatattggtgaaataggtataaccgcttaagctcagacaaagcttggttatctagtgtctgtatatatatgcttatagccgaatcgacgattctgttttggctcgagaagaagttgtcaatataatactttgccatttgtagcttcaggaacaacttacactcgtcttaattcgttcttttcaaaataaaaaaaggaattagctcgtttcccccggaaaaaaaaaaaaaaaaaaaa

SEQ ID NO: 539 - protein, 228 aa, Gossypium hirsutum
  misc_feature (1)..(228): Ceres CLONE ID no. 1836048
  misc_feature (1)..(228): Functional Homolog of  Ceres CLONE ID no.  17402
  misc_feature (33)..(73): Pfam Name: zf-C3HC4 Pfam Description: Zinc finger, C3HC4 type (RING finger)
MGSGFGESTSRLPPSPPCSGSTDNANDAGGFECNICFELAQDPIVTLCGHLFCWPCLYRWLHHHCHCHECPVCKALIQEEKLVPLYGRGKNHTDPRSKLYPGMEIPNRPTGQRPATAPPPPPEANPFGNYRFGLMGGFVPMATTRIGNFTMGFGGLLPSLFNIQSHGFPDATVYGTTSGFPFGYNTVHGSHPHGFPQPPTTRGQQADNVLKNLLLLIGVFVVLALLYW

SEQ ID NO: 540 - DNA, 684 bp, Populus balsamifera subsp. trichocarpa
  misc_feature (1)..(684): Ceres ANNOT ID no. 1541305
atggaaagtggatatgaggaatcgacaagtgtgcgtctggaaagctcgtctttttcgagcaataacggcactgatgcaggcgattttgaatgcaatatttgctttgaattagctcaggacccgatcgtaactctttgcggtcatctcttttgttggccctgtctataccgatggttacaccaccattcgcattcacatgaatgcccagtttgtaaggccatcatacaagaagagaaattggttcctctttatggtagagggaaaactcaggctgaccctcgatctaaatcttatccgggtattgatattcctactcgcccgtctggacaaaggcctgaaactgctcctccgccggatgcaaataatttaccccattttgggtttggaatgccaggaggattcatgcctgcagcgccaacaaggattggtggctttacgatttcaactgcttttggtggtctatcacttttcccatcgttgtttaatattcagtttcaagggtacccagatgctactgtgtatggaacaacatctggatttccatatggctttcatggttttcacggcaatcgtacacaccgcttcccacctgcaactactcgagggcagcaggccgataatgttttgaagaacctcttcttttttattggattcttggtggtcctcgctctgctttggtggtaa

SEQ ID NO: 541 - protein, 227 aa, Populus balsamifera subsp. trichocarpa
  misc_feature (1)..(227): Ceres ANNOT ID no. 1541305
  misc_feature (1)..(227): Functional Homolog of  Ceres CLONE ID no.  17402
  misc_feature (31)..(71): Pfam Name: zf-C3HC4 Pfam Description: Zinc finger, C3HC4 type (RING finger)
MESGYEESTSVRLESSSFSSNNGTDAGDFECNICFELAQDPIVTLCGHLFCWPCLYRWLHHHSHSHECPVCKAIIQEEKLVPLYGRGKTQADPRSKSYPGIDIPTRPSGQRPETAPPPDANNLPHFGFGMPGGFMPAAPTRIGGFTISTAFGGLSLFPSLFNIQFQGYPDATVYGTTSGFPYGFHGFHGNRTHRFPPATTRGQQADNVLKNLFFFIGFLVVLALLWW

SEQ ID NO: 542 - DNA, 768 bp, Populus balsamifera subsp. trichocarpa
  misc_feature (1)..(768): Ceres ANNOT ID no. 1487895
atggaaagtggatatgaggaatcgacaagtgtgcgtctggaaagctcgtctttttcgagcaataacggcactgatgcaggcgattttgaatgcaatatttgctttgaattagctcaggacccgatcgtaactctttgcggtcatctcttttgttggccctgtctataccgatggttacaccaccattcgcattcacatgaatgcccagtttgtaaggccatcatacaagaagagaaattggttcctctttatggtagagggaaaactcaggctgaccctcgatctaaatcttatccgggtattgatattcctactcgcccgtctggacaaaggcctgaaactgctcctccgccggatgcaaataatttaccccattttgggtttggaatgccaggaggattcatgcctgcagcgccaacaaggattggtggctttacgatttcaactgcttttggtggtctatcacttttcccatcgttgtttaatattcagtttcaagggtacccagatgctactgtgtatggaacaacatctggatttccatatggctttcatggttttcacggcaatcgtacacaccgcttcccacctgcaactactcgagggcagcaggccgataatgttttgaagaacctcttcttttttattggattcttggtggtcctcgctctgctttggtgcaatggagtttcagatggtgtcaggaaagttcaggcctttagaatgatgaacgggaatggagggttcctactgcaatctgcaatataa

SEQ ID NO: 543 - protein, 255 aa, Populus balsamifera subsp. trichocarpa
  misc_feature (1)..(255): Ceres ANNOT ID no. 1487895
  misc_feature (1)..(255): Functional Homolog of  Ceres CLONE ID no.  17402
  misc_feature (31)..(71): Pfam Name: zf-C3HC4 Pfam Description: Zinc finger, C3HC4 type (RING finger)
MESGYEESTSVRLESSSFSSNNGTDAGDFECNICFELAQDPIVTLCGHLFCWPCLYRWLHHHSHSHECPVCKAIIQEEKLVPLYGRGKTQADPRSKSYPGIDIPTRPSGQRPETAPPPDANNLPHFGFGMPGGFMPAAPTRIGGFTISTAFGGLSLFPSLFNIQFQGYPDATVYGTTSGFPYGFHGFHGNRTHRFPPATTRGQQADNVLKNLFFFIGFLVVLALLWCNGVSDGVRKVQAFRMMNGNGGFLLQSAI

SEQ ID NO: 544 - DNA, 693 bp, Populus balsamifera subsp. trichocarpa
  misc_feature (1)..(693): Ceres ANNOT ID no. 1510353
atggaaagtggatttgcagaatcgacaagtgtgccgccagaaaggtcgtcttactcgagcaataatggcaatgatgctggtgattttgaatgcaatatttgctttgaattagctcgagacccgattgtaactctttgtggtcatctctattgttggccttgtctgtaccaatggttacacctccactcgcattcccatgaatgcccagtttgcaaggccatcatacaagaggagaaactggttcctctttatggtagagggaattcacagtctgaccctcgatctaaatcgtatccggggattgatattcccagtcgcccatctggacaaaggccggaaactgcccctcctccggatgccaataattcacccaattttgggttcgggatggcgggaggatatatgccaacggccgctgcaaggagtggtaactttactttttcaactgcttttggcggtctgtctcatttcccgtctttttttaatgtccagtttcaagggttcccagatgctactgtctacggaacaacatctggatttccgtatggatttcatggttttcacggttttcacggccaccatgcacaccggttccctccagctactattcgagggcagcgggccgataatgttttgaaaaatctcttctttttaatcggttttttggtggtcatcgccctgctctggtggtaa

SEQ ID NO: 545 - protein, 230 aa, Populus balsamifera subsp. trichocarpa
  misc_feature (1)..(230): Ceres ANNOT ID no. 1510353
  misc_feature (1)..(230): Functional Homolog of  Ceres CLONE ID no.  17402
  misc_feature (31)..(71): Pfam Name: zf-C3HC4 Pfam Description: Zinc finger, C3HC4 type (RING finger)
MESGFAESTSVPPERSSYSSNNGNDAGDFECNICFELARDPIVTLCGHLYCWPCLYQWLHLHSHSHECPVCKAIIQEEKLVPLYGRGNSQSDPRSKSYPGIDIPSRPSGQRPETAPPPDANNSPNFGFGMAGGYMPTAAARSGNFTFSTAFGGLSHFPSFFNVQFQGFPDATVYGTTSGFPYGFHGFHGFHGHHAHRFPPATIRGQRADNVLKNLFFLIGFLVVIALLWW

SEQ ID NO: 546 - protein, 220 aa, Capsicum chinense
  misc_feature (1)..(220): Public GI no. 68299223
  misc_feature (1)..(220): Functional Homolog of  Ceres CLONE ID no.  17402
  misc_feature (28)..(68): Pfam Name: zf-C3HC4 Pfam Description: Zinc finger, C3HC4 type (RING finger)
MQDSTTRAFASSSSSSGDGNNDAGDFECNICFELAQDPIVTLCGHLYCWPCLYRWLRLHPQCHECPVCKALIQEEKLVPLYGRGRTFTDPRSKPIPGLEIPSRPAGQRPETAPQPEPNNFPNLGFGHMGGFFPTATARFGNFSMFAGFGGLLPSLLSFQFHGFPGPTAYPTTSNHPFGYTPAYHGAHVRNAHDTAQVQADSNLKFMFLLVGFLVLIYLLG

SEQ ID NO: 547 - DNA, 573 bp, Arabidopsis thaliana
  misc_feature (1)..(573): Ceres CLONE ID no.  1845
  misc_feature (1)..(573): GEMINI ID 532A12
ctattattcggggactaaagaaagccaaagaaaacatgaaaataatagtctccatcttagtgttagcctctcttcttctaatcagttcatctcttgcttcggctactatatcagatgcttttggtagtggcgcggtagctccggcaccgcagagcaaagatggaccggcgttagagaaatggtgtggacagaaatgtgaagggagatgcaaagaagcggggatgaaagatcggtgtttgaagtattgtgggatatgttgcaaagactgtcagtgtgttccttcaggcacttatgggaataagcatgaatgtgcttgctatcgtgacaagctcagtagcaaaggcactcctaaatgtccttgattctatttctttccaaccaaaaatttaaataaatgaataagagagatccagtaaactaatataaaactataaatggatcttttgtttatgattttttttttttcatttctatttttacgaatttgtcttggtctttttgaagtaagtttttaaatattgaaaagtgctaaaattatgtggaaatcgataatgttaatgaatgatataatat

SEQ ID NO: 548 - protein, 108 aa, Arabidopsis thaliana
  misc_feature (1)..(108): Ceres CLONE ID no.  1845
  misc_feature (1)..(108): GEMINI ID 532A12
  misc_feature (1)..(108): Pfam Name: GASA Pfam Description: Gibberellin regulated protein
MKIIVSILVLASLLLISSSLASATISDAFGSGAVAPAPQSKDGPALEKWCGQKCEGRCKEAGMKDRCLKYCGICCKDCQCVPSGTYGNKHECACYRDKLSSKGTPKCP

SEQ ID NO: 549 - protein, 90 aa, Triticum aestivum
  misc_feature (1)..(90): Ceres CLONE ID no. 890211
  misc_feature (1)..(90): Functional Homolog of  Ceres CLONE ID no.  1845
  misc_feature (1)..(90): Pfam Name: GASA Pfam Description: Gibberellin regulated protein
MKLVFGTLLLCSLLLSFSFLEPVIAYEDSSYCSNKCADRCSSAGVKDRCVKYCGICCVECKCVPSGTYGNKHECPCYRDKLNKKGKPKCP

SEQ ID NO: 550 - protein, 90 aa, Glycine max
  misc_feature (1)..(90): Ceres CLONE ID no. 556120
  misc_feature (1)..(90): Functional Homolog of  Ceres CLONE ID no.  1845
  misc_feature (1)..(90): Pfam Name: GASA Pfam Description: Gibberellin regulated protein
MKLVFATLLLCSLLLSSSFLEPVIAYEDSSYCSNKCSDRCSSAGVKDRCLRYCGICCAECKCVPSGTYGNKHQCPCYRDKLNKKGKPKCP

SEQ ID NO: 551 - protein, 90 aa, Glycine max; identical to SEQ ID NO: 550
  misc_feature (1)..(90): Ceres CLONE ID no. 1618178
  misc_feature (1)..(90): Functional Homolog of  Ceres CLONE ID no.  1845
  misc_feature (1)..(90): Pfam Name: GASA Pfam Description: Gibberellin regulated protein

SEQ ID NO: 552 - DNA, 309 bp, Populus balsamifera subsp. trichocarpa
  misc_feature (1)..(309): Ceres ANNOT ID no. 1483577
atgaagctctcttttgcagcactgctgctactttcagtggtcctcctgtcctctttccttcggttcaccatggctgtgcccaaccacgtcgcgtcacctccacctccctccccagcaattccaagtttctgtgatccaaagtgcaaggctaggtgtgccaaggcgggatactaccaacgctgctatgactactgtataatctgctgcaaagattgcaagtgtgtgccttcagggacttacggaaacaagtcagaatgtccatgctacagagacaagttgaactcaaagggcacctccaaatgcccttaa

SEQ ID NO: 553 - protein, 102 aa, Populus balsamifera subsp. trichocarpa
  misc_feature (1)..(102): Ceres ANNOT ID no. 1483577
  misc_feature (1)..(102): Functional Homolog of  Ceres CLONE ID no.  1845
  misc_feature (1)..(102): Pfam Name: GASA Pfam Description: Gibberellin regulated protein
MKLSFAALLLLSVVLLSSFLRFTMAVPNHVASPPPPSPAIPSFCDPKCKARCAKAGYYQRCYDYCIICCKDCKCVPSGTYGNKSECPCYRDKLNSKGTSKCP

SEQ ID NO: 554 - DNA, 1353 bp, Arabidopsis thaliana
  misc_feature (1)..(1353): Ceres CLONE ID no.  205648
  misc_feature (1)..(1353): GEMINI ID 536E7
caaatgatcccaataattattcttctctttatctctcttttcctcttaaccatccactaatcaaacactaaaacctagaaaaaaaaaggatcaaatcatggagacggaagaagagatgaaggaaagtagtataagcatggtggaggcaaagttgcctccgggattcagatttcacccgaaggacgatgagcttgtctgcgattacttgatgagacgatcgcttcacaataatcatcgaccacctcttgtcctgatccaagtcgatctcaacaagtgtgagccttgggacatcccaaaaatggcatgcgtgggagggaaggattggtatttctacagccaaagagaccgaaaatacgcgacggggctgagaactaaccgagcaacggccaccggatattggaaagccaccggcaaagacagaaccattctaagaaagggtaagctagttgggatgaggaagacattggttttctatcaaggtcgagctcctcgaggccgtaaaaccgattgggtcatgcacgaattccgtctccaaggatctcatcatcctcccaatcattctctgagctctccaaaggaagactgggtcttgtgtagggtattccataagaatacggaaggagttatatgtagagacaacatgggaagctgttttgatgagacagcctctgcatcgcttcctccactgatggatccttacatcaactttgaccaagaaccctcttcttatctcagtgatgatcatcactacatcatcaatgagcacgtaccctgcttctccaatttgtcacagaaccaaaccttaaactcgaacctaaccaactcagtctctgaactcaagattccatgcaagaaccctaaccccttgtttactggtggttcagcctcagccacgctcacaggcctcgactcattctgttcttcagatcagatggttctcagagctctactcagtcagctcactaagattgatggaagcctcgggcctaaagaatcacagagttatggagaaggtagctcggagagcctcctgaccgacatcggtattccaagcactgtttggaattgctgatgatcgagtgtaacgagagttactattgctatattcctatccatgattggaacaattcttcggggggaaataacgtgtgcttgtctgattgtacaaacatttcctcactcttgtacccacggtagattcatgtaaaataccacttatgacgctagacatacatatatttcatcgtagttccatttgtttcaaggtattaaggacctctagaacaattgatcaaaaagataatatgaaacatcactacctgtgtacatgatgggataggtgattgaatagcc

SEQ ID NO: 555 - protein, 324 aa, Arabidopsis thaliana
  misc_feature (1)..(324): Ceres CLONE ID no.  205648
  misc_feature (1)..(324): GEMINI ID 536E7
  misc_feature (19)..(146): Pfam Name: NAM Pfam Description: No apical meristem (NAM) protein
METEEEMKESSISMVEAKLPPGFRFHPKDDELVCDYLMRRSLHNNHRPPLVLIQVDLNKCEPWDIPKMACVGGKDWYFYSQRDRKYATGLRTNRATATGYWKATGKDRTILRKGKLVGMRKTLVFYQGRAPRGRKTDWVMHEFRLQGSHHPPNHSLSSPKEDWVLCRVFHKNTEGVICRDNMGSCFDETASASLPPLMDPYINFDQEPSSYLSDDHHYIINEHVPCFSNLSQNQTLNSNLTNSVSELKIPCKNPNPLFTGGSASATLTGLDSFCSSDQMVLRALLSQLTKIDGSLGPKESQSYGEGSSESLLTDIGIPSTVWNC

SEQ ID NO: 556 - protein, 278 aa, Musa acuminata
  misc_feature (1)..(278): Public GI no. 102139801
  misc_feature (1)..(278): Functional Homolog of  Ceres CLONE ID no.  205648
  misc_feature (13)..(144): Pfam Name: NAM Pfam Description: No apical meristem (NAM) protein
MAMSHLSMVEARLPPGFRFHPRDDELVCDYLERKVSGENGNGGMHGWPVIVDVDLNKCEPWELPEMACVGDKEWYFFNLRDRKYATGQRTNRATRSGYWKATGKDRRVARRGMLVGMRKTLVFYRGRAPKGRKTDWVMHEFRIEPSSNPPNFSFEEDWVLCRVSSKTRGVITKPDVKNYDDDTTSSSLPPLRNTYITFDQAPRSLEGFEQVPCFSNFTAQLAAAAPPVGSPDLSYYDNKFSTRPAFDHFPKLNPPNIIQENLESYFGENAVSHMRNPF

SEQ ID NO: 557 - protein, 299 aa, Phaseolus vulgaris
  misc_feature (1)..(299): Public GI no. 15148912
  misc_feature (1)..(299): Functional Homolog of  Ceres CLONE ID no.  205648
  misc_feature (11)..(135): Pfam Name: NAM Pfam Description: No apical meristem (NAM) protein
MSNISMVEAKLPPGFRFHPRDEELVCDYLMKKLTHNDSLLMIDVDLNKCEPWDIPETACVGGKDWYFYTQRDRKYATGLRTNRATASGYWKATGKDRPILRKGTLVGMRKTLVFYQGRAPKGRKTEWVMHEFRIEGPHGPPKVSSSKEDWVLCRVFYKSREVSAKPSMGSCYEDTGSSSLPALMDSYISFDQTQAHADEFEQVPCFSIFSQNQANPIFNHMTTMEPKLPATTYGGAPNLGYCLDPLSCDRKVLKAVLSQITKMERNPLNQSLKGSTSFGEGSSESYLSEVGMPHMWNNY

SEQ ID NO: 558 - protein, 302 aa, Glycine max
  misc_feature (1)..(302): Ceres CLONE ID no. 577178
  misc_feature (1)..(302): Functional Homolog of  Ceres CLONE ID no.  205648
  misc_feature (11)..(135): Pfam Name: NAM Pfam Description: No apical meristem (NAM) protein
MSNISMVEAKLPPGFRFHPRDEELVCDYLMKKVQHNDSLLLIDVDLNKCEPWDIPETACVGGKEWYFYTQRDRKYATGLRTNRATASGYWKATGKDRPILRKGTHVGMRKTLVFYQGRAPKGRKTEWVMHEFRIEGPHGPPKISSSKEDWVLCRVFYKNSEVLAKPSMGSCYEDTGSSTLPALMDSYISFDQTQTHADEFEQVPCFSIFSQNQTNPIFNHMTTMEPKFPLNHATTTYGGAPNLGYCLDPLSCDRKMLKAVLNQITKMERNPLNQSLKGSPSLGEGSSESYLSEVGMPHVWNY

SEQ ID NO: 559 - protein, 308 aa, Triticum aestivum
  misc_feature (1)..(308): Ceres CLONE ID no. 644344
  misc_feature (1)..(308): Functional Homolog of  Ceres CLONE ID no.  205648
  misc_feature (11)..(148): Pfam Name: NAM Pfam Description: No apical meristem (NAM) protein
MSSLSMVEARLPPGFRFHPRDDELVLDYLSRKLGGGGAGGAAAAVASIYGCPAMVDVDLNKIEPWDLPEIACIGGKEWYFYSLRDKKYATGQRTNRATESGYWKATGKDRAISRKGLLVGMRKTLVFYEGRAPKGKKTEWVMHEFRKEGQGDLMKLPLKEDWVLCRVFYKTRTTIAKPSTGSNYNIDSAAATSLPPLIDNYIAFDHPGMSTVQNLEGYEQVPCFSNGPSSHPSSSASMNIPVMAMAPMAADQEQQHMGKAIKDALSQLTRFEQGNVKREAPAQGGVFAQDGFEYLAESGFSQMWNSLS

SEQ ID NO: 560 - protein, 304 aa, Oryza sativa
  misc_feature (1)..(304): Public GI no. 52076897
  misc_feature (1)..(304): Functional Homolog of  Ceres CLONE ID no.  205648
  misc_feature (14)..(153): Pfam Name: NAM Pfam Description: No apical meristem (NAM) protein
MSGMNSLSMVEARLPPGFRFHPRDDELVLDYLERKLLDGGVGGAAAAAAAVTIYGCPVMVDVDLNKCEPWDLPEIACVGGKEWYFYSLRDRKYATGQRTNRATESGYWKATGKDRPISRKGLLVGMRKTLVFYKGRAPKGKKTEWVMHEFRKEGQGDPMKLPLKEDWVLCRVFYKSRTTIAKLPTEGSYNNIDSVATTSLPPLTDNYIAFDQPGSMQNLEGYEQVPCFSNNPSQQPSSSMNVPLTSAMVDQEQNNMGRAIKDVLSQFTKFEGNVKREALQSNFSQDGFDYLAESGFTQMWNSLS

SEQ ID NO: 561 - protein, 284 aa, Zea mays
  misc_feature (1)..(284): Ceres CLONE ID no. 1674566
  misc_feature (1)..(284): Functional Homolog of  Ceres CLONE ID no.  205648
  misc_feature (12)..(143): Pfam Name: NAM Pfam Description: No apical meristem (NAM) protein
MSSSISMMEARMPPGFRFHPRDDELVMDYLLQKLSGHGHHAGAAIVVDVDLNKCEPWDLPDSACVGGKEWYFFSLRDRKYATGQRTNRATHSGYWKATGKDRAVVAGGEDAVAVGMRKTLVFYRGRAPRGRKTEWVMHEFRLHPHAAPCLLPAAAANKEDWVLCRVFYKSRTTTPRPESEDARDGTPSAESQLPAALPLAPLADTYAAPTVAEKVYCLSGLPELPFRRPVSLGDLLAFEASEKESVTTVMTSVSNNTSSVLELTPNCNWNQENGMSRMWSPLGI

SEQ ID NO: 562 - DNA, 909 bp, Populus balsamifera subsp. trichocarpa
  misc_feature (1)..(909): Ceres ANNOT ID no. 1456842
atgagcaacataagctttgtggaggcaaaactgccaccagggtttaggttccatccaagagatgaagagcttgtatgtgattacttgatgaagaaggcttctcactgcgactcccttctcatgatagaggtcgacctcaacaagtgtgagccttgggatattcctgaaacggcatgcgtgggaggcaaggaatggtacttttacagccaaagagatcgtaaatatgcaactggactaagaactaatcgagcaacagcatctggatattggaaggccaccgggaaggacagacatatcctacgtaagggaacccttgttggcatgagaaagaccttggtgttctaccaaggtagggcacctaaagggaaaaaaaccgattgggtcatgcatgagtttcggcttgaagggccacttggtcagcccaaaacttcttcagagaaggaagattgggtcttatgtcgagtgttctataaaaacaccagagaagttgtggccaaacctagcataagaagctgctatgatgacacaggctcttcatctttgcctgcattaatggattcatacatcacttttgaccaaactcaacccaatttagatgagcacgagcaagtgccctgcttctccattttctcccaaatccaaaccaaccaaaatttcccttacataactcaaatggaagtaccaaatttacccacaaagggtacaggcccatttgggcaagtacctatgaatattaccactcattcagacgctttttcttgtgacacaaaggtactaaaagctgttttgaatcacttcaacatgatggaaagcaatgccaacattaaagggtcaccaagcttaggagaaggtagttcagaaagctacttatctgatgtgggcatgcccaacttatggaatcattattga

SEQ ID NO: 563 - protein, 302 aa, Populus balsamifera subsp. trichocarpa
  misc_feature (1)..(302): Ceres ANNOT ID no. 1456842
  misc_feature (1)..(302): Functional Homolog of  Ceres CLONE ID no.  205648
  misc_feature (11)..(135): Pfam Name: NAM Pfam Description: No apical meristem (NAM) protein
MSNISFVEAKLPPGFRFHPRDEELVCDYLMKKASHCDSLLMIEVDLNKCEPWDIPETACVGGKEWYFYSQRDRKYATGLRTNRATASGYWKATGKDRHILRKGTLVGMRKTLVFYQGRAPKGKKTDWVMHEFRLEGPLGQPKTSSEKEDWVLCRVFYKNTREVVAKPSIRSCYDDTGSSSLPALMDSYITFDQTQPNLDEHEQVPCFSIFSQIQTNQNFPYITQMEVPNLPTKGTGPFGQVPMNITTHSDAFSCDTKVLKAVLNHFNMMESNANIKGSPSLGEGSSESYLSDVGMPNLWNHY

SEQ ID NO: 564 - protein, 356 aa, Capsicum annuum
  misc_feature (1)..(356): Public GI no. 34558777
  misc_feature (1)..(356): Functional Homolog of  Ceres CLONE ID no.  205648
  misc_feature (14)..(143): Pfam Name: NAM Pfam Description: No apical meristem (NAM) protein
MSSNSSLSVVESKLPPGFRFHPRDEELICDYLMKKIDQSPDQQQQYPFLIEVDLNKSEPWEIPEVACVGGKEWYFYSQRDRKYATGLRTNRATVSGYWKATGKDRAVVRKGSLVGMRKTLVFYQGRAPKGRKSDWVMHEFRLEGPLNNNIRPQISSPREDWVLCRVFHKNKELLAAKQGTSSNNIYYDDGTISSSSVPQLMENPYITFDQTQPNNNNINMNELYYEQVPCFSIFTPNQTTFTSHSHHHHHPATSTTTGATPITTAYGGFPADIGNYLNATATSSTCDNKVIKAVLSHLSTKNIIMEGNNNNSNFNNSSAQNIMNIKGGNSPSFGEVSSETSFLSEVAYHPTMWNNY

SEQ ID NO: 565 - DNA, 1281 bp, Arabidopsis thaliana
  misc_feature (1)..(1281): Ceres CLONE ID no.  21406
  misc_feature (1)..(1281): GEMINI ID 553A11
aatcttttatttttcttttagaaaccaaacttttcagatttctctctctccatttggcgatagaagaagtcatgtaccaatcatcatcctccacgtcatcatcatcgcagagatcatcgcttcccggcggcggaggactgatccgttacggctcagctccgggatcgtttctaaactctgtggttgacgaagtcatcggaggaggctcatcaaacgctcgtgacttcaccggctatcaaccgtcgtcggataacttcatcggtaactttttcaccggagctgctgactcatcctcgctgagatccgattcgacgacttgtggagtcaacaactcatccgacggacacaaacagctaggcaataacaataataataatagtaataaagatatcttcctcgacagatcctacggtggattcaacgagatctcgcaacaacacaagagcaacgacatcggaggaggaaacagctcaggatcttactctctcgctagacaacgtagctctcccgccgatttcttcacctacctcgcctcagataaaaacaatttctcgttgaaccaaccaaccagtgattatagtccgcaaggagggtctaatgggggacgaggacattccagattgaagtctcagctaagcttcacgaatcacgactctctggctcggatcaacgaggtcaatgagaccccagtccacgacggttcaggccattcgttttctgcggctagctttggtgcagccactactgattcttgggatgacggttccggttcaatagggtttaccgtgactaggcccagtaaacgatccaaggacatggactctggtctcttttcgcagtatagtcttccttcagacacttcaatgaactacatggataacttcatgcagcttccagaagattctgtaccctgcaaaatccgggccaaacgcggctgcgccacccatcctagaagcatcgctgagcgggagaggagaacgagaataagtgggaagctaaagaagctacaagatcttgtccccaacatggataagcaaacaagctattcagacatgctggatttagctgtacaacacatcaaaggccttcagcatcaacttcagaatttgaaaaaagatcaagagaattgcacgtgtggatgcagtgagaaaccaagctagctcaaacccaaaggtagggtcatcctaattttatttgcattgttccgattttatcatatgagagaattagagaagatgtaaataaaatagattatattaaatgtctaatcctcttataatt

SEQ ID NO: 566 - protein, 362 aa, Arabidopsis thaliana
  misc_feature (1)..(362): Ceres CLONE ID no.  21406
  misc_feature: Bit score of 996.1 for HMM based on sequences of FIGURE 28
  misc_feature (1)..(362): GEMINI ID 553A11
  misc_feature (292)..(340): Pfam Name: HLH Pfam Description: Helix-loop-helix DNA-binding domain
MYQSSSSTSSSSQRSSLPGGGGLIRYGSAPGSFLNSVVDEVIGGGSSNARDFTGYQPSSDNFIGNFFTGAADSSSLRSDSTTCGVNNSSDGHKQLGNNNNNNSNKDIFLDRSYGGFNEISQQHKSNDIGGGNSSGSYSLARQRSSPADFFTYLASDKNNFSLNQPTSDYSPQGGSNGGRGHSRLKSQLSFTNHDSLARINEVNETPVHDGSGHSFSAASFGAATTDSWDDGSGSIGFTVTRPSKRSKDMDSGLFSQYSLPSDTSMNYMDNFMQLPEDSVPCKIRAKRGCATHPRSIAERERRTRISGKLKKLQDLVPNMDKQTSYSDMLDLAVQHIKGLQHQLQNLKKDQENCTCGCSEKPS

SEQ ID NO: 567 - protein, 362 aa, Arabidopsis thaliana
  misc_feature (1)..(362): Public GI no. 24030386
  misc_feature: Bit Score of  996.4 for HMM based on sequences of FIGURE 28
  misc_feature (1)..(362): Functional Homolog of  Ceres CLONE ID no.  21406
  misc_feature (292)..(340): Pfam Name: HLH Pfam Description: Helix-loop-helix DNA-binding domain
MYQSSSSTSSSSQRSSLPGGGGLIRYGSAPGSFLNSVVDEVIGGGSSNARDFTGYQPSSDNFIGNFFTGAADSSSLRSDSTTCGVNNSSDGQKQLGNNNNNNSNKDIFLDRSYGGFNEISQQHKSNDIGGGNSSGSYSLARQRSSPADFFTYLASDKNNFSLNQPTSDYSPQGGSNGGRGHSRLKSQLSFTNHDSLARINEVNETPVHDGSGHSFSAASFGAATTDSWDDGSGSIGFTVTRPSKRSKDMDSGLFSQYSLPSDTSMNYMDNFMQLPEDSVPCKIRAKRGCATHPRSIAERERRTRISGKLKKLQDLVPNMDKQTSYSDMLDLAVQHIKGLQHQLQNLKKDQENCTCGCSEKPS

SEQ ID NO: 568 - protein, 323 aa, Arabidopsis thaliana
  misc_feature (1)..(323): Public GI no. 6850309
  misc_feature: Bit Score of 817.5 for HMM based on sequences of FIGURE 28
  misc_feature (1)..(323): Functional Homolog of  Ceres CLONE ID no.  21406
MYQSSSSTSSSSQRSSLPGGGGLIRYGSAPGSFLNSVVDEVIGGGSSNARDFTGYQPSSDNFIGNFFTGAADSSSLRSDSTTCGVNNSSDGQKQLGNNNNNNSNKDIFLDRSYGGFNEISQQHKSNDIGGGNSSGSYSLARQRSSPADFFTYLASDKNNFSLNQPTSDYSPQGGSNGGRGHSRLKSQLSFTNHDSLARINEVNETPVHDGSGHSFSAASFGAATTDSWDDGSGSIGFTVTRPSKRSKDMDSGLFSQYSLPSDTSMNYMDNFMQLPEDSVPCKIRAKRGCATHPRSIAERERRTRISGKLKKLQDLVPNMDKVS

SEQ ID NO: 569 - DNA, 768 bp, Populus balsamifera subsp. trichocarpa
  misc_feature (1)..(768): Ceres ANNOT ID no. 1525350
atgtatcaacaaccgtcgtcgtcttcttcttcaccgcaaaaatccaatctgccaagtgggctaacaaggtatggttcggccccgggttcttttttaacccgagcagttgattcagtcatcggggctgaccgtgaactctctggtcttggatcaactcccctcgtgggccgtcaacaacacttctctggggactcaccctcaatcacctcggagtcgacctgcaaagtcaactcatccagctgcgatcgaaaagcacccaaaagtggcggcggcggggggttgcagaggtcgtacggtttgaatgagatagcacatggtgctggatctttggtgcggcagaggagctcgcctgctggatttctaagccatctcgccactgaaaatgtggagaagctgctacaaattcctgaagactctgttccttgcaaaatccgtgctaaacgtggttgtgccactcatcctagaagcattgctgaaagggagagaagaaccagaataagtgggaagctgaagacactacaagacctcgttcctaacatggataagcaaacaagttatgcagacatgttggagttggcagtgaagcatataaagggccttcaaaatgaagtggagatgctatgctgtactacttattgctggtcctttcctaatcttcacttgatatttgtttgcccatctctcacagaaactccacaaagaattggaaggttgtacttgtggatgcaaacaatcaaccccatgatattgccaacaaaggagatctaa

SEQ ID NO: 570 - protein, 255 aa, Populus balsamifera subsp. trichocarpa
  misc_feature (1)..(255): Ceres ANNOT ID no. 1525350
  misc_feature: Bit Score of 571.5 for HMM based on sequences of FIGURE 28
  misc_feature (1)..(255): Functional Homolog of  Ceres CLONE ID no. 21406
  misc_feature (153)..(201): Pfam Name: HLH Pfam Description: Helix-loop-helix DNA-binding domain
MYQQPSSSSSSPQKSNLPSGLTRYGSAPGSFLTRAVDSVIGADRELSGLGSTPLVGRQQHFSGDSPSITSESTCKVNSSSCDRKAPKSGGGGGLQRSYGLNEIAHGAGSLVRQRSSPAGFLSHLATENVEKLLQIPEDSVPCKIRAKRGCATHPRSIAERERRTRISGKLKTLQDLVPNMDKQTSYADMLELAVKHIKGLQNEVEMLCCTTYCWSFPNLHLIFVCPSLTETPQRIGRLYLWMQTINPMILPTKEI

SEQ ID NO: 571 - DNA, 984 bp, Populus balsamifera subsp. trichocarpa
  misc_feature (1)..(984): Ceres ANNOT ID no. 1498288
atgtatcaacagccgtcgtcgtcatcctcgtcgccacaaaaacctacggtcccaagtgggctgaccaggtatggctcagccccaggctcttttttaaccagagctgttgattcagtcatcggggttgaccgtgaactctctggccttggatcgacttcccttgtgggcagtcgacaatacttctctggtgactcgccctcggtaacctcagagtcaacttgcaaagtcaacccttccagctgcgatccaaaagcacccaaaagtggtggcagtagcggcagtttgcagaggtcgtacggctttaatgaggtagcacatggtgctggatctttggtgcggcagaggagctcacctgctggatttctaagccatctcgccactgaaaatggtggtttctcaattacaagggaatctggaggctataacgctcacagtggccctggtggtggccactcggtatcaaggttgaagcctcagttgagctttactaggcaagagtctctttctcagatatctgaagttagtgagaatgttgttgaaggcattggctctgacaataaccaccagaactgcactcattcttattctgctgctggctttggtatggaatcttgggacaatccaaattccattgtattctctggacccccctcgaaacaatttagcctgcctcagacaagtcttgagatagaaacagtggagaagctgctacatgttcctgaagactctgttccttgcaaaatccgtgctaagcgtggctttgccactcatccaagaagcattgctgaaagggagagaagaaccagaataagtgggaaactgaagaaactacaagatctcgttccgaacatggataagcaaacaagttatgcagacatgctggatttcgcagtgcagcatatcaaaggccttcaaaatgaggtggagaaactccacaaagaaatggaaaattgtacctgtggatgcgaaaaatcaaccccatga

SEQ ID NO: 572 - protein, 327 aa, Populus balsamifera subsp. trichocarpa
  misc_feature (1)..(327): Ceres ANNOT ID no. 1498288
  misc_feature: Bit Score of  894.1 for HMM based on sequences of FIGURE 28
  misc_feature (1)..(327): Functional Homolog of  Ceres CLONE ID no.  21406
  misc_feature (257)..(305): Pfam Name: HLH Pfam Description: Helix-loop-helix DNA-binding domain
MYQQPSSSSSSPQKPTVPSGLTRYGSAPGSFLTRAVDSVIGVDRELSGLGSTSLVGSRQYFSGDSPSVTSESTCKVNPSSCDPKAPKSGGSSGSLQRSYGFNEVAHGAGSLVRQRSSPAGFLSHLATENGGFSITRESGGYNAHSGPGGGHSVSRLKPQLSFTRQESLSQISEVSENVVEGIGSDNNHQNCTHSYSAAGFGMESWDNPNSIVFSGPPSKQFSLPQTSLEIETVEKLLHVPEDSVPCKIRAKRGFATHPRSIAERERRTRISGKLKKLQDLVPNMDKQTSYADMLDFAVQHIKGLQNEVEKLHKEMENCTCGCEKSTP

SEQ ID NO: 573 - DNA, 1125 bp, Populus balsamifera subsp. trichocarpa
  misc_feature (1)..(1125): Ceres ANNOT ID no. 1471938
atgtatcaacaaccgtcgtcgtcttcttcttcaccgcaaaaatccaatctgccaagtgggctaacaaggtatggttcggccccgggttcttttttaacccgagcagttgattcagtcatcggggctgaccgtgaactctctggtcttggatcaactcccctcgtgggccgtcaacaacacttctctggggactcaccctcaatcacctcggagtcgacctgcaaagtcaactcatccagctgcgatcgaaaagcacccaaaagtggcggcggcggggggttgcagaggtcgtacggtttgaatgagatagcacatggtgctggatctttggtgcggcagaggagctcgcctgctggatttctaagccatctcgccactgaaaatggaggtttctcaattacaaggggaactggaggctataactctcgcaatggctctggtggtggcccctcaaggttgaagtctcaattgagcttcactagacaagactctctttctcagatatctgaagttagtgagaatgttgttgaaggcatcggctctgacaatggcagtcagaactccactcattcttattctgcggctagctttggtatggaatcttgggacactccaaattccattgtattttctggccatccctcgaaacaagctaggactggagatggagacatttatagctgtttcaatgcgttagaaactcagtttagcctgccccagacaagtcttgagatggcaacagtggagaagctgctacaaattcctgaagactctgttccttgcaaaatccgtgctaaacgtggttgtgccactcatcctagaagcattgctgaaagggagagaagaaccagaataagtgggaagctgaagacactacaagacctcgttcctaacatggataagcaaacaagttatgcagacatgttggagttggcagtgaagcatataaagggccttcaaaatgaagtggagatgctatgctgtactacttattgctggtcctttcctaatcttcacttgatatttgtttgcccatctctcacagaaactccacaaagaattggaaggttgtacttgtggatgcaaacaatcaaccccatgatattgccaacaaaggagatctaa

SEQ ID NO: 574 - protein, 374 aa, Populus balsamifera subsp. trichocarpa
  misc_feature (1)..(374): Ceres ANNOT ID no. 1471938
  misc_feature: Bit Score of 1064.7 for HMM based on sequences of FIGURE 28
  misc_feature (1)..(374): Functional Homolog of  Ceres CLONE ID no.  21406
  misc_feature (272)..(320): Pfam Name: HLH Pfam Description: Helix-loop-helix DNA-binding domain
MYQQPSSSSSSPQKSNLPSGLTRYGSAPGSFLTRAVDSVIGADRELSGLGSTPLVGRQQHFSGDSPSITSESTCKVNSSSCDRKAPKSGGGGGLQRSYGLNEIAHGAGSLVRQRSSPAGFLSHLATENGGFSITRGTGGYNSRNGSGGGPSRLKSQLSFTRQDSLSQISEVSENVVEGIGSDNGSQNSTHSYSAASFGMESWDTPNSIVFSGHPSKQARTGDGDIYSCFNALETQFSLPQTSLEMATVEKLLQIPEDSVPCKIRAKRGCATHPRSIAERERRTRISGKLKTLQDLVPNMDKQTSYADMLELAVKHIKGLQNEVEMLCCTTYCWSFPNLHLIFVCPSLTETPQRIGRLYLWMQTINPMILPTKEI

SEQ ID NO: 575 - protein, 234 aa, Oryza sativa
  misc_feature (1)..(234): Public GI no. 34907702
  misc_feature: Bit Score of 37.5 for HMM based on sequences of FIGURE 28
  misc_feature (1)..(234): Functional Homolog of  Ceres CLONE ID no.  21406
  misc_feature (165)..(213): Pfam Name: HLH Pfam Description: Helix-loop-helix DNA-binding domain
MAATRGMGGYSGGGGDAGAMAHRRLSSQWSFSRQDLPQISEMGGLIPDIGESIVTGGGGNSSSDGAGHGAQSSSFLSSRNFSMSSWDDTNSIMFSPPSSSKKARVAAAAAGDHGDDMVSSFSNIDSQFGLSKQSSLEMAGMDDFLQLQPDSVACRARAKRGCATHPRSIAERERRTRISKRLKKLQDLVPNMDKQTNTSDMLDIAVTYIKELQGQVEKLKHDQANCTCSGKHDC

SEQ ID NO: 576 - protein, 417 aa, Glycine max
  misc_feature (1)..(417): Ceres CLONE ID no. 474693
  misc_feature: Bit Score of 78.1 for HMM based on sequences of FIGURE 28
  misc_feature (1)..(417): Functional Homolog of  Ceres CLONE ID no.  21406
  misc_feature (348)..(396): Pfam Name: HLH Pfam Description: Helix-loop-helix DNA-binding domain
MESDLQQHPPMFLDHHQQQMNSGLTRYRSAPSSYFSSIIDHEFYEHVFNRPSSPETERMLTRFVNSLGGGDADAEDSLATTQNPPTVVAVKEEVNQQPPDVTSMNNEPLVLQQQQQQQQQQQQSNNMYNYGSSGTQNFYQSTGRPPLPNQMKTGHGSSSNLIRHGSSPAGLFSNINIDITGYAAVVRGMGTMGAAANNTSEEANFSPATRMKNNAPNFSSGLMSSRAEVGNKSNTQNNNAENEGFAESQGNEFIPAGFPVGPWNDSAIMSDNVTGLKRFRDEDVKPFSGGLNAPESQNETGGQQPSSALAHQLSLPNTSAEMAAIEKFLQLSDSVPCKIRAKRGCATHPRSIAERVRRTKISERMRKLQDLVPNMDKQTNTADMLDLAVEYIKDLQNQVQTLSDNRAKCTCSHKKQQ

SEQ ID NO: 577 - DNA, 1491 bp, Populus balsamifera subsp. trichocarpa
  misc_feature (1)..(1491): Ceres ANNOT ID no. 1445304
atgtatcaacagccgtcgtcgtcatcctcgtcgccacaaaaacctacggtcccaagtgggctgaccaggtatggctcagccccaggctcttttttaaccagagctgttgattcagtcatcggggttgaccgtgaactctctggccttggatcgacttcccttgtgggcagtcgacaatacttctctggtgactcgccctcggtaacctcagagtcaacttgcaaagtcaacccttccagctgcgatccaaaagcacccaaaagtggtggcagtagcggcagtttgcagaggtcgtacggctttaatgaggtagcacatggtgctggatctttggtgcggcagaggagctcacctgctggatttctaagccatctcgccactgaaaatggtggtttctcaattacaagggaatctggaggctataacgctcacagtggccctggtggtggccactcggtatcaaggttgaagcctcagttgagctttactaggcaagagtctctttctcagatatctgaagttagtgagaatgttgttgaaggcattggctctgacaataaccaccagaactgcactcattcttattctgctgctggctttggtatggaatcttgggacaatccaaattccattgtattctctggacccccctcgaaacaagctaggaatggagatggagacatttatagctgtttcaatggcttagaaactcaggtactaaagttattttctgaagacttgtatgtcaggaaagtcatggaaatgtggataacttggtgttccctggccttaaaaacacatgcatttgcatgtccataccacacccctgcgttttctggttacttgtatacatacaagccaagggtaatttttagcctgcctcagacaagtcttgagatagaaacagtggagaagctgctacatgttcctgaagactctgttccttgcaaaatccgtgctaagcgtggctttgccactcatccaagaagcattgctgaaagggcaccggcaaggttgtttcatgacttaaaatacgaagtagggttgtcacaacccgaattccgggttctcataacagatgaggtttgtggccctgatcactgtgggatgatcggtcgccatagactggagagaagaaccagaataagtgggaaactgaagaaactacaagatctcgttccgaacatggataaggggaagcctatccaaatttctgaatctgtttccaatatctttgaggactcaaacttgagacctggtagtggaaatcctaacaaacaagttatgcagacatgctggatttcgcagtgcagcatatcaaaggccttcaaaatgaggtggagaaactccacaaagaaatggaaaattgtacctgtggatgcgaaaaatcaaccccatgattgtgtgaaaaatgggagcctggagcgatgggcaattctttgctctgtgtgtgaaaaatcatcacttcacggcaaggcaaccgaaagttag

SEQ ID NO: 578 - protein, 496 aa, Populus balsamifera subsp. trichocarpa
  misc_feature (1)..(496): Ceres ANNOT ID no. 1445304
  misc_feature: Bit Score of 683.4 for HMM based on sequences of FIGURE 28
  misc_feature (1)..(496): Functional Homolog of  Ceres CLONE ID no.  21406
MYQQPSSSSSSPQKPTVPSGLTRYGSAPGSFLTRAVDSVIGVDRELSGLGSTSLVGSRQYFSGDSPSVTSESTCKVNPSSCDPKAPKSGGSSGSLQRSYGFNEVAHGAGSLVRQRSSPAGFLSHLATENGGFSITRESGGYNAHSGPGGGHSVSRLKPQLSFTRQESLSQISEVSENVVEGIGSDNNHQNCTHSYSAAGFGMESWDNPNSIVFSGPPSKQARNGDGDIYSCFNGLETQVLKLFSEDLYVRKVMEMWITWCSLALKTHAFACPYHTPAFSGYLYTYKPRVIFSLPQTSLEIETVEKLLHVPEDSVPCKIRAKRGFATHPRSIAERAPARLFHDLKYEVGLSQPEFRVLITDEVCGPDHCGMIGRHRLERRTRISGKLKKLQDLVPNMDKGKPIQISESVSNIFEDSNLRPGSGNPNKQVMQTCWISQCSISKAFKMRWRNSTKKWKIVPVDAKNQPHDCVKNGSLERWAILCSVCEKSSLHGKATES

SEQ ID NO: 579 - protein, 243 aa, Zea mays
  misc_feature (1)..(243): Ceres CLONE ID no. 324760
  misc_feature: Bit Score of 57.2 for HMM based on sequences of FIGURE 28
  misc_feature (1)..(243): Functional Homolog of  Ceres CLONE ID no.  21406
  misc_feature (173)..(221): Pfam Name: HLH Pfam Description: Helix-loop-helix DNA-binding domain
FDVCSIFRMRRPTAGMAATGGAMGSYTQAGSDAALGPGHGHGHAQLSSQWSFSRQDLPQISEMGMIPADIGESIVGAGGCNSSSDAAQSSSYLSRTFSVGSWDDTNSIMFSSAPSKKPKVDPADDMVASFSTIDPQFGLSNSSLELPGMDDYLQLQQDSVACRVRAKRGCATHPRSIAERERRTRISKRLKKLQDLVPNMDKQTNTSDMLDLAVDYIKELKDQVEKLKHDQANCCCLGNKSCC

SEQ ID NO: 580 - DNA, 740 bp, Gossypium hirsutum
  misc_feature (1)..(740): Ceres CLONE ID no.1940689
cattttatgtactcctttgagctttgaaaaaaagaagatttctccttttacttgtataatttcccttcctagttctcccatttctccacgctaccaaagccatgtatccatcatcttcgtctcaaaagcccatgggtcaatccgggctcacccgttacggttctgctcccggctcctttctggccaacgccgttgattccgtcatcggagcggaccctaacctcgtcggccactacttctccgccgctgactcctcctctttaacttcagagtcaacttgtaaagtcagctcatccaacgatccgcgagagcctaaatcagctgctgctgctgctcctgcccctcctcatcctcctccgcatcatccccatggatcttaccctgcaccttcttcttcctctctgctcagacaacgcagctcccccgccggtttccttagtcacctcacatcggaaaacggtttttctgttacaatgggcaacagaaattatagctctcaaggcagtggtaatggtggccatggagtgtcaaggttgaagtcccagttgagtttcactaggcaagattctctttctcagatctctgaagtgagtgagaatcttgtggatggtgttagctctaacagtaaccaccaaaatcctgcacattcgtttgctgctgctggctttggaatggattcatgagataatacaaactccattgtgttttctgcctcatcaagcaagagagctaaaaatctt

SEQ ID NO: 581 - protein, 193 aa, Gossypium hirsutum
  misc_feature (1)..(193): Ceres CLONE ID no. 1940689
  misc_feature: Bit Score of 26.5 for HMM based on sequences of FIGURE 28
  misc_feature (1)..(193): Functional Homolog of  Ceres CLONE ID no.  21406
MYPSSSSQKPMGQSGLTRYGSAPGSFLANAVDSVIGADPNLVGHYFSAADSSSLTSESTCKVSSSNDPREPKSAAAAAPAPPHPPPHHPHGSYPAPSSSSLLRQRSSPAGFLSHLTSENGFSVTMGNRNYSSQGSGNGGHGVSRLKSQLSFTRQDSLSQISEVSENLVDGVSSNSNHQNPAHSFAAAGFGMDS

SEQ ID NO: 582 - DNA, 1550 bp, Arabidopsis thaliana
  misc_feature (1)..(1550): Ceres CLONE ID no.  222885
  misc_feature (1)..(1550): GEMINI ID 555C3
actcccccgcctcgccgccagtcagattcaccaccggctcccctgcacaaccgcgtccgcgctgcaccaccaccgttcatcgaggaggaggggggacggagaccacggacatggagagatctcaacggcagtctcctccgccaccgtcgccgtcctcctcctcgtcctccgtctccgcggacaccgtcctcgtccctcccggaaagaggcggagggcggcgacggccaaggccggcgccgagcctaataagaggatccgcaaggaccccgccgccgccgccgcggggaagaggagctccgtctacaggggagtcaccaggcacaggtggacgggcaggttcgaggcgcatctctgggacaagcactgcctcgccgcgctccacaacaagaagaaaggcaggcaagtctacctgggggcgtatgacagcgaggaggcagctgctcgtgcctatgacctcgcagctctcaagtactggggtcctgagactctgctcaacttccctgtggaggattactccagcgagatgccggagatggaggccgtttcccgggaggagtacctggcctccctccgccgcaggagcagcggcttctccaggggcgtctccaagtacagaggcgtcgccaggcatcaccacaacgggaggtgggaggcacggattgggcgagtctttgggaacaagtacctctacttgggaacatttgacactcaagaagaggcagccaaggcctatgaccttgcggccattgaataccgtggcgtcaatgctgtaaccaacttcgacatcagctgctacctggaccacccgctgttcctggcacagctccaacaggagccacaggtggtgccggcactcaaccaagaacctcaacctgatcagagcgaaaccggaactacagagcaagagccggagtcaagcgaagccaagacaccggatggcagtgcagaacccgatgagaacgcggtgcctgacgacaccgcggagcccctcagcacagtcgacgacagcatcgaagagggcttgtggagcccttgcatggattacgagctagacaccatgtcgagaccaaactttggcagctcaatcaatctgagcgagtggttcgctgacgcagacttcgactgcaacatcgggtgcctgttcgatgggtgttctgcggctgacgaaggaagcaaggatggtgtaggtctggcagatttcagtctgtttgaggcaggtgatgtccagctgaaggatgttctttcggatatggaagaggggatacaacctccagcgatgatcagtgtgtgcaactaattctggaacccgaggaggttttcgctttccaggtgtcctgtcttgggtaatccttgatctgtctaatgccacagtgccactgcaccagagcagctgagaactttcttgtagaaagcccatggcagtttggcgttagacaagtgtgtcgatgttctttaattctttgaatttgcccctaggctgcttggctaacgttaagggtttgtcattgtctcacttagcctagattcaactaatcacatcctgaatctg

SEQ ID NO: 583 - protein, 395 aa, Arabidopsis thaliana
  misc_feature (1)..(395): Ceres CLONE ID no.  222885
  misc_feature (1)..(395): GEMINI ID 555C3
  misc_feature (166)..(218): Pfam Name: AP2 Pfam Description: AP2 domain
MERSQRQSPPPPSPSSSSSSVSADTVLVPPGKRRRAATAKAGAEPNKRIRKDPAAAAAGKRSSVYRGVTRHRWTGRFEAHLWDKHCLAALHNKKKGRQVYLGAYDSEEAAARAYDLAALKYWGPETLLNFPVEDYSSEMPEMEAVSREEYLASLRRRSSGFSRGVSKYRGVARHHHNGRWEARIGRVFGNKYLYLGTFDTQEEAAKAYDLAAIEYRGVNAVTNFDISCYLDHPLFLAQLQQEPQVVPALNQEPQPDQSETGTTEQEPESSEAKTPDGSAEPDENAVPDDTAEPLSTVDDSIEEGLWSPCMDYELDTMSRPNFGSSINLSEWFADADFDCNIGCLFDGCSAADEGSKDGVGLADFSLFEAGDVQLKDVLSDMEEGIQPPAMISVCN

SEQ ID NO: 584 - DNA, 1061 bp, Arabidopsis thaliana
  misc_feature (1)..(1061): Ceres CLONE ID no.  224919
  misc_feature (1)..(1061): GEMINI ID 536H10
acgaatcccgtcttcttcctttcttggccttctccacctcatcgccgagacgagatctctcccacacgaggaagggagagatgggcgggcgggtggatcacgagtactcctacctgttcaagatggtcctcatcggagacagcggcgtcggcaagtccaatatcctctctcgcttcacgcgcaaccacttctccctcgactccaagtccaccatcggcgtcgagttcgccaccaagtccctgcagatggacggcaaaacaataaaggctcagatctgggacacagctgggcaggaaaggtaccgtgcaattacaagtgcctactaccgtggagccgtgggagccctccttgtgtacgacatcacaaagaggcagagcttcgacaatgttcacaggtggcttcgtgaactccgcgaccatgctgactccagtattgtgatcatgatggtcggtaacaaatctgacctaatccacctgagagctatctctgaggatgaaggcaaagcgttggctgagaaggaggggttgttcttcctcgagacatcagctatggaggctataaacgtggagcaagccttccagactatcatgacggaggtctatggcattgtcaacaggaaagcgctggctgccaaagaagcagcagctgcaactgcttcgttgccctcccagggtaaaattatcagcattgacagcactgcaggaaacacaaagagggcatgctgctctacctaaaaatgttcaaacaccacattatacagaaccttggagacaattgttggtagaaaatggagcatagtgatcacaaatgatgtcgtggcaatatctactcttattctattctattctattcttttcttttctttattgtgtggacaaaatgggggtacatgcagtttagtttgttcagtgtgtgttagtcaaaagttagatattttcgttaggatccataccatttatcttctcaagttaaatgatactgcagtataactcagaatcatatagtcccaagttgctacagaattcaactgcgaatttgtgatttcatcatgcttacattct

SEQ ID NO: 585 - protein, 217 aa, Arabidopsis thaliana
  misc_feature (1)..(217): Ceres CLONE ID no.  224919
  misc_feature (1)..(217): GEMINI ID 536H10
  misc_feature (14)..(175): Pfam Name: Ras Pfam Description: Ras family
MGGRVDHEYSYLFKMVLIGDSGVGKSNILSRFTRNHFSLDSKSTIGVEFATKSLQMDGKTIKAQIWDTAGQERYRAITSAYYRGAVGALLVYDITKRQSFDNVHRWLRELRDHADSSIVIMMVGNKSDLIHLRAISEDEGKALAEKEGLFFLETSAMEAINVEQAFQTIMTEVYGIVNRKALAAKEAAAATASLPSQGKIISIDSTAGNTKRACCST

SEQ ID NO: 586 - protein, 217 aa, Oryza sativa
  misc_feature (1)..(217): Public GI no. 50933495
  misc_feature (1)..(217): Functional Homolog of  Ceres CLONE ID no.  224919
  misc_feature (14)..(175): Pfam Name: Ras Pfam Description: Ras family
MGGRVDHEYSYLFKMVLIGDSGVGKSNILSRFTRNHFSLDSKSTIGVEFATKSLQMEGKTIKAQIWDTAGQERYRAITSAYYRGAVGALLVYDITKRQSFDNVHRWLRELRDHADSSIVIMMVGNKSDLIHLRAVSEDEGKALAEKEGLFFLETSAMEAVNVEEAFQTIITEVYGIVNRKALAAKEAAAASAPLPSQGKTISIDSAAGNTKRACCSA

SEQ ID NO: 587 - protein, 217 aa, Zea mays
  misc_feature (1)..(217): Ceres CLONE ID no. 1556085
  misc_feature (1)..(217): Functional Homolog of  Ceres CLONE ID no.  224919
  misc_feature (14)..(175): Pfam Name: Ras Pfam Description: Ras family
MGGRVDHEYSYLFKMVLIGDSGVGKSNILSRFTRNHFSLDSKSTIGVEFATKSLQIDGKTIKAQIWDTAGQERYRAITSAYYRGAVAALLVYDITKRQSFDNVHRWLRELRDHADSSIVIMMVGNKSDLIHLRAISEDEGKALAEKEGLFFLETSAMEAINVEEAFQTIITEVYGIVNRKALAAKEAAATAAPLPSQGKTISIDSNAGNTKKACCST

SEQ ID NO: 588 - protein, 217 aa, Oryza sativa
  misc_feature (1)..(217): Public GI no. 218204
  misc_feature (1)..(217): Functional Homolog of  Ceres CLONE ID no.  224919
  misc_feature (14)..(175): Pfam Name: Ras Pfam Description: Ras family
MGGRVDHEYSYLFKMVLIGDTGVGKSNILSRFTRNHFSLDSKSTIGVEFATKSLQMEGKTIKAQIWDTAGQERYRAITSAYYRGAVGALLVYDITKRQSFDNVHRWLRELRDHADSSIVIMMVGNKSDLIHLRAVSEDEGKALAEKEGLFFLETSAMEAVNVEEAFQTIITEVYGIVNRKALAAKEAAAASRPLPSQGKTISIDSAAGNTKRACCSA

SEQ ID NO: 589 - DNA, 542 bp, Arabidopsis thaliana
  misc_feature (1)..(542): Ceres CLONE ID no.  22671
  misc_feature (1)..(542): GEMINI ID 532C7
aggagagttggggacctctctttgtgtctctacatagttttgtaaacctcacatctctttcttcgcttgcattctccaaactccaattttttttgtttctctcaataatatttgtgttcatactgtttcgctgtttccaatacatactaatggataacacaaaccgtcttcgccgccttcactgtcataaacaacccaagttcactcatagctctcaagaagtgagtagtatgaaatgggagtttatcaatatgaccgaacaagaagaagatctcatctttagaatgtacagacttgttggcgacaggtgggatttaatagcaagaagagtggtgggacgtgaggcaaaggagatagagagatactggattatgagaaattgtgactatttctcccacaaatgacgcaaaagtcactctctttaaaaaatctcgagaatctccctgtttttctatttctcatcctcattaaataatttctgtgattgtggacaagaaaagctttattaagttgtcgagtggggttctcctcatcattaaagc

SEQ ID NO: 590 - protein, 84 aa, Arabidopsis thaliana
  misc_feature (1)..(84): Ceres CLONE ID no.  22671
  misc_feature (1)..(84): GEMINI ID 532C7
  misc_feature: Bit Score of 158.7 for HMM based on sequences of FIGURE 30
  misc_feature (32)..(77): Pfam Name: Myb_DNA-binding Pfam Description: Myb-like DNA-binding domain
MDNTNRLRRLHCHKQPKFTHSSQEVSSMKWEFINMTEQEEDLIFRMYRLVGDRWDLIARRVVGREAKEIERYWIMRNCDYFSHK

SEQ ID NO: 591 - protein, 96 aa, Brassica napus
  misc_feature (1)..(96): Ceres CLONE ID no. 1079601
  misc_feature: Bit Score of 201.8 for HMM based on sequences of FIGURE 30
  misc_feature (1)..(96): Functional Homolog of  Ceres CLONE ID no.  22671
  misc_feature (30)..(75): Pfam Name: Myb_DNA-binding Pfam Description: Myb-like DNA-binding domain
MDNTNRRRRSKQHKVTLEDSEEVSSIEWKFINMTEQEEDIILRMYRLVGDRWDLIAGRVPGRQPEEIERFWIMRNSDSFAEKRLQLHHSSSHKNNK

SEQ ID NO: 592 - DNA, 288 bp, Populus balsamifera subsp. trichocarpa
  misc_feature (1)..(288): Ceres ANNOT ID no. 1483277
atggagagtatgaaccgccgccgccgccggaaacaacctaaaattaacagttctgagtctgaagaggtcagtagtattgaatgggagtttataaacatgagcgagcaagaggaagacctcatttacagaatgcatagacttgttggtgaaaggtgggatttgatagctggaaggattccaggccgaaaagcagaagaaatagagaggttttggataatgaaacaccgcgaagggtttgctgaaaacggaaaattgtataacgaagtgaagtctaggacttctagttga

SEQ ID NO: 593 - protein, 95 aa, Populus balsamifera subsp. trichocarpa
  misc_feature (1)..(95): Ceres ANNOT ID no. 1483277
  misc_feature: Bit Score of 197.7 for HMM based on sequences of FIGURE 30
  misc_feature (1)..(95): Functional Homolog of  Ceres CLONE ID no.  22671
  misc_feature (30)..(75): Pfam Name: Myb_DNA-binding Pfam Description: Myb-like DNA-binding domain
MESMNRRRRRKQPKINSSESEEVSSIEWEFINMSEQEEDLIYRMHRLVGERWDLIAGRIPGRKAEEIERFWIMKHREGFAENGKLYNEVKSRTSS

SEQ ID NO: 594 - protein, 80 aa, Glycine max
  misc_feature (1)..(80): Ceres CLONE ID no. 690625
  misc_feature: Bit Score of 151.9 for HMM based on sequences of FIGURE 30
  misc_feature (1)..(80): Functional Homolog of  Ceres CLONE ID no.  22671
  misc_feature (19)..(64): Pfam Name: Myb_DNA-binding Pfam Description: Myb-like DNA-binding domain
MSTTATTTSEEVSSNEWKVIHMSEQEEDLIRRMYKLVGDKWNLIAGRIPGRKAEEIERFWIMRHGDAFSVKRNGSKTQDS

SEQ ID NO: 595 - DNA, 285 bp, Populus balsamifera subsp. trichocarpa
  misc_feature (1)..(285): Ceres ANNOT ID no. 1467420
atggaccgccgccgacgccgacgccgcaaacaagctaaaattaacaattctgagtctgaagaggtcagtagtattgaatgggagtttatagacatgagtgaacaagaggaagacctcatttacagaatgtataggcttgttggagaaaggtgggatttgatagctggaaggattccaggccgtaaagcagaagaaatagagaggttttggataatgaaacaccgtgaaggttttgctgagaaacgaaggttgcatagcaaagcgaagtctaagacttatcgttag

SEQ ID NO: 596 - protein, 94 aa, Populus balsamifera subsp. trichocarpa
  misc_feature (1)..(94): Ceres ANNOT ID no. 1467420
  misc_feature: Bit Score of 192.9 for HMM based on sequences of FIGURE 30
  misc_feature (1)..(94): Functional Homolog of  Ceres CLONE ID no.  22671
  misc_feature (29)..(74): Pfam Name: Myb_DNA-binding Pfam Description: Myb-like DNA-binding domain
MDRRRRRRRKQAKINNSESEEVSSIEWEFIDMSEQEEDLIYRMYRLVGERWDLIAGRIPGRKAEEIERFWIMKHREGFAEKRRLHSKAKSKTYR

SEQ ID NO: 597 - protein, 113 aa, Zea luxurians
  misc_feature (1)..(113): Public GI no. 15042132
  misc_feature: Bit Score of 248.9 for HMM based on sequences of FIGURE 30
  misc_feature (1)..(113): Functional Homolog of  Ceres CLONE ID no.  22671
  misc_feature (67)..(112): Pfam Name: Myb_DNA-binding Pfam Description: Myb-like DNA-binding domain
MGRRACCAKEGVKRGAWTSKEDDALAAYVKAHGEGKWREVPQKAGLRRCGKSCRLRWLNYLRPNIRRGNISYDEEDLIIRLHRLLGNRWSLIAGRLPGRTDNEIKNYWNSTLV

SEQ ID NO: 598 - DNA, 1373 bp, Arabidopsis thaliana
  misc_feature (1)..(1373): Ceres CLONE ID no.  231109
  misc_feature (1)..(1373): GEMINI ID 539H2
actctttgattagggttttatcattctcaatcagggttttagtttaaacatcgaattaagcactggattagctgattttgtgtgatttgatttcaaagttcacagcttttagtttctctgatcctaatttatgatttgaagtttctatcaaaaggtcaggaactgatgaataaccctgtaccgtgtcagtcggtctctggtggcaattctggtggttatttgtttccttcttcctctggatactgcaatgtttcagctgtcttgcctcatggaaggaatttgcaaaaccagccacctgtttccaccgtgcctagagacagattggctatgcaggattgtcctttgatagctcaatcctcgttgattaatcatcaccctcaagagttcatagatccacttcatgagttctttgatttctctgatcatgttcctgttcagaatctacaagcagagagtagtggagtaagggtggactcatccgtggaacttcataagaaaagtgaatggcaagattgggcagatcagctgatttctgttgacgatggttctgagccaaattggtctgaacttcttggagattcaagttcccacaatccaaattcagagatacctacaccatttttggatgtaccaaggctagatataacagctaaccagcagcaacagatggtttcatcagaggaccagctcagcggcagaaactcatcatctagtgtagcaacatctaaacaacgtatgcgttggacaccagaacttcacgaggcattcgttgaagctgttaatcagcttggtggtagtgaacgagccacccctaaggctgttttgaagctcttgaataaccctggcttgaccatttatcatgtaaaaagccatttgcagaaatatagaacggcaaggtataaaccggagacttcggaagttacaggagaacctcaagagaagaagatgacatctattgaagatatcaaatctcttgacatgaaaacgagcgttgagatcacacaagctctacggttacaaatggaagtgcagaaacgtctccacgagcagctcgagatccaacggtcactgcagttacagattgaaaaacagggccggtacctacagatgatgttcgagaaacaacaaaagatacaagacaacaagagctcttcttcagaagcatcaccaaagcaatgcaatggttcatttgcagaagttgaagttggtcttgagacactaacaggggaccaaaatgaatctgcttcagcatcaaggaaacgtgtcagagaagattaaagcatgtttaattgatctcgtttgacgaaacatgtttattgggaattaattgtggaaaccaactccagttttgttaaaagaatctgtttctttcc

SEQ ID NO: 599 - protein, 370 aa, Arabidopsis thaliana
  misc_feature (1)..(370): Ceres CLONE ID no.  231109
  misc_feature (1)..(370): GEMINI ID 539H2
  misc_feature (190)..(241): Pfam Name: Myb_DNA-binding Pfam Description: Myb-like DNA-binding domain
MNNPVPCQSVSGGNSGGYLFPSSSGYCNVSAVLPHGRNLQNQPPVSTVPRDRLAMQDCPLIAQSSLINHHPQEFIDPLHEFFDFSDHVPVQNLQAESSGVRVDSSVELHKKSEWQDWADQLISVDDGSEPNWSELLGDSSSHNPNSEIPTPFLDVPRLDITANQQQQMVSSEDQLSGRNSSSSVATSKQRMRWTPELHEAFVEAVNQLGGSERATPKAVLKLLNNPGLTIYHVKSHLQKYRTARYKPETSEVTGEPQEKKMTSIEDIKSLDMKTSVEITQALRLQMEVQKRLHEQLEIQRSLQLQIEKQGRYLQMMFEKQQKIQDNKSSSSEASPKQCNGSFAEVEVGLETLTGDQNESASASRKRVRED

SEQ ID NO: 600 - DNA, 1394 bp, Oryza sativa
  misc_feature (1)..(1394): Ceres CLONE ID no.  240112
  misc_feature (1)..(1394): GEMINI ID 474E10
  misc_feature (1)..(1394): GEMINI ID 552A6
agatcccctcacagtcatcctccacccaccccacccaccgcctccgcctctctctctctctcgtttgttcgtctcggcttccggtcgccgattcttctctgcgcaaaagattcctggtggtggtgcccgtaccttgctccacgcctcgctcgcgtcgcgtgcatggggctggacgtcggcggcatcgggatgggcctggatctgggtctggacctcgggctgttcgccgcgcggagcgccggagggatggcggccgcggccaagggtgcgccggcggagatcgagtcctgcatcaggagcctcgaggaggagcgccggaagatcgaggtgttcaggcgcgagctcccgctctgcgtgcgtctcctcgccgatgtaatcgacgaattgaaggatgaggccgccaagagaggcggagacgcggaggccaaggccgacgacggcgataagcggaaatggatgagcaccgctcagctgtggctcgacagcgacgccaaatccgacgagtctgacaaagagcaactgagtgaaatcacttcgccggagcccaagttgctcggtggcgcacccatgcccataagggccgttgcggcggtgccacccctgccgcctccattcttcaggagagaagacagctctgccggcagtggtctgtcgctggtaccacccgcagctaagccgccgattcctcccatgtctgccagcgacaacgcgagcggcagattctgtgccactatgccaccgtctggctctggggccaacttgcactctcaggctcagcagcaagccaggaaggcgaggcggtgctggtcgccggagcttcaccggctgtttgttgccgccttgcatcaactcggcggccctcaagttgctactccgaagcagatcagggaggtgatgaaggtggacgggcttacaaacgatgaagtgaaaagccatctccagaagtaccggctgcacaacagaagatcccccggcgtcgtggctccggtgagccagtcggtcatgctggcgggcggcctctgggctcctcctcatcaggagcaaagcagctcgcagtccgggtctccccagggcccgcttcagttctctggatccggtgtagcggccaccgtcggcggcgatagcagcagcagcgacgaggacgacaagtccgaaggctacagccggaaatacgtgtaaaggccgcgttcgacggatgagagtgtagagatagcgtcgcggcttctgcttgcccgtctgtggcaataacagattcatcagtcttgagagaggttgtagtgcgtgcgcccaagagctcaactgatcatgggttggattgtttgtttgtcatgtacgtacatggaaagctgatggcttcctgacttttaatttctgggcaggtcccaaaattttcg

SEQ ID NO: 601 - protein, 338 aa, Oryza sativa
  misc_feature (1)..(338): Ceres CLONE ID no.  240112
  misc_feature (1)..(338): GEMINI ID 474E10
  misc_feature (1)..(338): GEMINI ID 552A6
  misc_feature (212)..(263): Pfam Name: Myb_DNA-binding Pfam Description: Myb-like DNA-binding domain
MGLDVGGIGMGLDLGLDLGLFAARSAGGMAAAAKGAPAEIESCIRSLEEERRKIEVFRRELPLCVRLLADVIDELKDEAAKRGGDAEAKADDGDKRKWMSTAQLWLDSDAKSDESDKEQLSEITSPEPKLLGGAPMPIRAVAAVPPLPPPFFRREDSSAGSGLSLVPPAAKPPIPPMSASDNASGRFCATMPPSGSGANLHSQAQQQARKARRCWSPELHRLFVAALHQLGGPQVATPKQIREVMKVDGLTNDEVKSHLQKYRLHNRRSPGVVAPVSQSVMLAGGLWAPPHQEQSSSQSGSPQGPLQFSGSGVAATVGGDSSSSDEDDKSEGYSRKYV

SEQ ID NO: 602 - DNA, 1537 bp, Panicum virgatum
  misc_feature (1)..(1537): Ceres CLONE ID no.1791988
aatccagatcctccagtcgcccacccacccacccacccaccgctttctcctctcccttccttccttcctacctttccctgttcgtgttcgtctcggcttccggtcgctgattccgcggcggagattctgtggtggcggtgctcgttcgctctcgcgcttggggttcgcgtgtgcatggggctcgacgtggcggagatcgggatgggcctggacctggggctcgacctcaggctcttcgccgcgcggagcgccgtcgggatggcggcggccgcggccaagggcgcgcccgcggggatcgaggcctgcatcaggagcctcgaggaggagcgccgcaagatcgaggtcttcaggcgcgagctcccgctctgcgtccgcctcctcgccgacgtgatcgaggagttgaaggaagaggccgcgaggaaaggcggcgatttggagttaaggccggacgacggcgacaagaggaaatggatgagcaccgcgcagctttgggtggactccgacgccacatccaagtccgagaaagagcaaccaagtgagatgacctcgccggagcccaagttgctcggtggccccatgccgatacgggctgttccggtggtgccgccgccgcctccaccgggcttcaggagggatgacaacgctgccggaactgcgaggctgcccggtctgtcgttgctgccaccggctgcaaagacatcggtctctccggtccctgccgttgatgaacaccggcagaacgccgccgcaagattgtctgccaccatgtcaccatctggctctggactcaacctgcatactcagactcaacagcagcaacagctggcgaggaagacaaggcggtgctggtcgccggagcttcaccggcagtttgttgctgccttgcatcaactcggcggccctcaagttgctactccgaagcagatcagagaggtgatgcaagtggacgggcttacaaacgacgaagtgaaaagccatctccagaagtaccggctgcacaacagaagatcgcccggcatggctcccgtgagccagtcgattgtgctggtgggtggcctctggagttctcaggagcaaagcagctcacagtcacagtcagggtctcctcagggcccccttcagttctctgggtcagggatggccgtctctgcagccaccgtcggcggcgacagcagcagcagcgacgaagatgacaagtccgatgaaggctacagccggaaatgattgcaaggctgcgtttgcagaagatcggttgagagtgtagaggtagcatcgcggctttgcgcatcggtggcaataacaggttcatcagtcagggagaggctgtagtgcagccaggccatgcacgcagggagattgggcggtgagtgctcaagagatgaactgatcatgagtttggttgttggttgtcatgtacatgaaaagctgataccagttttcatgaggcttcttgactttagttcccgggcagatccaaattttcgccctgagaattatatacatgcaagattattcacaaaaaaaaaaaaaaaaaaaa

SEQ ID NO: 603 - protein, 349 aa, Panicum virgatum
  misc_feature (1)..(349): Ceres CLONE ID no. 1791988
  misc_feature (1)..(349): Functional Homolog of  Ceres CLONE ID no.  240112
  misc_feature (222)..(273): Pfam Name: Myb_DNA-binding Pfam Description: Myb-like DNA-binding domain
MGLDVAEIGMGLDLGLDLRLFAARSAVGMAAAAAKGAPAGIEACIRSLEEERRKIEVFRRELPLCVRLLADVIEELKEEAARKGGDLELRPDDGDKRKWMSTAQLWVDSDATSKSEKEQPSEMTSPEPKLLGGPMPIRAVPVVPPPPPPGFRRDDNAAGTARLPGLSLLPPAAKTSVSPVPAVDEHRQNAAARLSATMSPSGSGLNLHTQTQQQQQLARKTRRCWSPELHRQFVAALHQLGGPQVATPKQIREVMQVDGLTNDEVKSHLQKYRLHNRRSPGMAPVSQSIVLVGGLWSSQEQSSSQSQSGSPQGPLQFSGSGMAVSAATVGGDSSSSDEDDKSDEGYSRK

SEQ ID NO: 604 - protein, 348 aa, Oryza sativa
  misc_feature (1)..(348): Public GI no. 50918981
  misc_feature (1)..(348): Functional Homolog of  Ceres CLONE ID no.  240112
  misc_feature (226)..(277): Pfam Name: Myb_DNA-binding Pfam Description: Myb-like DNA-binding domain
MGLDVGEIGMGLDLSLDLKMFAARSAVRMAAAAAKEATGVEACIRSLEEERRKIEMFRRELPLCARLLADVIELMKEEAGKRRKDGDDAEAKAEDGDKTKWMSTAQLWVDSRGSDADSENDRRSGSTSPASRLLGGAEESSSRAVAPPPYFRREERVVLRPAMPLLPPASHRSPPPAAAAAATAAGDDHRHVVASSFATAVPSPVPAALSLQAQAQQQQQQARKSRRCWSPELHRQFVAALQQLGGPQVATPKQIREVMKVDGLTNDEVKSHLQKYRLHNRKSPGTASASHSIVLVGDLWASQEVSCSQSGSPQGPLQLSGSGVAVSAATAGDSCCEDDDKSEGYVRK

SEQ ID NO: 605 - DNA, 727 bp, Arabidopsis thaliana
  misc_feature (1)..(727): Ceres CLONE ID no.  2499
  misc_feature (1)..(727): GEMINI ID 531C8
acacaaacttagaaaaatggaagaagaaaagagattggagctaaggctagctcctccttgtcaccaattcacttccaacaacaacatcaatggatctaaacaaaaaagctcgaccaaagaaacatcattcctttccaataacagggttgaggtagctccagtggtgggatggccgccggtgagatcatcccggagaaacctaacggcacaactaaaggaggagatgaaaaagaagtagagtgatgaagagaaggaattgtacgttaagatcaacatggaaggagttccaataggaagaaaagtcaacctttcagcttataacaactaccaacagctttcacatgccgttgaccaactcttctctaagaaagattcgtgggatctaaacagacaatacactttggtctacgaagacactgaaggagataaagttctggtcggggatgttccttgggagatgtttgtatctactgtaaagaggttgcatgttttaaagacctcccacgccttctcactctcacctagaaaacatggcaaggaatagagagaggttggccaaaatcatcagttcgatggtttgtttttaatgtaatttttgtggaaactaatggggtttggctttgatttactggttttctttttcacttatgtactaggtttttgcttgctatgttatttcttgttttgattgtaaatatgctgttcgtttaagaaatcgggggttagc

SEQ ID NO: 606 - protein, 89 aa, Arabidopsis thaliana
  misc_feature (1)..(89): Ceres CLONE ID no.  2499
  misc_feature (1)..(89): GEMINI ID 531C8
  misc_feature (41)..(85): Pfam Name: AUX_IAA Pfam Description: AUX/IAA family
MEGVPIGRKVNLSAYNNYQQLSHAVDQLFSKKDSWDLNRQYTLVYEDTEGDKVLVGDVPWEMFVSTVKRLHVLKTSHAFSLSPRKHGKE

SEQ ID NO: 607 - DNA, 1223 bp, Arabidopsis thaliana
  misc_feature (1)..(1223): Ceres CLONE ID no.  25211
  misc_feature (1)..(1223): GEMINI ID 535H10
aatttcgacacaaaaagccctaatctctgcttctgtaaagttcaacatttggccgagtcaaagaaacagagtgattctctgatccgattccggcgaaagaggacgaaacaaacggaacttgttcatcatcttctccagaaatgacgtcgtttcaggtgatgcgttcttcaaattcgagaaactcggatctatctcgtcgcatctcttctgcttctacttcttcttcgtctataagacctcaacaacagttccggcgagatctaacaagtgtcggttacggcggaagaaacgacggattatacagttcaaattcgatgacggtcgaagggattttacacgatactttcgcatcagatccaccagcaccaacggaatcttcactcttagatgcgtcgataaatctgatggatgcttctccagcaccaatggagataacaacaacgacggcttctgatgttgtggatcacggcggaggaacggagacgacgcgtggtgggaagagtgttgatgaggtttggagagagatggtatcaggagaaggtaaagggatgaaggaagagacgtcggaagagataatgacgttagaggattttctagcgaaagctgcggtggaagacgaaacagcggtgacggcgtcggcggaggatttggatgtgaagattccggtgacgaattacggattcgatcattctgcaccgccgcataatccgtttcagatgattgataaagtagaaggatcaatagttgcgtttgggaatggtttagatgtttacggaggaggagcgagagggaagagagcgagagtgatggttgagccattggataaagcagctgcacagagacagagaaggatgattaagaatcgtgaatctgcagctaggtctagagagaggaaacaagcttatcaagttgagttagaagctttggctgcgaagcttgaggaagagaatgagttgctttctaaggagattgaagataagaggaaagagagataccagaagttgatggagtttgtgattcctgttgttgagaaaccgaagcagcagccaccacggtttttacgcaggattcggtctttggaatggtgataaaaggtatagacttttgaggattttaggatcttaaggttacttactttgtgtatgtgtgtgtgtgagttgattcataatctgcagtagagtgtaatgattatggttaataacttatatattatattagattgc

SEQ ID NO: 608 - protein, 315 aa, Arabidopsis thaliana
  misc_feature (1)..(315): Ceres CLONE ID no.  25211
  misc_feature (1)..(315): GEMINI ID 535H10
  misc_feature (229)..(292): Pfam Name: bZIP_1 Pfam Description: bZIP transcription factor
MTSFQVMRSSNSRNSDLSRRISSASTSSSSIRPQQQFRRDLTSVGYGGRNDGLYSSNSMTVEGILHDTFASDPPAPTESSLLDASINLMDASPAPMEITTTTASDVVDHGGGTETTRGGKSVDEVWREMVSGEGKGMKEETSEEIMTLEDFLAKAAVEDETAVTASAEDLDVKIPVTNYGFDHSAPPHNPFQMIDKVEGSIVAFGNGLDVYGGGARGKRARVMVEPLDKAAAQRQRRMIKNRESAARSRERKQAYQVELEALAAKLEEENELLSKEIEDKRKERYQKLMEFVIPVVEKPKQQPPRFLRRIRSLEW

SEQ ID NO: 609 - DNA, 1117 bp, Arabidopsis thaliana
  misc_feature (1)..(1117): Ceres CLONE ID no.  25816
  misc_feature (1)..(1117): GEMINI ID 553H11
aaaaatttcaatctttggctcacttctttgtttatctcatagctcttcaccaaaaccaatattttctcctttgttgttctttcttttctatcaaaactttctacttaaaatatcattcctttaaacaatgataagcaaggatccaagatcgagtttacctccagggtttcgatttcatccaacagatgaagaactcattctccattacctaaggaagaaagtttcctcttccccagtcccgctttcgattatcgccgatgtcgatatctacaaatccgatccatgggatttaccagctaaggctccatttggggagaaagagtggtattttttcagtccgagggataggaaatatccaaacggagcaagaccaaacagagcagctgcgtctggatattggaaagcaaccggaacaaataaattgattgcggtaccaaatggtgaagggtttcatgaaaacattgctggatgattgggttctttgccggatttacaagaaatcacacgcttcattgtcatcacctgatgttgctttggtcacaagcaatcaagagcatgaggaaaatgacaacgaaccattcgtagaccgcggaacctttttgccaaatttgcaaaatgatcaaccccttaaacgccagaagtcttcttgttcgttctcaaacttactagacgctacagatttgacgtttctcgcaaattttctaaacgaaaccccggaaaatcgttctgaatcagatttttctttcatgattggcaatttctctaatcctgacatttacggaaaccattacttggatcagaagttaccgcagttgagctctcccacttcagagacaagcggcatcggaagcaaaagagagagagtggattttgcggaagaaacgataaacgcttcgaagaagatgatgaacacatatagttacaataatagtatagatcaaatggatcatagtatgatgcaacaacctagtttcctgaaccaggaactcatgatgagttctcaccttcaatatcaaggctagagagaatattaatttgaaaacctaatcacgaattagggatcattcggtatgtgattgaaaagtaggagtcgttgttagtaatttaccaaactatt

SEQ ID NO: 610 - protein, 194 aa, Arabidopsis thaliana
  misc_feature (1)..(194): Ceres CLONE ID no.  25816
  misc_feature (1)..(194): GEMINI ID 553H11
MVKGFMKTLLDDWVLCRIYKKSHASLSSPDVALVTSNQEHEENDNEPFVDRGTFLPNLQNDQPLKRQKSSCSFSNLLDATDLTFLANFLNETPENRSESDFSFMIGNFSNPDIYGNHYLDQKLPQLSSPTSETSGIGSKRERVDFAEETINASKKMMNTYSYNNSIDQMDHSMMQQPSFLNQELMMSSHLQYQG

SEQ ID NO: 611 - DNA, 1482 bp, Zea mays
  misc_feature (1)..(1482): Ceres CLONE ID no.  280261
  misc_feature (1)..(1482): GEMINI ID 552C6
aatagccatggaagaattgctctcctgaggtgtgctctgctgcttgtttttcctcctcccgttcacctcgccgtcgacggggccaggcggccgaacacatccttgacgaccgccgccgccctactcgcagcttcctgggtttcatcggatcctctgctagcgacgagcaccccctacaccaggccgttacttgggcgccggtgccatgcccggcgggtcttcgggtccagatggtgaagtggatgcaggatttgcgaagctccagggagaggatttcgagtattacatgcaaacgtactccatcatgctgggacgcaacagcaagaaatcaacagtggatgtggatctctcgagcctcggtgggggtatgaacatctcccgccaccacgctcggatattctacgacttccagcgccgcaggttcgcgctcgatgtcattggcaagaacgggtgccttgtcgagggcgtcctgcaccttccagggaacccccctgtcaagcttgactcgcaggatctgctgcagattggggacaagaagttctacttcctactgccaacacggtccatcttcgcttcggctgctgctgctcggcatgctcctattattccacagcagcttcctcctccaccgtatgcacatgcacgggcaggccgccctcgtttgtccgagtttcatgaccgctccttcgaaggtgattatgggcgggaggttgatgagattgggaatggtatcagtgaaactgggatgaggggaaagctggtaaagaggaacaagaagtcttctggcgacttggatatctatggtgggcatagaatcaatgtggaaccaatagggacgctaggtgaagacagtagatcagaaataagatcaaggggtgacagggatattgacaaccaacaagcccttcaagcagaagagaaggatgttgtgtcatctgtggccacagtgttatctgatctctgtggccctggagaatggatgcccatggcaaaactccacaacgagcttcttgagcagttcggcaacgtgtggcaccccagcagggtccggaagtacctgacacaggacgactggtcgccgacggagaccaagggcaggccttggttcggccttctggcgcttctcaggaagtacccggagcactttgtcatcaacacgaggtccaagggcaggatgacctcggagttcgtctcgctggtctccttgctctcctagagggacggagagggggtggtgttgtgtccagtactccagtccgtgtccagaagggtcggaggtgtactggctctcgtttgcttgccccttgctgtgtttcagcagctgttatatggacccaccatgttgtgctgtagtatctcgtgtggttgaggcagctgcactggtccgtgaccgtctctgtagtgtcggcagcagtgtatggaaagcatgcgttttaagttttaacctatgctagcaattcagcagcagctcggtgattaccg

SEQ ID NO: 612 - protein, 336 aa, Zea mays
  misc_feature (1)..(336): Ceres CLONE ID no. 280261
  misc_feature (1)..(336): GEMINI ID 552C6
  misc_feature (33)..(108): Pfam Name: FHA Pfam Description: FHA domain
MPGGSSGPDGEVDAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASAAAARHAPIIPQQLPPPPYAHARAGRPRLSEFHDRSFEGDYGREVDEIGNGISETGMRGKLVKRNKKSSGDLDIYGGHRINVEPIGTLGEDSRSEIRSRGDRDIDNQQALQAEEKDVVSSVATVLSDLCGPGEWMPMAKLHNELLEQFGNVWHPSRVRKYLTQDDWSPTETKGRPWFGLLALLRKYPEHFVINTRSKGRMTSEFVSLVSLLS

SEQ ID NO: 613 - DNA, 1107 bp, Arabidopsis thaliana
  misc_feature (1)..(1107): Ceres CLONE ID no.  2831
  misc_feature (1)..(1107): GEMINI ID 534C10
ttctttcgtttggcctttgatcctatcataagctttttttcgtttatcaatcttctcgattcagccacaattctagtttctcagataattcatttcctttctttgatccgtttccttctgctctgttctcagttctagatctagatctaggtttttttctttctcatcggaaatttgacttagaggcttgttttgatctagggtttggtctttgggaattttgaaaaaaaaaacaaaattaggaatgaatctatgagctactcaatcctgtttcgtcggattcgtattctacactctttctccgtcgtttacctctactacacctacgttttctcatgaagtaatcgttctcgatctcagttttcgtttttgatctaacttattctttgatagatttagaaatcggggattttcagattgtgtctttgagaggtttttataggaaaatatctctagaagaagaagaagaatattatattgattttaattttggtgagaagaagtcaaaaagtcaacgagaaatggggtcgttgcaaatgcaaacaagtcctgaatccgataatgatccgaggtacgccacggtgacggatgagaggaagaggaagagaatgatctctaacagagaatctgctcggaggtcaaggatgaggaaacagaagcaacttggtgatttgatcaacgaagtcactcttctcaagaatgataacgctaaaatcaccgaacaggttgatgaagcttcaaagaaatacattgaaatggagtctaagaacaatgtcttgagggcacaggcttcggagttgacggataggttaagatcattgaactctgtgcttgagatggttgaagagattagtggtcaggctttggatattcctgagattcctgaatctatgcagaacccttggcagatgccttgtccaatgcaaccaatcagagcttctgctgacatgtttgattgctgaagatggatgattcatatctgaaggatcaaaaatgaagcattgagatcgagtctttggtctgttttacttactgtccttgttgtaacaattagtgtgtcattggtgaattgagtcttgtgttgtcaatggacaacgcaatctttat

SEQ ID NO: 614 - protein, 141 aa, Arabidopsis thaliana
  misc_feature (1)..(141): Ceres CLONE ID no.  2831
  misc_feature (1)..(141): GEMINI ID 534C10
  misc_feature (16)..(79): Pfam Name: bZIP_1 Pfam Description: bZIP transcription factor
MQTSPESDNDPRYATVTDERKRKRMISNRESARRSRMRKQKQLGDLINEVTLLKNDNAKITEQVDEASKKYIEMESKNNVLRAQASELTDRLRSLNSVLEMVEEISGQALDIPEIPESMQNPWQMPCPMQPIRASADMFDC

SEQ ID NO: 615 - protein, 146 aa, Arabidopsis thaliana
  misc_feature (1)..(146): Public GI no. 15228754
  misc_feature (1)..(146): Functional Homolog of  Ceres CLONE ID no.  2831
  misc_feature (21)..(84): Pfam Name: bZIP_1 Pfam Description: bZIP transcription factor
MGSLQMQTSPESDNDPRYATVTDERKRKRMISNRESARRSRMRKQKQLGDLINEVTLLKNDNAKITEQVDEASKKYIEMESKNNVLRAQASELTDRLRSLNSVLEMVEEISGQALDIPEIPESMQNPWQMPCPMQPIRASADMFDC

SEQ ID NO: 616 - protein, 146 aa, Arabidopsis thaliana; identical to SEQ ID NO: 615
  misc_feature (1)..(146): Ceres CLONE ID no. 29982
  misc_feature (1)..(146): Functional Homolog of  Ceres CLONE ID no.  2831
  misc_feature (21)..(84): Pfam Name: bZIP_1 Pfam Description: bZIP transcription factor

SEQ ID NO: 617 - protein, 134 aa, Zea mays
  misc_feature (1)..(134): Ceres CLONE ID no. 1385680
  misc_feature (1)..(134): Functional Homolog of  Ceres CLONE ID no.  2831
  misc_feature (17)..(80): Pfam Name: bZIP_1 Pfam Description: bZIP transcription factor
MGSKSPDSDNDPRYASVTDERKRKRMISNRESARRSRMRKQKQLGDLINEVTVLKNDNAKITEQVDAATRRYVEMESKNDVLRAQEVELKERLRSLNSVLEMVEEISGQALDIPEIQNPWQIPCPIMQTNHGFC

SEQ ID NO: 618 - DNA, 435 bp, Populus balsamifera subsp. trichocarpa
  misc_feature (1)..(435): Ceres ANNOT ID no. 1497776
atgtctgcaaggcaagcggcgagctcaggatcggatagtgatccgcgatatgcgaatgtcgatgagaggaaaaggaagaggatgatatccaacagggaatctgcgaggcgttccaggatgaggaagcagaaacaaatgggggatttggtcaatgaagtgagcaaattgcagaacgagaacaatcagttgatgcagggtatcaatgttggccaacaacgccgcatggcgatggagtcagccaacaatgtcctgagggctcaggctgtggaattgactgagaggctgcggtcgttgaactctgtgttgcagattgtggaggatgttagtgggctctctatggagatacccgaaatacccgatcctttgttgaagccgtggcagctcccctgttcagtaatgcccatcatggcatctgctgatatgtttcaatattag

SEQ ID NO: 619 - protein, 144 aa, Populus balsamifera subsp. trichocarpa
  misc_feature (1)..(144): Ceres ANNOT ID no. 1497776
  misc_feature (1)..(144): Functional Homolog of  Ceres CLONE ID no.  2831
  misc_feature (19)..(82): Pfam Name: bZIP_1 Pfam Description: bZIP transcription factor
MSARQAASSGSDSDPRYANVDERKRKRMISNRESARRSRMRKQKQMGDLVNEVSKLQNENNQLMQGINVGQQRRMAMESANNVLRAQAVELTERLRSLNSVLQIVEDVSGLSMEIPEIPDPLLKPWQLPCSVMPIMASADMFQY

SEQ ID NO: 620 - DNA, 420 bp, Populus balsamifera subsp. trichocarpa
  misc_feature (1)..(420): Ceres ANNOT ID no. 1471578
atgtctgcaaggcaagcagcgagctcaggatcggacagcgatccacgatatgcgaacgtcgatgagaggaaaaggaagaggatgatatccaacagggattctgccaggcggtccaggatgaggaagcagaaacaaatggaggatttggttaatgaagtgagcaaattgcagaacgagaataatcaattgatgcagggtatcaatgttgcccaacaacgctacatggagatggaatcagccaacaatgttctgagggctcaagctgtggaattgactgagaggctgcggtcgttgaactctgtgctgcagattgtggaggatgttagcggactctccgtggagatacctgaaatacctgatcctttgttcaagccgtgggcagctcccgtgttcagtacagcctattatgacatctgctga

SEQ ID NO: 621 - protein, 139 aa, Populus balsamifera subsp. trichocarpa
  misc_feature (1)..(139): Ceres ANNOT ID no. 1471578
  misc_feature (1)..(139): Functional Homolog of  Ceres CLONE ID no.  2831
  misc_feature (19)..(73): Pfam Name: bZIP_2 Pfam Description: Basic region leucine zipper
MSARQAASSGSDSDPRYANVDERKRKRMISNRDSARRSRMRKQKQMEDLVNEVSKLQNENNQLMQGINVAQQRYMEMESANNVLRAQAVELTERLRSLNSVLQIVEDVSGLSVEIPEIPDPLFKPWAAPVFSTAYYDIC

SEQ ID NO: 622 - protein, 147 aa, Petroselinum crispum
  misc_feature (1)..(147): Public GI no. 9650826
  misc_feature (1)..(147): Functional Homolog of  Ceres CLONE ID no.  2831
  misc_feature (26)..(85): Pfam Name: bZIP_1 Pfam Description: bZIP transcription factor
MASVQNQNQVSSGSDGDLRYATFDEKKRKRMISNRESARRSRMKKQQHVDKLIAEMSQLQSQNKVVTQKINEATDMFFGVVSENNVLRAQLSELTDRLYSLNSVLHIVEEVSGLAMDIPQVPDTLMEPWQLPCPAQPITTSANMFKF

SEQ ID NO: 623 - protein, 144 aa, Musa acuminata
  misc_feature (1)..(144): Ceres CLONE ID no. 1728175
  misc_feature (1)..(144): Functional Homolog of  Ceres CLONE ID no.  2831
  misc_feature (19)..(73): Pfam Name: bZIP_2 Pfam Description: Basic region leucine zipper
MSSIPVRRASSSEGDSQPTSDERKRKRMLSNRESARRSRMRKQQHLDDLINQAEQLKNQNSQIDVQINLATQQYVKVESENAILRAQLSELTERLHSINSVLRFIEEVSGMAMDIPEIPDPLLKPLQLPRAAQPIMANADMLQF

SEQ ID NO: 624 - protein, 140 aa, Antirrhinum majus
  misc_feature (1)..(140): Public GI no. 2244744
  misc_feature (1)..(140): Functional Homolog of  Ceres CLONE ID no.  2831
  misc_feature (15)..(78): Pfam Name: bZIP_1 Pfam Description: bZIP transcription factor
MAPEQQSPNSGSNSNIDERKRKRKQSNRESARRSRMRKQQRLDELMAQESQIQEENKKLQKIIDDSKQLYLNFASENNVLRAQLGELTDRLRSLNSVLEIASEVSGMAFDIPAIPDALLEPWLLPCPIQPIAASADMFRH

SEQ ID NO: 625 - protein, 150 aa, Glycine max
  misc_feature (1)..(150): Ceres CLONE ID no. 676378
  misc_feature (1)..(150): Functional Homolog of  Ceres CLONE ID no.  2831
  misc_feature (29)..(88): Pfam Name: bZIP_1 Pfam Description: bZIP transcription factor
MASPIQQQQRSTTTSSGSEGGDPHIIDERKRKRMLSNRESARRSRMRKQKQLEDLTDEVSRLQSANKKLAENIEAKEEACVETEAANSILRAQTMELADRLRFLNSILEIAEEVEGLSVEIPEIPDPLLKPWQIPHPIQPIMATANMFLR

SEQ ID NO: 626 - protein, 144 aa, Capsicum annuum
  misc_feature (1)..(144): Public GI no. 77999786
  misc_feature (1)..(144): Functional Homolog of  Ceres CLONE ID no.  2831
  misc_feature (19)..(82): Pfam Name: bZIP_1 Pfam Description: bZIP transcription factor
MASTQQPASSGSDGQRYANYDERKRKRMESNRESARRSRMRKQQHLEELMSELTQLQNQNTIWSKRIDAVGKNYHTVEAENNVLRAQIAELTERLDSLNSLTRFWADANGLAVDIPEIPDALLEPWQLPCPIQPITASADMLQF

SEQ ID NO: 627 - protein, 144 aa, Nicotiana tabacum
  misc_feature (1)..(144): Public GI no. 16580132
  misc_feature (1)..(144): Functional Homolog of  Ceres CLONE ID no.  2831
  misc_feature (19)..(82): Pfam Name: bZIP_1 Pfam Description: bZIP transcription factor
MALTQQPASSGSDGQRYATNDDRKRKRMESNRESARRSRMRKQQHLEELMSQMTQLQNQNVLWREKIDAVGRNYLTLDAENNVLRAQMAELTERLDSLNSLTRFWADANGLAVDIPEIPDTLLEPWQLPCPIQPITASADMFKF

SEQ ID NO: 628 - protein, 144 aa, Nicotiana tabacum
  misc_feature (1)..(144): Public GI no. 10241920
  misc_feature (1)..(144): Functional Homolog of  Ceres CLONE ID no.  2831
  misc_feature (19)..(82): Pfam Name: bZIP_1 Pfam Description: bZIP transcription factor
MALTQQPASSGSDGQRYATNDDRKRKRMESNRESARRSRMRKQQHLEELMSQMTQLQNQNVLWREKIDAVGRNYLTLDAENNVLRAQMAELTERLDSLNSLTRFWADANGLAVDIPEIPDTLLEPWQLPCPIQPITASADMFQF

SEQ ID NO: 629 - protein, 144 aa, Raphanus sativus
  misc_feature (1)..(144): Public GI no. 3986151
  misc_feature (1)..(144): Functional Homolog of  Ceres CLONE ID no.  2831
  misc_feature (20)..(83): Pfam Name: bZIP_1 Pfam Description: bZIP transcription factor
MASTQQAVSSASDADQQYAKFDERKRKRMESNRECARRSRMRKQQRLGELMGETTQLHKQNSICRERIDSVERNYRAMDAENNVLRAQIAELTERLNSLNSPTQFWADANGFPVELSEIPDALLEPWQLPCPIQPIDASDMLLF

SEQ ID NO: 630 - protein, 145 aa, Oryza sativa
  misc_feature (1)..(145): Public GI no. 77556137
  misc_feature (1)..(145): Functional Homolog of  Ceres CLONE ID no.  2831
  misc_feature (22)..(85): Pfam Name: bZIP_1 Pfam Description: bZIP transcription factor
MSSSSLSPAGSSDGDSAGVVVAADHRREKRRLSNRESARRSRLRKQQHLDELVQEVARLQADNARVLARASEIAGQYARVEQENTVLRARAAELGDRLRSVNEVLRVVEEFSGVAMDIQEECPPDDPLLRPWQIPCPAAAHMLQY

SEQ ID NO: 631 - protein, 139 aa, Craterostigma plantagineum
  misc_feature (1)..(139): Public GI no. 72398495
  misc_feature (1)..(139): Functional Homolog of  Ceres CLONE ID no.  2831
  misc_feature (21)..(77): Pfam Name: bZIP_1 Pfam Description: bZIP transcription factor
MATNPRSTSPLSDIDGERQRKRKLSNRESARRSRMRKQQRLDELTAQATQLKEENKKLREMIDGSNQLYLSAASENSVLRAQAAELADRLKSLNTLLRIASDVSGLAFDIPDVPDALAEPWQMPCAVLPVAASADMFQY

SEQ ID NO: 632 - protein, 139 aa, Craterostigma plantagineum
  misc_feature (1)..(139): Public GI no. 72398497
  misc_feature (1)..(139): Functional Homolog of  Ceres CLONE ID no.  2831
  misc_feature (21)..(77): Pfam Name: bZIP_1 Pfam Description: bZIP transcription factor
MATNPRSTSPLSDIDGERQRKRKLSNRESARRSRMRKQQRLDELTAQATQLKEENKKLREMIDGSNQLYLSVASENSVLRAQATELADRLKSLNALLRVASDVSGLAFDIPDVPDALAEPLQMPCSVLPITASADMFQY

SEQ ID NO: 633 - protein, 144 aa, Lycopersicon esculentum
  misc_feature (1)..(144): Public GI no. 5901747
  misc_feature (1)..(144): Functional Homolog of  Ceres CLONE ID no.  2831
  misc_feature (19)..(82): Pfam Name: bZIP_1 Pfam Description: bZIP transcription factor
MASTQQPASSGSDGQRYATNDERKRKRMESNRESARRSRKRKQQHLEELMSQLTQLQNQSTIWREKIESVGRNFHTLDAENNVLRAQMAELTERLDSLNSLTRFWADANGLAVDIPEIPDTLLEPWQLPCPIQPITASADMFQF

SEQ ID NO: 634 - protein, 157 aa, Secale cereale
  misc_feature (1)..(157): Public GI no. 40019253
  misc_feature (1)..(157): Functional Homolog of  Ceres CLONE ID no.  2831
  misc_feature (26)..(89): Pfam Name: bZIP_1 Pfam Description: bZIP transcription factor
MSSSSLSPGGGRLSGSDGDSGATFVAGDNRREKRRLSNRESARRSRLRKQQHLDELVQEVARLKAENARVLARANDITSQFVRVDQENTVLRARAAELGDRLRSVNQVLRVVEEFSGVAMDIQEECPPDDPLLRPWQIPYPATAMPIAATATHMLQY

SEQ ID NO: 635 - protein, 150 aa, Triticum aestivum
  misc_feature (1)..(150): Public GI no. 62898531
  misc_feature (1)..(150): Functional Homolog of  Ceres CLONE ID no.  2831
  misc_feature (24)..(87): Pfam Name: bZIP_1 Pfam Description: bZIP transcription factor
MSSPSRRSSSPESNIDGGSGSGSAGDERKRKRMLSNRESARRSRARKQQRMEELIAEASRLQAENKRVEAQIGAYTTELTKVDGENAVLRARHGELAGRLQALGGVLEIFQVAGAPVDIPEIPDPLLRPWQSPFAPQLATAGGMPDAFQF

SEQ ID NO: 636 - protein, 150 aa, Triticum aestivum; identical to SEQ ID NO: 635
  misc_feature (1)..(150): Ceres CLONE ID no. 869920
  misc_feature (1)..(150): Functional Homolog of  Ceres CLONE ID no.  2831
  misc_feature (24)..(87): Pfam Name: bZIP_1 Pfam Description: bZIP transcription factor

SEQ ID NO: 637 - DNA, 1263 bp, Arabidopsis thaliana
  misc_feature (1)..(1263): Ceres CLONE ID no.  285598
  misc_feature (1)..(1263): GEMINI ID 536G9
gtctttcactccatcaccccctctcccccgtccctttcccctcagccctcagccctcagccatctccttccccctcacctcgccatggcgttcttctctcaccaccatctccagcagccacacccgcagcaggcaccgcccccgaatcagcagcagccggtgcttccttccttcaggaacgcgctaccggtgcctgtggatggccagatcccagcgcccctcaccttcttcaacccgccgcctgccttcccggagcagcccgcgcagacaacgctggtggatgcggtggggctgacggcagctgctgggcttgggtggaggcagccgagggagcaggaactgcttggagaaaactcccagatgtcgtccatcgattttctgcagacgggctcggcggtatcgacggggctggcgctgtctctggaggaccggcgccacggcggcggcggggctgggaactcctccggcgattcaccgctgctcctgctgcccatgctggacgatgacatttcacgcgaggtccagcggcttgacgctgatatggaccgcttcattaaagctcagagtgaacggctgaggcaatctatactggagaaagttcaggcaaagcaatttgaggcactggcctcagttgaggacaagatattcagaaaaatacgggataaagaggcggaagtggaaaccatcaacaaaaggaactctgaactagaggaccagattaagcatttgggagtggaagttggtgcttggcagcaaagggccaagtacaatgagagcctgatcaatgcactcaagtacaacttggaacaagtatgtgctcaccagagcaaggacttcaaggaaggctgcggtgatagcgaggtagatgacacggcgtcctgtccctatggtggtgctgtcaatttgcaactgatgccaaaggagaacagacaaccgaagaatttaacggcttgcagggtctgtaaatcaagtgaggcatgcatgctcttgttgccgtgtcggcatctttgtctatgcaaggagtgcgagagcaagctgagcatctgccccctgtgccagtcctccaagatacttggcatggagatatattatgcatagaatataatttatgtatcacattagtatcgtacgagatactgctatgttaatacgtcaatctattgccgaagttcagaacctatgtaccactattgacttgccactggatcaaaaaaagactgccgtttatggtagatttaacgcagcaaatttctttgcgaagct

SEQ ID NO: 638 - protein, 337 aa, Arabidopsis thaliana
  misc_feature (1)..(337): Ceres CLONE ID no.  285598
  misc_feature (1)..(337): GEMINI ID 536G9
MAFFSHHHLQQPHPQQAPPPNQQQPVLPSFRNALPVPVDGQIPAPLTFFNPPPAFPEQPAQTTLVDAVGLTAAAGLGWRQPREQELLGENSQMSSIDFLQTGSAVSTGLALSLEDRRHGGGGAGNSSGDSPLLLLPMLDDDISREVQRLDADMDRFIKAQSERLRQSILEKVQAKQFEALASVEDKIFRKIRDKEAEVETINKRNSELEDQIKHLGVEVGAWQQRAKYNESLINALKYNLEQVCAHQSKDFKEGCGDSEVDDTASCPYGGAVNLQLMPKENRQPKNLTACRVCKSSEACMLLLPCRHLCLCKECESKLSICPLCQSSKILGMEIYYA

SEQ ID NO: 639 - protein, 329 aa, Zea mays
  misc_feature (1)..(329): Ceres CLONE ID no. 236111
  misc_feature (1)..(329): Functional Homolog of  Ceres CLONE ID no.  285598
MAFFSHHHLQQPHAQQPVLPSFRNALPVPVDGQIPAPLTFFNPPPAFPEQPAQAPLVDAVGLTAAAGLGWRQPREQELLGENSQMSSIDFLQTGSAVSTGLALSLEDRRHGGGGAGNSSGDSPLLLLPMLDDDISREVQRLDADMDRFIKAQSERLRQSILEKVQAKQFEALASVEDKILRKIRDKEAEVETINKRNSELEDQIKHLGVEVGAWQHRAKYNESMINALKYNLEQVCAHQSKDFKEGCGDSEVDDTASCRDGGAINFQLTPKENRQPKDLTACRVCKSSEASMLLLPCRHLCLCKECESKLSFCPLCQSSKILGMEIYYA

SEQ ID NO: 640 - protein, 342 aa, Oryza sativa
  misc_feature (1)..(342): Public GI no. 34902144
  misc_feature (1)..(342): Functional Homolog of  Ceres CLONE ID no.  285598
MAFFSHHHLQQPHPQAPPPPPPQQQQQPVPPSFRNALPVPVDGQIPAPLPFFNPPPAFQDQPAQPPLVDAMGLTAAAGLGWRQPREQELLGENSQMSSIDFLQTGSAVSTGLALSLEDRRHGGGSGAGAGNSSGDSPLLLLPMLDDDISREVQRLDADMDRFIKAQSERLRQSILEKVQAKQFEALASVEDKILRKIRDKEAEVENINKRNSELEDQIKQLAVEVGAWQQRAKYNESMINALKYNLEQVCAHQSKDFKEGCGDSEVDDTASCCNGGAANLQLMPKENRHSKDLTACRVCKSSEACMLLLPCRHLCLCKECESKLSFCPLCQSSKILGMEIYM

SEQ ID NO: 641 - protein, 339 aa, Triticum aestivum
  misc_feature (1)..(339): Ceres CLONE ID no. 1315656
  misc_feature (1)..(339): Functional Homolog of  Ceres CLONE ID no.  285598
MAFFSHHHLQQPHPAAPPPQQQQQQPAPLSFRNALPVPVDGQIPAPLAFFNAPPAFPDQAGQPQIVDAAGLTAAAGMGWRQPREQELLGENSQMSSIDFLQTGSAVSTGLALSLEDRRHGGGGAGAGNSSGDSPLLLLPMLDDDISREVQRLDADMDRFIRAQSERMRQSILEKVQAKQFEALASVEDKILRKIRDKESEVQNINKRNLELEDQIKQMAGEVGAWQQRAKYNESMISALKYNLEQVCAHQSKDFKEGCGDSEVDDTASCCNGGAVNLQLMPKENNHPKDLTACRVCKSSEACMLLLPCRHLCLCKECESKLSFCPLCQSSKILGMEIYM

SEQ ID NO: 642 - protein, 332 aa, Petunia x hybrida
  misc_feature (1)..(332): Public GI no. 45602841
  misc_feature (1)..(332): Functional Homolog of  Ceres CLONE ID no.  285598
GTSHLQLHIQQQPQQQSKSYRDIYNNMDGQISTPVAYFNCSNLPEQSQHPPYIPPFQVVGLAPGLVDDGGLDLQWNYGLEPKRKRPKEQDFLENNNSQISSIDFLQPRSVSTGLGLSLDNGRLASSGDSAFLGLVGDDIERELQRQDAEIDRYIKVQGDRLRQAILEKVQANQLQTVTYVEEKVIQKLREKETEVEDINKKNMELELRTEQLALEANAWQQRAKYNENLINTLKVNLEHVYAQSRDSKEGCGDSEVDDTASCCNGRATDLHLLCRDSNEMKELMTCKVCRVNEVSMLLLPCKHLCLCKECESKLSLCPLCQSTKYIGMEIYM

SEQ ID NO: 643 - protein, 338 aa, Lycopersicon esculentum
  misc_feature (1)..(338): Public GI no. 45544873
  misc_feature (1)..(338): Functional Homolog of  Ceres CLONE ID no.  285598
MALPHHHLQLHIQQQPHQQQQQSKSYRDLYNNMDGQITNPVVYFNGSNLPEQSQHPPYIPPFQVVGLAPGTADDGGLDLQWNYGLEPKKKRPKEQDFMENNNSQISSVDLLQRRSVSTGLGLSLDNGRLASSCDSAFLGLVGDDIERELQRQDAEIDRYIKVQGDRLRQAVLEKVQANQIQAITYVEEKVLQKLRERDTEVDDINKKNMELELRMEQLALEANAWQQRAKYNENLINTLKVNLQHVYAQSRDSKEGCGDSEVDDTASCCNGRATDLHLLCRDSKEMKELMTCRVCRTNEVCMLLLPCKHLCLCKECESKLSLCPLCQSTKYIGMEVYM

SEQ ID NO: 644 - protein, 337 aa, Solanum chacoense
  misc_feature (1)..(337): Public GI no. 45758663
  misc_feature (1)..(337): Functional Homolog of  Ceres CLONE ID no.  285598
MALPHHHLQLHIQQQQPHQQQSKSYRDLYNNMDGQITTPVVYFNGSNLPEQSQHPPYIPPFQVVGLAPGTADDGGLDLQWNYGLEPKKKRPKEQDFMENNNSQISSVDLFQRRSVSTGLGLSLDNGRLASSCDSAFLGLVGDDIERELQRQDAEIDRYIKVQGDRLRQAVLEKVQANQIQAITYVEEKVLQKLRERDTEVDDINKKNMELELRMEQLDLEANAWQQRAKYNENLINTLKVNLQHVYAQSRDSKEGCGDSEVDDTASCCNGRATDLHLLCRDSKEMKELMTCRVCRTNEVCMLLLPCKHLCLCKECESKLSLCPLCQSTKYIGMEVYM

SEQ ID NO: 645 - protein, 325 aa, Arabidopsis thaliana
  misc_feature (1)..(325): Public GI no. 62320820
  misc_feature (1)..(325): Functional Homolog of  Ceres CLONE ID no.  285598
MALHPHLQDSKNFRDFCGIDGQISPELGFNRSENLHDQSQHPPYIPPFHVAGFAPGPVVQIDGSDGGNGADFEWNYGLGLEPRRERIKEQDFLENNSQISSIDFLQARSVSTGLGLSLDNARVASSDGSALLSLVGDDIDRELQRQDADIDRFLKIQGDQLRHAILDKIKRGQQKTVSLMEEKVVQKLREKDEELERINRKNKELEVRMEQLTMEAEAWQQRAKYNENMIAALNYNLDRAQGRPRDSIEGCGDSEVDDTASCFNGRDNSNNNTKTMMMCRFCGVREMCMLLLPCNHMCLCKECERKLSSCPLCQSSKFLGMEVYM

SEQ ID NO: 646 - protein, 325 aa, Arabidopsis thaliana
  misc_feature (1)..(325): Ceres CLONE ID no. 1344853
  misc_feature (1)..(325): Functional Homolog of  Ceres CLONE ID no.  285598
  misc_feature (153)..(153): Xaa is any aa, unknown, or other
MALHPHLQDSKNFRDFCGIDGQISPELGFNRSENLHDQSQHPPYIPPFHVAGFAPGPVVQIDGSDGGNGADFEWNYGLGLEPRRERIKEQDFLENNSQISSIDFLQARSVSTGLGLSLDNARVASSDGSALLSLVGDDIDRELQRQDADIDRXLKIQGDQLRHAILDKIKRGQQKTVSLMEEKVVQKLREKDEELERINRKNKELEVRMEQLTMEAEAWQQRAKYNENMIAALNYNLDRAQGRPRDSIEGCGDSEVDDTASCFNGRDNSNNNTKTMMMCRFCGVREMCMLLLPCNHMCLCKECERKLSSCPLCQSSKFLGMEVYM

SEQ ID NO: 647 - protein, 337 aa, Medicago truncatula
  misc_feature (1)..(337): Public GI no. 92888885
  misc_feature (1)..(337): Functional Homolog of  Ceres CLONE ID no.  285598
MAFLQDQFQRHYQQQQQPQPQTKSFRNLQTIEGQMSQQMAFYNPTDLQDQSQHPPYIPPFGFAPGPVIPADGSDGGVDLHWNFGLEPERKRLKEQDFLENNSQISSVDFLQPRSVSTGLGLSLDNTRLASTGDSALLSLIGDDIDRELQQQDLEMDRFLKLQGEQLRQTILEKVQATQLQSVSIIEDKVLQKLREKETEVENINKRNMELEDQMEQLSVEAGAWQQRARYNENMIAALKFNLQQAYLQGRDSKEGCGDSEVDDTASCCNGRSLDFHLLSNENSNMKDLMKCKACRVNEVTMVLLPCKHLCLCKDCESKLSFCPLCQSSKFIGMEVYM

SEQ ID NO: 648 - protein, 342 aa, Solanum chacoense
  misc_feature (1)..(342): Public GI no. 40807658
  misc_feature (1)..(342): Functional Homolog of  Ceres CLONE ID no.  285598
MGALPHHHLQLHIQQQQPHQQQQQQQSKSYRDLYNNMDGQITTPVVYFNGSNLPEQSQHPPYIPPFQVVGLAPGTADDGGLDLQWNYGLEPKKKRPKEQDFMENNNSQISSVDLLQRRSVSTGLGLSLDNGRLASSCDSAFLGLVGDDIERELQRQDAEIDRYIKVQGDRLRQAVLEKVQANQIQAITYVEEKVLQKLRERDTEVDDINKKNMELELRMEQLDLEANAWQQRAKYNENLINTLKVNLQHVYAQSRDSKEGCGDSEVDDTASCCNGRATDLHLLCRDSKEMKELMTCRVCRTNEVGMLWLPCKHLGLCKECESKLSLCPLCQSIKYIGMEVYM

SEQ ID NO: 649 - DNA, 1014 bp, Populus balsamifera subsp. trichocarpa
  misc_feature (1)..(1014): Ceres ANNOT ID no. 1486505
atggctcatccccaacaccagtttcaacagcactaccaacctcaacagcaacaacaacaacctaagaatttgaggaatttatatgcaatcgacagccagatttctccggcagtggcttattttaatccctctaatttgcaagatcagtctcagcatcctccctatgtccctccttttcatgtggtggggtttgctccgggtcctgggaatgatggcagtgatgggggacttgaattgcagtggaattatgggctagaacccaagagaaagagattgaaggagcaagactttttggagaataattcccagatttcctctgttgatttcttgcaagcacgatcagtctcaactgggttagggttgtctcttgacaatacccgtgtttcatcttctggtgactcggctttgttatcgcttattggtgatgatattgatagtgaattgcagcgacaggacgtggaggttgataaattcctcaaaattcagggtgatcgactgcggcaaaccatcctagagaaggtccaagccgaccaacttcaaactatctcacttgtggaagagaaggttcttcaaaaacttcgtcagaaagaagcagaggtggagagcatcaataagaagaacatggaacttgaagagaaaatggaacagttgtctatggaagcaggtgcatggcaggaacgggccagatacaatgaaaacatgataaatgccatcaagttcaacatccagcaagtctatgctcaaagtagagatagtaaagaaggttgtggtgacagtgaggtggatgatacagcttcgtgctgcaatggccgtgccattgattttcacctgctttccaatgacaataatgacatgaaggagctgatgacttgtaaggcttgcagagtcaatgaagtttgcatgcttttgttaccttgtaagcatctctgcctctgtaaggattgtgaaagtaagcttagtttttgtcccctgtgtcattcctccaagtttattggcatggaagtttatatgtaa

SEQ ID NO: 650 - protein, 337 aa, Populus balsamifera subsp. trichocarpa
  misc_feature (1)..(337): Ceres ANNOT ID no. 1486505
  misc_feature (1)..(337): Functional Homolog of  Ceres CLONE ID no.  285598
MAHPQHQFQQHYQPQQQQQQPKNLRNLYAIDSQISPAVAYFNPSNLQDQSQHPPYVPPFHVVGFAPGPGNDGSDGGLELQWNYGLEPKRKRLKEQDFLENNSQISSVDFLQARSVSTGLGLSLDNTRVSSSGDSALLSLIGDDIDSELQRQDVEVDKFLKIQGDRLRQTILEKVQADQLQTISLVEEKVLQKLRQKEAEVESINKKNMELEEKMEQLSMEAGAWQERARYNENMINAIKFNIQQVYAQSRDSKEGCGDSEVDDTASCCNGRAIDFHLLSNDNNDMKELMTCKACRVNEVCMLLLPCKHLCLCKDCESKLSFCPLCHSSKFIGMEVYM

SEQ ID NO: 651 - DNA, 886 bp, Arabidopsis thaliana
  misc_feature (1)..(886): Ceres CLONE ID no.  2898
  misc_feature (1)..(886): GEMINI ID 535H5
aaaaacgagttttttcttcggctttccactttttcctctgttcgtgtcattcttctcgtagatctcgagagagagccttaaggaaattaaaaaaggttggattttgatcgatgggttcttcgtcaggacaacccgaatttgattacttgtttaaggttttattgatcggagattctggtgttggaaagagctctcttttgttgagtttcacatctaatacctttgatgatctttctccaacgattggtgtggattttaaggttaagtatctgacaattggaggaaaaagaaactcaagcttgcgatttgggatacagctgggcaagagagatttaggacgctaacaagttcgtattacagaggagctcagggtataattatggtatatgatgtgacacgaagagacacgttcacaaacctatcagacatatgggctaaggaaatcgacctctattcgactaatcaggattgcattaagatgcttgtcgggaataaagttgataaggagagtgaaagagctgtttctaaaaaagaaggcatagactttgctcgggagtacggatgtttgtttctggagtgtagtgcaaagactcgagtcaacgttgagcaatgttttgaagagcttgttcttaagatattggaaacgccgagtcttactgctgaaggttcgtctggcggaaagaagaacatcttcaaacaaaaccccgcacagaccaccagtacctcgtcgagctactgctgctcgtcttagacatggttttacagtttatgacaaattacactcttgctcatcatcttgttcttgattgtctctttgttttcctaaaccgcagcatcttggatgtaaatctcaaccctgatttaaaagttgtgttcactagtttcg

SEQ ID NO: 652 - protein, 123 aa, Arabidopsis thaliana
  misc_feature (1)..(123): Ceres CLONE ID no.  2898
  misc_feature (1)..(123): GEMINI ID 535H5
  misc_feature (2)..(88): Pfam Name: Ras Pfam Description: Ras family
MVYDVTRRDTFTNLSDIWAKEIDLYSTNQDCIKMLVGNKVDKESERAVSKKEGIDFAREYGCLFLECSAKTRVNVEQCFEELVLKILETPSLTAEGSSGGKKNIFKQNPAQTTSTSSSYCCSS

SEQ ID NO: 653 - protein, 131 aa, Musa acuminata
  misc_feature (1)..(131): Ceres CLONE ID no. 1716210
  misc_feature (1)..(131): Functional Homolog of  Ceres CLONE ID no.  2898
  misc_feature (16)..(131): Pfam Name: Ras Pfam Description: Ras family
MDSASSGQPEFDYLFKLLLIGDSGVGKSSLLLRFTSDSFEDLSPTIGVDFKVKIVNIGGKRLKLAIWDTAGQERFRTLTSSYYRGAQGVIMVYDVTRRDTFTNLSDIWAKEIELYSTNQDCIKMLVGNKVD

SEQ ID NO: 654 - protein, 160 aa, Zea mays
  misc_feature (1)..(160): Ceres CLONE ID no. 1421639
  misc_feature (1)..(160): Functional Homolog of  Ceres CLONE ID no.  2898
  misc_feature (15)..(157): Pfam Name: Ras Pfam Description: Ras family
  misc_feature (158)..(158): Xaa is any aa, unknown, or other
MGSPSGQPEFDYLFKVLLIGDSGVGKSSLLLSFTSNTFDDLSPTIGVDFKVKYLTIGEKKLKLAIWDTAGQERFRTLTSSYYRGAQGIIMVYDVTRRETFTNLSDIWAKEIDLYSTNQDCIKMLVGNKVDKESERAVSKKEGIDFARVYGCLFLECSXQT

SEQ ID NO: 655 - DNA, 690 bp, Populus balsamifera subsp. trichocarpa
  misc_feature (1)..(690): Ceres ANNOT ID no. 1443201
atggaagtaccgtcgacgagtcaacaggagtttgagtacctgttcaagttgttgttaattggggattctggtgtgggaaagagtactctgcttttgagtttcacgtccaagaattttgaggatctttctcctaccattggtgtggattttaaagtaaagcatgtcaccataggtgggaaaaagttgaagcttgctatctgggacacagctggacaagagaggtttagaactctaactagttcttattacagaggagctcaagggataattatggttgttcttatctcgctcctcttgcttaatgctgttgtctttggaataagtacagtgtatgatgtaacacgacgagaaacatttacaaatctatctgaaatatgggcaaaggaaattgatttgtactcaacaaatcaggattgcatcaagatgcttgttggaaacaaagtcgataaggagagcgaaagggttgtcaccaaaaaagagggtattgactttgctagggaatatggatgcctcttccttgaatgtagtgcaaaaactagagtcaatgtggagcaatgcttcgaggaacttgttttaaagattttggaaacgcctagtctgttggctgaaggctctagtggtgtgaaaaagaacgtctttaaacagaagcctccagaggatgttacaaccagtagttgttgctcatggtaa

SEQ ID NO: 656 - protein, 139 aa, Populus balsamifera subsp. trichocarpa
  misc_feature (1)..(139): Ceres ANNOT ID no. 1443201
  misc_feature (1)..(139): Functional Homolog of  Ceres CLONE ID no.  2898
  misc_feature (20)..(106): Pfam Name: Ras Pfam Description: Ras family
MVVLISLLLLNAVVFGISTVYDVTRRETFTNLSEIWAKEIDLYSTNQDCIKMLVGNKVDKESERVVTKKEGIDFAREYGCLFLECSAKTRVNVEQCFEELVLKILETPSLLAEGSSGVKKNVFKQKPPEDVTTSSCCSW

SEQ ID NO: 657 - protein, 158 aa, Triticum aestivum
  misc_feature (1)..(158): Ceres CLONE ID no. 749118
  misc_feature (1)..(158): Functional Homolog of  Ceres CLONE ID no.  2898
  misc_feature (2)..(126): Pfam Name: Ras Pfam Description: Ras family
MVNIAGKKLKLAVWDTAGQERFRTLTSSYYRGAQGIIMGMYDVTRRETFTNLSDIWAKEIDLYSTNQDCIKMLVGNKVDKESERAVTKKEGIDFAREYGCLFLECSAKTKVNVEQCFEELVLKILDTPSLLADASSGAKKNIFKQKAPEADAAASGCC

SEQ ID NO: 658 - DNA, 726 bp, Populus balsamifera subsp. trichocarpa
  misc_feature (1)..(726): Ceres ANNOT ID no. 1450718
atgaccaaccaccactctgccgatggagaacatggagtcgcatccaagggggcaccacgtggtgaagtagggcacattgtggtgtcggaggaactgggattttatagttcgaatgctccggagtttgattacttgttcaagttgttgatgattggagattctggtgttgggaaaagtagtctccttttgagtttcacttctgacacctttgaagatctctcccccaccattggtgttgattttaaagtaaaatttgtgaatattggagggaaaaatctgaaacttgcgatatgggatactgctggtcaggagagatttagaacattgacaagttcatactacagaggggcccaagggatcattatggtctatgatgtaactcgacgagacacatttaccaatctctctgagatatgggctaaggaaattgatctatattcaacaaatcaagattgcatcaagatgcttgttggaaacaaggttgacaaggaaagtgatcgggcggtgacaaaaaaggagggcataaactttgctagggaatatggatgcctctttattgaatgcagcgctaaaacccgtgttaatgtacaacaatgttttgaagagcttgttctaaagattttagatacacccagcctattggctgagggttccaaaggtgtaaaaaagaacatctttagtgagaagcggccacaacctgatgcatccactagcagttgttgctga

SEQ ID NO: 659 - protein, 120 aa, Populus balsamifera subsp. trichocarpa
  misc_feature (1)..(120): Ceres ANNOT ID no. 1450718
  misc_feature (1)..(120): Functional Homolog of  Ceres CLONE ID no.  2898
  misc_feature (2)..(88): Pfam Name: Ras Pfam Description: Ras family
MVYDVTRRDTFTNLSEIWAKEIDLYSTNQDCIKMLVGNKVDKESDRAVTKKEGINFAREYGCLFIECSAKTRVNVQQCFEELVLKILDTPSLLAEGSKGVKKNIFSEKRPQPDASTSSCC

SEQ ID NO: 660 - DNA, 1209 bp, Arabidopsis thaliana
  misc_feature (1)..(1209): Ceres CLONE ID no.  2913
  misc_feature (1)..(1209): GEMINI ID 533B11
accagaagtggtatagtctaggccgatacatttcactatctctctctcttttgtttttcctcttcttctttttttccatttaatttcaaactctcacacaaagagcttcagatttataagaccatgataatggctttaagacaaagattggcaagaagaaaaaactaaagagaaacgaccaaaatctcaagcaaacagtactaacttctgttgcaaaacagaagaagatgtcttgtaataatggaatgtcttttttcccttcaaatttcatgatccaaacctcttacgaagatgatcatcctcatcaatctccatctcttgctcctcttcttccttcttgctctctacctcaagatctccatggatttgcttcgtttctaggtaagagatctccaatggaagggtgttgtgatttagaaacagggaacaatatgaatggagaagaggattattcagatgatgggtcacaaatgggagagaagaagaggagattgaacatggaacaagtgaagacactagagaagaactttgagcttggaaacaaacttgaaccagagaggaaaatgcagctagctcgtgccttaggtttgcaaccaagacagatcgcgatttggtttcaaaatcgaagagctcgttggaaaacaaagcagctagagaaagattatgatactcttaaacgacagtttcatacacttaaagctgaaaatgatcttcttcaaactcataatcagaaactccaagctgagataatgggattaaaaaacagagaacaaacagaatcaataaatctaaacaaagaaactgaaggatcttgcagtaacagaagtgataacagttcagataatctcagactagatatctcaactgcgccgccatcaaacgacagtacattaaccggtggccacccaccgccaccacagacagttggtcgacacttcttcccaccgtcgccagccaccgcaacgacaactactacaacaatgcagttctttcaaaactcatcttcaggacagagtatggttaaagaagagaatagtatcagtaacatgttctgtgcaatggatgaccattctggtttttggccatggcttgatcagcaacagtacaattgaaattggtctacctgttttttttgtttttgtttttaaaaaaatttatattttttttttgtatttggaattttgatcagaagaacccatgcatgttttc

SEQ ID NO: 661 - protein, 294 aa, Arabidopsis thaliana
  misc_feature (1)..(294): Ceres CLONE ID no.  2913
  misc_feature (1)..(294): GEMINI ID 533B11
  misc_feature (140)..(184): Pfam Name: HALZ Pfam Description: Homeobox associated leucine zipper
  misc_feature (85)..(139): Pfam Name: Homeobox Pfam Description: Homeobox domain
MSCNNGMSFFPSNFMIQTSYEDDHPHQSPSLAPLLPSCSLPQDLHGFASFLGKRSPMEGCCDLETGNNMNGEEDYSDDGSQMGEKKRRLNMEQVKTLEKNFELGNKLEPERKMQLARALGLQPRQIAIWFQNRRARWKTKQLEKDYDTLKRQFHTLKAENDLLQTHNQKLQAEIMGLKNREQTESINLNKETEGSCSNRSDNSSDNLRLDISTAPPSNDSTLTGGHPPPPQTVGRHFFPPSPATATTTTTTMQFFQNSSSGQSMVKEENSISNMFCAMDDHSGFWPWLDQQQYN

SEQ ID NO: 662 - protein, 285 aa, Zea mays
  misc_feature (1)..(285): Ceres CLONE ID no. 1384592
  misc_feature (1)..(285): Functional Homolog of  Ceres CLONE ID no.  2913
  misc_feature (133)..(177): Pfam Name: HALZ Pfam Description: Homeobox associated leucine zipper
  misc_feature (78)..(132): Pfam Name: Homeobox Pfam Description: Homeobox domain
MSCNNGMSFFPSNFMIQTSYEDLPPSLSPLLPSCSIPQDLHGFASFLGKRSPVEGLEAGNIMNGEEDYSDDGSQMGEKKRRLNMEQVKTLEKNFELGNKLDPERKMQLARALGLQPRQIAIWFQNRRARWKTKQLEKDYDTLKRQFDSLKAENDHLQTHNQKLQAEIMSSRNREQTESINLNKETEGSCSNRSDNSSDNFRLDISTAVPSVDSTITGGHPPAPQTVGRHFFPPATATTTTTTMQFFQNSSSGQSMVKEENSISNMFCAMDDHSGFWPWLDQQQYN

SEQ ID NO: 663 - protein, 285 aa, Glycine max; identical to SEQ ID NO: 662
  misc_feature (1)..(285): Ceres CLONE ID no. 1121989
  misc_feature (1)..(285): Functional Homolog of  Ceres CLONE ID no.  2913
  misc_feature (133)..(177): Pfam Name: HALZ Pfam Description: Homeobox associated leucine zipper
  misc_feature (78)..(132): Pfam Name: Homeobox Pfam Description: Homeobox domain

SEQ ID NO: 664 - DNA, 891 bp, Populus balsamifera subsp. trichocarpa
  misc_feature (1)..(891): Ceres ANNOT ID no. 1463575
atgacgtgcaatgggatggctttcttcccaacaaatttcatgctccagatttctcatgatcaagatgatcatcaacctcccacatctctcaatccaattctaccctcaccccaagatttccatggggtggcatcatttatagggaagagatcatcaatgtcattttcagggattgatgcgtgtcatgaagaaggcaatggagaagatgagttgtctgatgatggctcacaagcaggagaaaagaagaggaggctcaatatggaacaagtcaagactcttgaaaaaaactttgagttgggtaacaagcttgaacctgagagaaaaatgcaactggctagagctcttggtctgcagccaagacagattgctatatggttccaaaacaggagggccagatggaaaaccaaacaactagagaaagattatgatctcctcaagagacagtttgatgctattaaagccgaaaacgatgcgctacaagcacagaaccagaaacttcatgcggagatattgacactgaaaagcagagaaccgactgaacctatcaacctcaacaaagaaacagagggttctagcagtaatagaagtgaaaacagctctgatatcaagttggatatctcgaggacgccagcaattgacagccctctatctaatcatcatccaacgagtagatcctttttcccctcatcatcatcatctataaggcctgcaggcgttgctataagacctacaggtgttgctcaactcttccaaacaaacccttcaaggcctgatattcaatgccagaagattgatcaattagtcaaagaagaaaatcttggcaatatgttctgtagcatcgaagatcaatctggattttggccctggcttgagcaacaacatttcaattaa

SEQ ID NO: 665 - protein, 296 aa, Populus balsamifera subsp. trichocarpa
  misc_feature (1)..(296): Ceres ANNOT ID no. 1463575
  misc_feature (1)..(296): Functional Homolog of  Ceres CLONE ID no.  2913
  misc_feature (136)..(180): Pfam Name: HALZ Pfam Description: Homeobox associated leucine zipper
  misc_feature (81)..(135): Pfam Name: Homeobox Pfam Description: Homeobox domain
MTCNGMAFFPTNFMLQISHDQDDHQPPTSLNPILPSPQDFHGVASFIGKRSSMSFSGIDACHEEGNGEDELSDDGSQAGEKKRRLNMEQVKTLEKNFELGNKLEPERKMQLARALGLQPRQIAIWFQNRRARWKTKQLEKDYDLLKRQFDAIKAENDALQAQNQKLHAEILTLKSREPTEPINLNKETEGSSSNRSENSSDIKLDISRTPAIDSPLSNHHPTSRSFFPSSSSSIRPAGVAIRPTGVAQLFQTNPSRPDIQCQKIDQLVKEENLGNMFCSIEDQSGFWPWLEQQHFN

SEQ ID NO: 666 - protein, 304 aa, Solanum demissum
  misc_feature (1)..(304): Public GI no. 48209882
  misc_feature (1)..(304): Functional Homolog of  Ceres CLONE ID no.  2913
  misc_feature (134)..(178): Pfam Name: HALZ Pfam Description: Homeobox associated leucine zipper
  misc_feature (79)..(133): Pfam Name: Homeobox Pfam Description: Homeobox domain
MAFFPTNFMLQTPHHEDEHQPSTSLNPILPSCSPQDFHGIASFLGKRSMSFSGMDGNNACEENHGEDDLSDDGSQAGEKKRRLNMEQVKTLEKNFELGNKLEPERKMQLARALGLQPRQIAIWFQNRRARWKTKQLEKDYEVLKRQFDAIKAENDALQTQNQKLHAEIMSLKNREQPTESINLNKETEGSCSNRSENSSEIKLDISRTPAIDSPLSNHHPNISSRPFFPPSMIRSNNNNNGVVVSHQLFHINSSSSRQDLKLMDQNTTTTNNNSSVKEESLSNMFCGIDDQTSFWPWLEQQHFN

SEQ ID NO: 667 - protein, 306 aa, Arabidopsis thaliana
  misc_feature (1)..(306): Public GI no. 48209945
  misc_feature (1)..(306): Functional Homolog of  Ceres CLONE ID no.  2913
  misc_feature (141)..(174): Pfam Name: HALZ Pfam Description: Homeobox associated leucine zipper
  misc_feature (86)..(140): Pfam Name: Homeobox Pfam Description: Homeobox domain
MTCTNYEMAFFPTNFMLQTPHHEDEHQPSTSLNPILPSCSPQDFHGIASFLGKRSMSFSGMDGNNACEENHGEDDLSDDGSQAGEKKRRLNMEQVKTLEKNFELGNKLEPERKMQLARALGLQPRQIAIWFQNRRARWKTKQLEKDYEVLKRQFDAIKAENDALQTQNQKLHAEQPTESINLNKETEGSCSNRSENSSEIKLDISRTPAIDSPLSNHHPNISSRPFFPPSMIRSNNNNNSNNGVVVPHQLFHINSSSPRQDLKLMDQNTTTTNNNSSVKEESLSNMFCGIDDQTSFWPWLEQQHFN

SEQ ID NO: 668 - protein, 313 aa, Helianthus annuus
  misc_feature (1)..(313): Public GI no. 349379
  misc_feature (1)..(313): Functional Homolog of  Ceres CLONE ID no.  2913
  misc_feature (147)..(191): Pfam Name: HALZ Pfam Description: Homeobox associated leucine zipper
  misc_feature (92)..(146): Pfam Name: Homeobox Pfam Description: Homeobox domain
MTCTGMAFFSSNFMLQSSQEDDHHAPTSLSPILPPCSTTTQDFSGAAFLGKRSMSSYSGLNNNNMDGCDQEGNMNGEDELSDDGSQLLAGEKKRRLNMEQVKTLQRNFELGNKLEPERKMQLARALGLQPRQIAIWFQNRRARWKTKQLEKDYDALKRQFEAVKAENDSLQSQNHKLHAEIMALKNREPAELINLNIKETEGSCSNRSENSSEIKLDISRTPATDSPLSSHHQHQHQPIPNLFPSSNIDRPNSNNIVAHQLFHNSSSRPADHQLHCHKLDQSNAIKEECFSTMFVGMDDQSGFWPWLEQPQFN

SEQ ID NO: 669 - protein, 331 aa, Triticum aestivum
  misc_feature (1)..(331): Ceres CLONE ID no. 677386
  misc_feature (1)..(331): Functional Homolog of  Ceres CLONE ID no.  2913
  misc_feature (118)..(172): Pfam Name: Homeobox Pfam Description: Homeobox domain
  misc_feature (173)..(217): Pfam Name: HALZ Pfam Description: Homeobox associated leucine zipper
MASNGMASSPSAFFPPNFLLHMQQAPPQHDPQEHHQQHHHHHHEHHLPPPHPQHNPFLPSPQCPSLQDFRGGLSPMLGKRPAMYGGGGDGGCGGDEVTGGGANEEETSDDGSQLGGEKKRRLNVEQVRTLEKNFEVANKLEPERKMQLARALGLQPRQVAIWFQNRRARWKTKQLEKDYDVLKRQFDAVKAENDALLSHNKKLQSEILGLKGCREAASELINLNKETEASCSNRSENSSEINLDISRTPPSDGPMDAPPSHQQGGGGGGMIPFYPSVARPAGVDIDHLLHASVPKMEHHHGGPDTPSFGNLLCGVDEPPPFWPWADHQQFN

SEQ ID NO: 670 - DNA, 1337 bp, Arabidopsis thaliana
  misc_feature (1)..(1337): Ceres CLONE ID no.  2942
  misc_feature (1)..(1337): GEMINI ID 533H10
ggaagcagaagaagaagctcagtcggcggccggattaatctccccatcatctctctctctccctctctctgttcctatcccggcgaattcatatctgaatttcccaaaattcaaacttttccggtggaattattttaggaaaccaagtgacttcttaagctccaaaaattgggtatttaatggcggcgagcgcgaacccgtcggggaacaatcaggaaggttcgtcggcgacgcagaaggtatcgtcttcttcagcggcggcggcgaatggcgctgctgtgaattccgtcgataatggtggaaatacaggcgcggcggcggataattcacagacgattggcgcgttgaggcataatccagggatctctaccgattggactcttgaggaacaatctctattggaagatttgcttgtcaagtacgcgacagaaccgtcggtttttcgatatgcgaagattgctatgaaaatgaaagataagactgttcgagatgttgccctgcgctgtagatggatgactaaaaaggaaaacggaaagcgtaggaaagaagatcattcctcgaggaaaagcaaagataagaaagaaaaagctacagattcttcagccaagtcctcatctcatttgaatgttcatcctaatggtccttcttatgctccgcctatgatgcctatcgataccgatgatggtatttcatataaagctattggtggtgtgagtggagatcttctcgagcaaaatgctcaaatgttcaatcaactttcaacaaatttctcagctttccaggtgaattcaacttccacttttcatcttctacatgagaatgtcaatatcttgtgcaaagctcgagacaatatccttgcaatcttgaacgacttgaatgacatgccagaagttatgaagcagatgccacctcttccggtgaagttgaatgaggagctggcaaattcgatcctccctcgcccatcccatcaaaggaagtcatgatcgaggcgatagatggttggttctgaccaaggagtctctttaatccgggatcaatgaagaaaggaataaatcgcgggatagagagagagctccactcgtactggttgatagaatgaggggtttcccctgactcatagagttatagtctctttttacaatttccgtcagtctctgaatgttttagcaaatggttaattgatacatgagtagggtcgcgtatcgttgtttaggatgtgaatagatttcaattggtatggtataagtctctctgtataaaattggtatcaagctgaaaggtttgagattagaaagggcctatatcctaatgatgcacacccgtgatgcatttctctc

SEQ ID NO: 671 - protein, 267 aa, Arabidopsis thaliana
  misc_feature (1)..(267): Ceres CLONE ID no.  2942
  misc_feature (1)..(267): GEMINI ID 533H10
MAASANPSGNNQEGSSATQKVSSSSAAAANGAAVNSVDNGGNTGAAADNSQTIGALRHNPGISTDWTLEEQSLLEDLLVKYATEPSVFRYAKIAMKMKDKTVRDVALRCRWMTKKENGKRRKEDHSSRKSKDKKEKATDSSAKSSSHLNVHPNGPSYAPPMMPIDTDDGISYKAIGGVSGDLLEQNAQMFNQLSTNFSAFQVNSTSTFHLLHENVNILCKARDNILAILNDLNDMPEVMKQMPPLPVKLNEELANSILPRPSHQRKS

SEQ ID NO: 672 - protein, 232 aa, Glycine max
  misc_feature (1)..(232): Ceres CLONE ID no. 1619846
  misc_feature (1)..(232): Functional Homolog of  Ceres CLONE ID no.  2942
MMANPSGNHQEHTHVVSSSAPETSGAALAMKHNPGISLDWTAEEQAILEDGLSKYASESNIVRYAKIALQLQQKTVRDVALRVRWMNKKENSKRRKDDHNLTRKSKDKKERVSDPAVKSSNFVARSNVSPYAPPMIAMDNDDGISYTAIGGPTGDLLEQNAQALNQISTNLSAFQVQENINLFCQTRDNILKIMNELNDSPEVMKQMPPLPVKVNEELANSILPRTNLPPQS

SEQ ID NO: 673 - protein, 246 aa, Oryza sativa
  misc_feature (1)..(246): Public GI no. 50925955
  misc_feature (1)..(246): Functional Homolog of  Ceres CLONE ID no.  2942
  misc_feature (52)..(102): Pfam Name: Myb_DNA-binding Pfam Description: Myb-like DNA-binding domain
MGANGHPPPASAAAQNGSHSSGGGGGGDGGGGGANPSPGGTVAALRHDPGLAREWSPEEQSTLDELLVKYASDAPVIRYAKIAMKLPDKTVRDVALRCRWMNKKESGKRKKEDHSSSKKSKDKKEKVSDSSLKPPVHIAGRPNVPPYPLPALPIDDDEISSKAIGGPTGEILETNAQVLSQISTNLSTMQIQDNISLLCQTRDNILRVLKEINDAPDIMKQMPPLPVKINEELVNSMLPRPTVPMQ

SEQ ID NO: 674 - DNA, 798 bp, Populus balsamifera subsp. trichocarpa
  misc_feature (1)..(798): Ceres ANNOT ID no. 1455934
atggcaaacccatctgggacaaataatcaagatggcaatcaagctccttcttcattcaatggaaacaatccaagtaatggtaattcggacccttcttctggttcttctttgaagcacaatcctggtatatcaactgactggacttttgaagaacagacaattcttgaagagggattggtagactacgagatccttttagctgagtgtttgaaatttttggcgtactgttattcccagaagttgattttccttatgtcccacagttttgcagaggaaacaaacgtagtacgttatgcaaagatagctattaatctaccaaacaagacagtccgagatgttgctttgcgttgcagatggatgaataaaaaggaacagagcaagcgaaggaaggaagataatctagcacgtagaagtagagataaaaaggaaagacatggtgatccttctgcaaagacttctaacttcatggctgcccgccccagtgtttctccatttgcaactccaatgctgccactggaaagtgaagaaggcatctcatatgatgcaattggtggagttacaggagaccttcttaagcaaaatgcacagattctaaatcaaatttctgcaaaccttgcaagttttcagatacaggagaacctcaatcttctccgccgaacgcgtgacaacatccgcaaaattatgaaccagatgaatgatgtgccagaactaatgaagcagatgccaccacttccagtcaagttgaacgatgatctagctgacaccatccttctgcctccaaaccttcctaggccataa

SEQ ID NO: 675 - protein, 265 aa, Populus balsamifera subsp. trichocarpa
  misc_feature (1)..(265): Ceres ANNOT ID no. 1455934
  misc_feature (1)..(265): Functional Homolog of  Ceres CLONE ID no.  2942
MANPSGTNNQDGNQAPSSFNGNNPSNGNSDPSSGSSLKHNPGISTDWTFEEQTILEEGLVDYEILLAECLKFLAYCYSQKLIFLMSHSFAEETNVVRYAKIAINLPNKTVRDVALRCRWMNKKEQSKRRKEDNLARRSRDKKERHGDPSAKTSNFMAARPSVSPFATPMLPLESEEGISYDAIGGVTGDLLKQNAQILNQISANLASFQIQENLNLLRRTRDNIRKIMNQMNDVPELMKQMPPLPVKLNDDLADTILLPPNLPRP

SEQ ID NO: 676 - protein, 241 aa, Zea mays
  misc_feature (1)..(241): Ceres CLONE ID no. 337432
  misc_feature (1)..(241): Functional Homolog of  Ceres CLONE ID no.  2942
  misc_feature (1)..(241): GEMINI ID 538E7
MGANGHPPASTVAQNGSHSGGGGGGGGGVNPSNGGTGAALRHDPGLAREWSTEEQTILDELLVKYASDLPVVRYAKVAMKLPEKTVRDVALRCRWMNKKESAKRKKEDHNSSKKSKDKKEKVSDSSSKPPVHMVGRPNVPPYPLPVLPMDDDEISSKAIGGPTGEILETNAHVLGQISSNLSNMQIQDNISLLCQTRDNILRVLKEINDAPDIMKQMPPLPVKINEELVNSLLPRPTVPMQ

SEQ ID NO: 677 - DNA, 1787 bp, Arabidopsis thaliana
  misc_feature (1)..(1787): Ceres CLONE ID no.  299144
  misc_feature (1)..(1787): GEMINI ID 536C10
aaaggattcccaaccccaaccccaaccccccaagaagcaccgcgcagaaccctctgctcctctcaccctcacgctccaaggcggcggcgccatgcacggcggaggcgcggcctcgcccgatgccgccatatgcatctccccagaagctgggcccatcgtcggggtcgcccccgccgggatcagggtcgaaaactgctacgtgttcaagagccggctgcaggagtatgctcagagggttggcattccaaccccggagtaccacacgctgaaagaaggcccgtctcatgaacctgtcttcaagtccacagtgttcgttaataataccaagtatgaatcgctgcctgggttcttcagccggaaggctgcagaacagtctgccgcggaagttgcgctcatggagatagccatgtccgctccggtgaccgaaattaggaacatgccagcagttcaagaaactggactgtgcaagaatctccttcaggagtatgctcagaagatgaattatgccattccatcttatatttgcactaaacaagcttcgggtgtagctcctttcgtatgcagtgttgagattggtggcatcctatacattggtgctgcagctaggacaaagaaggaggcagagataaaagctgcccgaactgctcttcttgcaatccaaagtcaatcagaaggtggtgcaaatggtgccaaaaagtacattgttgttcctgggcaaaggccagataaggaggcgaataaaaatccaactgaaacccccataccacttagagtcaagaagcgtggttccaggaagaaatggaacaagaggaaattcaggaggatggctgaccgaattgttgatgctggaaaggatgcagaggggcttggaacgcttgtacatgatgactatgaggaagctagaagaataggatatgagttacctacagatactgctatggttcaatttaacaaggaagttgtaatgacacaacctggtgaaggagataggatagtacaattggagccacccagagatcctgcagagtttcaatataacaaggaagctagaagtgttgaacaggacccacccagagatcctgcagaggtccaacataacaaggaagctagaagtgttgaacaggacccacccagagatcctgcagaggtccaacataacaaggaagctagaactgtcgaacaggacccacccagcaacactgaagtgtggaagcctgacaataaggctacaactacagagcaggagtcggtgagcgcttacatagcattgagatctaatggggattctacagatgtggaggcggcaccaggcgataccttgatgatgcagggcgaggagtcggaagccacaatgcaagaagcatctcacgctggtgaacaggcccagcctaactaggaacctgaaagcaaaaaaaacttcctgaacaggaagaccgaaatgtaggtcgaatgcatgcattgctgtaggagaataagtccgctggaggtacatgagcctaaaataatttgtggagtggtggttgactccagttgtaagtgccttccagagtgtaccggcatgcccaaaactgaaatttccggtttagatagaattgggggcgcggaagagggtgccatgtgtgtgtgtgtgtgttgcctgtggatggaggaattgatgggagtatgtgaactgatgtagctagtctatgtttgttaccattgatgatatgattgtgtttggtcatgttttcactgtcatatttgttgacgaccagcacttgcatgagcattggattcgaggtagcctg

SEQ ID NO: 678 - protein, 434 aa, Arabidopsis thaliana
  misc_feature (1)..(434): Ceres CLONE ID no.  299144
  misc_feature (1)..(434): GEMINI ID 536C10
  misc_feature (38)..(104): Pfam Name: dsrm Pfam Description: Double-stranded RNA binding motif
MHGGGAASPDAAICISPEAGPIVGVAPAGIRVENCYVFKSRLQEYAQRVGIPTPEYHTLKEGPSHEPVFKSTVFVNNTKYESLPGFFSRKAAEQSAAEVALMEIAMSAPVTEIRNMPAVQETGLCKNLLQEYAQKMNYAIPSYICTKQASGVAPFVCSVEIGGILYIGAAARTKKEAEIKAARTALLAIQSQSEGGANGAKKYIVVPGQRPDKEANKNPTETPIPLRVKKRGSRKKWNKRKFRRMADRIVDAGKDAEGLGTLVHDDYEEARRIGYELPTDTAMVQFNKEVVMTQPGEGDRIVQLEPPRDPAEFQYNKEARSVEQDPPRDPAEVQHNKEARSVEQDPPRDPAEVQHNKEARTVEQDPPSNTEVWKPDNKATTTEQESVSAYIALRSNGDSTDVEAAPGDTLMMQGEESEATMQEASHAGEQAQPN

SEQ ID NO: 679 - DNA, 1152 bp, Arabidopsis thaliana
  misc_feature (1)..(1152): Ceres CLONE ID no.  31044
  misc_feature (1)..(1152): GEMINI ID 554G6
aaccatctctctaaagcttcttctctcataacaatggcaagacaaatcaacatagagagtagtgtttctcaagttacctttatctcctccgccatccccgccgtatcttcctcctcctccatcaccgcttccgcctcattgtcctcttcacctactacatcttcctcttcttcgtcatcaacaaattctaacttcattgaggaagacaactctaaaagaaaagcatctcgaagatcattgtcatcgttagtctccgttgaagacgatgatgatcaaaacggtggaggtgggaaacggcgaaagaccaacggtggagataaacatccgacgtatagaggagtgaggatgaggagtttggggaaaatgggtgtcggagattagagagccgagaaagaaatcaagaatctggctcgggacttatccaacggctgagatggcagctcgagctcatgacgtagcggctttagccattaaaggtacaacggcttacctcaattttcccaagttagccggcgagcttcctcgtccagtcacaaattctcctaaagacattcaagccgccgcctctttagcggccgttaactggcaagattcggtcaacgatgtgagtaattctgaagtggctgaaatagttgaagccgagccgagtcgaaccgtggtggctcagttgttttcttcggacacaagcacgacgacgacgactcagagtcaagagtattcggaagcttcgtgtgcttcgacttcggcgtgtacggacaaagacagtgaggaagagaagctgtttgatttgccggatttgtttaccgatgagaatgagatgatgatacgaaacgatgcgttttgctactactcgtccacgtggcagctttgtggagccgatgctgggtttcggcttgaagagccgttttttctatctgaatgactaaagtacccctctcgagagagctctcactaacactttattagtttgccatttacttcttcttcattttctctatttacgtttgatatttttttttctttccaacttgagtgatattgattttttgtaaagaaacaatttcttttttttttcctagcaaaatcgtgtttgtgtaatataaatgtggtgataacatgttgaaatattgcagaataatataatgtagcctt

SEQ ID NO: 680 - protein, 162 aa, Arabidopsis thaliana
  misc_feature (1)..(162): Ceres CLONE ID no.  31044
  misc_feature (1)..(162): GEMINI ID 554G6
MAARAHDVAALAIKGTTAYLNFPKLAGELPRPVTNSPKDIQAAASLAAVNWQDSVNDVSNSEVAEIVEAEPSRTVVAQLFSSDTSTTTTTQSQEYSEASCASTSACTDKDSEEEKLFDLPDLFTDENEMMIRNDAFCYYSSTWQLCGADAGFRLEEPFFLSE

SEQ ID NO: 681 - DNA, 786 bp, Populus balsamifera subsp. trichocarpa
  misc_feature (1)..(786): Ceres ANNOT ID no. 1496976
atggaaaaacatatcaaccttgagattgatgctcaagacaatccccttgcctcatcttccaccaccacctccaccaccaaggggaacatctcttcctcctccacgcccatttcatgcataaagcaccaaggctcaaagaaagaagagaattgtattgctccaagagtatcaagaaaagctcaagaattacagagtagtggcaacgagggtggtaaaaggcgaaagaccaccgagaatgagaaaaatgggaagcatccgacatatagaggagtgaggatgagaagttggggcaaatgggtgtccgaaatcagagagccaaggaagaagtcgagaatatggcttggaacataccctacagctgaaatggcagctcgagcacatgatgtagccgcgttagccatcaaagggggctcagcttatctcaattttcctgaattcgctcatgaactccctcccccactcagcaagtcccctaaggacattcaagctgcagccgccaaggcagcggctgcttcgttcactgaaacaagatactgtgaaggtgaaggtgggggcgaagccgagcttaacgtttcgaatttatcagatagtttggccatggacaacacacaagaatcaagcagttctccttctactgattctgatgacacgttatttgaccttcctgacctcttcatcgatggcgttcatcacagtgatggattttgctattattcttcatcatggcaattatgtgcagccgatactggcttccggcttggagagccatttttattggagtactag

SEQ ID NO: 682 - protein, 140 aa, Populus balsamifera subsp. trichocarpa
  misc_feature (1)..(140): Ceres ANNOT ID no. 1496976
  misc_feature (1)..(140): Functional Homolog of  Ceres CLONE ID no.  31044
MAARAHDVAALAIKGGSAYLNFPEFAHELPPPLSKSPKDIQAAAAKAAAASFTETRYCEGEGGGEAELNVSNLSDSLAMDNTQESSSSPSTDSDDTLFDLPDLFIDGVHHSDGFCYYSSSWQLCAADTGFRLGEPFLLEY

SEQ ID NO: 683 - DNA, 819 bp, Populus balsamifera subsp. trichocarpa
  misc_feature (1)..(819): Ceres ANNOT ID no. 1444027
atgccacttgctctagctagagacctcccaatcatggaaaaacatatcaaccttgagattgatgctcaagacaatccccttgcctcatcttccaccaccacctccaccaccaaggggaacatctcttcctcctccacgcccatttcatgcataaagcaccaaggctcaaagaaagaagagaattgtattgctccaagagtatcaagaaaagctcaagaattacagagtagtggcaacgagggtggtaaaaggcgaaagaccaccgagaatgagaaaaatgggaagcatccgacatatagaggagtgaggatgagaagttggggcaaatgggtgtccgaaatcagagagccaaggaagaagtcgagaatatggcttggaacataccctacagctgaaatggcagctcgagcacatgatgtagccgcgttagccatcaaagggggctcagcttatctcaattttcctgaattcgctcatgaactccctcccccactcagcaagtcccctaaggacattcaagctgcagccgccaaggcagcggctgcttcgttcactgaaacaagatactgtgaaggtgaaggtgggggcgaagccgagcttaacgtttcgaatttatcagatagtttggccatggacaacacacaagaatcaagcagttctccttctactgattctgatgacacgttatttgaccttcctgacctcttcatcgatggcgttcatcacagtgatggattttgctattattcttcatcatggcaattatgtgcagccgatactggcttccggcttggagagccatttttattggagtactag

SEQ ID NO: 684 - protein, 169 aa, Populus balsamifera subsp. trichocarpa
  misc_feature (1)..(169): Ceres ANNOT ID no. 1444027
  misc_feature (1)..(169): Functional Homolog of  Ceres CLONE ID no.  31044
  misc_feature (2)..(45): Pfam Name: AP2 Pfam Description: AP2 domain
MRSWGKWVSEIREPRKKSRIWLGTYPTAEMAARAHDVAALAIKGGSAYLNFPEFAHELPPPLSKSPKDIQAAAAKAAAASFTETRYCEGEGGGEAELNVSNLSDSLAMDNTQESSSSPSTDSDDTLFDLPDLFIDGVHHSDGFCYYSSSWQLCAADTGFRLGEPFLLEY

SEQ ID NO: 685 - DNA, 1172 bp, Arabidopsis thaliana
  misc_feature (1)..(1172): Ceres CLONE ID no.  312833
  misc_feature (1)..(1172): GEMINI ID 538H5
aaatccacaaaggcacaaagatggaaaaggtgtattggactctttttaaagctaaaaaaacagttcaaaagattgctgcttttcgcttcagtgctgctccgattctgtttcagaagattaacaatttgaaattgtgacgatcctaattgccatcttctcgataataatgaggaaaaaaagattgacgcgcttttcgtgtcctcagaaactgcgggtttgctgaaattctcctccactttcccaagcaaagaacaaagaaccgcccttgttctctgcgactctgcccggccggtctccgaggcgggcggagggaaccagagagcaaggcgaggagcgcggaagggctgagggaaggggcggcggggcatggctcgccggccggcgtcgtgggagcagggcggcgacgagtacgactatctcttcaaggtcgtgctcatcggcgactctggcgtggggaagtccaacctgctctcccgcttcaccaagaacaccttcgccctcgactccaagtccaccatcggcgttgagttcgccacgcgcacactccaggtggagaacaagattataaaagctcaaatctgggacactgctgggcaggagaggtaccgagcaattacaagtgcttactatcgaggagctgtcggggcgttgctagtctacgatgtcactaaagtaatgacatttgagaatgtgaagaggtggttgaaggagctccgggaccatgctgactcgaacatagtcgtaatgctcattggcaacaagactgaccttaggcacctgcgctctgtcgccgttgaggatgctgcaagctttgcagagagcgaaggtttgttcttcatcgagacctctgcgctcgatgcgacaaacgtcgagaaggccttccacaccgttctagccgagatctaccggataatcagcaagaagcccctgtcttcggaggagtctggtttggggtccggtaacctcagagagggacagtccatccaagtgtcagccacaaattctggcgcccttacgtcgcggtgctgctcttcttagagccacgcccaccagaatcatctgaagaacaacagttcgtcaagaaggtcctctcttccgaagtcgaaatatttactcccctttgtgtgaacaataagcgtagatttaaagaatgtcagactcagacgctgact

SEQ ID NO: 686 - protein, 223 aa, Arabidopsis thaliana
  misc_feature (1)..(223): Ceres CLONE ID no.  312833
  misc_feature (1)..(223): GEMINI ID 538H5
  misc_feature (20)..(181): Pfam Name: Ras Pfam Description: Ras family
MARRPASWEQGGDEYDYLFKVVLIGDSGVGKSNLLSRFTKNTFALDSKSTIGVEFATRTLQVENKIIKAQIWDTAGQERYRAITSAYYRGAVGALLVYDVTKVMTFENVKRWLKELRDHADSNIVVMLIGNKTDLRHLRSVAVEDAASFAESEGLFFIETSALDATNVEKAFHTVLAEIYRIISKKPLSSEESGLGSGNLREGQSIQVSATNSGALTSRCCSS

SEQ ID NO: 687 - protein, 223 aa, Oryza sativa
  misc_feature (1)..(223): Public GI no. 50920025
  misc_feature (1)..(223): Functional Homolog of  Ceres CLONE ID no.  312833
  misc_feature (20)..(181): Pfam Name: Ras Pfam Description: Ras family
MARRPAPWEQGGDEYDYLFKIVLIGDSGVGKSNLLSRFTRNSFSLDSKSTIGVEFATRTIQVEGKIVKAQIWDTAGQERYRAITSAYYRGAVGALLVYDVTKATTFENVKRWLKELRDHADSNIVVMLIGNKIDLKHLRSVSLEDATSFAEREGLSFVETSALDATNVDKAFQTVLTEIYRIISKKALAADEAGAGAGAVREGQSIQVSATDSSSFTSRCCSF

SEQ ID NO: 688 - DNA, 635 bp, Arabidopsis thaliana
  misc_feature (1)..(635): Ceres CLONE ID no.  31322
  misc_feature (1)..(635): GEMINI ID 531C9
aatcgtcgtctctccccaattcaaaaaaagaaataacctaaacgtgttcacacagagatctcgagatgaaagataaccaaacggaagttgaatcgaggagcactgatgatagattgaaagttagagggaacaaagttggaaagaaaacaaaggatccaaacaggcctaagaaaccaccaagtcctttcttcgtcttcctggacgatttccgaaaggagtttaatctggctaaccctgacaacaaatccgtcggtaatgttggtagagcagctggaaagaaatggaaaaccatgactgaagaagaaagagcaccttttgtagcaaaatcacagagcaaaaagactgagtatgctgtgactatgcaacagtataacatggaactggctaatggaaacaagacaactggagatgatgagaaacaagagaaagctgctgatgattaggaagttggatcagtgatttgtgtatcaactatatctgttgttttatgtcaacttttagctagcttttagggagaacaattgttacattcctgttttatcctttctgtcaactgtgggattattcagatgtaactttggatttagctttgagcttcaattccaccttttatgagatcatatcatatgtttgct

SEQ ID NO: 689 - protein, 125 aa, Arabidopsis thaliana
  misc_feature (1)..(125): Ceres CLONE ID no.  31322
  misc_feature (1)..(125): GEMINI ID 531C9
  misc_feature (34)..(103): Pfam Name: HMG_box Pfam Description: HMG (high mobility group) box
MKDNQTEVESRSTDDRLKVRGNKVGKKTKDPNRPKKPPSPFFVFLDDFRKEFNLANPDNKSVGNVGRAAGKKWKTMTEEERAPFVAKSQSKKTEYAVTMQQYNMELANGNKTTGDDEKQEKAADD

SEQ ID NO: 690 - protein, 141 aa, Brassica napus
  misc_feature (1)..(141): Ceres CLONE ID no. 980901
  misc_feature (1)..(141): Functional Homolog of  Ceres CLONE ID no.  31322
  misc_feature (35)..(104): Pfam Name: HMG_box Pfam Description: HMG (high mobility group) box
MKGGETKAQSKSTDERLKTRGKKAGKKAAKDPNKPKRPPSAFFVFLEGFRKEFNLANPDNKSVGAVGKAAGAKWKSMTDEDKAPYVAKAESKKTEYTKTMQKYNMKLANGTSTAGDDDSDKSKSEVNDEAEGGSEEEEDDD

SEQ ID NO: 691 - protein, 140 aa, Triticum aestivum
  misc_feature (1)..(140): Ceres CLONE ID no. 1030653
  misc_feature (1)..(140): Functional Homolog of  Ceres CLONE ID no.  31322
  misc_feature (34)..(103): Pfam Name: HMG_box Pfam Description: HMG (high mobility group) box
MKGGESKAQAKSTDERLKTRGKKAGKKVKDPNKPKRPPSAFFVFLEGFRKEFNLANPDNKSVGAVGKAAGAKWKSMTAEDKAPYVAKAETKKTEYAKTMQKYNMKLANGTSTAGDDDSDKSKSEVNDEEDAASDEEEDDD

SEQ ID NO: 692 - protein, 140 aa, Brassica napus; identical to SEQ ID NO: 691
  misc_feature (1)..(140): Ceres CLONE ID no. 956177
  misc_feature (1)..(140): Functional Homolog of  Ceres CLONE ID no.  31322
  misc_feature (34)..(103): Pfam Name: HMG_box Pfam Description: HMG (high mobility group) box

SEQ ID NO: 693 - protein, 121 aa, Papaver somniferum
  misc_feature (1)..(121): Ceres CLONE ID no. 1620744
  misc_feature (1)..(121): Functional Homolog of  Ceres CLONE ID no.  31322
  misc_feature (55)..(118): Pfam Name: HMG_box Pfam Description: HMG (high mobility group) box
  misc_feature (114)..(114): Xaa is any aa, unknown, or other
MKGAKGKGTVKDKKEVLKPVDDKRVGKRKAATKTESSSKKQTKKGKLASKDPNKPKKPASAFFVFMEEFRKTYKLENPDVKGVAAVGEAGGEKWKSLFYAEKAPYEAKAAKRNXKYERSWL

SEQ ID NO: 694 - DNA, 1792 bp, Arabidopsis thaliana
  misc_feature (1)..(1792): Ceres CLONE ID no.  325679
  misc_feature (1)..(1792): GEMINI ID 538H10
atctagttagttctcgatagcctctctctccctgcctccccgctgttgtggttgcggtgcttctgctgatctgctccgtcttctcctcccggcaatggcctgcttggaggcgcccccgcgcgtcgagctctgcccggtctcgtgccagccccgcggcctgcagcttccgccatggcggctcagcctgtcgaggtcctcctcttcatgcagatcttgcacccttgtgtctcgccagcttccaatttgcaatgcacagtcatatgctgatgatttatgggtggctgcgcctcatagccctgcatctgttcgctcaaggttgcttgcagcggaaagagaggaagcaaaggctgtcctgtccctgtttctgaggcagaaaggtctgcgaagcacgctggccgcacggatcgtcaacaaatcggatggcttcatcgagcacctggtctcgaagctccagattgcttacagatctcgatatgctgaaggaagggagctgagcacgcctgaaatcagagacgctctccttccctatctcgaagctctctccaaagaacatggcgacagtttggtcgaggtggtggagaatttccccgacccttttgctatggaaagggaagccttatcttcatcaatggcgtttacacccacgagctcaaacaagcagaaggcgattgctcgaataagcacgcagcctcaggcgccgccctccctgagctggtcccctacctactagaccttggcatggaccacgaggagataaaggacatcgtgcgcaagttcccagcgttcgcgtactacagcgtggatcgcaagatcaagcccctggtggagctcctgcttgagcttggggtgaaaaattccagcataccaggaatcatcaagaagcggccccagctgtgcgggatcagcatgtcagacaatctcaagccgatgatggcttatctggagagcatcggcgtcgacaaggctcagtggagcaaggtgatcacccgcttcccggcgctcctcacgtacagccggaacaaggtgcagacgaccgtgagcttcctcgccgagctaggtgtctccgagaagagcatcggcaagatcctgacgcggtgcccccacatcatgagctacagcgtggacgacaacctcaggccgaccgccgcctacttccggtcgatcggcgcggacgccgcgtcccttatccagaagagcccgcaggccttcggtctgaacgtcgaggccaagctgaggccgaccacggagttcttcctggcgagggggttcagcgtcgaggaggtcggcgtcatggcgaacaggttcgggatcgttcacacgctgagcctggaggagaacctgctccccaagtacgagttcttcctggcgatggagtacccgaggtgcgagctcgtcaagttcccgcagtactttgggtacagcttggaccggcggataaagccacggtacgcgaggatgactgggtgtggggtgaggttgattttgaaccagatgctttcggtctccgatgccaggtttgagaagattctagagaagaagacggctaggctttgataagacagcagtttcagattaggcacagtgttggagttcatttgagaagaactgtcaatgataaaaccatcagttttcagagcacgtagcttattatcgtggccttcatggacgtgcaacgtccagaggcgaactgtttgatgtgctaatctgtagttagcttctgcgaggtattgaaatgcatgcaactttggcaatcagaaatgccagttgcagtgggcgagattgcttggtgctc

SEQ ID NO: 695 - protein, 271 aa, Arabidopsis thaliana
  misc_feature (1)..(271): Ceres CLONE ID no.  325679
  misc_feature (1)..(271): GEMINI ID 538H10
  misc_feature (105)..(262): Pfam Name: mTERF Pfam Description: mTERF
MDHEEIKDIVRKFPAFAYYSVDRKIKPLVELLLELGVKNSSIPGIIKKRPQLCGISMSDNLKPMMAYLESIGVDKAQWSKVITRFPALLTYSRNKVQTTVSFLAELGVSEKSIGKILTRCPHIMSYSVDDNLRPTAAYFRSIGADAASLIQKSPQAFGLNVEAKLRPTTEFFLARGFSVEEVGVMANRFGIVHTLSLEENLLPKYEFFLAMEYPRCELVKFPQYFGYSLDRRIKPRYARMTGCGVRLILNQMLSVSDARFEKILEKKTARL

SEQ ID NO: 696 - protein, 271 aa, Oryza sativa
  misc_feature (1)..(271): Public GI no. 50910213
  misc_feature (1)..(271): Functional Homolog of  Ceres CLONE ID no.  325679
  misc_feature (105)..(262): Pfam Name: mTERF Pfam Description: mTERF
MDHEEIKNVVRKFPAFAYYNVDRKIKPLVALLLELGVPRSNIPGIIKKRPQLCGISLSDNLKPMMTYLENVGINKDKWSKVLSRFPALLTYSRQKVETTVSFLTELGVPKENIGKILTRCPHIMSYSVNDNLRPTAEYFQSIGADAASLIQKSPQAFGLNIEAKLKPITEFFLERDFTMEEIGTMANRFGIIHTLSMEDNLLPKYEYFLTMGYPRNELVKFPQYFGYSLEQRIKPRYARMIDCGVRLILNQLLSVSDSRFEDILRKRMDGI

SEQ ID NO: 697 - DNA, 1101 bp, Arabidopsis thaliana
  misc_feature (1)..(1101): Ceres CLONE ID no.  32754
  misc_feature (1)..(1101): GEMINI ID 554G1
gactcttgtaatagtataaaattttattgaataattcatctgtagacaagggggaaaagaaagactgattttacgctttattgctctcactaaaaccctaattctctccgtctcgatcgcgacctctgtttcttcggcaatggcggattctcctcaaagaagaagggattcacgatctccttcaccccgaaaagaacgagctagatccagatccaggtctaggtccaggtctagatccaggcccaggcttaggtccaggtcaagatctttgccaaggcctgtttctccatcacgaagccgtggaaggtcaaggtcaagaagccgtggaagaagtgaagttgaaaaccctggtaccactctctatgtgactggcctatctacaagagtcactgacaaggatcttgaagcacatttcgccaaggaaggaaaggttgcgtcttgttttcttgtgatggagccgcgcacccgtgtgtctcgtggttttgcctttgttacaatgagcagccttaaagatgctgagcggtgcattaaatatctcaaccagtctgtactagaaggccgatacataactgtggaaaggtccaggagaaagcgcccgagaactcccaccccaggccactatcttggcttgaaaagctccagagacagcgatcgagaaggccgtagcagtcgagggaggcactatgatcgtgatgattacagagaccgtaggtcaccaagacgcgactattcacctcgtgatgaaagaaggtctagaagagatcggtcttactctcctcatggaagaagcccagagagaagatcagagagaaggtctgagaggtcagagagaaggtatgaaccccgtggctcgagatgacctgttttcatccttttgacaaaggattcaaaaacttctctgttgatttaggttgtgtaattgatcatccttaaaatagcacaaagattctgtcaggcaacgctttgggtttcatttattttctgttgttaacgtgttattctgtcggaactctctgaagtgaaaactaaaaactgtaatagcttctctgttatgtctctactctacttgtttttgaatgaatcagaatatcttatgtgatt

SEQ ID NO: 698 - protein, 239 aa, Arabidopsis thaliana
  misc_feature (1)..(239): Ceres CLONE ID no.  32754
  misc_feature (1)..(239): GEMINI ID 554G1
  misc_feature (74)..(145): Pfam Name: RRM_1 Pfam Description: RNA recognition motif. (a.k.a. RRM, RBD, or RNP domain)
MADSPQRRRDSRSPSPRKERARSRSRSRSRSRSRPRLRSRSRSLPRPVSPSRSRGRSRSRSRGRSEVENPGTTLYVTGLSTRVTDKDLEAHFAKEGKVASCFLVMEPRTRVSRGFAFVTMSSLKDAERCIKYLNQSVLEGRYITVERSRRKRPRTPTPGHYLGLKSSRDSDREGRSSRGRHYDRDDYRDRRSPRRDYSPRDERRSRRDRSYSPHGRSPERRSERRSERSERRYEPRGSR

SEQ ID NO: 699 - DNA, 1053 bp, Gossypium hirsutum
  misc_feature (1)..(1053): Ceres CLONE ID no.1855403
acatttaattgacctttgctattattccctgtgcgtataaaccctaaaatttcaaatttcccttctcgcgttctagggttctctttctcttcaccaagatggcggattctcctcgtaaaaggaattctcagtctccctccccatggagagaacagtcaaggtcacgatccagatctagacctaggtctaggtctaggtcaagatcccgctcctggtcgaggccaaggcataggtccaggtcacatagtcgcggcaggtcaaggtcaagaagtcgaggcagggttgacgctggaaatcctggcaacacactttatgtgaccggtctatctcaaagggtcactgagagggaccttgaagagcatttctccaaggaggggaaggtggcatcgtgtttcctggttgttgaacctcgtactcgcatatctcgtggttttgcttttgttactatggacagtgttgaggatgcgagccgctgcatcaagtatctcaaccaatcaattttagaaggtcgatttataaccgtggagaggtcgcgtaggaaacggcctaggactccaacaccaggccattaccttggactaaaaaataccagagactatggtcgtggtgagcgtggcaggtaccgtggtggtggtcgtgatgactacgggtatcgtcgatctcccaggcgctcaccatatcgaggtcgtgattactctccaaggtattctcctcatggtggaagatcaaggagggagcgctcttattcaccaccatattctcgcggatctaggtgaagaagtgttttgggtcgaaggggaaagatgagagatttgctttagtctcgtcagtgttgaatgttgatgtattctctagtttggacggagcttcaaagttaatgtttgcagtgttcttatatctctttaagcatgtaggggtaccttgtatggtaacactattattaaacttcggttagatattattaggctttaagctatcacctgattgcgaaccattttttgtttttgtatggaaattatgaatctgatttctcaaaaaaaaaaaaaaaaaaaa

SEQ ID NO: 700 - protein, 225 aa, Gossypium hirsutum
  misc_feature (1)..(225): Ceres CLONE ID no. 1855403
  misc_feature (1)..(225): Functional Homolog of  Ceres CLONE ID no.  32754
  misc_feature (71)..(142): Pfam Name: RRM_1 Pfam Description: RNA recognition motif. (a.k.a. RRM, RBD, or RNP domain)
MADSPRKRNSQSPSPWREQSRSRSRSRPRSRSRSRSRSWSRPRHRSRSHSRGRSRSRSRGRVDAGNPGNTLYVTGLSQRVTERDLEEHFSKEGKVASCFLVVEPRTRISRGFAFVTMDSVEDASRCIKYLNQSILEGRFITVERSRRKRPRTPTPGHYLGLKNTRDYGRGERGRYRGGGRDDYGYRRSPRRSPYRGRDYSPRYSPHGGRSRRERSYSPPYSRGSR

SEQ ID NO: 701 - protein, 246 aa, Glycine max
  misc_feature (1)..(246): Ceres CLONE ID no. 572426
  misc_feature (1)..(246): Functional Homolog of  Ceres CLONE ID no.  32754
  misc_feature (71)..(142): Pfam Name: RRM_1 Pfam Description: RNA recognition motif. (a.k.a. RRM, RBD, or RNP domain)
MADSPPRRNSRSPSPWRAESRSRSRSRSRPRSRSRSRSFEKQRPRSRSRSRGRSRSRSNERSEAKNAGTTLYVTGLSSRVTERDLEEHFSKEGKVASCFLVVEPRTRISRGFAFITMDTVEDANRCIKYLNQSVLEGRYITVERSRRKRPRTPTPGHYLGLKSTRDYGHRGDHGRYRGGGSGHDDYGYRGDRGRSPRHSPPYRGGRDYSPRHSPPPYGGRSRRDRSRSLPYSPYGSPDRRYARGSR

SEQ ID NO: 702 - DNA, 1282 bp, Arabidopsis thaliana
  misc_feature (1)..(1282): Ceres CLONE ID no.  33139
  misc_feature (1)..(1282): GEMINI ID 553F1
gtcgccaagcttaaccattagatccatttcagagctaagcgtactaattagtgtactaagggtagtgtgactcattaccacctaaagtagtttcaattttcttctatttttcttggcaaagagttatagtgggaaacaaagggagtggttaataaagaattaattagttaattaagggagttcaagatcataatggtgaggcctccttgttgtgacaaaggaggagtgaagaaagggccatggactcctgaagaagatatcattttagtcacttacatccaagaacatggtcctggtaattggagagctgttcctaccaatactgggctgcttagatgcagcaagagttgtagacttagatggacaaactatttaaggccaagaatcaaaagaggcaatttcacagaacatgaagaaaagatgattgttcatctccaagccctcttaggaaatagatgggctgcaattgcgtcatatcttccacaaaggacagacaatgacattaagaactattggaacactcatttgaagaagaaactcaacaaagtcaatcaagattctcatcaagaacttgaccgttcctcgctctcatcttcaccatcgtcttcttctgctaattccaactcaaacatctcaagaggccaatgggaaaggcgacttcaaaccgatatccacttggcgaaaaaggctctctctgaggctttatctcctgccgttgcaccaatcattacatctacagtgacaacaacgtcttcctctgctgaatcaagacgctctactgcctcagctagcgggtttcttaggacgcaagaaacatctacaacttatgcctcaagcaccgaaaatatcgcgaaattgctcaaagggtgggtgaaaaactcgccgaagactcaaaactccgcggatcaaatcgcttctacagaggtaaaagaagtgatcaagagtgatgatgggaaggagtgtgcaggggcatttcagtcattttctgagtttgatcactcatatcaacaggctggtgtttcacctgatcatgagaccaaaccagacataactggatgctgcagtaaccaaagtcaatggtctttgtttgagaagtggttgtttgaggattctggtggacagattggtgatattttattggatgaaaacactaatttcttctgaagaatttgctttaatcacatggttctaattttaggatcctcatctctatttttttttttgggttttccaaattaactcgcttagattatcgtgagataaatcagtaataattttattt

SEQ ID NO: 703 - protein, 247 aa, Arabidopsis thaliana
  misc_feature (1)..(247): Ceres CLONE ID no.  33139
  misc_feature (1)..(247): GEMINI ID 553F1
  misc_feature (2)..(36): Pfam Name: Myb_DNA-binding Pfam Description: Myb-like DNA-binding domain
MIVHLQALLGNRWAAIASYLPQRTDNDIKNYWNTHLKKKLNKVNQDSHQELDRSSLSSSPSSSSANSNSNISRGQWERRLQTDIHLAKKALSEALSPAVAPIITSTVTTTSSSAESRRSTASASGFLRTQETSTTYASSTENIAKLLKGWVKNSPKTQNSADQIASTEVKEVIKSDDGKECAGAFQSFSEFDHSYQQAGVSPDHETKPDITGCCSNQSQWSLFEKWLFEDSGGQIGDILLDENTNFF

SEQ ID NO: 704 - DNA, 933 bp, Populus balsamifera subsp. trichocarpa
  misc_feature (1)..(933): Ceres ANNOT ID no. 1503188
atgggcagaccaccttgctgtgataagataggagtgatgaaaggaccatggactcctgaagaagatatcattttggtatcatatattcaagaacatggtcctggaaattggagagccgtgcctactaatacaggtttgcttagatgcagtaagagttgcaggctgagatggactaattacctcaggccagggatcaaacgtggtaattttacccataacgaggagaagatgataatccacctccaagcccttctaggcaacagatgggctgccatagcttcatacctccctcagagaacagataacgacattaaaaactattggaatacacatttgaagaagttgaaaaagcttcaagcagggcaagaaggtcagtctaggcaaatttctagaggccaatgggagaggaggcttcaaactgatatccacatggctaggcaagctctaagcgaggccttgtctcctgagaaaccaaacagcttattaactgagttgaaaccgtcctgtgggtatgaaaaaccagctccagcatcactctatgcatcaagcactgaaaacatagctaagttgctcaaaggttggatgagaagcgggcctaaccagtccctaacaaattcaacaactactcagaattccttcaacaatatggctgtagctgattcattttctagtgaagagactctaaatagagcagacgaaaatgacactgaattatcagaggcatttgaatcactctttggttttgactcttcaaatatagatttctcccagtcaacgtcacctgatactggccttctccaagacgaaagcaaaccaaattccagtgctcaagtgccattgtcagtgattgagaggtggctatttgatgaaggagctatgcaagggaaagagtaccttagtgaagtcacaccagatgaaaataatctcttctag

SEQ ID NO: 705 - protein, 234 aa, Populus balsamifera subsp. trichocarpa
  misc_feature (1)..(234): Ceres ANNOT ID no. 1503188
  misc_feature (1)..(234): Functional Homolog of  Ceres CLONE ID no.  33139
  misc_feature (2)..(36): Pfam Name: Myb_DNA-binding Pfam Description: Myb-like DNA-binding domain
MIIHLQALLGNRWAAIASYLPQRTDNDIKNYWNTHLKKLKKLQAGQEGQSRQISRGQWERRLQTDIHMARQALSEALSPEKPNSLLTELKPSCGYEKPAPASLYASSTENIAKLLKGWMRSGPNQSLTNSTTTQNSFNNMAVADSFSSEETLNRADENDTELSEAFESLFGFDSSNIDFSQSTSPDTGLLQDESKPNSSAQVPLSVIERWLFDEGAMQGKEYLSEVTPDENNLF

SEQ ID NO: 706 - DNA, 675 bp, Arabidopsis thaliana
  misc_feature (1)..(675): Ceres CLONE ID no.  331755
  misc_feature (1)..(675): GEMINI ID 527D4
  misc_feature (1)..(675): GEMINI ID 538F5
agaatgcaaaccacaaaacaaagtcaaaccagctgcaacgatcaagagcgaggcttccttgtccagctctccgctcagccgacacacacagattgacagatggcgtctatgtcgctgagctcgtcgagggcgcagtggacggcgaagcagaacaagctgttcgagcaggcgttggcggtgtacgacagggacacgccggaccgctggcacaacatcgcgcgcgccgtgggtggcaagtcggcggacgaggtcaggcgctactacgagctgctggtgaaggacttggagcacatcgaggccggcaaggtggccttccccgcgtacaggtgccccggcggctacgacgacgccgacagcgacaggctgaagcacctgacctgaagatctaggcggcaggcaagcatcatgagaaccactgaacaagtacgtcctacatacgtacacttcgcgccatgtgagtgtagcacgtgtggctacaaaagaagcaagccaagcgagtgggtcggacggattatctgttcaagcacgcatgtgaattagaattactactagcaatagctataggatgttgatcaatcgatctccgttccccccgtgttgcgatgtaaaatctcagcatctgtagcatatatattctgaggagtgaaataaaatacattcactagtttgtggacc

SEQ ID NO: 707 - protein, 93 aa, Arabidopsis thaliana
  misc_feature (1)..(93): Ceres CLONE ID no.  331755
  misc_feature (1)..(93): GEMINI ID 527D4
  misc_feature (1)..(93): GEMINI ID 538F5
  misc_feature (10)..(59): Pfam Name: Myb_DNA-binding Pfam Description: Myb-like DNA-binding domain
MASMSLSSSRAQWTAKQNKLFEQALAVYDRDTPDRWHNIARAVGGKSADEVRRYYELLVKDLEHIEAGKVAFPAYRCPGGYDDADSDRLKHLT

SEQ ID NO: 708 - DNA, 663 bp, Panicum virgatum
  misc_feature (1)..(663): Ceres CLONE ID no.1775942
acaagccacacaggccaagcgagcgatcaagagccagccatcagctctcgcgcgctcagtttagctagctgcttcttctgagagaaattaaagatacatatagctagtaggagatagatggcgtcgatgtcaatgagatcgtcgagggcgcagtggacgaagaagcaggacaagctgttcgagcaggcgctggcggtgtacgacaaggacacgccggaccggtggcacaacatcgcgcgcgccgtggggggcaagtcggcggaggaggtcaggcgctactacgagctgctggaagaggacgtcaagcgcatcgaggccggcaaggtgcccttccccgtctataggtgcccgccggcgccgcccccaattactagctaggcccacaggctgaagcaccagaagatctacgtacgtacttcggcaacaatcatgacatacagtgggtttggctacaaaacagtaactcaaccaagtggccggagcatccgtgcacatatatgaataactaccgctacctctagttaccgcagatcaatcgatctcccatgtatgtagtagtatacgtgttcatctggattctcaatttctcatgtaagatcatctctgtatttgtattatgtatcttgagaaaaagtgaagtaaaaaagtccttcatttcccctt

SEQ ID NO: 709 - protein, 86 aa, Panicum virgatum
  misc_feature (1)..(86): Ceres CLONE ID no. 1775942
  misc_feature (1)..(86): Functional Homolog of  Ceres CLONE ID no.  331755
  misc_feature (10)..(59): Pfam Name: Myb_DNA-binding Pfam Description: Myb-like DNA-binding domain
MASMSMRSSRAQWTKKQDKLFEQALAVYDKDTPDRWHNIARAVGGKSAEEVRRYYELLEEDVKRIEAGKVPFPVYRCPPAPPPITS

SEQ ID NO: 710 - protein, 90 aa, Oryza sativa
  misc_feature (1)..(90): Public GI no. 34913016
  misc_feature (1)..(90): Functional Homolog of  Ceres CLONE ID no.  331755
  misc_feature (11)..(60): Pfam Name: Myb_DNA-binding Pfam Description: Myb-like DNA-binding domain
MASMSVSSSRAPQWTARQNEQFERALAVYDRDTPERWHNIARAVAGKSADEVKLYYDLLVEDVKRIETGKVPFPAYRCPQPAIAENSGIW

SEQ ID NO: 711 - protein, 79 aa, Musa acuminata
  misc_feature (1)..(79): Ceres CLONE ID no. 1723374
  misc_feature (1)..(79): Functional Homolog of  Ceres CLONE ID no.  331755
  misc_feature (7)..(56): Pfam Name: Myb_DNA-binding Pfam Description: Myb-like DNA-binding domain
MASGSMSSSWTAKENKMFEKALAVYDRDTPDRWHKIARAIGGKTADEVKRYYDLLVEDVRRIEAGQMPYANYRSSNGRG

SEQ ID NO: 712 - DNA, 1144 bp, Gossypium hirsutum
  misc_feature (1)..(1144): Ceres CLONE ID no.1847251
ataccactcccttaacttcaaacaaaatcttcttttaagagtcccttccatcaccttgctttcacattcaggcacctgcatacttcttttaacttttcagccctataattctctcacttaagattttcaccaatggcatctaattctctcacttcctcacgtacctctggctcgtcctggacggcaaagcaaaacaaactgttcgagaaggctctggctaaatatgacaaagacactcctgaccgctggcataacattgccaaggctgtgggtggaaagtcagttgaggaagtcaagctgcactatgagatcctagtcagggatctcaaagacattgagtctggccgctacccttatccatatccaaccaactaaagcgctatgagtttactacttactattcactacctatccacaatcactatagataaccaagaagtgaaggccactttcatatgcatgaatcacattcctaaaaatgcagctgtcatgcttttttgttgatgtagttgtggatttaaagaaaacgtggttcttagaattatcatacatgcgcatatccatgacgtccttgtccttccagctccacacacccacaaccccaaagtccttaagcattgaaaactctcaagtacccaagtgggtccataaaagaaaatccagaaaagtagggaatcttcatgtgcctccccccccccccccccaaatttctttctgtggtctatcactttaaatttttttcctttttccactgagcatatacagttcatttgcatttaatgttcttatagacctaattccttacaattactcaatcctaatctcaaatctttcgactctttttgtctttttggattttggacaacatgccgatggtacttttgtcatttccaacatattttatcttaattatctgcatttgtttttctcacaggagcaaatcaataaattccgtttctagagacttaacttgtcctacttgtctttcaggttagctgaagactatgaatatatatatgcatctagagacctcagttgctgagagactagcctagttccccacctaaagaaatccatacaaaactaattatcccattggtgtaatactaaatgctgttactaccaaaaaaaaaaaaaaaaaaaa

SEQ ID NO: 713 - protein, 80 aa, Gossypium hirsutum
  misc_feature (1)..(80): Ceres CLONE ID no. 1847251
  misc_feature (1)..(80): Functional Homolog of  Ceres CLONE ID no.  331755
  misc_feature (13)..(62): Pfam Name: Myb_DNA-binding Pfam Description: Myb-like DNA-binding domain
MASNSLTSSRTSGSSWTAKQNKLFEKALAKYDKDTPDRWHNIAKAVGGKSVEEVKLHYEILVRDLKDIESGRYPYPYPTN

SEQ ID NO: 714 - DNA, 631 bp, Gossypium hirsutum
  misc_feature (1)..(631): Ceres CLONE ID no.1916571
cataccactcccttaacttcaaataaaatcttcttttaagagtcccttccatcaccttgctttcacattcaggcacctgcatacttcttttactttttcagccctataattctcttacttaagattttcaccaatggcatctaattctctcacttcctcacgtacctctggctcctcctggacggcaaagcaaaacaaactgttcgagaaggctctggctaaatatgacaaagacactcctgaccgctggcataacattgccaaggctgtgggtggaaagtcagttgaggaagtcaagctgcactatgagatcctagtcagggatctcaaagacattgagtctggccgctacccttatccatatccaaccaactaaagcgctgttagctgaagaatcaaagactatgaatatatatatgcatctagagacctcagttgctgagagactagcctagttccccacctaaaacaatccatacaaaactaattatcccattggtgtaatactaaatgctgttactactatttaccttttttttttcttggttattatcatctatttgtattttcctttggcctttatctaactaaagtaaatgctatattttggtaaaaaaaaaaaaaaaaaaaa

SEQ ID NO: 715 - protein, 80 aa, Gossypium hirsutum; identical to SEQ ID NO: 713
  misc_feature (1)..(80): Ceres CLONE ID no. 1916571
  misc_feature (1)..(80): Functional Homolog of  Ceres CLONE ID no.  331755
  misc_feature (13)..(62): Pfam Name: Myb_DNA-binding Pfam Description: Myb-like DNA-binding domain

SEQ ID NO: 716 - protein, 81 aa, Arabidopsis thaliana
  misc_feature (1)..(81): Public GI no. 38566494
  misc_feature (1)..(81): Functional Homolog of  Ceres CLONE ID no.  331755
  misc_feature (9)..(58): Pfam Name: Myb_DNA-binding Pfam Description: Myb-like DNA-binding domain
MASNSMSSSASWTRKENKLFERALATYDQDTPDRWHNVARAVGGKSAEEVRRHYELLIRDVNDIESGRYPHPNYRSNGNNH

SEQ ID NO: 717 - DNA, 273 bp, Populus balsamifera subsp. trichocarpa
  misc_feature (1)..(273): Ceres ANNOT ID no. 1514100
atggcatcaagctcaatgtcctctcgcggttcgggctcgtggactgttcagcagaacaaagcctttgaaagggctttggctgtgtatgacagagacacgcccgatcgctggtacaatgtagccagggcagtcggtggaaaaaccgcagaagaagtgaaaaggcactatgaactgcttgtggaggatgtgaagcatattgagtcgggccatgttcccttccctaattacaggactaccggggcaaatggccacgcaagagacgggattgtttag

SEQ ID NO: 718 - protein, 90 aa, Populus balsamifera subsp. trichocarpa
  misc_feature (1)..(90): Ceres ANNOT ID no. 1514100
  misc_feature (1)..(90): Functional Homolog of  Ceres CLONE ID no.  331755
  misc_feature (11)..(60): Pfam Name: Myb_DNA-binding Pfam Description: Myb-like DNA-binding domain
MASSSMSSRGSGSWTVQQNKAFERALAVYDRDTPDRWYNVARAVGGKTAEEVKRHYELLVEDVKHIESGHVPFPNYRTTGANGHARDGIV

SEQ ID NO: 719 - DNA, 297 bp, Populus balsamifera subsp. trichocarpa
  misc_feature (1)..(297): Ceres ANNOT ID no. 1450327
atggcatcaagctccgtgtcctctcgcggttcgggctcgtggactgctcagcagaacaaagcctttgaaagggctttggctgtttatgacagggacacacccgaccgttggcataatgtagccagggcagttggtggaaaaactgctgaagaagtgaaaaggcattacgaaatcctcgtggaggatgtcaagcatattgagtcaggccgagttcccttccctaattacaggactaccggggcaaatggccactcaaagactggtgaggaaaagatgtatatatatagcagtttataa

SEQ ID NO: 720 - protein, 98 aa, Populus balsamifera subsp. trichocarpa
  misc_feature (1)..(98): Ceres ANNOT ID no. 1450327
  misc_feature (1)..(98): Functional Homolog of  Ceres CLONE ID no.  331755
  misc_feature (11)..(60): Pfam Name: Myb_DNA-binding Pfam Description: Myb-like DNA-binding domain
MASSSVSSRGSGSWTAQQNKAFERALAVYDRDTPDRWHNVARAVGGKTAEEVKRHYEILVEDVKHIESGRVPFPNYRTTGANGHSKTGEEKMYIYSSL

SEQ ID NO: 721 - DNA, 336 bp, Populus balsamifera subsp. trichocarpa
  misc_feature (1)..(336): Ceres ANNOT ID no. 1460832
atggcatcaagctcaatgtcctctcgcggttcgggctcgtggactgttcagcagaacaaagcctttgaaagggctttggctgtgtatgacagagacacgcccgatcgctggtacaatgtagccagggcagtcggtggaaaaaccgcagaagaagtgaaaaggcactatgaactgcttgtggaggatgtgaagcatattgagtcgggccatgttcccttccctaattacaggactaccggggcaaatggccacgcaagagctaaccatatcatgccacaattaaaggtagctaaatctaatcaagtggggtgtcatggagtcactgctactgtctaa

SEQ ID NO: 722 - protein, 111 aa, Populus balsamifera subsp. trichocarpa
  misc_feature (1)..(111): Ceres ANNOT ID no. 1460832
  misc_feature (1)..(111): Functional Homolog of  Ceres CLONE ID no.  331755
  misc_feature (11)..(60): Pfam Name: Myb_DNA-binding Pfam Description: Myb-like DNA-binding domain
MASSSMSSRGSGSWTVQQNKAFERALAVYDRDTPDRWYNVARAVGGKTAEEVKRHYELLVEDVKHIESGHVPFPNYRTTGANGHARANHIMPQLKVAKSNQVGCHGVTATV

SEQ ID NO: 723 - DNA, 670 bp, Gossypium hirsutum
  misc_feature (1)..(670): Ceres CLONE ID no.1927753
aagtaattttctttgagagaaataaccccatcttttccctttatacaagtttcaatttattcactctttcaaattcaggaactgacatagttctctaaatttttagcctgtcattctgatccgaagcttgttaaaaagaccctctgttttcagttgtacttattttcacttatgtcatccaattttctcaataattcacgctgctctagctcttcctggacacctaaacaaaacaaaacgttcgagaaggctctggctaaatatgaccaggacactcctgaccgctggcacaatgttgccaaggctgtgggtggaaagtctgctgaggaagtcaagctgcactatgatgccctagtcagggatctcaaagacattgagtctggccgctacccttatccatatccaagtggaagcaacagctaaagtggttcccaaagagtcaagtactaaaatgaaaaagaacatgatactcacaaaaccagagacctcagtcgcacagtcgcagaaatctagcattggatgatattcccccagaaaaaaagaaaatccctactgtaattgtacatgctgctattactattttctgtattatcactttgtattttcctttgaccttgtctagttaaattaaaatattaaatatttatatagtaattaaaaaaaaaaaaaa

SEQ ID NO: 724 - protein, 83 aa, Gossypium hirsutum
  misc_feature (1)..(83): Ceres CLONE ID no. 1927753
  misc_feature (1)..(83): Functional Homolog of  Ceres CLONE ID no.  331755
  misc_feature (13)..(62): Pfam Name: Myb_DNA-binding Pfam Description: Myb-like DNA-binding domain
MSSNFLNNSRCSSSSWTPKQNKTFEKALAKYDQDTPDRWHNVAKAVGGKSAEEVKLHYDALVRDLKDIESGRYPYPYPSGSNS

SEQ ID NO: 725 - protein, 100 aa, Glycine max
  misc_feature (1)..(100): Ceres CLONE ID no. 638126
  misc_feature (1)..(100): Functional Homolog of  Ceres CLONE ID no.  331755
  misc_feature (13)..(62): Pfam Name: Myb_DNA-binding Pfam Description: Myb-like DNA-binding domain
MASSSLSKQKASDSSWTPKQNKLFEKALAKYDKDTPDRWQNVAKAVGGKSADEVKRHYEILLEDLRHIESGHVPLPKYKSTGSSTNVEEEERLLKYLKLN

SEQ ID NO: 726 - protein, 88 aa, Lycopersicon esculentum
  misc_feature (1)..(88): Public GI no. 7981380
  misc_feature (1)..(88): Functional Homolog of  Ceres CLONE ID no.  331755
  misc_feature (11)..(60): Pfam Name: Myb_DNA-binding Pfam Description: Myb-like DNA-binding domain
MSSMSSQHGSSGSWTAKQNKAFEKALAVYDKETRDRWSNVAKAVGGKTAEEVKRHYEILLRDVFFIDNGMVPFPKYKTTGGSHNSTSD

SEQ ID NO: 727 - protein, 93 aa, Medicago truncatula
  misc_feature (1)..(93): Public GI no. 92894385
  misc_feature (1)..(93): Functional Homolog of  Ceres CLONE ID no.  331755
MDDILKGLCGWSWKENKLFELALALVDESHPERWEMVAAMVGGEKSAGEVQKHYVILLEDLELIESGKFDHKLGEDNTCVIVDLTESLCLSDK

SEQ ID NO: 728 - protein, 93 aa, Antirrhinum majus
  misc_feature (1)..(93): Public GI no. 61652985
  misc_feature (1)..(93): Functional Homolog of  Ceres CLONE ID no.  331755
  misc_feature (8)..(57): Pfam Name: Myb_DNA-binding Pfam Description: Myb-like DNA-binding domain
MASTRGSGRPWSAKENKAFERALAVYDKDTPDRWANVARAVEGRTPEEVKKHYEILVEDIKYIESGKVPFPNYRTTGGNMKTDEKRFRNLKIR

SEQ ID NO: 729 - DNA, 801 bp, Arabidopsis thaliana
  misc_feature (1)..(801): Ceres CLONE ID no.  33435
  misc_feature (1)..(801): GEMINI ID 531C5
tttaacccttcactcttctatataaatctcccccaagtacttaacactcttcactactctctccactaaacaaaaacactagagttaagttacatatagagtaaggaagagatggcagttaggtgtttagccgtgttcctcgttgctctcatggtgtctcaagcagtcaccgcaacaagaccggctccaaccaagaatgtcggagctggtcttgacgaccaaaagaactttgtagcgttcgctggtgtcggtggagctgctggaattggtggagccggtggtgttggagctggtcttggtggtgtcgccggtggagttggtggtgttgccggagttttgcctgttggcggtgtaggcggcggaattggtggtctaggcggtggtgtaggtggtcttggcggtctaggtggtctaggtggtggttcaggtcttggtcatggagtaggtggaattggtggtgaccctggtattggtagtggtatcggtggactcggcggtgcaggtggtctaggcggtataggcggtgttggtggtttgggtggaattggcggtggaagcgattgcggtggcgtaattcctcaccattgatgttaaacgtttttttttttgtttttttgctctctataaaccaaagatcggtcgaaaggttcataattattatgttttaagttcttttatcgatgtttatgttttaagtcgtttgttttctatatatgtttcttgttttgtttgttatgctgtttgttattaattacttgtgagaaacttgtgttatcaataaatagtgttttttttttgttc

SEQ ID NO: 730 - protein, 158 aa, Arabidopsis thaliana
  misc_feature (1)..(158): Ceres CLONE ID no.  33435
  misc_feature (1)..(158): GEMINI ID 531C5
MAVRCLAVFLVALMVSQAVTATRPAPTKNVGAGLDDQKNFVAFAGVGGAAGIGGAGGVGAGLGGVAGGVGGVAGVLPVGGVGGGIGGLGGGVGGLGGLGGLGGGSGLGHGVGGIGGDPGIGSGIGGLGGAGGLGGIGGVGGLGGIGGGSDCGGVIPHH

SEQ ID NO: 731 - protein, 156 aa, Arabidopsis thaliana
  misc_feature (1)..(156): Ceres CLONE ID no. 116606
  misc_feature (1)..(156): Functional Homolog of  Ceres CLONE ID no.  33435
MAVRCLAVFLVALMVSQAVTATRPAPTKNVGAGLDDQKNFVAFAGVGGAAGIGGAGGVGAGLGGVAGGVGGVAGVLPVGGVGGGIGGLGGGVGGLGGLGGLGGGSGLGHGVGGIGGNPGIGSGIGGLGGAGGLGGIGGVGGFDTRTGDWSETGGVW

SEQ ID NO: 732 - protein, 131 aa, Brassica napus
  misc_feature (1)..(131): Ceres CLONE ID no. 1079147
  misc_feature (1)..(131): Functional Homolog of  Ceres CLONE ID no.  33435
MAIKCLAVFLVALTVAQSVTATRPAPAKNVGAGLEDQKNFVAFAGVGGAAGVGGVGTGLGGVAGGVGGVAGVLPVGGVGGGIGGLGGGVGGLGGVGGLGGGSGLGGGIGGGSGLGGVGGLGGVGGLGGVGG

SEQ ID NO: 733 - protein, 145 aa, Brassica napus
  misc_feature (1)..(145): Ceres CLONE ID no. 957098
  misc_feature (1)..(145): Functional Homolog of  Ceres CLONE ID no.  33435
  misc_feature (142)..(142): Xaa is any aa, unknown, or other
MAIKCLAVFLVALTGAHSVTATRPAPAKNVGAGLEDQKNFVAFAGVGGAAGVGGVGTGLGGVAGGVGGVAGVLPVGGVGGGIGGLGGGVGGLGGGSGLGGGIGGGSGLGGVGGLGGVGGLGGVGGVGGLGGIDGGSDCGGVXPHP

SEQ ID NO: 734 - protein, 140 aa, Zea mays
  misc_feature (1)..(140): Ceres CLONE ID no. 1435704
  misc_feature (1)..(140): Functional Homolog of  Ceres CLONE ID no.  33435
MASRYLAVFLVALTVVQSVTAARPTPAKNVGAGLDDQKNFVAFAGVGGAAGAGFGGVVGGVAGVLPVGGVGGGIGGLGGGVGGLGGGIGGIGGGSGLGGGAGAGGLGGVGGLGGVGGIGGVGGLGGIGGGSDCGDVLPHP

SEQ ID NO: 735 - protein, 140 aa, Glycine max; identical to SEQ ID NO: 734
  misc_feature (1)..(140): Ceres CLONE ID no. 1496331
  misc_feature (1)..(140): Functional Homolog of  Ceres CLONE ID no.  33435

SEQ ID NO: 736 - DNA, 1094 bp, Arabidopsis thaliana
  misc_feature (1)..(1094): Ceres CLONE ID no.  337432
  misc_feature (1)..(1094): GEMINI ID 538E7
  misc_feature: Encodes the peptide sequence at SEQ ID NO. 737
  misc_feature: Encodes the peptide sequence at SEQ ID NO. 676
aacccctttctttttcttaattcctcatccactcgccgcacgacgaagagagcggctcccattccccaccacctactcggaccggagcagcaggttctcgaaccgaccggtgaaacattctcgcgccaattgtgggggccatgggcgccaacggacacccgccggcgagcaccgtcgcgcagaacggatcccactctggcggaggcggaggagggggagggggagtgaaccctagcaacggcggcacgggggcggctcttcggcacgaccctggtctggcgcgggagtggtcgacggaggagcagaccatcctcgacgagctgctggtcaagtatgcatccgatttacccgtcgttcgctatgcaaaagttgcaatgaagttgccagagaaaacagttcgggatgtagccttgcgctgcagatggatgaataaaaaggagagcgccaaaagaaagaaagaggatcacaactcgtctaagaaaagcaaggacaaaaaggagaaggtttcagattcttcgtcgaaaccacctgtgcatatggtgggtaggcctaatgttcctccataccctcttccagttcttccaatggacgatgatgaaatctcatccaaagccattggaggtccaacgggtgaaatacttgaaactaatgcccatgttttgggtcaaatttcgtcaaaccttagcaacatgcagatacaggacaatatctctctgctctgccaaactcgcgataatatactcagggtcttgaaagagataaacgatgctccagatatcatgaagcagatgcccccgctacctgtgaagataaacgaggagctcgtcaactcgttgctccccagaccaactgtacctatgcagtagtgatagcaaaatgagcttttaagataggcagctgaaataaaaaaaaggggcagccctggtacttttttgttcgttttgtagctccatcctctcgccttctgtattgtatgtttcgtctggatgcttgtgtttgttccaaccttttgcaagtcaggcggttggaacgtgtaccaagttaccaagggctgcttccacataagtatcaggtcctgactctgttttgtaagc

SEQ ID NO: 737 - protein, 241 aa, Arabidopsis thaliana; identical to SEQ ID NO: 676
  misc_feature (1)..(241): Ceres CLONE ID no.  337432
  misc_feature (1)..(241): GEMINI ID 538E7

SEQ ID NO: 738 - protein, 246 aa, Oryza sativa; identical to SEQ ID NO: 673
  misc_feature (1)..(246): Public GI no. 50925955
  misc_feature (1)..(246): Functional Homolog of  Ceres CLONE ID no.  337432
  misc_feature (52)..(102): Pfam Name: Myb_DNA-binding Pfam Description: Myb-like DNA-binding domain

SEQ ID NO: 739 - protein, 232 aa, Glycine max; identical to SEQ ID NO: 672
  misc_feature (1)..(232): Ceres CLONE ID no. 1619846
  misc_feature (1)..(232): Functional Homolog of  Ceres CLONE ID no.  337432

SEQ ID NO: 740 - protein, 258 aa, Arabidopsis thaliana
  misc_feature (1)..(258): Public GI no. 27754217
  misc_feature (1)..(258): Functional Homolog of  Ceres CLONE ID no.  337432
MAASANPSGNNQEGSSATQKVSSSSAAAANGAAVNSVDNGGNTGAAADNSQTIGALRHNPGISTDWTLEEQSLLEDLLVKYATEPSVFRYAKIAMKMKDKTVRDVALRCRWMTKKENGKRRKEDHSSRKSKDKKEKATDSSAKSSSHLNVHPNGPSYAPPMMPIDTDDGISYKAIGGVSGDLLEQNAQMFNQLSTNFSAFQLHENVNILCKARDNILAILNDLNDMPEVMKQMPPLPVKLNEELANSILPRPSHQRKS

SEQ ID NO: 741 - DNA, 717 bp, Populus balsamifera subsp. trichocarpa
  misc_feature (1)..(717): Ceres ANNOT ID no. 1509127
atggcaaacccatctgggacaaataatcaagatggcaatcaagctccttcttcattcaatggaaacaatccaagtaatggtaattcggacccttcttctggttcttctttgaagcacaatcctggtatatcaactgactggacttttgaagaacagacaattcttgaagagggattggtagattttgcagaggaaacaaacgtagtacgttatgcaaagatagctattaatctaccaaacaagacagtccgagatgttgctttgcgttgcagatggatgaataaaaaggaacagagcaagcgaaggaaggaagataatctagcacgtagaagtagagataaaaaggaaagacatggtgatccttctgcaaagacttctaacttcatggctgcccgccccagtgtttctccatttgcaactccaatgctgccactggaaagtgaagaaggcatctcatatgatgcaattggtggagttacaggagaccttcttaagcaaaatgcacagattctaaatcaaatttctgcaaaccttgcaagttttcagatacaggagaacctcaatcttctccgccgaacgcgtgacaacatccgcaaaattatgaaccagatgaatgatgtgccagaactaatgaagcagatgccaccacttccagtcaagttgaacgatgatctagctgacaccatccttctgcctccaaaccttcctaggccataa

SEQ ID NO: 742 - protein, 238 aa, Populus balsamifera subsp. trichocarpa
  misc_feature (1)..(238): Ceres ANNOT ID no. 1509127
  misc_feature (1)..(238): Functional Homolog of  Ceres CLONE ID no.  337432
MANPSGTNNQDGNQAPSSFNGNNPSNGNSDPSSGSSLKHNPGISTDWTFEEQTILEEGLVDFAEETNVVRYAKIAINLPNKTVRDVALRCRWMNKKEQSKRRKEDNLARRSRDKKERHGDPSAKTSNFMAARPSVSPFATPMLPLESEEGISYDAIGGVTGDLLKQNAQILNQISANLASFQIQENLNLLRRTRDNIRKIMNQMNDVPELMKQMPPLPVKLNDDLADTILLPPNLPRP

SEQ ID NO: 743 - DNA, 1728 bp, Arabidopsis thaliana
  misc_feature (1)..(1728): Ceres CLONE ID no.  339518
  misc_feature (1)..(1728): GEMINI ID 538G9
agtccacacccaccatcccgttctccctctcttctcctctccaaggtccctgccacccacacaaggcttggactcttgggccggccgggggggaagaagacaagacaaactcagccgccggcatgatggcgatctgcagcgcgcacaccaccaccatctccctgcgctccccatgcacgacgaccgtctcgaacgcggcagctggcttggtgcagaagcaagtcatcttcttgaccagcatcaacaggaggagcggcagcagaaggcgtggaggaggggtgagcaggaccttactccaggtctcgtgctccgccgacggcaacaagccagtggtgatcggcctggcggcggactccgggtgcggcaagagcaccttcatgcgccggctcaccagcgtcttcggcggcgccgcggagccgcccaggggcgggaacccggactccaacacgctcatcagcgacaccacgaccgtgatatgcctcgacgactaccactccctggacaggaccggcaggaaggagaagggcgtcaccgcgctcgacccgagggccaacaacttcgacctcatgtacgagcaggtgaaggcgatcaagcaaggccaggcggtccagaagcccatctacaaccacgtcaccggcctcctcgacccgccggagcttatcacgccgcccaagatctttgtcatcgaaggtctgcacccaatgttcgacgagcgtgtgagggacctcttagacttcagcatctacttggacatcagtgatgaggttaagtttgcatggaaaatccagcgggacatggcagagcgtgggcacagccttgaaagcatcaaggccagcatcgaagccaggaaaccagatttcgatgcatatattgatccgcagaagcagtacgctgacgccgtgatcgaagttctgccgacccagttgatccccaacgacgacgaagggaaggttctgcgagtcaagctgatcatgaaagaaggggtggacaacttcaacccggtctacctcttcgacgaagggtccaccatctcctgggtgccctgtggaagaaagctcacgtgctcttaccccggcatcaaattcgcctacggcccagacatttacttcggaaacgaggtatctgttttggagatggatgggcagttcgacagactagacgagctcatctacgtggagagccatctgagcaacctctcgaccaagttctacggggaggtgacacagcagatgctgaagcacgcggacttcccgggaagcaacaacgggacaggcctcttccagaccatcgtcgggctgaagattagagacctctacgagcagattgttgccgagagggctggcgcgccagcggaagcagccaaagtttgatggcccacgtgcattcagatgtcctaaaactacagctcttcaaactcgacgcacgtctgttgggatatatgcatggcgagctaggagcctaggaggacgatgtggaagaaacgtcattgcagaaccagaactcaggaaaacgtgcagcacttgtttagatgtgtgccttcttccatgcttcattgcagaaagaaatcccaagtgcctactactgtcaggtactcctattcaagtgtaggagatgaatccataccacttctattgttggttattgtttctctgacccggagccaagaacagtcaacaaggacccgaggttgaacatctctttttatggactactggagagtaacaacgg

SEQ ID NO: 744 - protein, 415 aa, Arabidopsis thaliana
  misc_feature (1)..(415): Ceres CLONE ID no.  339518
  misc_feature (1)..(415): GEMINI ID 538G9
  misc_feature (71)..(270): Pfam Name: PRK Pfam Description: Phosphoribulokinase / Uridine kinase family
MMAICSAHTTTISLRSPCTTTVSNAAAGLVQKQVIFLTSINRRSGSRRRGGGVSRTLLQVSCSADGNKPVVIGLAADSGCGKSTFMRRLTSVFGGAAEPPRGGNPDSNTLISDTTTVICLDDYHSLDRTGRKEKGVTALDPRANNFDLMYEQVKAIKQGQAVQKPIYNHVTGLLDPPELITPPKIFVIEGLHPMFDERVRDLLDFSIYLDISDEVKFAWKIQRDMAERGHSLESIKASIEARKPDFDAYIDPQKQYADAVIEVLPTQLIPNDDEGKVLRVKLIMKEGVDNFNPVYLFDEGSTISWVPCGRKLTCSYPGIKFAYGPDIYFGNEVSVLEMDGQFDRLDELIYVESHLSNLSTKFYGEVTQQMLKHADFPGSNNGTGLFQTIVGLKIRDLYEQIVAERAGAPAEAAKV

SEQ ID NO: 745 - protein, 405 aa, Zea mays
  misc_feature (1)..(405): Ceres CLONE ID no. 243130
  misc_feature (1)..(405): Functional Homolog of  Ceres CLONE ID no.  339518
  misc_feature (61)..(260): Pfam Name: PRK Pfam Description: Phosphoribulokinase / Uridine kinase family
MAICSAHTTTSLRSPCTTVSNAGLRQKQVIFVTSNRRSGGGRRHGGARSFQVSCSVDKPVVIGLAADSGCGKSTFMRRLTSVFGGAAEPPKGGNPDSNTLISDTTTVICLDDYHSLDRNGRKEKGVTALDPRANNFDLMYEQVKAIKEGQAVEKPIYNHVTGLLDPPELIAPPKIFVIEGLHPMFDERVRDLLDFSIYLDISDEVKFAWKIQRDMAERGHSLESIKASIEARKPDFDAFIDPQKQYADAVIEVLPTQLIPDDNEGKVLRVKLIMKEGVKNFNPVYLFDEGSTISWVPCGRKLTCSYPGIKFSYGPDTYFGNEVSVLEMDGQFDRLDELIYVESHLSNLSTKFYGEVTQQMLKHADFPGSNNGTGLFQTIIGLKIRDLYEQIVAERAGVPAEAAKV

SEQ ID NO: 746 - DNA, 1584 bp, Panicum virgatum
  misc_feature (1)..(1584): Ceres CLONE ID no.1776411
attccattctccctcctctttctcttgaagtcccacccataaggcttggagggaagaagagaaagcttagcccagaacaaaggccggcaagcaaaaatggcgatctgcagcacgcacaccaccacctccctgcactccccatgcacaacagtctcaaacgcaggcttcaggcagaagcaagtcatcttcttcaccagcaacaggagaagcggcagaaggcatggaggggcaagaacctttcaggtttcatgctccgtcgagaagccagtggtgatcggcctggcggcagactcaggatgcgggaagagtaccttcatgcgccgtctcaccagtgtgtttggtggtgctgcagagccacccaagggtggcaacccggactccaacaccctcatcagtgacaccacgacagtgatatgccttgatgactaccactccttggacagaaccgggagaaaggagaagggtgtgaccgccctcgacccaagggccaacaactttgatctcatgtatgagcaggtgaaggcaatcaaagaaggccagacaattgagaagccgatctacaaccatgtcactggcctcctcgacccaccggaggttatcaagcccccaaagatttttgtcattgagggcttgcacccaatgtttgatgagcgtgtgagagacctcctagacttcagtatctacttggacatcagcgatgaggttaagtttgcatggaaaattcagcgggacatggcagagcgcgggcacagccttgaaagcatccaggctagtatcgaagctaggaaaccagattttgatgccttcattgatccgcagaagcaatatgctgatgctgtgattgaagttctgccgacacagttgattcccgatgacaatgaaggaaaggtgctgcgtgttaaattgatcatgaaagaaggcgtgaagcacttcaacccagtttacctcttcgatgagggatcaagtatcagctgggtgccttgcggaagaaagctcacatgctcttaccctggcatcaaatttgcctatggcccagacacttacttcggccacgaggtatcagtgttggagatggatgggcaattcgacagactagatgagctcatatatgtggagagccatctaagcaatctctcaactaaattctatggagaagtgacacagcaaatgctaaagcatgcagatttcccaggaagcaacaacggaacagatctcttccagaccatcgttggactgaagattagagatctctatgagcagatagttgccgaaagggctggtgcaccagctgaaacagcaaaagtttaatgatctgcacattcagatttcctacacctcttcaaactcaatgagaacgagaatcctcgaaattcttgtaattagttcggatacatcacggctagaaggcggtagaaatgtcattgcagtactcaggaaaacatgcgatgaaatttctagaaatacctcgccatgggggtgctcttacatctcttctgcgcatgtttaaatgcatatcttcatccatgcttttatgcggaaagaaatacagctgcctgctactacgaaaaaaaaaaaaaaaaaaaa

SEQ ID NO: 747 - protein, 403 aa, Panicum virgatum
  misc_feature (1)..(403): Ceres CLONE ID no. 1776411
  misc_feature (1)..(403): Functional Homolog of  Ceres CLONE ID no.  339518
  misc_feature (59)..(258): Pfam Name: PRK Pfam Description: Phosphoribulokinase / Uridine kinase family
MAICSTHTTTSLHSPCTTVSNAGFRQKQVIFFTSNRRSGRRHGGARTFQVSCSVEKPVVIGLAADSGCGKSTFMRRLTSVFGGAAEPPKGGNPDSNTLISDTTTVICLDDYHSLDRTGRKEKGVTALDPRANNFDLMYEQVKAIKEGQTIEKPIYNHVTGLLDPPEVIKPPKIFVIEGLHPMFDERVRDLLDFSIYLDISDEVKFAWKIQRDMAERGHSLESIQASIEARKPDFDAFIDPQKQYADAVIEVLPTQLIPDDNEGKVLRVKLIMKEGVKHFNPVYLFDEGSSISWVPCGRKLTCSYPGIKFAYGPDTYFGHEVSVLEMDGQFDRLDELIYVESHLSNLSTKFYGEVTQQMLKHADFPGSNNGTDLFQTIVGLKIRDLYEQIVAERAGAPAETAKV

SEQ ID NO: 748 - protein, 403 aa, Oryza sativa
  misc_feature (1)..(403): Public GI no. 50911777
  misc_feature (1)..(403): Functional Homolog of  Ceres CLONE ID no.  339518
  misc_feature (59)..(258): Pfam Name: PRK Pfam Description: Phosphoribulokinase / Uridine kinase family
MAISSLHATTSLHSPCTTNTSFRQNQVIFFTTRSNRRGSTRYGGARTFQVSCSVDKPVVIGLAADSGCGKSTFMRRLTSVFGGAAEPPKGGNPDSNTLISDTTTVICLDDYHSLDRTGRKEKGVTALDPRANDFDLMYEQVKAIKEGKAIEKPIYNHVTGLLDPPELIQPPKIFVIEGLHPMFDERVRDLLDFSIYLDISDEVKFAWKIQRDMAERGHSLESIKASIEARKPDFDAFIDPQKQYADAVIEVLPTQLIPDDNEGKVLRVKLIMKEGVKNFNPVYLFDEGSSITWVPCGRKLTCSYPGIKFAYGPDTYFGHEVSVLEMDGQFDRLDELIYVESHLSNLSTKFYGEVTQQMLKHADFPGSNNGTGLFQTIVGLKIRDLYEQIIAERAGAPTEAAKV

SEQ ID NO: 749 - protein, 404 aa, Triticum aestivum
  misc_feature (1)..(404): Public GI no. 5924030
  misc_feature (1)..(404): Functional Homolog of  Ceres CLONE ID no.  339518
  misc_feature (60)..(259): Pfam Name: PRK Pfam Description: Phosphoribulokinase / Uridine kinase family
MAFCSPHTTTSLRSPCTTIPNSGFRQNQVIFFTTRSSRRSNTRHGARTFQVSCAVEQPIVIGLAADSGCGKSTFMRRLTSVFGGAAEPPKGGNPDSNTLISDTTTVICLDDYHSLDRTGRKEKGVTALDPKANDFDLMYEQVKAIKEGKAIEKPIYNHVTGLLDPAELIQPPKIFVIEGLHPMYDERVRELLDFSIYLDISNEVKFAWKIQRDMAERGHSLESIKASIEARKPDFDAFIDPQKQYADAVIEVLPTQLIPDDNEGKVLRVKLIMKEGIKFFNPVYLFDEGSTINWIPCGRKLTCSYPGIKFSYGPDTYFGQEVSVLEMDGQFDRLDELIYVESHLSNLSTKFYGEVTQQMLKHADFPGSNNGTGLFQTIVGLKIRDLYEQIIAERAGVPAEAAKV

SEQ ID NO: 750 - protein, 404 aa, Triticum aestivum
  misc_feature (1)..(404): Public GI no. 100796
  misc_feature (1)..(404): Functional Homolog of  Ceres CLONE ID no.  339518
  misc_feature (60)..(259): Pfam Name: PRK Pfam Description: Phosphoribulokinase / Uridine kinase family
MAFCSPHSTTSLRSPCTTIPNSGFRQNQVILFTTRSSRRSNTRHGARTFQVSCAVEQPIVIGLAADSGCGKSTFMRRLTSVFGGAAEPPKGGNPDSNTLISDTTTVICLDDYHSLDRTGRKEKGVTALDPKANDFDLMYEQVKAIKEGKAIEKPIYNHVTGLLDPAELIQPPKIFVIEGLHPMYDERVRELLDFSIYLDISNEVKFAWKIQRDMAERGHSLESIKASIEARKPDFDAFIDPQKQYADAVIEVLPTQLIPDDNEGKVLRVKLIMKEGIKFFNPVYLFDEGSTINWIPCGRKLTCSYPGIKFSYGPDTYFGQEVSVLEMDGQFDRLDELIYVESHLSNLSTKFYGEVTQQMLKHADFPGSNNGTGLFQTIVGLKIRDLYEQIIAERAGVPAEAAKV

SEQ ID NO: 751 - protein, 404 aa, Triticum aestivum
  misc_feature (1)..(404): Public GI no. 21839
  misc_feature (1)..(404): Functional Homolog of  Ceres CLONE ID no.  339518
  misc_feature (60)..(259): Pfam Name: PRK Pfam Description: Phosphoribulokinase / Uridine kinase family
MAFCSPHSTTSLRSPCTTIPNSGFRQNQVILFTTRSSRRSNTRHGARTFQVSCAVEQPIVIGLAADSGCGKSTFMRRLTSVFGGAAEPPKGGNPDSNTLISDTTTVICLDDYHSLDRTGRKEKGVTALDPKANDFDLMYEQVKAIKEGKAIEKPIYNHVTGLLDPAELIQPPKIFVIEGLHPMYDERVRELLDFSIYLDISNEVKFAWKIQRDMAERGHSLESIKASIEARKPDFDAFIGPQKQYADAVIEVLPTQLIPDDNEGKVLRVKLIMKEGIKFFNPVYLFDEGSTINWIPCGRKLTCSYPGIKFSYGPDTYFGQEVSVLEMDGQFDRLDELIYVESHLSNLSTKFYGEVTQQMLKHADFPGSNNGTGLFQTIVGLKIRDLYEQIIAERAGVPAEAAKV

SEQ ID NO: 752 - DNA, 1206 bp, Populus balsamifera subsp. trichocarpa
  misc_feature (1)..(1206): Ceres ANNOT ID no. 1500106
atggcagtttgcacggtatacactacgcagtccctcaattcaacttgctcaatctccaccccaacaaaaacccacttggggtttaaccaaagacatgtagtgttctatagcactaacaagaaaacaaccaagagggctagcagtgctgtgataacctgctcagctgacacacaaactgttgtgattggcctagcagcagactctgggtgtggtaagagtaccttcatgaggaggttaacaagtgtttttggaggtgcagcagagccaccaagaggtggcaatcctgactcgaacacactcataagcgacactacaactgtaatatgtttagacgattatcactcacttgataggactggaaggaaagagaagggtgtcactgcgcttgatccaagagccaacaactttgatctcatgtacgagcaagtaaaggctatcaaagatgggactgctgttgagaaaccaatttacaatcatgttacaggtctcttggatcctcctgagcttattaagcctcctaagattcttgtcattgaagggtatgaccaacgtgtgagggacctcttggacttcagtatctacttggacattagcaacgaggttaaatttgcatggaaaattcagagggatatggctgagcgaggacacagtcttgaaagcattaaagctagtattgaagcacgcaagccggattttgatgcttatattgatccacaaaagcaatatgctgatgctgtcattgaagtgctgccaacccaactcattccggacgacaacgaggggaaggttttaagagttaagctgatcatgaaagaaggggtggaatttttcagccctgtctacttgtttgatgaaggctcttctatttcatggatcccgtgtggtaggaagctcacctgctcttaccctggcatcaaattctcctatgggcccgacgcttactacggccatgaggtgtctgtactggaaatggatgggcaatttgacagattagatgagctcatctatgtcgaaagccatctaagtaacatctctaccaagttctatggagaagtcacccagcagatgttgaagcatgctgatttccccggcagcaacaacggaacaggtctcttccaaacaatcgtcggattgaaaataagagacctcttcgagcaaattgttgccagcagggccaaaaccccagttgaagccacaaaagcctaa

SEQ ID NO: 753 - protein, 401 aa, Populus balsamifera subsp. trichocarpa
  misc_feature (1)..(401): Ceres ANNOT ID no. 1500106
  misc_feature (1)..(401): Functional Homolog of  Ceres CLONE ID no.  339518
  misc_feature (61)..(256): Pfam Name: PRK Pfam Description: Phosphoribulokinase / Uridine kinase family
MAVCTVYTTQSLNSTCSISTPTKTHLGFNQRHVVFYSTNKKTTKRASSAVITCSADTQTVVIGLAADSGCGKSTFMRRLTSVFGGAAEPPRGGNPDSNTLISDTTTVICLDDYHSLDRTGRKEKGVTALDPRANNFDLMYEQVKAIKDGTAVEKPIYNHVTGLLDPPELIKPPKILVIEGYDQRVRDLLDFSIYLDISNEVKFAWKIQRDMAERGHSLESIKASIEARKPDFDAYIDPQKQYADAVIEVLPTQLIPDDNEGKVLRVKLIMKEGVEFFSPVYLFDEGSSISWIPCGRKLTCSYPGIKFSYGPDAYYGHEVSVLEMDGQFDRLDELIYVESHLSNISTKFYGEVTQQMLKHADFPGSNNGTGLFQTIVGLKIRDLFEQIVASRAKTPVEATKA

SEQ ID NO: 754 - DNA, 1218 bp, Populus balsamifera subsp. trichocarpa
  misc_feature (1)..(1218): Ceres ANNOT ID no. 1539024
atggcagtttgcactgtatacaccactcagtcccttaattcaacatgctcaatctccacgccaacaaaaacccgcttgggatttaaccaaaaacatttagtgttctatagcagtaacaagaaaacaagcaagagagctagcagtgcagtgataacctgctcagctgacacacagactgtagtaattggtctagctgcagactctgggtgtggtaaaagtaccttcatgaggaggttaacaagtgtttttggaggtgcagcggagccaccaaaaggtggaaatcctgactcaaacactctcataagtgacacaacaactgtgatatgtttagatgattatcactcacttgataggactggaaggaaagaaaagggtgtcacagcacttgacccaagagccaacgacttcgatctcatgtatgaccaagttaaggccattaaagatgggattgctgttgagaaacctatttacaatcatgttactggtctcttggatcctccagagcttattaagcctcctaagatccttgtcattgaaggtttgcatccaatgtatgaccaacgtgtgagagatcttttagacttcagtatctacttggacattagcaatgaggttaaatttgcatggaaaattcagagggatatggcagagcgaggacacagtctcgagagcattaaagctagtattgaagcacgcaagccagattttgatgcttatattgatccacaaaagcaatatgctgatgcagtcattgaagtgctgccaacccaactcattccagacgacaatgaagggaaggttttaagagttaggttgataatgaaagagggggtgaagtttttcagccctgtttatttgtttgatgaaggctctgctatttcatggataccatgtggtaggaagctcacctgctcttaccctggcatcaaattctcctatagccccgacacttattacggccacgaggtgtctatactggaaatggatgggcaatttgacagattagatgaactcatctatgtcgaaagccatctaagcaacctctccaccaagttctacggcgaagttacccaacaaatgttgaagcatgctgatttccccggcagcaacaatggaacaggtctcttccaaacaatcgtcggattgaaaataagagacctctttgagcaaatcattgccagcagggccaaaaccccagtagaagccacaaaagcctaa

SEQ ID NO: 755 - protein, 405 aa, Populus balsamifera subsp. trichocarpa
  misc_feature (1)..(405): Ceres ANNOT ID no. 1539024
  misc_feature (1)..(405): Functional Homolog of  Ceres CLONE ID no.  339518
  misc_feature (61)..(260): Pfam Name: PRK Pfam Description: Phosphoribulokinase / Uridine kinase family
MAVCTVYTTQSLNSTCSISTPTKTRLGFNQKHLVFYSSNKKTSKRASSAVITCSADTQTVVIGLAADSGCGKSTFMRRLTSVFGGAAEPPKGGNPDSNTLISDTTTVICLDDYHSLDRTGRKEKGVTALDPRANDFDLMYDQVKAIKDGIAVEKPIYNHVTGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDNEGKVLRVRLIMKEGVKFFSPVYLFDEGSAISWIPCGRKLTCSYPGIKFSYSPDTYYGHEVSILEMDGQFDRLDELIYVESHLSNLSTKFYGEVTQQMLKHADFPGSNNGTGLFQTIVGLKIRDLFEQIIASRAKTPVEATKA

SEQ ID NO: 756 - protein, 395 aa, Arabidopsis thaliana
  misc_feature (1)..(395): Public GI no. 23197622
  misc_feature (1)..(395): Functional Homolog of  Ceres CLONE ID no.  339518
  misc_feature (52)..(251): Pfam Name: PRK Pfam Description: Phosphoribulokinase / Uridine kinase family
MAVSTIYSTQALNSTHFLTSSSSSKQVFLYRRQPQTNRRFNTLITCAQETIVIGLAADSGCGKSTFMRRLTSVFGGAAKPPKGGNPDSNTLISDTTTVICLDDYHSLDRYGRKEQKVTALDPRANDFDLMYEQVKALKNGIAVEKPIYNHVTGLLDPPELIQPPKILVIEGLHPMFDERVRDLLDFSIYLDISNEVKFAWKIQRDMAERGHSLESIKASIEARKPDFDAFIDPQKQYADAVIEVLPTTLIPDDNEGKVLRVRLIMKEGVKYFSPVYLFDEGSTISWIPCGRKLTCSYPGIKFNYEPDSYFDHEVSVLEMDGQFDRLDELIYVESHLSNLSTKFYGEVTQQMLKHADFPGSNNGTGLFQTIVGLKIRDLYEQLIANKATARAEAKA

SEQ ID NO: 757 - protein, 395 aa, Arabidopsis thaliana; identical to SEQ ID NO: 756
  misc_feature (1)..(395): Ceres CLONE ID no. 11226
  misc_feature (1)..(395): Functional Homolog of  Ceres CLONE ID no.  339518
  misc_feature (52)..(251): Pfam Name: PRK Pfam Description: Phosphoribulokinase / Uridine kinase family

SEQ ID NO: 758 - protein, 402 aa, Spinacia oleracea
  misc_feature (1)..(402): Public GI no. 21279
  misc_feature (1)..(402): Functional Homolog of  Ceres CLONE ID no.  339518
  misc_feature (58)..(257): Pfam Name: PRK Pfam Description: Phosphoribulokinase / Uridine kinase family
MAVCTVYTIPTTTHLGSSFNQNNKQVFFNYKRSSSSNNTLFTTRPSYVITCSQQQTIVIGLAADSGCGKSTFMRRLTSVFGGAAEPPKGGNPDSNTLISDTTTVICLDDFHSLDRNGRKVEKVTALDPKANDFDLMYEQVKALKEGKAVDKPIYNHVSGLLDPPELIQPPKILVIEGLHPMYDARVRELLDFSIYLDISNEVKFAWKIQRDMKERGHSLESIKASIESRKPDFDAYIDPQKQHADVVIEVLPTELIPDDDEGKVLRVRMIQKEGVKFFNPVYLFDEGSTISWIPCGRKLTCSYPGIKFSYGPDTFYGNEVTVVEMDGMFDRLDELIYVESHLSNLSTKFYGEVTQQMLKHQNFPGSNNGTGFFQTIIGLKIRDLFEQLVASRSTATATAAKA

SEQ ID NO: 759 - DNA, 959 bp, Arabidopsis thaliana
  misc_feature (1)..(959): Ceres CLONE ID no.  34635
  misc_feature (1)..(959): GEMINI ID 553A7
aaaacaaaaagattaaacaaagagagaagaatatggcgagagggaagatccagatcaagaggatagagaaccagacaaacagacaagtgacgtattcaaagagaagaaatggtttattcaagaaagcacatgagctcacggttttgtgtgatgctagggtttcgattatcatgttctctagctccaacaagcttcatgagtatatcagccctaacaccacaacgaaggagatcgtagatctgtaccaaactatttctgatgtcgatgtttgggccactcaatatgagcgaatgcaagaaaccaagaggaaactgttggagacaaatagaaatctccggactcagatcaagcagaggctaggtgagtgtttgaacaagcttgacattcaggagctgcgtcgtcttgaggatgaaatggaaaacactttcaaactcgttcgcgagcgcaagttcaaatctcttgggaatcagatcgagaccaccaagaaaaagaacaaaagtcaacaagacatacaaaagaatctcatacatgagctggaactaagagctgaagatcctcactatggactagtagacaatggaggagattacgactcagttcttggataccaaatcgaagggtcacgtgcttacgctcttcgtttccaccagaaccatcaccactattaccccaaccatggccttcatgcaccctctgcctctgacatcattaccttccatcttcttgaataattaaaggctaaaaggtttgctggtgccatcattgtctatctaattatttagtaactacttaaaacataaggcatggtgttgctaaaaccttaaactgtcatgtttcttagttatgtattttaaagcctaaagaaatatggattgtgtgatcagtagtgcttaggcttattgtgtgtggaatgttttcaagacttttatcatgtatcgtattattatattgaccactcc

SEQ ID NO: 760 - protein, 232 aa, Arabidopsis thaliana
  misc_feature (1)..(232): Ceres CLONE ID no.  34635
  misc_feature (1)..(232): GEMINI ID 553A7
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MARGKIQIKRIENQTNRQVTYSKRRNGLFKKAHELTVLCDARVSIIMFSSSNKLHEYISPNTTTKEIVDLYQTISDVDVWATQYERMQETKRKLLETNRNLRTQIKQRLGECLNKLDIQELRRLEDEMENTFKLVRERKFKSLGNQIETTKKKNKSQQDIQKNLIHELELRAEDPHYGLVDNGGDYDSVLGYQIEGSRAYALRFHQNHHHYYPNHGLHAPSASDIITFHLLE

SEQ ID NO: 761 - protein, 231 aa, Arabidopsis lyrata
  misc_feature (1)..(231): Public GI no. 6707088
  misc_feature (1)..(231): Functional Homolog of  Ceres CLONE ID no.  34635
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
  misc_feature (163)..(163): Xaa is any aa, unknown, or other
MARGKIQIKRIENQTNRQVTYSMRRNGLFKKAHELTVLCDARVSIIMFSSSNKLHEYISPNTTTKEIVDLYQTVSDVDVWATQYERMQETKRKLLETNRNLRTQIKQRLGECLDELDIQELRRLEDEMENTFKLVRERKIKSLGNQIETTKKKNKSQQDIQKXLIHELELRAEDPHYGLVDNGGDYDSVLGYQIEGSRAYAFRFHQNHHHQYPNHALHAPSASDIITFHLL

SEQ ID NO: 762 - protein, 224 aa, Brassica rapa
  misc_feature (1)..(224): Public GI no. 48375197
  misc_feature (1)..(224): Functional Homolog of  Ceres CLONE ID no.  34635
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MARGKIQIKRIENQTNRQVTYSKRRNGLFKKAHELTVLCDARVSIIMFSSSNKLHEFISPNTTTKEIIDLYQTVSDVDVWSAHYERMQETKRKLLETNRNLRTQIKQRLGECLDELDIQELRSLEEEMENTFKLVRERKFKSLGNQIETTKKKNKSQQDIQKNLIHELELRAEDPHYGLVDNGGDYDSVLGYQLRFHQNHHHHYPNHALHAASASDIITFHLLE

SEQ ID NO: 763 - protein, 232 aa, Brassica oleracea
  misc_feature (1)..(232): Public GI no. 1561782
  misc_feature (1)..(232): Functional Homolog of  Ceres CLONE ID no.  34635
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MARGKIQIKRIENQTNRQVTYSKRRNGLFKKAHELTVLCDARVSIIMFSSSNKLHEFISPNTTTKEIIDLYQTVSDVDVWSAHYERMQETKRKLLETNRKLRTQIKQRLGECLDELDIQELRSLEEEMENTFKLVRERKFKSLGNQIETTKKKNKSQQDIQKNLIHELELRAEDPHYGLVDNGGDYDSVLGYQIEGSRAYALRYHQNHHHHYPNHALHAPSASDIITFHLLE

SEQ ID NO: 764 - DNA, 1090 bp, Gossypium hirsutum
  misc_feature (1)..(1090): Ceres CLONE ID no.1921942
accgattaggctttgcctttccatttttggtaaatggattccaccatctccttcatttcgtttcatttaaggtttaactccttgtttttttcttttccctcttcattttcacaactttccctgaaaaactagagataaaatcaatcatggctcgagggaagatccagatcaagctgatagagaactcgaccaacaggcaagtcacgtattcgaagagaagaaacggtcttttcaagaaagctaatgaacttacagttctttgcgatgctagagtttcgatcatcatgttttccactactggtaaactccatgagtttatcagcccttccaccacaacgaagcaagtaattgatcagtaccagaaaaccttggggatcgatatctggaacacccactatgagaaaatgcaagagcagttgaagcagctgaaagaggttaacaggaacctgcgcaaagagattaggagaaggatgggcgactgtttgaatgatttgagcattgaagatcttggtgctttggaacaagagatggagagctctgtcactcttattcgtgatagaaagtatcgtgttctctccaaccagatcgatacttccaggaaaaaggtgaggaatgtggaagagatacacaaaaatctcttacatgaactggaatccctgaaagaagatccatatggattagttgataatggaggggattatgataccctgatcgggtatcagaatggaggtcctcgtatatttgctttacgcctgcagccaaaccatcctagccttcacagtggcggaggctccgatctcaccacctatcccttgcttgattaaaatatctatctcgtgatgatttccgtatccataagctaagttcatgctgttaatcatataatattgctgtgaaagcaaaattggtgtgtactgttacttttactttaaaaattatcgtcacttctattatgtgcctatgttgtatcgtatctgttggagattatgtatttgatgatgatggaacattttcctgtttgtcgttttctaaatttctgtatttaaatcttatgttaaagatatattcggaaaaaaaaaaaaaaaaaaaa

SEQ ID NO: 765 - protein, 225 aa, Gossypium hirsutum
  misc_feature (1)..(225): Ceres CLONE ID no. 1921942
  misc_feature (1)..(225): Functional Homolog of  Ceres CLONE ID no.  34635
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MARGKIQIKLIENSTNRQVTYSKRRNGLFKKANELTVLCDARVSIIMFSTTGKLHEFISPSTTTKQVIDQYQKTLGIDIWNTHYEKMQEQLKQLKEVNRNLRKEIRRRMGDCLNDLSIEDLGALEQEMESSVTLIRDRKYRVLSNQIDTSRKKVRNVEEIHKNLLHELESLKEDPYGLVDNGGDYDTLIGYQNGGPRIFALRLQPNHPSLHSGGGSDLTTYPLLD

SEQ ID NO: 766 - protein, 227 aa, Nicotiana tabacum
  misc_feature (1)..(227): Public GI no. 1370276
  misc_feature (1)..(227): Functional Homolog of  Ceres CLONE ID no.  34635
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MARGKIQIKRIENQTNRQVTYSKRRNGLFKKANELTVLCDAKVSIIMISSTGKLHEFISPSVTTKQLFDLYQKTVGVDLWNSHYEKMQEQLRKLKDVNRNLRREIRQRMGESLNDLNYEQLEELNENVDNSLKLIRERKYKVIGNQIDTYKKKVRNVEEIHRNLLLEFDARQEDPYGLVEQEGDYNSVLGFPNGGPRILALRLQPNHQPNHHLHSGGGSDITTFALA

SEQ ID NO: 767 - protein, 231 aa, Petunia x hybrida
  misc_feature (1)..(231): Public GI no. 22665
  misc_feature (1)..(231): Functional Homolog of  Ceres CLONE ID no.  34635
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MARGKIQIKRIENQTNRQVTYSKRRNGLFKKANELTVLCDAKVSIIMISSTGKLHEFISPSITTKQLFDLYQKTVGVDLWNSHYEKMQEQLRKLKEVNRNLRKEIRQRMGESLNDLNYEQLEELMENVDNSLKLIRERKYKVIGNQIETFKKKVRNVEEIHRNLLLEFDARQEDPYGLVEQEGDYNSVLGFPNGGHRILALRLQPNHHQPNHHHHLHSGGGSDITTFALLE

SEQ ID NO: 768 - protein, 244 aa, Cucumis sativus
  misc_feature (1)..(244): Public GI no. 60858812
  misc_feature (1)..(244): Functional Homolog of  Ceres CLONE ID no.  34635
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MARGKIQIKRIENPTNRQVTYSKRRNGLLKKANELTVLCDAKVSIIMFSSTGKLHEYISPATSTKELFDQYQKTLGVDLWITHYERMQDNLKKLKDINRNLRRQIRQRMGECMNDLSFEELRCLEQDMDSAVRIIRERKYRVISNQIETHKKKLKSVGEIHKSLLQEFDIATEEDPHYGLVDNGGVGVGIGGGDYESIMGFSGAAHPRIFALRLQPNHTHNNHLNNIHLHHPPPSDLTTYPLLE

SEQ ID NO: 769 - protein, 228 aa, Misopates orontium
  misc_feature (1)..(228): Public GI no. 82734191
  misc_feature (1)..(228): Functional Homolog of  Ceres CLONE ID no.  34635
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MARGKIQIKRIENQTNRQVTYSKRRNGLFKKAHELSVLCDAKVSIIMISSTQKLHEYISPTTATKQLFDQYQKAVGVDLWSSHYEKMQEHLKKLNEVNRNLRREIRQRMGESLNDLGYEQIVNLIEDMDNSLKLIRERKYKVISNQIDTSKKKVRNVEEIHRNLVLEFDARREDPHFGLVENEGDYNSVLGFPNGGPRIIALQRLPNNHHPTLHSGGGSDLTTFALLE

SEQ ID NO: 770 - protein, 259 aa, Impatiens hawkeri
  misc_feature (1)..(259): Public GI no. 99109361
  misc_feature (1)..(259): Functional Homolog of  Ceres CLONE ID no.  34635
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MARGKIQIKRIENDTNRQVTYSKRRNGLFRKAGELTVLCDAKISILMFSSTSKLHEFISPSISAKQLFDQYQKTVGVDLWSSQYERMQEHLKKLKEGNRSLRTEIRQRMGDCLNELCYEQLVGLEQDMDSSLQRIRDRKFKVLGNQIETHRKKLRNVEQIHRNLLQEFDVREEDVVQVECGVGGLMENMNGHGGGGEYVGGGFHGFGGRSSTTSPRIFAVRTPAPASGNQMMRRSSINLQSSTTAAGVVGSDLTTYALL

SEQ ID NO: 771 - protein, 237 aa, Mimulus guttatus
  misc_feature (1)..(237): Public GI no. 42795301
  misc_feature (1)..(237): Functional Homolog of  Ceres CLONE ID no.  34635
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MARGKIQIKRIENQTNRQVTYSKRRNGLFKKAHELTVLCDAKVSILMISSTQKLHEYISPSITTKQMFDQYQKAVGVDVWNTHYERMQEHLKKLKDVNRNLRTEIRQRIGESLNDLGYEQMVNLIEEIDNSLTIIREKKYKAISSQIDTSKKKLRNVEEINRNLVLEFDARQEDPHYGLVENEGDYNSLLGFPNGGPRIIALRLPHNHHPHHHHHHHHPGLHSGGGGSDLTTFALLE

SEQ ID NO: 772 - protein, 228 aa, Lycopersicon esculentum
  misc_feature (1)..(228): Public GI no. 83999564
  misc_feature (1)..(228): Functional Homolog of  Ceres CLONE ID no.  34635
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MARGKIQIKKIENQTNRQVTYSKRRNGLFKKANELTVLCDAKVSIVMISSTGKLHEFISPSITTKQLFDLYQKTIGVDIWTTHYEKMQEQLRKLKDVNRNLRKEIRQRMGESLNDLNYEQLEELMENVDNSLKLIRERKFKVIGNQIETYRKKVRNVEEINRNLLLEFDARQEDPYGGLVEHDGDYNSVLGFPTGGPRILDLRLQPNNNYHNHLHSGGGSDITTFALG

SEQ ID NO: 773 - protein, 244 aa, Mimulus guttatus
  misc_feature (1)..(244): Public GI no. 42795285
  misc_feature (1)..(244): Functional Homolog of  Ceres CLONE ID no.  34635
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MARGKIQIKKIENQTNRQVTYSKRRNGLFKKAHELSVLCDAKVSIVMISSTQKLHEYISPSITTKQVFDQYQKAVGVDLWNTHYQKMQDHLQKLKEVNRNLRKEIRQRMGESLNDLGYDQMVNLIEEVDNSLGLIREKKYKVIGNRIETSKKKLRNVEEIHRSLVLEFDARQEDPHYGLVENEGDYNSVLGFPHGGPRIIALRLPPNHHQHQHHHHEQQHHQHHHPGLHSGGAGSDLTTFALLE

SEQ ID NO: 774 - protein, 237 aa, Mazus reptans
  misc_feature (1)..(237): Public GI no. 42795257
  misc_feature (1)..(237): Functional Homolog of  Ceres CLONE ID no.  34635
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MARGKIQIKKIENQTNRQVTYSKRRNGLFKKAHELTVLCDAKVSIIMISSTQKLHEYISPSITTKQMFDQYQKIAQVDVWQPHYEKMQEHLKKLKEVNRNLRREIMQRVGESVTDLSYDQIVNLIADIDNALKVIREKKYKTISGQIDTTKKKVRNVEEIHRGLVLEYEARHEDPHYGLVENEGDPYNSVLGFPSGGPRIVALHLPQHHHHHNHHHHHGGSFHSGGASDLTTFALLE

SEQ ID NO: 775 - protein, 214 aa, Magnolia praecocissima
  misc_feature (1)..(214): Public GI no. 16549070
  misc_feature (1)..(214): Functional Homolog of  Ceres CLONE ID no.  34635
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENSTNRQVTYSKRRGGIMKKAKELTVLCDAQVSLIMFSSTGKFSEYCSPSTTTKNIFDRYQQASGISLWNSHYERMQSHLIKLKEENNNLRREIRQRIGEDLEDLEIEELRGLEQNLESSIKVVRDRKYHVITTQTETYKKKLRSLRDEHAKLIRQLEGQAENGAYGLVDNGGPDYESALVLANGGVHSLHDTGFGIHDLRLA

SEQ ID NO: 776 - protein, 229 aa, Lotus japonicus
  misc_feature (1)..(229): Public GI no. 60100348
  misc_feature (1)..(229): Functional Homolog of  Ceres CLONE ID no.  34635
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MARGKIQIKRIENTTNRQVTYSKRRNGLFKKANELTVLCDAKVSIIMFSSTGKLHEYISPSTSTKQFFDQYQMTVGVDLWSSHYENMQENLKKLKEVNRNLRKEIRQRVGDCLNDLSMDELRLLEQEMDNAAKAVRERKYKVITNQIDTQRKKFNNEREVHNRLLRDLDARAENPPYELMDNGGEYESVIGFSNLGPRMFALSLQPSHPNVHNSGGGAGSDLTTYPLLF

SEQ ID NO: 777 - protein, 224 aa, Hieracium piloselloides
  misc_feature (1)..(224): Public GI no. 5825623
  misc_feature (1)..(224): Functional Homolog of  Ceres CLONE ID no.  34635
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MARGKIQIKKIENSTNRQVTYSKRRNGLFKKASELTVLCDAKVSIIMVSCTDKLHEYISPSTTTKQFFDQYQKAAGIDLWNSHYEKMQEELRQLKEVNKNLRRQIRQRLGDCLEHLGFEKLLDLEKESQEAVYIIRERKLKVIGNKLETSKKKVRSAQDVYKKLMHEFGIRGEDPQFGMIEDGEYDAVYGYPPQMSAPRILTFRLHPNNLHATASDLTTYALLG

SEQ ID NO: 778 - DNA, 1741 bp, Zea mays
  misc_feature (1)..(1741): Ceres CLONE ID no.  362438
  misc_feature (1)..(1741): GEMINI ID 539G8
ctctagcttcccactccgctcggccaccagctttgaccgcctcccctccgctccgctcccctccgctcctgttcctccataccccacccccgcaggagcggcgcggcggcggcggcaaaggcaaaggcaagatgttcgggcgcgcgccgaagaagagcgacaacaccaagtactacgagatcctcgggatgcccaagtcggcgtcccaggacgacctcaagaagacctaccgcaaggcagctatcaagaaccaccccgacaagggcggtgaccccgagaagctgttacatatgcatttccaccacattatttgcgaccggcacgagatcccccgccacgaaataaagaaggctcttgcaaaggcactgacgacagatcaactcttctacctaagagagcagtttacattattcggtccaaacaagagtggccatatatcattgcaaaatatgaagacgatgctttgtgaggatagaggtatcttcttggagatagctgactttattaaaggactcggattaaccatcttaaggggcgtcatggaggagcggtcttctgggcgatctcgtgggtttggctatgtaacattcgcatcagccgacgatgcaaagaatgttcttgattgcgagcatgttcttgggagccgtacattagaagtgaagatagctactccaaaggaagaaatgaaatcacaaggaacaaagaaagctacaaggatatttgttgctcgaattccacagtcagtggacgagtcgatgtttcgtaggcattttgaagcttttggagaaattcttgatctttacatgccaaaggaacatggttcaaaggggcatcgtggaattgggtttatcacgtttcagagtgcagagtctgtggacagcatcatgcaagagtcacatgagcttgatggcacaacagtagttgttgatcgcgcgactccgaaggaggaagatgtaagataccccccgagtagaccatctcagggtggctatggtgcatataacgcttacatttcagctgctaccaggtatgcaactttgggtgcaccaacactgtatgatcatcctggatcagcctatggaagagggtactatggatcctctcaagcagtgggcaagaagatatttgttggtagacttccacaagaagcaaacacggatgacctaagacattactttggcagatttggtcgaatcgtagatgcgtatattccaaaggaccccaaaagaagtggccaccgaggttttgggtttgtcaccttcgctgatgagggtgtggcagaacgggtatctcgtagaagccatgaaattctgggccatgaggttgcaatagacacagctgcaccacttgagaatgattcagctggtggtggttacattgatcccatggacctttacggagcttatggttcaatgagatcttttggcaggttctgcggtggtctagattataattacggctatggccccagcagcggaagcagcagatcaaggtcggattggcgataccgaccttactgaacgtgttttagtttacctctagggaaggaaactgaggagatggagaaaagaattacctgtctaagaatgctaagtgaggggggtaccttacgcgtggaatctatcattttgtttcatgttgtgattttggatttgtcgtgattcacattattgacaagatgaaggcagtccttgtagttactgtatggaagtgctgtatgtgtaataaaaaagtatcattt

SEQ ID NO: 779 - protein, 462 aa, Zea mays
  misc_feature (1)..(462): Ceres CLONE ID no.  362438
  misc_feature (1)..(462): GEMINI ID 539G8
  misc_feature (13)..(50): Pfam Name: DnaJ Pfam Description: DnaJ domain
  misc_feature (331)..(400): Pfam Name: RRM_1 Pfam Description: RNA recognition motif. (a.k.a. RRM, RBD, or RNP domain)
MFGRAPKKSDNTKYYEILGMPKSASQDDLKKTYRKAAIKNHPDKGGDPEKLLHMHFHHIICDRHEIPRHEIKKALAKALTTDQLFYLREQFTLFGPNKSGHISLQNMKTMLCEDRGIFLEIADFIKGLGLTILRGVMEERSSGRSRGFGYVTFASADDAKNVLDCEHVLGSRTLEVKIATPKEEMKSQGTKKATRIFVARIPQSVDESMFRRHFEAFGEILDLYMPKEHGSKGHRGIGFITFQSAESVDSIMQESHELDGTTVVVDRATPKEEDVRYPPSRPSQGGYGAYNAYISAATRYATLGAPTLYDHPGSAYGRGYYGSSQAVGKKIFVGRLPQEANTDDLRHYFGRFGRIVDAYIPKDPKRSGHRGFGFVTFADEGVAERVSRRSHEILGHEVAIDTAAPLENDSAGGGYIDPMDLYGAYGSMRSFGRFCGGLDYNYGYGPSSGSSRSRSDWRYRPY

SEQ ID NO: 780 - DNA, 1102 bp, Arabidopsis thaliana
  misc_feature (1)..(1102): Ceres CLONE ID no.  36370
  misc_feature (1)..(1102): GEMINI ID 535B5
aagcttcccaaagcgtttgttttatcctctcagagagctttctttagtgatggcggcgcttatccggtgttgctcctccttctctcatacttccggtggccaaccaccgccgcgtgacaagtctcgagctccagagattggaaaatttgctacatctattggctactcagtagtcagaaaacctggggatcatcctcctttctccaaaattatacattcgtcttcacagcctaaggagcgacaaggaaagggaatcttacaaacgccatttgccagtgtgggatctcttgacaagttttcagcttttgagggaattgggaggctcaaattaccggtgatggcagtgttgttgacaaactcccttcagatggctacacctcttgaagctttggctgctgagatatgtgagcctgagagctccatgttcagcatgcctattttgttgcttgttgctcttattggagccaccgttggagggttgcttgctcggcagaggaaaggggagttacagaggttgaatgaacaactacgacagattaacgcagctcttaggagacaagccaaaatcgagtcttatgcaccaagcttgagttatgctccagtgggagcaagaatcccagatagtgaaatcattgtggaaccaaagaaacaagagttgatttccaagttgaaaacaggaaaaacctttcttaggaaccaagaaccagagaaagcttatacagagttcaagatagctttggaacttgcccagagtctcaaagaccccaccgaagaaaagaaggctgcaagaggcctaggcgcctcgctgcagcgccaagggaagtatagggaagccatacagtatcactccatggttctagccatctcaaagagggaaagtgaagattctggaatcactgaagcatatggagctattgcagactgttataccgagctgggagatctcgagaaagctggaaagttctatgatacgtacattgctcggttagagactgactgatccttccgcaatgtttttttctttgttgtctgtttatgatcatgtaaaatcacatagaatggatatccaaatcccttttattgaatgtaattcgcttgtctt

SEQ ID NO: 781 - protein, 316 aa, Arabidopsis thaliana
  misc_feature (1)..(316): Ceres CLONE ID no.  36370
  misc_feature (1)..(316): GEMINI ID 535B5
  misc_feature (283)..(316): Pfam Name: TPR_2 Pfam Description: Tetratricopeptide repeat
MAALIRCCSSFSHTSGGQPPPRDKSRAPEIGKFATSIGYSVVRKPGDHPPFSKIIHSSSQPKERQGKGILQTPFASVGSLDKFSAFEGIGRLKLPVMAVLLTNSLQMATPLEALAAEICEPESSMFSMPILLLVALIGATVGGLLARQRKGELQRLNEQLRQINAALRRQAKIESYAPSLSYAPVGARIPDSEIIVEPKKQELISKLKTGKTFLRNQEPEKAYTEFKIALELAQSLKDPTEEKKAARGLGASLQRQGKYREAIQYHSMVLAISKRESEDSGITEAYGAIADCYTELGDLEKAGKFYDTYIARLETD

SEQ ID NO: 782 - protein, 316 aa, Arabidopsis thaliana; identical to SEQ ID NO: 781
  misc_feature (1)..(316): Public GI no. 18400278
  misc_feature (1)..(316): Functional Homolog of  Ceres CLONE ID no.  36370
  misc_feature (283)..(316): Pfam Name: TPR_2 Pfam Description: Tetratricopeptide repeat

SEQ ID NO: 783 - protein, 321 aa, Arabidopsis thaliana
  misc_feature (1)..(321): Public GI no. 9294636
  misc_feature (1)..(321): Functional Homolog of  Ceres CLONE ID no.  36370
  misc_feature (288)..(321): Pfam Name: TPR_2 Pfam Description: Tetratricopeptide repeat
MAALIRCCSSFSHTSGGQPPPRDKSRAPEIGKFATSIGYSVVRKPGDHPPFSKIIHSSSQPKERQGKGILQTPFASVGSLDKFSAFEIWMWQGIGRLKLPVMAVLLTNSLQMATPLEALAAEICEPESSMFSMPILLLVALIGATVGGLLARQRKGELQRLNEQLRQINAALRRQAKIESYAPSLSYAPVGARIPDSEIIVEPKKQELISKLKTGKTFLRNQEPEKAYTEFKIALELAQSLKDPTEEKKAARGLGASLQRQGKYREAIQYHSMVLAISKRESEDSGITEAYGAIADCYTELGDLEKAGKFYDTYIARLETD

SEQ ID NO: 784 - protein, 297 aa, Glycine max
  misc_feature (1)..(297): Ceres CLONE ID no. 627169
  misc_feature (1)..(297): Functional Homolog of  Ceres CLONE ID no.  36370
  misc_feature (264)..(297): Pfam Name: TPR_1 Pfam Description: Tetratricopeptide repeat
MVMLIRCSCFFARPRFSQPQFYGNNTKPLLPGKLAFLSLKPDKGVPHFEDTLDGSSKISCLLHCSKCKEDIHQRFPSLIFVASNVLMFSMPNTALAETCEADNSVFNMPILLAVALIGATVGGLLARQRRNELQRVNEQLIQINAALRKQAKIESYAPSLSYAPIGGGRILDNEIIVDPKKQELISKLKNGKNFLRNQQPDKAFTEFKNALELAQNLKDPIEEKKAARGLGASLQRQGKYRDAIKYHSMVLGISEREEEDSGSTEAFGAIADCYTELGELEKAGQFYDKYIARLEKD

SEQ ID NO: 785 - DNA, 1165 bp, Panicum virgatum
  misc_feature (1)..(1165): Ceres CLONE ID no.1724787
actccctatccagtttatcctctccctaatggcgcttcctctgcgccccgccgctccggcgccaccgccttggcgatgctccggcgtgagctcctcgccgcgcgcatccctcctggacacggcctccaagcaagcatttcctgttccattaccagctgaccgggttgcaagattttccttatctgcaaagcgttctgcatctcggcttgtccagtcaatgactgatctcaccggttttagaagtgatgggatccatgcagccaatgaacattcacgtgatctcatgaggtccatatctgatcttcaggaagttgtattatcctcttttgggaaagcatgtattttcggtagttgcatcatatatgttctgcctcctgcttgtttagcagaaccatgcgagcaagagtactctctccctaacatgcctttgctgtttgcaatagccatggttggtgctactgttggagggctcctcgcaagacagaggagaggggagcttgcacggctgaatgatcagttacgtcagataaatgctgcactgagaagacaagccaagattgaatcttacgctcctactttgagctatgccccagttggtagtaagataccagaatcagaagttattgttaatcctcagaaagagcgcctgattgcatatctgaggactgggaagaactacctgagaaaccaagctcctgacaaggcatttcctgagtttaaagcagctcttgatcttgcacaagctttaggtgatcatgttgaagagaagaaagcagcacgaggattaggggcatcattccagagacaaggcaagtacaaggaagccataaagtatcactccatggtcctaaacatctctaagatgaccggagaggatgcgggtgtcactgaagcatatggagcaatagcagactgctacaccgagcttggtgagcttgagaaggctggcgagttctacgacaaatacattgcaaggttggagagtgactgaaaagaagagcaccgatcagaaaatatgttagagcattgacaagtctaatggaatttctaccctttttcgcttgtcatgtagtttattgtagatttgcagttcccagctcgaattgagttttattaccaccatgcaagttctttttggcaggattaaaaaaaaaaaaaaaaaaaa

SEQ ID NO: 786 - protein, 320 aa, Panicum virgatum
  misc_feature (1)..(320): Ceres CLONE ID no. 1724787
  misc_feature (1)..(320): Functional Homolog of  Ceres CLONE ID no.  36370
  misc_feature (287)..(320): Pfam Name: TPR_1 Pfam Description: Tetratricopeptide repeat
MALPLRPAAPAPPPWRCSGVSSSPRASLLDTASKQAFPVPLPADRVARFSLSAKRSASRLVQSMTDLTGFRSDGIHAANEHSRDLMRSISDLQEVVLSSFGKACIFGSCIIYVLPPACLAEPCEQEYSLPNMPLLFAIAMVGATVGGLLARQRRGELARLNDQLRQINAALRRQAKIESYAPTLSYAPVGSKIPESEVIVNPQKERLIAYLRTGKNYLRNQAPDKAFPEFKAALDLAQALGDHVEEKKAARGLGASFQRQGKYKEAIKYHSMVLNISKMTGEDAGVTEAYGAIADCYTELGELEKAGEFYDKYIARLESD

SEQ ID NO: 787 - protein, 324 aa, Oryza sativa
  misc_feature (1)..(324): Public GI no. 34914598
  misc_feature (1)..(324): Functional Homolog of  Ceres CLONE ID no.  36370
  misc_feature (291)..(324): Pfam Name: TPR_1 Pfam Description: Tetratricopeptide repeat
MELLLRPSPPPPWAIPRRSSGERTKPCRSRSRSRTGTSKQTFPVPLLVGKVGRRPFPVQCSIVRCCLSSTDAIHSTSDDIHEDNGHGHFLMKSTSDLQKVISSCFGKACLLSSVMLVLPPSCFAEPCEPEYSLPNMPLLFAIAMIGATVGGLLARQRRGELKRLNDQLRQINAALRRQAKIESYAPSLSYAPVGSKIPESEVIVDPQKDRLISYLRAGKNYLRNQAPDKAFPEFKAAFDLAQSLGDHVEEKKAARGLGASLQRQGKYKEAIKYHSMVLNISKLTGEDAGVTEAYGAIADCYTELGELEKAGKFYDKYIARLEND

SEQ ID NO: 788 - protein, 319 aa, Zea mays
  misc_feature (1)..(319): Ceres CLONE ID no. 1397168
  misc_feature (1)..(319): Functional Homolog of  Ceres CLONE ID no.  36370
  misc_feature (286)..(319): Pfam Name: TPR_1 Pfam Description: Tetratricopeptide repeat
MALLLRLAAPSVPPRRSSGLRALPRVVLPEVVSKQSFLRLLVDSTASMPCPIKCSAARCAPSLTEHNDSRNNGIHASSVYGHDLMKSMSDLQEVVFSSFSKACLLSSCIIYGLPPSCIAEPCEQEYFLPNMPLLFAIAMVGATVGGLLARQRRGELARLNDQLRQINAALRRQAKIESYAPALSYAPVGSKIPESEVIVDPQKQRLIAYLRTGKNYLRNQAPDKAFPEFKAALDLARSLGDHVEEKKAARGLGASLQRQGKYKEAINYHSMVLNISKVTGEDAGVTEAYGAIADCYTELGELEKAGKFYDKYIARLENE

SEQ ID NO: 789 - DNA, 975 bp, Populus balsamifera subsp. trichocarpa
  misc_feature (1)..(975): Ceres ANNOT ID no. 1481678
atggcagtgataatccgctgcagctcttgcttctcttctccaccctcctccgatcacatcatctcccccaaaccccatcttccagctggaaaattggcctctcttctgtttagagcacggaagtttacaccatcatctggagatgcttcaagtatactatctgcttctcgccataagttgccaggcagcgaaagtgtgcacataaggcctgcatcagaagggcatctgaacactgttcaagtaccgcctgtttgtgacaaatttcttgaactattgtctgctcatcagggaaacatgcaattgagatcctcggcaatggcttttcttgttactaatgccttgatgtggactaccccttttgaagctctagctgaaacatgtgaggcagatagctctatcttcaacatgcctttgctgttatttgtggcccttgtaggggccactgttggagggttgcttgcacggcagaggaaaggggaattgcagcggctgaatgagcaattacgccagatcaatgcagctctaagaaggcaagccaagatcgagtcctatgcccccaccttgagctatgctcctgttggtagtagaatactagagagtgaagtgattgttgatccaaggaaggaggatttgatttctcgattgaaagttggaaagaattttttgcggaatcaagatccagagaaggcatttgtggagtttaagtcagctcttgagcttgctcagaacctgaaggatccaacagaggagaagaaggctgtaagaggtttaggagcctcactgcaaaggcagggtaaacttcaagaagctattaaatatcactcaatggttcttgcaatctccaagagagaaggagaggaatccggaaacacggaggcttatggagcaatagcggattgctacactgaacttggtgatctcgagcaagctgccaaattttatgacaaatatattgcaaggttggaaacagactga

SEQ ID NO: 790 - protein, 324 aa, Populus balsamifera subsp. trichocarpa
  misc_feature (1)..(324): Ceres ANNOT ID no. 1481678
  misc_feature (1)..(324): Functional Homolog of  Ceres CLONE ID no.  36370
  misc_feature (291)..(324): Pfam Name: TPR_1 Pfam Description: Tetratricopeptide repeat
MAVIIRCSSCFSSPPSSDHIISPKPHLPAGKLASLLFRARKFTPSSGDASSILSASRHKLPGSESVHIRPASEGHLNTVQVPPVCDKFLELLSAHQGNMQLRSSAMAFLVTNALMWTTPFEALAETCEADSSIFNMPLLLFVALVGATVGGLLARQRKGELQRLNEQLRQINAALRRQAKIESYAPTLSYAPVGSRILESEVIVDPRKEDLISRLKVGKNFLRNQDPEKAFVEFKSALELAQNLKDPTEEKKAVRGLGASLQRQGKLQEAIKYHSMVLAISKREGEESGNTEAYGAIADCYTELGDLEQAAKFYDKYIARLETD

SEQ ID NO: 791 - protein, 315 aa, Triticum aestivum
  misc_feature (1)..(315): Ceres CLONE ID no. 704527
  misc_feature (1)..(315): Functional Homolog of  Ceres CLONE ID no.  36370
  misc_feature (241)..(274): Pfam Name: TPR_2 Pfam Description: Tetratricopeptide repeat
MQAAASYRGAAGHRRAGHPSRRPPGPSLLLPVSVAGVGRFSDAAVPLRVGSLPLPRARGGGDFARLDARDGEAWQLTRALGLILPGHQKMVHANLLKTAVLSTMSMLIMPLEASAETCQPTSSFANMPIFIAVALIGAAVGGLLARQRKDELKRLNNQLRQINTALRRQAQIESFAPGLTYAPVGRAGEIEVIVDPRKQQLVVNLKNGKNYMRNQDLDKAVMEFKTALELAESIGDRFEEKKAARGLGASLQRLGQYREAMSWYYKVLALSKETGEDSGCTEAYGAIADCCVDLGDLEGAAKLYDEYISRLQPRD

SEQ ID NO: 792 - DNA, 1523 bp, Arabidopsis thaliana
  misc_feature (1)..(1523): Ceres CLONE ID no.  37739
  misc_feature (1)..(1523): GEMINI ID 554C4
acaaaacatttccataaccaaaaaacctcaaaataaaaaaatgagaactctcttaccttcccatactccggcaacggtaacaacggcggcgagaagaagacacgtcatacattgcgccggtaagagatctgactctttctccattaattccagtagctccgattggcaaagctcctgcgccattctctcaagcaaagttaactcacaagaacaatctgaatccttatcttccaattccaatggatcatcatcctaccacgtttccgccgtcaacggtcacaacaacggcgccggagtctcagatttgaatctagttccattcaacaacaaccaatcgattcaatcgaagaagcctttaagtatttcagatctatctccagctccgatgcatggatctaacctccgtgtagcttatcaaggtgttcccggagcttactccgaagccgccgctggtaaagcttatcctaactgtcaagcgattccttgcgatcaattcgaagttgcgtttcaagcggttgagctttggatcgccgatcgcgctgttttacccgtcgaaaactcactcggcggttcgattcatcgtaattacgatcttctcctccgtcaccgtcttcacatcgtcggcgaagttcagcttccggttcatcattgtctcatggctcttcccggtgtacggaaagagtttctcactcgtgtgatctctcatcctcaaggactagctcaatgcgaacacacgttgactaaactcggtctcaacgtagctcgtgaagctgttgatgataccgccggtgcggcggagtttatcgctgcgaataatatccgtgacaccgccgcgattgcgagtgcacgcgcggcggagatctacggattggagattttggaagatgggatacaagatgacgcgagtaacgtcacgcgctttgtgatgttggcgcgtgaaccgattataccgagaactgatcggccgtttaagacgagtatagtgtttgctcacgagaaaggcacgtgcgttttgtttaaggttctctctgcttttgcgtttaggaacattagtttgactaagattgagtctaggccgaaccataatgttcctattaggctagtcgatgaggctaatgtgggcacggctaagcattttgagtatatgttttatatcgacttcgaggcttccatggccgagtcacgtgctcagaatgcgctttctgaggttcaagagtttacgtcgtttttacgggttttggggagttatccgatggatatgacttcttggtcaccatcgtcttcgtcctcttcgtcatcaacattttcattgtgacaacactaagatcataaccaacgtgtgaagtcaattgtgtatgtaaattggagaagaaagttgtaaacataattttggtgaaaataaattacttatttctccaaagatcaatcttttgtattttgctgtttacattattatactttggagtttcgtttgatcgtagttttattatgaaattgcaagttttgagttgatttatttctcc

SEQ ID NO: 793 - protein, 424 aa, Arabidopsis thaliana
  misc_feature (1)..(424): Ceres CLONE ID no.  37739
  misc_feature (1)..(424): GEMINI ID 554C4
  misc_feature (123)..(302): Pfam Name: PDT Pfam Description: Prephenate dehydratase
MRTLLPSHTPATVTTAARRRHVIHCAGKRSDSFSINSSSSDWQSSCAILSSKVNSQEQSESLSSNSNGSSSYHVSAVNGHNNGAGVSDLNLVPFNNNQSIQSKKPLSISDLSPAPMHGSNLRVAYQGVPGAYSEAAAGKAYPNCQAIPCDQFEVAFQAVELWIADRAVLPVENSLGGSIHRNYDLLLRHRLHIVGEVQLPVHHCLMALPGVRKEFLTRVISHPQGLAQCEHTLTKLGLNVAREAVDDTAGAAEFIAANNIRDTAAIASARAAEIYGLEILEDGIQDDASNVTRFVMLAREPIIPRTDRPFKTSIVFAHEKGTCVLFKVLSAFAFRNISLTKIESRPNHNVPIRLVDEANVGTAKHFEYMFYIDFEASMAESRAQNALSEVQEFTSFLRVLGSYPMDMTSWSPSSSSSSSSTFSL

SEQ ID NO: 794 - protein, 413 aa, Arabidopsis thaliana
  misc_feature (1)..(413): Public GI no. 20259555
  misc_feature (1)..(413): Functional Homolog of  Ceres CLONE ID no.  37739
  misc_feature (118)..(297): Pfam Name: PDT Pfam Description: Prephenate dehydratase
MKALSSSSPILGASQPATATALIARSGRSEWQSSCAILTSKVISQEESESLPVPPVSGGVDHLNGHNSAAARVPGMNLVPIEKSDSNPLVPQHRHNPLKPLSMTDLSPAPMHGSNLRVAYQGVPGAYSEAAAGKAYPNCQAIPCDQFEVAFQAVELWIADRAVLPVENSLGGSIHRNYDLLLRHRLHIVGEVQLPVHHCLLALPGVRKEFLTRVISHPQGLAQCEHTLTKLGLNVAREAVDDTAGAAEFIASNNLRDTAAIASARAAEIYGLEILEDGIQDDVSNVTRFVMLAREPIIPRTDRPFKTSIVFAHEKGTSVLFKVLSAFAFRDISLTKIESRPNHNRPIRVVDDANVGTAKHFEYMFYVDFEASMAEARAQNALAEVQEFTSFLRVLGSYPMDMTPWSPTSSTSS

SEQ ID NO: 795 - DNA, 712 bp, Panicum virgatum
  misc_feature (1)..(712): Ceres CLONE ID no.1754197
aatcgcccggcgaatccatccggcgccgcgatggaggccgcgcccgccgtgctagacgccttcttcgccgggccgcgccaccaccagctccgtcccgccggagccgggggcggctgcagatccgcgcgcctgcaggcccagccgtgccgcgccgccgcccgcttcgccagcaactccggcggcggcggcggcaccagccccgacgccgccagcggcggcaggcagccggcgccgcgggtgaacgggcagaagccgccgcccgcgctggaggcggcgccggcgccggccccggcggagctggatctggtgcccgtctccaacctgccccggccgctgagcatcagcgacctgtccccggcgccgatgcacgggtcgcagctgcgcgtggcgtaccagggcgtcccgggcgcctacagcgaggcggcggccgccaaggcctacccgggctgcgacgccatcccctgcgaccagttcgaggtcgccttccaggccgtcgagctctggatcgccgaccgcgccgtgctccccgtcgaaaactcgctcggcggcagcatccaccgcaactacgacctcctcctccgccaccgcctccacatcgtcggcgaggtccagctccccgtccaccactgcctgctcgcgctccccggggtgcgccgggagctgctcacgcgcgtcatctcccacccgcaggcgctcgcgcagtgcgagctca

SEQ ID NO: 796 - protein, 425 aa, Panicum virgatum
  misc_feature (1)..(425): Ceres CLONE ID no. 1754197
  misc_feature (1)..(425): Functional Homolog of  Ceres CLONE ID no.  37739
  misc_feature (119)..(298): Pfam Name: PDT Pfam Description: Prephenate dehydratase
MEAAPAVLDAFFAGPRHHQLRPAGAGGGCRSARLQAQPCRAAARFASNSGGGGGTSPDAASGGRQPAPRVNGQKPPPALEAAPAPAPAELDLVPVSNLPRPLSISDLSPAPMHGSQLRVAYQGVPGAYSEAAAAKAYPGCDAIPCDQFEVAFQAVELWIADRAVLPVENSLGGSIHRNYDLLLRHRLHIVGEVQLPVHHCLLALPGVRRELLTRVISHPQALAQCELTLNAMGLNVAREAFDDTAGAAEHIAAAGLRDTAAIASARAAELYGLQVLADGIQDDAGNVTRFVMLAREPIIPRTDRPFKTSIVFTHDADGTSILFKVLSAFAFRDISLTKIESRPHRHRPIRLVDDANVGTAKHFEYMFYIDFQASMADVRAQNALAEIQEFTSFLRVLGSYPMDMTPWEAAPSSWSSRVDNSSSQH

SEQ ID NO: 797 - DNA, 1454 bp, Gossypium hirsutum
  misc_feature (1)..(1454): Ceres CLONE ID no.1856164
agcttgacgttcgcttcttcaagagaacaccaagcttatctccattccctctcctctttttgttcttttcttttctttttggtttttttgaaggaaacgctttatttatttatttatttattacgaaatacataaatatgcaggcggtttctcctacacaaaatcttaattcttctgtcattcgtccttccaagcctcgccggttccatcagttgactcgctcctttatccgttgcgtttatcacaatgactccgttcaattccctaatggagtcggtttaaaccgcgctgattggcagagctcttgcgctattctttctagcaaggtcttttcgcaagatcaaggttccggtgacaaatccactgctccttccaactcggaccaccttgctgccgccgtcaatggtcataaaacttccatagatcttaaccttgtccctattgaaacaaacaacaagcctcaaccacctacacagaaacccttaaccatcaccgacctctcccctgctccgatgcacggctctcagttgcgcgtggcttaccaaggagtccccggggcctactccgaagctgccgctgggaaagcttatcctaattgcgaagcgatcccttgtgaccagtttgaagtcgcattccaagcggttgagctttggatcgccgatcgagctgttttaccggtggagaactcactaggaggttccattcatcggaactacgatctcctcctccgacaccgactccacatcgtcggcgaagtccaactcccagtgcaccactgtttattagctctcccaggtgttaggaaagaataccttgcacgagtcatttctcatccacaagctctctcccagtgtgaacacacgctcaccaaactcggactcaacgtcacgcgtgaagctgtcgatgacaccgccggagccgcggagtacatagcggccaacaaccttcgtgacaccgccgccatagcaagcgcacgcgccgctgaactttatggacttcaaatcctagccgatggtatccaagacgattcgagtaatgtgacgcgcttcgttatgttagctcgggagccaatcatccctcgcacggaccggccattcaaaacgagcatcgtattcgcgcacgataaagggacgagcgtgcttttcaaagtactatcagcttttgcgtttaggaatatcagtttgacgaaaatcgaatcccggccacaccgcaataggccgatccggttggtagatgacgccaacgttggaaccgccaagcatttcgagtatatgttctacgtggatttcgaagcgtcgatggcagaggttagagcccaaaacgcgttggctgaggtccaggagttcacttctttcttgagggtattgggcagttacccaatggatatgacgccttggtgcccttccagcggagattaacaaaacctatgaaagtaaaaaaaaaaaaaaaaaaaa

SEQ ID NO: 798 - protein, 426 aa, Gossypium hirsutum
  misc_feature (1)..(426): Ceres CLONE ID no. 1856164
  misc_feature (1)..(426): Functional Homolog of  Ceres CLONE ID no.  37739
  misc_feature (133)..(312): Pfam Name: PDT Pfam Description: Prephenate dehydratase
MQAVSPTQNLNSSVIRPSKPRRFHQLTRSFIRCVYHNDSVQFPNGVGLNRADWQSSCAILSSKVFSQDQGSGDKSTAPSNSDHLAAAVNGHKTSIDLNLVPIETNNKPQPPTQKPLTITDLSPAPMHGSQLRVAYQGVPGAYSEAAAGKAYPNCEAIPCDQFEVAFQAVELWIADRAVLPVENSLGGSIHRNYDLLLRHRLHIVGEVQLPVHHCLLALPGVRKEYLARVISHPQALSQCEHTLTKLGLNVTREAVDDTAGAAEYIAANNLRDTAAIASARAAELYGLQILADGIQDDSSNVTRFVMLAREPIIPRTDRPFKTSIVFAHDKGTSVLFKVLSAFAFRNISLTKIESRPHRNRPIRLVDDANVGTAKHFEYMFYVDFEASMAEVRAQNALAEVQEFTSFLRVLGSYPMDMTPWCPSSGD

SEQ ID NO: 799 - DNA, 1335 bp, Populus balsamifera subsp. trichocarpa
  misc_feature (1)..(1335): Ceres ANNOT ID no. 1488340
atgcagtcgctatctcctccatctccaatcaagtccctgatccggccacggcctcgggtcatccgagggagtcccaacaaactcgccctccaatgcatctaccgttccgactcggtatctttcccgaacggcgtcggttcgaacagggcagattggcaaagttcctgttctatactagcaagcaaagtggtagctcaacaacagccaaccgataaatctagtagaagtggcgatgttgacggtggagcagatcacgtggctgcagttaacggccacaagacatctatggacttaaaccttgtcccgatagaaaaaaccgcgagctcgaacagcaacagcagcatcaagcctcatcagcctcaaaaaccgttaacgataactgacttatgtcctgcccctatgcatgggtcccatctccgagtcgcgtaccaaggagttccaggcgcgtactctgaagctgctgcaggaaaagcttaccccaactgtgaagcgattccttgtgaccagtttgaggttgcttttcaagctgtcgagctttggatagccgatcgtgctgttttacctgtcgaaaactcactcggtgggtctattcaccggaattatgaccttctcctccgtcaccgactccatatagtaggtgaggttcagttaccggtccaccactgcctccttgccctccctggagtccgaaaggagtatattaaccgcgtcatttcgcacccacaagctcttgctcaatgcgaattgacgctgaccaaactcggtctccaggctgcgcgtgaggccgtggatgatacagcaggtgctgctgagtatattgctgccaacaacctccgtgacacggcggcgattgctagtgcacgcgctgcggagctttatgggatgcaggtgcttgctgatgggatccaagacgattcaagtaatgtcacccgctttgttatgttggcgcgtgagccgattataccgagaacggacaggccgtttaagacgagcatcgtgttcgctcatgataaagggacgagtgtgctgttcaaggtgctttcagcttttgcgtttagaaacatcagtttgacgaagattgaatcaaggccgcataggaaccgtccgattaggttagttgatgatgggaatgtggggacagcaaagcattttgagtacatgttttatattgattttgaagcatccatggctgaggttagagcacagaatgcattggctgaggttcaagaattcacatcattcttgagggtgttagggagctatcccatggacatgacaccttggtgtccatcaagaggagaggatgatgatgatgatgagaaaaacccattttaa

SEQ ID NO: 800 - protein, 444 aa, Populus balsamifera subsp. trichocarpa
  misc_feature (1)..(444): Ceres ANNOT ID no. 1488340
  misc_feature (1)..(444): Functional Homolog of  Ceres CLONE ID no.  37739
  misc_feature (141)..(320): Pfam Name: PDT Pfam Description: Prephenate dehydratase
MQSLSPPSPIKSLIRPRPRVIRGSPNKLALQCIYRSDSVSFPNGVGSNRADWQSSCSILASKVVAQQQPTDKSSRSGDVDGGADHVAAVNGHKTSMDLNLVPIEKTASSNSNSSIKPHQPQKPLTITDLCPAPMHGSHLRVAYQGVPGAYSEAAAGKAYPNCEAIPCDQFEVAFQAVELWIADRAVLPVENSLGGSIHRNYDLLLRHRLHIVGEVQLPVHHCLLALPGVRKEYINRVISHPQALAQCELTLTKLGLQAAREAVDDTAGAAEYIAANNLRDTAAIASARAAELYGMQVLADGIQDDSSNVTRFVMLAREPIIPRTDRPFKTSIVFAHDKGTSVLFKVLSAFAFRNISLTKIESRPHRNRPIRLVDDGNVGTAKHFEYMFYIDFEASMAEVRAQNALAEVQEFTSFLRVLGSYPMDMTPWCPSRGEDDDDDEKNPF

SEQ ID NO: 801 - DNA, 1435 bp, Gossypium hirsutum
  misc_feature (1)..(1435): Ceres CLONE ID no.1807870
tttaacgctttcctttccttcgtctttcctttgctttcctctgtgtgatttttaataaaagggaaacgagaaggaaaaatgcaggcaatttctcaagtgcaaaatcttaattcgtaccttataattcgccggtcgaagcctcggtttgataagccggttcggttagctgtacctgtacgttgtgtgtatcactctgattcagttccattccccaatggagtccgttcaagccgggtggattggcaaagctcgtgtgctattttgtctagcaaagtcttctctcaggatcaagattccggtgagaaatcgaacacttcctccgcctccgatcacctggcggcggcagttaacggccataaaacttccttggatctgaacttagttccgctagataagaagaacaagcctcagccacctgctaaacagcctccacagaagccgttaactattaccgatttgtctcctgctccgaagcacggttctcagttgcgtgtggcttatcaaggagttcccggtgcttactcggaagctgcggcggggaaagcttatccaaattgtgaagctattccttgtgaccagtttgaagttgcgtttcaagcggttgagctttggattgctgatcgagctgttttaccggtggaaaattcactcggaggttcgattcatcggaactatgatcttctcctccgtcaccgactccatatcgtcggtgaagttcaattacctgtccatcactgtcttttagctctcccgggagttaggacagagtatttgacgcgcgtcatttctcatccacaagctctgtcacagtgtgaaaacactatcaccaaactcggcctcaacgtcacgcgcgaagcagtcgacgatacagccggagccgccgaatatatcgcgacgaacaacctccgtgacacagcagccatagcgagcgcacgcgccgccgaactctacggactcaacgtcctcgccgacgggatccaagacgattcaagcaatgtcacgcgcttcgttattttagctcgtgatccgatcattccacgcacggaccggccgttcaaaacgagcatcgtcttcgcacacgaagaaggaaccagcgtgcttttcaaagtgttgtcggcgttcgcgtttaggaacatcagtttgacgaagatcgagtcacggccacaccgtaaccggcctatccggctagtcgacgacgccaatgtaggaaccgcgaagcatttcgaatacatgttttacgtggatttcgaagcgtcaatggcggaggtcagagctcaaaacgcgttggcggaggttcaagaatttacctctttcttgagggtattaggcagttacccaatggatatgacgccttggtgcccatccagttgaaacccatgaaaataaaaaataagaaaaaacaaaataatatgcacaaaaaaaaaaaaaaaaaaaa

SEQ ID NO: 802 - protein, 430 aa, Gossypium hirsutum
  misc_feature (1)..(430): Ceres CLONE ID no. 1807870
  misc_feature (1)..(430): Functional Homolog of  Ceres CLONE ID no.  37739
  misc_feature (139)..(318): Pfam Name: PDT Pfam Description: Prephenate dehydratase
MQAISQVQNLNSYLIIRRSKPRFDKPVRLAVPVRCVYHSDSVPFPNGVRSSRVDWQSSCAILSSKVFSQDQDSGEKSNTSSASDHLAAAVNGHKTSLDLNLVPLDKKNKPQPPAKQPPQKPLTITDLSPAPKHGSQLRVAYQGVPGAYSEAAAGKAYPNCEAIPCDQFEVAFQAVELWIADRAVLPVENSLGGSIHRNYDLLLRHRLHIVGEVQLPVHHCLLALPGVRTEYLTRVISHPQALSQCENTITKLGLNVTREAVDDTAGAAEYIATNNLRDTAAIASARAAELYGLNVLADGIQDDSSNVTRFVILARDPIIPRTDRPFKTSIVFAHEEGTSVLFKVLSAFAFRNISLTKIESRPHRNRPIRLVDDANVGTAKHFEYMFYVDFEASMAEVRAQNALAEVQEFTSFLRVLGSYPMDMTPWCPSS

SEQ ID NO: 803 - protein, 443 aa, Ipomoea trifida
  misc_feature (1)..(443): Public GI no. 45935145
  misc_feature (1)..(443): Functional Homolog of  Ceres CLONE ID no.  37739
  misc_feature (150)..(329): Pfam Name: PDT Pfam Description: Prephenate dehydratase
MQSLTSSSGINLKSLTRASSPPGFTHRVGSNRLAVQCAFRFDSANANGAAAAAAANSSSTVNTNSAPSGNFGGHIGATRADWQSSCSILASKVVSQQQDVQKSGGDAGNITAVNGHMTTLDLVPIESSLPKPLTITDLSPAPMHGSTLRVAYQGVPGAYSEAAAGKAYPNCEAIPCDQFEVAFQAVELWIADRAVLPVENSLGGSIHRNYDLLLRHRLHIVGEVQLPVHHCLLALPGVRKEYLTRVISHPQALAQCELTLTKLGLNVAREAVDDTAGAAEYIAANNLRDTAAIASARAAELYGLHVLEEGIQDDSSNVTRFVMLAREPIIPRTDRPFKTSIVFAHDKGTSVLFKVLSAFAFRNISLTKIESRPHRNRPIRLVDDENVGTAKHFEYMFYVDFEASMADVRAQNALAEVQEFTSFLRVLGSYPMDMTPWSPSRGD

SEQ ID NO: 804 - protein, 424 aa, Zea mays
  misc_feature (1)..(424): Ceres CLONE ID no. 383227
  misc_feature (1)..(424): Functional Homolog of  Ceres CLONE ID no.  37739
  misc_feature (118)..(297): Pfam Name: PDT Pfam Description: Prephenate dehydratase
  misc_feature (350)..(350): Xaa is any aa, unknown, or other
MAAAGITRAPPIGQNPRLACYAPRRGGGVVRCSLQGAVVGGRAEWQSSCAVLSSKVAALGTHSVNGHVAPAPTQNGAVLDLVPVSSSSINGAITKNLPQPLRIADLSPAPMHGSQLRVAYQGVPGAYSEKAAGKAYPGCDAIPCDQFEVAFQAVELWIADRAVLPVENSLGGSIHRNYDLLLRHRLHIVGEVQLPVHHCLLALPGVRKECLTRVISHPQALAQCEHTLTAMGLNVVREAFDDTAGAAEYVAANGLRDTAAIASSRAAELYGMEVLADGIQDDSGNVTRFVMLAREPVVPRTDRPFKTSIVFAHDREGTSVLFKVLSAFAFRDISLTKIESRPHRHRPIRXVDDANVGTAKHFEYMFYVDFQASLAEPRAQNALAEVQEYTSFLRVLGSYPMDMTPMTAGSSSTVVSSSDDPSSS

SEQ ID NO: 805 - protein, 419 aa, Oryza sativa
  misc_feature (1)..(419): Public GI no. 70664005
  misc_feature (1)..(419): Functional Homolog of  Ceres CLONE ID no.  37739
  misc_feature (115)..(294): Pfam Name: PDT Pfam Description: Prephenate dehydratase
MGAGRSSGGGGVVRCSLQGAVVGGRAEWQSSCAVLSSKVAALGAASPHAAAPSFVNGHVAPLVPEQQAAAEDGGAVLDLVPVSSVNGGGVAKNLPQPLRISDLSPAPMHGSQLRVAYQGVPGAYSEKAAGKAYPGCDAIPCDQFEVAFSAVELWIADRAVLPVENSLGGSIHRNYDLLLRHRLHIVGEVQLPVHHCLMALPGVRKECLTRVMSHPQALAQCEHTLTAMGLNVVREAFDDTAGAAEYVAANGLRDTAAIASSRAAELYGMEVLADGIQDDCGNVTRFVMLAREPIVPRTDRPFKTSIVFAHDKEGTSVLFKVLSAFAFRDITLTKIESRPHRHRPIRLVDDANVGTAKHFEYMFYVDFQASLAEPRAQNALAEVQEYTSFLRVLGSYPMDMTPMTAGSSSTVTSDDSSST

SEQ ID NO: 806 - protein, 416 aa, Triticum aestivum
  misc_feature (1)..(416): Ceres CLONE ID no. 909699
  misc_feature (1)..(416): Functional Homolog of  Ceres CLONE ID no.  37739
  misc_feature (115)..(295): Pfam Name: PDT Pfam Description: Prephenate dehydratase
MAVVNFVKPHIGQSPKLQGRTPRRGSGVVRSSLQGAVVGNRAEWLTSCAVLSSKVAALAPHSTNGHLALAVAASNGAVLDLVPVKTVDGSARSLPAPLRIADLSPAPMHGSELRVAYQGVPGAYSEKASAKAYPGSDAIPCDQFEVAFQAVENWVADRAVLPVENSLGGSIHRNYDLLLRHRLHIVGEVQLPVHHCLLALPGVRREDITRVISHPQALAQCEHTLTRMPGLNAAREAFDDTAGAAEYVAANGLRDTAAIASSRAAELYGMEVLADGIQDDSGNVTRFVMLAREPIVPRMDRPFKTSIVFAHDKEGTSVLFKVLSAFAFRDISLTKIESRPHRPIRLADSSTAPKQFEYMFYVDFQASLADPRVQNALAEVQEFTSFLRVLGSYPMDMTPMAAGVASSESSSAYSSS

SEQ ID NO: 807 - DNA, 1355 bp, Arabidopsis thaliana
  misc_feature (1)..(1355): Ceres CLONE ID no.  37980
  misc_feature (1)..(1355): GEMINI ID 532H8
aactctcttctcttctctagtcttgtcttctattatgcaaaaggtcttcttggccatggatacttgtgctctagtaatccatcagtctctgtctcgcatcaaactttctcctcccaaatcttcttcttcttcttcttcttctgctttctcccctgaatccttaccgatcagacggatcgagctgtgtttccgaggagctatatgtgccgccgtacaaagaaactacgaagaaacgacctcctccgtggaagaggcagaggaagatgatgagtcatcatcatcgtacggagaagtgaacaagatcattggaagccgaacggcgggggaaggagccatggagtaccttatcgagtggaaggacggccattctccgtcgtgggttccatcgagctacatcgcagcagacgtagtgtcggagtacgagacaccctggtggacggcagctagaaaagccgacgagcaggccctgtcacagctcctggaggaccgagacgtcgatgccgtggacgaaagcggccggacggctctgcttttcgtggcaggtctggggtcggacaagtgcgtaaggcttctggcggaggctggagccgatctcgaccaccgagacatgaggggaggcttgacggcgctgcacatggcggctggttacgtgaggccggaggtggtggaggcgctggtggagctgggagctgatattgaagtggaagacgagagagggttaacggcgttggaactagcgagggagattctgaagacgacgccgaaggggaatccgatgcagttcgggaggagaattgggttagagaaagtgatcaatgtcctggaaggacaagtgttcgagtacgccgaggtggatgagatcgtagagaaacgagggaaaggcaaagacgttgaatatctggtcagatggaaggacggtggagattgcgagtgggtgaaaggtgtacacgtggcggaagatgtggctaaggactacgaggatgggctggagtacgctgtagcggagagtgtgatcgggaagagggtgggagacgatgggaagaccatcgagtatcttgtcaaatggactgatatgtctgatgccacttgggagcctcaggacaatgtcgactctactcttgttctactctaccaacaacaacaaccaataaatgaatgattgattttgatgattacattcttctcaatttgcttctttctcatatgtgttggttcatctgaccggttcggttggtacgtaccggtacattttcattttcttttaagatgtgatcttgatggtttttggccttttggggacactatttgattttatatccatgctttgaattttgcttccctttttggggagattc

SEQ ID NO: 808 - protein, 374 aa, Arabidopsis thaliana
  misc_feature (1)..(374): Ceres CLONE ID no.  37980
  misc_feature (1)..(374): GEMINI ID 532H8
  misc_feature (194)..(226): Pfam Name: Ank Pfam Description: Ankyrin repeat
  misc_feature (321)..(369): Pfam Name: Chromo Pfam Description: 'chromo' (CHRromatin Organisation MOdifier) domain
MQKVFLAMDTCALVIHQSLSRIKLSPPKSSSSSSSSAFSPESLPIRRIELCFRGAICAAVQRNYEETTSSVEEAEEDDESSSSYGEVNKIIGSRTAGEGAMEYLIEWKDGHSPSWVPSSYIAADVVSEYETPWWTAARKADEQALSQLLEDRDVDAVDESGRTALLFVAGLGSDKCVRLLAEAGADLDHRDMRGGLTALHMAAGYVRPEVVEALVELGADIEVEDERGLTALELAREILKTTPKGNPMQFGRRIGLEKVINVLEGQVFEYAEVDEIVEKRGKGKDVEYLVRWKDGGDCEWVKGVHVAEDVAKDYEDGLEYAVAESVIGKRVGDDGKTIEYLVKWTDMSDATWEPQDNVDSTLVLLYQQQQPINE

SEQ ID NO: 809 - protein, 382 aa, Glycine max
  misc_feature (1)..(382): Ceres CLONE ID no. 630887
  misc_feature (1)..(382): Functional Homolog of  Ceres CLONE ID no.  37980
  misc_feature (151)..(183): Pfam Name: Ank Pfam Description: Ankyrin repeat
  misc_feature (312)..(359): Pfam Name: Chromo Pfam Description: 'chromo' (CHRromatin Organisation MOdifier) domain
MEAIFVTKPASHSLLLTKLSPNPKHLFPPHQQSFHNIRHKPTRFRPVIAVFQNQHQQDAAAASNHTEDESYGEVKGIIGSRALEAATGMEYLIEWNDGHAPSWVPADFIAKDVVAEYETPWWTAAKKADESALKNLIESDDGRDVDAVDADGRTALLFVAGLGSESCVKLLAEAGANLDHRDRSGGLAALHMAAGYVRPGVAKVLLDLGADPEVADDRGRTALDLAREILKVTPKGNPMQFGRRIGLEGVIRVLEGAVFEYAEVQEILERRGKGENLEYLVRWKDGGANEWVKAKFVAEDLVKDYEAGLEYAVAEAVLAKRVADEGTPEFLVKWADLEEPTWEPEENVDPELVKAFEGSNNQAQPSSNGPAVVFSNQDSPSL

SEQ ID NO: 810 - DNA, 1143 bp, Populus balsamifera subsp. trichocarpa
  misc_feature (1)..(1143): Ceres ANNOT ID no. 1460561
atggactctctctttgttaaccaagctctttcacgcctcaagctctctccaaaactcacaatcccttcttacttttcctatcaatctcctttacacctcaaacaaaaccatggtagaaaaccctacaattccttcacactctttgctatccaagaccaacaagaaacacaaaacccacttcaagaaaccactcaaaacatcgaagacgacgagtcgtatggagaagtcagcaagatcatcggaagcagagcagttgaaggtggtaaaggcatggagtacttcattgagtggaaagacggccatacgccctcgtgggtcccatcagatttcatagctaaagatgtggtggccgagtacgagacgccatggtggacagcagccaagaaggccgactcgtcggctcttagtcagattctatcggagaatgaagatgaacgacgtgatgttaatgctgtggatagtgacggacgcacagctttgctttttgtatctgggctcggctctgagccgtgtgttaagctcctagccgaagctggagctgaactggatcatagagacaacagtggtggcctgacggctcttcatatggcagctggctatgttaagccaggtgtcgttaagttattggttgacctaggtgctgatcctgaggtgaaggatgatagaggattaactcccttggatttggccaaggaaattttaagagtgaccccaaaagggaacccaatgcaattcgggagaagattggggttagaaagtgtaataagaaacttagaggagggaatattcgagtacgctgaggtacaggaaatactggagaaaagagggaaagggaaggacttggagtatttggtaaaatggaaggatggcagtgataatgagtgggtgaaagcaaagtttataggggaggatttggtgatggattttgaggcagggttagagtatgccgtggcaaagggagtggtgggtaagaggctaggtgatgatgggaagaatgagtatcttgtgaaatggacggatattgatgaggccacgtgggagcctgaagagaatgttgatcttgatttgatcaaggagtttgaggagggacagatcaatggagttggaagtgttgaggcccagttgactagtgatgggctataa

SEQ ID NO: 811 - protein, 380 aa, Populus balsamifera subsp. trichocarpa
  misc_feature (1)..(380): Ceres ANNOT ID no. 1460561
  misc_feature (1)..(380): Functional Homolog of  Ceres CLONE ID no.  37980
  misc_feature (189)..(221): Pfam Name: Ank Pfam Description: Ankyrin repeat
  misc_feature (315)..(363): Pfam Name: Chromo Pfam Description: 'chromo' (CHRromatin Organisation MOdifier) domain
MDSLFVNQALSRLKLSPKLTIPSYFSYQSPLHLKQNHGRKPYNSFTLFAIQDQQETQNPLQETTQNIEDDESYGEVSKIIGSRAVEGGKGMEYFIEWKDGHTPSWVPSDFIAKDVVAEYETPWWTAAKKADSSALSQILSENEDERRDVNAVDSDGRTALLFVSGLGSEPCVKLLAEAGAELDHRDNSGGLTALHMAAGYVKPGVVKLLVDLGADPEVKDDRGLTPLDLAKEILRVTPKGNPMQFGRRLGLESVIRNLEEGIFEYAEVQEILEKRGKGKDLEYLVKWKDGSDNEWVKAKFIGEDLVMDFEAGLEYAVAKGVVGKRLGDDGKNEYLVKWTDIDEATWEPEENVDLDLIKEFEEGQINGVGSVEAQLTSDGL

SEQ ID NO: 812 - protein, 388 aa, Oryza sativa
  misc_feature (1)..(388): Public GI no. 50919643
  misc_feature (1)..(388): Functional Homolog of  Ceres CLONE ID no.  37980
  misc_feature (194)..(226): Pfam Name: Ank Pfam Description: Ankyrin repeat
  misc_feature (321)..(370): Pfam Name: Chromo Pfam Description: 'chromo' (CHRromatin Organisation MOdifier) domain
MEAVLRHPSLSRLKPPNPNAQRTPALSITVPFRLRLPNRRLTAAAVFQDQTNPRNPASKGGDDDEAYGEVDRIVSSRTIKNPVFAEDGSATTVTATEYLVEWKDGHEPSWIPAEAIAADVVAEYETPWWTAAKKADAAEITALLADETLRRDPDAEDAQGRTAMHFAAGLGSEECVRALAEAGADVGRPERAGGGLTPLHIAVGYGRPAAVRALLELGAEPEAPDGQGRTPLELVQDVLAKTPKGNPATFERRLALEAAAKELEKAVYEWGEVEKVVDGRGEGKWREYLVEWRDGGDREWVRAAWVAEDLVKDFDAGLEYAVAEAVVNKREAAEGEGKWEYLVKWVDIEEATWEPAENVDAELLQEFEQRQSGVAAGGDAPPPPPVAG

SEQ ID NO: 813 - DNA, 1252 bp, Arabidopsis thaliana
  misc_feature (1)..(1252): Ceres CLONE ID no.  382267
aagctctctcatccagctaactaatggaagtagctagcaaacgtacgtattcttcttcaccatctgtttcttggggaaattaaaccccagtacgcgtacgtcacaatcgcgcgcaatggagaaggagaaggagaagtccagggccaggccgtcgaggggccactggcggcccggcgaggacgacaagctgcggcagctcgtcgacaagtacggcccgcggaactggaactccattgctgagagtctggaggggagatcaggcaagagctgccggctacgatggttcaaccagcttgacccgcggatcaaccggcggcccttcacggtggcggaggaggagctgctcctgcgggcgcaccgcgcccacggcaaccgctgggcgatcatctcccgcctcttcccgggccgcaccgacaacgccgtcaagaaccactggcacgtcgtcatggcgcgccgccgccgccgtaccctcgtcggcgaggccgcagccatcggctctgtcgttgtaccgcctcgtcatcagtacttccattttggaagctgctcgccgccgccgccgacccgctcgctgtgcttcgcggtgcctgcaggtttcggtccgctcggactcagcagaccagctgcaagttgcggtgtcaggaactgcaatgtgcccactgccgtcgcattactggacgacggccatcgtcatgacatgagcaaagaccttggtggcgacgatgacaatggcggtgatgcgcttgcaaagaggaaggacgtgcaattcttcgacttcttgggcgtcgggatctaaagcaaaataatgatgctactaatggtacattaattagtacactacatttcaacgatacactattggggtcttcttttccgtcgaagattcttttaaaaaacatcttcgacaaaatgatacaaaggatcaccgaagccaccttcagtctcgatttatctcctcaagacgaagactctgtatagagccgacagtgcaagatgccgaagctcaatggcctcagcccacatcaagcaaggaaggaaaaaggactagataggccttattggttttaattacttgtaaacaagtgttcaagggcatggatgtaattttaccgggctgcgtcccgtgactataaatagatgaacagtaccccgaccgtactattcacgctggattgtaatcactctcgcatcatcctcgttctctcaccttttggcaagccgaaagtaccaatataatatgaatattgttgatgtt

SEQ ID NO: 814 - protein, 225 aa, Arabidopsis thaliana
  misc_feature (1)..(225): Ceres CLONE ID no.  382267
  misc_feature (66)..(111): Pfam Name: Myb_DNA-binding Pfam Description: Myb-like DNA-binding domain
MEKEKEKSRARPSRGHWRPGEDDKLRQLVDKYGPRNWNSIAESLEGRSGKSCRLRWFNQLDPRINRRPFTVAEEELLLRAHRAHGNRWAIISRLFPGRTDNAVKNHWHVVMARRRRRTLVGEAAAIGSVVVPPRHQYFHFGSCSPPPPTRSLCFAVPAGFGPLGLSRPAASCGVRNCNVPTAVALLDDGHRHDMSKDLGGDDDNGGDALAKRKDVQFFDFLGVGI

SEQ ID NO: 815 - DNA, 1146 bp, Arabidopsis thaliana
  misc_feature (1)..(1146): Ceres CLONE ID no.  38360
  misc_feature (1)..(1146): GEMINI ID 554D4
gcttcatttttttctccgaccaaacaagttccgggtgttttgaaagaaccccgacaatggcgtggaacgtgttcaagttctgcacagcacttcgcgccttgggttcgatcatgatcttaattgttatcgggatcatcggattcacatactacgccgttgtcgtcgttaattacggacctgctctactgatcggtggtgtcgattcattactatctgttctcgtcttagcgttgttccactttctgcttataatgctactgtggagttatttctctgttgttgtgacggaccctggtggtgttccaacgggttggaggccagaattagacatagagaaaagcgagggaaaccaagctttgattggagaagcttcggttggagattcctcgtctcatggtgtaagatattgtagaaagtgcaatcaatataaaccgcctcgttctcaccattgttcagtctgtggaagatgcatactaaagatggaccatcactgtgtttgggtggtgaattgtgttggtgcaaataactacaaatcatttctcctattcttgttttacacatttcttgagacaacggtggttgcagtatcactattgccaattttcctcgtattcttcagcgatggagatggtgatataaccgtatcaccaggaagcctagcagccagctttgttgcatttgtattgaacatagcatttgccctaagtgtcctaggcttcctaataatgcacataatgttggtcgctcgtaacaccacaactattgaggcgtatgagaagcatacagtgaactggccatacaacgttggtcgtaagacaaactttgaacaggtttttggaagtgataaaatgtattggttcgtgccattgtacacggaagacgataagaagaagttgccagcacttggagggttagactttacgagcaggtcggagtccgagacagagccgcttcagtctctatgaccttacaaacttgaaatttttggaagtgtgtcttctgctttgtgtatgtatcaatcaaatattatatcaaacattgtcttgtgtattataaagattagtgccttttgtggaatttgtatctttttatttcgtgaaaagaaatttctcaaacttcttaaatataccattttcacatttgctc

SEQ ID NO: 816 - protein, 284 aa, Arabidopsis thaliana
  misc_feature (1)..(284): Ceres CLONE ID no.  38360
  misc_feature (1)..(284): GEMINI ID 554D4
  misc_feature (89)..(153): Pfam Name: zf-DHHC Pfam Description: DHHC zinc finger domain
MILIVIGIIGFTYYAVVVVNYGPALLIGGVDSLLSVLVLALFHFLLIMLLWSYFSVVVTDPGGVPTGWRPELDIEKSEGNQALIGEASVGDSSSHGVRYCRKCNQYKPPRSHHCSVCGRCILKMDHHCVWVVNCVGANNYKSFLLFLFYTFLETTVVAVSLLPIFLVFFSDGDGDITVSPGSLAASFVAFVLNIAFALSVLGFLIMHIMLVARNTTTIEAYEKHTVNWPYNVGRKTNFEQVFGSDKMYWFVPLYTEDDKKKLPALGGLDFTSRSESETEPLQSL

SEQ ID NO: 817 - protein, 256 aa, Oryza sativa
  misc_feature (1)..(256): Public GI no. 108711626
  misc_feature (1)..(256): Functional Homolog of  Ceres CLONE ID no.  38360
  misc_feature (125)..(189): Pfam Name: zf-DHHC Pfam Description: DHHC zinc finger domain
MHRSAGATMAWNVFRFCTALRGLGSIMILLVLSIVGVTYYAVVVYNYGPALFAGGASTLLALVVLLLFHFLLVMLLWSYFSVVFTDPGSVPPNWNLDFDEERGETAPLSGLDFNSQVNSQQSIAHNDTGHPRARYCRKCNQMKPPRCHHCSVCGRCVLKMDHHCVWVVNCVGALNYKYFLLFLFYTFLETTLVTLSLLPHFIAFFSDIDIPGSPAALATTFLTFVLNLAFSLSVLGFMIMHVSLVSANTTTIEASI

SEQ ID NO: 818 - protein, 304 aa, Glycine max
  misc_feature (1)..(304): Ceres CLONE ID no. 573293
  misc_feature (1)..(304): Functional Homolog of  Ceres CLONE ID no.  38360
  misc_feature (115)..(179): Pfam Name: zf-DHHC Pfam Description: DHHC zinc finger domain
MHRSGATMAWNVFKFCTALRGLGSIMILLVLGVVGATYYAVVLTNYGPALYAGGLDSLVALAVLILFHSLLVMLLWSYFSVVFTDPGSVPPNWKPTIDEERGEADPLVGTEFSNLPSDPNPRVRYCRKCNQLKPPRCHHCSVCGRCVLKMDHHCVWVVNCVGALNYKYFLLFLFYTFLETTLVTASLLPHFIAFFSDGEIPGTPGSLATTFLAFVLNLAFALSVLGFLIMHISLVAANTTTIEAYEKKTTPKWRYDLGRRKNFEQVFGMDKKYWFIPAYSDEDIRKMPALQGLDYPSKPDFDSQ

SEQ ID NO: 819 - DNA, 646 bp, Panicum virgatum
  misc_feature (1)..(646): Ceres CLONE ID no.1825572
agaagcccgcaaacaaagtcacgcggctgctttcggggcgcggccgtcctcgctttttctcctcctcgacgccgggcggccggggcggtagtggtaggtgagcgctgtgccctcgtgccgccgcgccgtgggaggcccagagccggagatgcacagatcggggacggcgatggcgtggaacgtgttcaagttctgcacggcgttgcgggggttgggctccgtcatgatcctcctcgtcctcggcatcgtcggcgtcacctactacgcgctcgtcctctgcaactacgggccagcgctgctcgctgccacgggggcgcttgacgccctcgtcgcgctcgccgtcctcctcatcttccacttcttgcttgtcatgcttctctggagctatttctctgttgtgtttactgaccctggtggtgttccaccaaattggaggccagatgttgacgaagagaggggcgaaactgcaccattgtccaccacggagctcagtgatacagggagtccaaggataaggtactgcaggaagtgtaaccagctaaagccacctcggtgccatcactgttctgtttgtggaagatgtgtgcttaagatggatcatcattgtgtatgggttgtgaattgtgttggggcactgaactacaag

SEQ ID NO: 820 - protein, 220 aa, Panicum virgatum
  misc_feature (1)..(220): Ceres CLONE ID no. 1825572
  misc_feature (1)..(220): Functional Homolog of  Ceres CLONE ID no.  38360
  misc_feature (114)..(178): Pfam Name: zf-DHHC Pfam Description: DHHC zinc finger domain
MHRSGTAMAWNVFKFCTALRGLGSVMILLVLGIVGVTYYALVLCNYGPALLAATGALDALVALAVLLIFHFLLVMLLWSYFSVVFTDPGGVPPNWRPDVDEERGETAPLSTTELSDTGSPRIRYCRKCNQLKPPRCHHCSVCGRCVLKMDHHCVWVVNCVGALNYKFFLLFLFYTFLETALVTLSLLPHFIAFFSDVEIPGTPGALATTFLTFVLNLALL

SEQ ID NO: 821 - DNA, 915 bp, Populus balsamifera subsp. trichocarpa
  misc_feature (1)..(915): Ceres ANNOT ID no. 1524357
atgcatagatccagagctgttatggcttggaatgtgttcaaattttgtacggccttaaggggtctaggctcgatcatgatcttgttggtgcttggcgttgttggtgtaacatattatgctgttgttttgaataattatggccctgctttgtatgatggtggcatcgattctctcgtttctcttgctgtcttgatcccattccattctttgttagtgatgctactgtggagttacttttctgttgttttaactgatccggggagcgtgcctcctaattggaggcctgctattgatgaggaaagaggggaggctgacccgttgaatggatcagagtttagtggagtgcagtctgaccaatcaaatcaaagaatccgatattgccggaagtgcaaccagctgaaaccacctcgttgccatcattgttctgtttgtgggaggtgtgtgctaaagatggaccatcattgcgtatgggttgtaaattgtgttggggccttgaattataagtattttcttctatttttgttctacacatttcttgagacaagtcttgtaactttatctctttcaccacactttatagcattctttagtgatggagaaattcctgggactccaggcacccttgcaaccacatttcttgcctttgtcttaaatctggcgtttgcattgagtgttctgggatttctgatcatgcacatatcgcttgtgtctgctaatactacaactattgaggcatacgagaagaagaccaccccaaaatggcgctatgaccttggtcgaaagaagaattttgagcaggctaataagcgatactggttcattccgacttattcagacgatgatttacggcgaatgcctgcacttcagggtcttgaatatccatcgaaacccgactttgattcccaggaattctag

SEQ ID NO: 822 - protein, 304 aa, Populus balsamifera subsp. trichocarpa
  misc_feature (1)..(304): Ceres ANNOT ID no. 1524357
  misc_feature (1)..(304): Functional Homolog of  Ceres CLONE ID no.  38360
  misc_feature (117)..(180): Pfam Name: zf-DHHC Pfam Description: DHHC zinc finger domain
MHRSRAVMAWNVFKFCTALRGLGSIMILLVLGVVGVTYYAVVLNNYGPALYDGGIDSLVSLAVLIPFHSLLVMLLWSYFSVVLTDPGSVPPNWRPAIDEERGEADPLNGSEFSGVQSDQSNQRIRYCRKCNQLKPPRCHHCSVCGRCVLKMDHHCVWVVNCVGALNYKYFLLFLFYTFLETSLVTLSLSPHFIAFFSDGEIPGTPGTLATTFLAFVLNLAFALSVLGFLIMHISLVSANTTTIEAYEKKTTPKWRYDLGRKKNFEQANKRYWFIPTYSDDDLRRMPALQGLEYPSKPDFDSQEF

SEQ ID NO: 823 - DNA, 1481 bp, Panicum virgatum
  misc_feature (1)..(1481): Ceres CLONE ID no.1819666
atctagacgaagaaacgaaaccaggcgaattcgctgccgaggcaggtagaagcccgcaaacagtcacgcggctgcttgctttcggagcgcggctgtccctgcttctctcctcctcgacgccggggcggcactggtaggtgagcgctgtgcccgcgtgccgccgcgccgtgggaggcgggtagccggagatgcacagatcggggacggcgatggcgtggaacgtgttcaagttctgcacggcgttgcgggggttgggctccgtcatgatcctcctcgtcctcggtatcgtcggcgtcacctactacgcgctcgtcctatgcaactacgggccagcgctgctcgctgccacggcggcgcttgacgccctcgtcgcactcgcagtcctcctcctcttccacttcttgcttgtcatgcttctctggagctatttctctgttgtgtttactgaccctggtggtgttccaccaaattggaggccagatgttgacgaagagaggggtgaaactgcaccattgtccaccacagagctcaatgatacagggagttcaaggatcaggtactgcaggaagtgtaaccaactaaagccacctcggtgccatcactgttctgtttgtggaagatgtgtgcttaagatggatcatcattgtgtatgggttgtgaattgtgttggggcactgaactacaagttcttccttctgttcctgttgtatacttttctggagacagcacttgttaccctgtccttattgccccactttattgctttcttcagtgatgttgagattccaggaactcctggagcacttgcaaccacattcctgacctttgttctgaacctggcctttactttgagtgtccttggttttatgatcatgcatgtatcacttgtttctggtaacacaacaacaattgaggcatatgagaaaaaaactactccattctggaagtatgatcttggccggaagaggaattttgctcaggtttttggaaacaacaagtggtattggttcattccatcatactcagaggaggacttaagaataataccagctctgcagggcctggattatcctgtcagatcagattttgatgggcaagggttctaattagatgagtttgatgtgcacagttgccctctgtataacatgtttgatgttacagccatgccttcattaccggacagtgtctcgtgatggtcggtcttgtacaacatccttgacaactaacatcagtatggctgatctacacggtgcgatgaatgtagaggtatatatacgggggcatgtgaactcgtttctgatacttagtaatggaagaactcgctggactcccccctgtagtttgtccacagcagtgatctgttgtacatttgttttatgtatctgaaagaagcttgaaagtttttgtgctaaatgtatcaagtaacagatgtaccaattattcaagttatattctgtgaacaaaaaaaaaaaaaaaaaaaa

SEQ ID NO: 824 - protein, 298 aa, Panicum virgatum
  misc_feature (1)..(298): Ceres CLONE ID no. 1819666
  misc_feature (1)..(298): Functional Homolog of  Ceres CLONE ID no.  38360
  misc_feature (107)..(171): Pfam Name: zf-DHHC Pfam Description: DHHC zinc finger domain
MAWNVFKFCTALRGLGSVMILLVLGIVGVTYYALVLCNYGPALLAATAALDALVALAVLLLFHFLLVMLLWSYFSVVFTDPGGVPPNWRPDVDEERGETAPLSTTELNDTGSSRIRYCRKCNQLKPPRCHHCSVCGRCVLKMDHHCVWVVNCVGALNYKFFLLFLLYTFLETALVTLSLLPHFIAFFSDVEIPGTPGALATTFLTFVLNLAFTLSVLGFMIMHVSLVSGNTTTIEAYEKKTTPFWKYDLGRKRNFAQVFGNNKWYWFIPSYSEEDLRIIPALQGLDYPVRSDFDGQGF

SEQ ID NO: 825 - protein, 316 aa, Oryza sativa
  misc_feature (1)..(316): Public GI no. 50919203
  misc_feature (1)..(316): Functional Homolog of  Ceres CLONE ID no.  38360
  misc_feature (125)..(189): Pfam Name: zf-DHHC Pfam Description: DHHC zinc finger domain
MHRSAGATMAWNVFRFCTALRGLGSIMILLVLSIVGVTYYAVVVYNYGPALFAGGASTLLALVVLLLFHFLLVMLLWSYFSVVFTDPGSVPPNWNLDFDEERGETAPLSGLDFNSQVNSQQSIAHNDTGHPRARYCRKCNQMKPPRCHHCSVCGRCVLKMDHHCVWVVNCVGALNYKYFLLFLFYTFLETTLVTLSLLPHFIAFFSDIDIPGSPAALATTFLTFVLNLAFSLSVLGFMIMHVSLVSANTTTIEAYEKKTTPRWMYDIGRKRNFIQVFGNDKRYWFIPAYSEEDLRRMPVLQGLDYPVRTDLDGQEL

SEQ ID NO: 826 - protein, 316 aa, Zea mays
  misc_feature (1)..(316): Ceres CLONE ID no. 230342
  misc_feature (1)..(316): Functional Homolog of  Ceres CLONE ID no.  38360
  misc_feature (125)..(189): Pfam Name: zf-DHHC Pfam Description: DHHC zinc finger domain
MYRSAGVAMAWNVFRFCTALRGLGSIMILLVLAIVGVTYYAVVLCNYGPALFTGGGTTLAALAVLLSFHFLLAMLLWSYFSVVFTDPGSVPPNWNLDFDVEMGETAPLASSELCSQMNSQQSVALGNMTNPRVRYCRKCNQLKPPRCHHCSVCGRCVLKMDHHCVWVVNCVGALNYKYFLLFLFYTFLETTLVTLSLLPHFIAFFSDAEIPGSPAALATTFLTFVLNLAFSLSVLGFMIMHISLVSANTTTIEAYEKKTTPHWIYDLGRKRNFAQVFGNDRKYWFIPAYSEEDLRRTPALQGLDYPVRPDFDGQEL

SEQ ID NO: 827 - DNA, 1624 bp, Gossypium hirsutum
  misc_feature (1)..(1624): Ceres CLONE ID no.1850953
aagcatcgaaaataccaattgcatcatcaaattcattatttgacccaaattcctgggaacggaattccttttctccatcggagttccatattcccccctcctgaattctcttttttcccctaccctcaaaatctcctctttgttctatacagaataaataaaattttaattttatggcatggaacgtgttcaaattctgtacggcactacgtgctttgggttcgattatgatcgttttcgttcttgcggttatcggcctcacttactatgctgtggtcattgctcattatggtccaagtctctttcttggaagctttgaaaccttttttgccatcgtagttctcatcgtgtttcattctctgctggtaatggtaatgtggtgctattcttctgttgttgtaactgaccccgggggtgtcccaccgaattggaggcccttcacggatgaggagaaaggtgatgccgatcctttggtaggttctggttatggaagtgcacaattagatcccaagcagtcagctatggtagccgtgagccaggagatacgtttctgtcacaagtgcaaacaatttaaacctcctcgcgcccaccactgctctgtttgtaggaggtgtatactaaaaatggaccatcactgtgtttgggttgtcaactgcgtcggggcattgaactacaagtatttccttctatttttgttttacacatttcttgaaaccacacttgtcagtttattgttgttgcgagtttttatggaattttttaacgaaggcgagatagatgaaacaccaggatcacttgctgctacttttatcacatttgttttgaacatagcatttacgctgagtattcttggctttctgattatgcacataacactggttggagccaatacctccactattgaggtaataatctatgtttccctttgttgccaaagtaatcagtcaaggtctcgttttcacatgtttatttttcaggcatatgagaagaaaacctctccaaaatggcgttatgaccttggttggaagaagaattttgaacaggtgtttggactagataagaagtactggttcatcccagcctattctgaagacgatttaagacgattgccagcccttcacggatttgaatacccaacacggcctgacttggagccactccagcaacattaacaaaggaacaaaacaagctttcaagtttcaatcactcaaaaaaaaactaggttgcagctcatgtatatatctgtatccttgtgatttgtaagtgatttcatcagttctttattttagtcagtggtgtcaccgattaaagctcaacattttcgttgattttccttcttgccaatcacgatatgtgatctttccttttgagttttgtaatctttatttgcaatgattgaaactttcagaaaacagttctttcccgtaccagacattagacaacctggatagttgcctgtaatttgtgtttatacgatgaatgtgaaagagaacgaaaaaaaagagtgcggagacatgttcatgggctgggcatgtggttgatattggttggatttatgtatagcattatttacatttatttaaattcggtttgatttgaaactcaaaaaaaaaaaaaaaaaaaa

SEQ ID NO: 828 - protein, 332 aa, Gossypium hirsutum
  misc_feature (1)..(332): Ceres CLONE ID no. 1850953
  misc_feature (1)..(332): Functional Homolog of  Ceres CLONE ID no.  38360
  misc_feature (117)..(180): Pfam Name: zf-DHHC Pfam Description: DHHC zinc finger domain
MAWNVFKFCTALRALGSIMIVFVLAVIGLTYYAVVIAHYGPSLFLGSFETFFAIVVLIVFHSLLVMVMWCYSSVVVTDPGGVPPNWRPFTDEEKGDADPLVGSGYGSAQLDPKQSAMVAVSQEIRFCHKCKQFKPPRAHHCSVCRRCILKMDHHCVWVVNCVGALNYKYFLLFLFYTFLETTLVSLLLLRVFMEFFNEGEIDETPGSLAATFITFVLNIAFTLSILGFLIMHITLVGANTSTIEVIIYVSLCCQSNQSRSRFHMFIFQAYEKKTSPKWRYDLGWKKNFEQVFGLDKKYWFIPAYSEDDLRRLPALHGFEYPTRPDLEPLQQH

SEQ ID NO: 829 - DNA, 945 bp, Populus balsamifera subsp. trichocarpa
  misc_feature (1)..(945): Ceres ANNOT ID no. 1470949
atggcttggaatgtgttcaaattttgtacggccttaaggggtctaggctcgatcatgatcttgttggtgcttggcgttgttggtgtaacatattatgctgttgttttgaataattatggccctgctttgtatgatggtggcatcgattctctcgtttctcttgctgtcttgatcccattccattctttgttagtgatgctactgtggagttacttttctgttgttttaactgatccggggagcgtgcctcctaattggaggcctgctattgatgaggaaagaggggaggctgacccgttgaatggatcagagtttagtggagtgcagtctgaccaatcaaatcaaagaatccgatattgccggaagtgcaaccagctgaaaccacctcgttgccatcattgttctgtttgtgggaggtgtgtgctaaagatggaccatcattgcgtatgggttgtaaattgtgttggggccttgaattataagtattttcttctatttttgttctacacatttcttgagacaagtcttgtaactttatctctttcaccacactttatagcattctttagtgatggagaaattcctgggactccaggcacccttgcaaccacatttcttgcctttgatgtcaatttgccatgcacttgcagctgttacctgctttgtggatgtggtataagaaacagtgatgactctatgcagtgtcaatgtctagcatacgagaagaagaccaccccaaaatggcgctatgaccttggtcgaaagaagaattttgagcaggctatattaccttttgaattacttctaggcatattacatgtgtttggggcagataagcgatactggttcattccgacttattcagacgatgatttacggcgaatgcctgcacttcagggtcttgaatatccatcgaaacccgactttgattcccaggaattctag

SEQ ID NO: 830 - protein, 296 aa, Populus balsamifera subsp. trichocarpa
  misc_feature (1)..(296): Ceres ANNOT ID no. 1470949
  misc_feature (1)..(296): Functional Homolog of  Ceres CLONE ID no.  38360
  misc_feature (92)..(155): Pfam Name: zf-DHHC Pfam Description: DHHC zinc finger domain
MILLVLGVVGVTYYAVVLNNYGPALYDGGIDSLVSLAVLIPFHSLLVMLLWSYFSVVLTDPGSVPPNWRPAIDEERGEADPLNGSEFSGVQSDQSNQRIRYCRKCNQLKPPRCHHCSVCGRCVLKMDHHCVWVVNCVGALNYKYFLLFLFYTFLETSLVTLSLSPHFIAFFSDGEIPGTPGTLATTFLAFDVNLPCTCSCYLLCGCGIRNSDDSMQCQCLAYEKKTTPKWRYDLGRKKNFEQAILPFELLLGILHVFGADKRYWFIPTYSDDDLRRMPALQGLEYPSKPDFDSQEF

SEQ ID NO: 831 - protein, 307 aa, Medicago truncatula
  misc_feature (1)..(307): Public GI no. 92897066
  misc_feature (1)..(307): Functional Homolog of  Ceres CLONE ID no.  38360
  misc_feature (117)..(180): Pfam Name: zf-DHHC Pfam Description: DHHC zinc finger domain
MIMQNMNLFKLCSALRVLGYFMILLFAAIVILTYYAVVFVTWGPLLFPLSSSSSFFSAFFILLLFHTLLLLLTWSYFMAVFNDPGSVPLNWTPLPQLPAVAVPPPSNVEFELEEAASTTTPSTGRYCTRCQNAKPPRCHHCSICQRCVLKMDHHCIWVVNCVGARTYKYFLLFLLYTFLETTLVCLALIPSFLRFFGVGGAKNHKLSPGGFSAIFLASILNLAFALSLLCFIVMHLSLLLSNTTSVEVHEKKKGVRWRYDVGRKKNFEQVFGTKKALWLFPLFSEEDLENIPALRGIEFPTRSDVDV

SEQ ID NO: 832 - DNA, 1737 bp, Arabidopsis thaliana
  misc_feature (1)..(1737): Ceres CLONE ID no.  388074
  misc_feature (1)..(1737): GEMINI ID 539E10
acctccacccgccccgtcccgttttgacggccctttctcccctctcctccgcgagcgccgccgcagtagaacccggtggtaacccactgccgcaagcatcccaccgcgccgagctacgcgacggacgcggcgcgcggcccacaacccaaccgcagcggcaacaaccgctctataaagcaatccccccacctaccggctccgcggcctcgctcgcttcgctttcccccaaatccaccgcgggctcgagctcggaggagaggagacgagacgacccaagactttctcacccccctttgcttcctgcgcaattcctgcggcagcgcctttctctctttcaatggacagcgactacgttgctagcctgctcatgggcatgggctcatccgcccctgcgctcgacttcgccgcgctggacgccgggttcctcgaaacgctctgcggcggcggcggcggcctcttcggggtgtccggggtcgccgcgggggccgggtgtggcggcgtgtccccggaggggtcgtcggtgtccgacccggcgtgggcgcgcgccagggacgatgacaatgtcaggaagcgcaaggagccgcccacggggtccgccggcggcaaggaggcctgcccgggcaaggctgcggaggccaagggtccggacgggaagaggtgcagagtgggcggcagcgacagcccggtgaagccgaaggtagaggaggtggcggcgagcgacgcctcggttgaactcaaagcgcagaagaagggcaaggggaagaccgccaagccggcagtcgaaccgcccaaggactacgtccatgtccgggcgcggcgagggcaggcgactgacagccacagcctcgcagagagggttagaagagagaagatcagccagaggatgaagtttctgcaggacctagtgccaggatgcaacaaggtggttggcaaggcactcatgctcgatgagatcataaactacgtccagtcgctgcagcagcaagtcgagttcctgtccatgaagctcgccactgtgaacccacagcttgacttcagcaacctgtcgacactcctacacaaagacatgtaccaaccatgtggcccttcggcaaattcggtctttccactggaaagtgacggtgcagctttcccattctgcgaccaagcggatcttttccacagctttggttcgggttcggctgctatggaggatcagtgctctctaagcctgctagacacggctctgccccacgcggccaacccacagtttgcttttcaaaagcagcagagggacttctgggaggatggcctacagaacgcattgcctaccggtagtgagcaaagacaggaggaggatgggcttttagtacccaactttgatggccagttacatgctgaccagacaaaggttgagttctagtccctggtgctcctcccaaggttgatatttttgtatataggtggggtaccaagacctgtggcaagcaaagctctctctttctctctgtgtccgaagctgaccatcattagagtctaggcctgcgaactgatttcgttccgtgataatgctgcatgtatggcatctcgattcttcccacagagatcatgtgatgtgatcgacctcgagaaattaaaagtagattgtgtactagatatggcgcaaatattacatgcgccatcttctaaagttgtactgattggtatgtaagggcgctgggtggtgttggaacggataccgtgtactgtttgttgctt

SEQ ID NO: 833 - protein, 354 aa, Arabidopsis thaliana
  misc_feature (1)..(354): Ceres CLONE ID no.  388074
  misc_feature (1)..(354): GEMINI ID 539E10
  misc_feature (164)..(214): Pfam Name: HLH Pfam Description: Helix-loop-helix DNA-binding domain
MDSDYVASLLMGMGSSAPALDFAALDAGFLETLCGGGGGLFGVSGVAAGAGCGGVSPEGSSVSDPAWARARDDDNVRKRKEPPTGSAGGKEACPGKAAEAKGPDGKRCRVGGSDSPVKPKVEEVAASDASVELKAQKKGKGKTAKPAVEPPKDYVHVRARRGQATDSHSLAERVRREKISQRMKFLQDLVPGCNKVVGKALMLDEIINYVQSLQQQVEFLSMKLATVNPQLDFSNLSTLLHKDMYQPCGPSANSVFPLESDGAAFPFCDQADLFHSFGSGSAAMEDQCSLSLLDTALPHAANPQFAFQKQQRDFWEDGLQNALPTGSEQRQEEDGLLVPNFDGQLHADQTKVEF

SEQ ID NO: 834 - DNA, 1221 bp, Arabidopsis thaliana
  misc_feature (1)..(1221): Ceres CLONE ID no.  38961
  misc_feature (1)..(1221): GEMINI ID 555F10
gagaattagtgagtcataaatcagagagcgagagaaaagtggtgagacatagagtgggaggttaacgaaagagagaacgatgaagaacaaagcgtttggtcagattatggatgatgcagagaatcccgggttcttcaagatccttcgaagtgcagatttatcgtctgaaatcatgagagggatccctctaaacttcatcaaaagcatctcggaagaagagttatcggctaagatgttgttaaaagtgtcatggggaagttcttggcctatcaaaatttgtagaaacccaagcttctactttatggagaaaaagggatgggatcagtttttgagcgacaatggattaggtaatgatgagtttcttaccttcacacaccaaggaaatatgtgctttaccgtggacatctaccaaatagacggtaaagagctacttacaccacgcagatctgcaaccattgcttctagttccggtcggaacaagagagaacaaaggaataacatctacaaagatgtgaaggaggaagaagacatagagtcttggtctgaatcgagctatcctggtcacaaaacagctgaatctacaggaagaagacaaaggcttagcttgagtaataagaaagccaaggaaactgagaaatcaaagaagaagaagatgaaggtggaaagtattagttacgattctcaagatgacagtttgtctcttgttccagaatttaccctcaccataaagaaatcatacctcattttcttggggattccaaagatgtttgaggagctgcatatgccaacggaggcaactatgttcaagatccatgatccggaagggaaaaggtcatgggatgttatgtataagttcagtaataaccagacaagattctgtgctggttggattcgtttggctaaagaacttggtttggagatcggagatgtttgcactttcacgctcatcaaacctaccgagatgcttgttagagtctctaaataagagatgatgaagatatgatattagtttgataactctctcaaaatctagttaatgtgttaggaatctttactaattatgggtcttattaacttgttacatttgttgtttctcttaagactttttatgttagtacaagtatacaatggttcttctatccggtttggaattacaaattctcttaaccgagtattagatccggtttgatttggtttatagttaattttaaccaatatatt

SEQ ID NO: 835 - protein, 227 aa, Arabidopsis thaliana
  misc_feature (1)..(227): Ceres CLONE ID no.  38961
  misc_feature (1)..(227): GEMINI ID 555F10
  misc_feature (137)..(227): Pfam Name: B3 Pfam Description: B3 DNA binding domain
MEKKGWDQFLSDNGLGNDEFLTFTHQGNMCFTVDIYQIDGKELLTPRRSATIASSSGRNKREQRNNIYKDVKEEEDIESWSESSYPGHKTAESTGRRQRLSLSNKKAKETEKSKKKKMKVESISYDSQDDSLSLVPEFTLTIKKSYLIFLGIPKMFEELHMPTEATMFKIHDPEGKRSWDVMYKFSNNQTRFCAGWIRLAKELGLEIGDVCTFTLIKPTEMLVRVSK

SEQ ID NO: 836 - protein, 117 aa, Brassica napus
  misc_feature (1)..(117): Ceres CLONE ID no. 963923
  misc_feature (1)..(117): Functional Homolog of  Ceres CLONE ID no.  38961
  misc_feature (32)..(32): Xaa is any aa, unknown, or other
KRSATIASSNRNKREEVNNVLEEERESLSASXYPVSETAESTVGGRLKQKRQLINLGKKQVKKAEKANKCKKRKMDTESDDSEAGTSSLVSEFTLTIKKSYVLFLGVPKRFAEMHMP

SEQ ID NO: 837 - DNA, 876 bp, Arabidopsis thaliana
  misc_feature (1)..(876): Ceres CLONE ID no.  3900
  misc_feature (1)..(876): GEMINI ID 178A7
  misc_feature (1)..(876): GEMINI ID 532H9
ctccaatgcattggttggtccaaaacaagatcctcatttcatacatcttgtaatctttctggtctgtaatttgcactaggatggtaaccttgtaccctatgtaaaatgtcttgttagtataaattatgggtcatgttgtgttgatgactcttaagcgcatttcttattgaccaagaggtatggaattctctggagacgctggaatgatgatggagaacaagcggaatgtctgctctctcggagaaagcagcatcaaacgccacaagtctgatctctctttcaattccaaggagaggaaggacaaggttggagaacgtatttcagctcttcaacaaatagtttccccttatggaaagaccgacactgcatcagttcttctagacgcgatgcattacatagagtttcttcacgaacaagtgaaggtgctaagtgctccgtatctgcaaacgatacctgatgctacgcaggaggagctggagcagtacagcctgagaaacagaggattatgtcttgttccaatggagaatacagttggagttgctcaaagcaacggcgctgatatatgggcgcccgtgaagactcctctatcaccagctttcagtgtcacatctcaatcaccctttagatgaccaattcgactaatcacctactacgatctttgtgttaagcctaaaaaagaatgaccaattgttatttttctgatgatgcctctgtaacatatatagacagagagcacatgatgttggtttagaactgctcatggttggcaatgattgttattattatttgactgcttaatgcatccccttactttggacttgtgtaatatgcccaaacaggagccaaatgattttaatgcaaagtaatctttatccc

SEQ ID NO: 838 - protein, 149 aa, Arabidopsis thaliana
  misc_feature (1)..(149): Ceres CLONE ID no.  3900
  misc_feature (1)..(149): GEMINI ID 178A7
  misc_feature (1)..(149): GEMINI ID 532H9
  misc_feature: Bit Score of 325.2 for HMM based on sequences of FIGURE 53
MEFSGDAGMMMENKRNVCSLGESSIKRHKSDLSFNSKERKDKVGERISALQQIVSPYGKTDTASVLLDAMHYIEFLHEQVKVLSAPYLQTIPDATQEELEQYSLRNRGLCLVPMENTVGVAQSNGADIWAPVKTPLSPAFSVTSQSPFR

SEQ ID NO: 839 - protein, 134 aa, Arabidopsis thaliana
  misc_feature (1)..(134): Ceres CLONE ID no. 158765
  misc_feature: Bit Score of  272.1 for HMM based on sequences of FIGURE 53
  misc_feature (1)..(134): Functional Homolog of  Ceres CLONE ID no.  3900
MSALSEKAASNATSLISLFNSKERKDKVGERISALQQIVSPYGKTDTASVLLDAMHYIEFLHEQVKVLSAPYLQTIPDATQEELEQYSLRNRGLCLVPMENTVGVAQSNGADIWAPVKTPLSPAFSVTSQSPFR

SEQ ID NO: 840 - DNA, 1229 bp, Gossypium hirsutum
  misc_feature (1)..(1229): Ceres CLONE ID no.1839717
atttcttccactcttcctcactttctttaagccttcaccagtgtttaggtttaaaatttgcagattttgaactaaaaggattttgattgttccttaaagttttcaccttgtttagatgtaaacaaactgacatgtttttggcaataaaggtccagtctttttagtcccacaaagaagattgctgttctttttaatgttttgttgaagaaaagtaggaaaaaaaaaaggacaaagaaaaagaaaagagctggctttcggactttggggtgttgatagtttggttgaagaaagtgaaaacactgaagcagaaagctttttactttggggaatttttcccttgttgaatttgggtattgaaagttttcaagttatagtacaaggcttgagatttttgcttttagctctttggccaatgcaaactttatgttcttgtgaaaacgggatagaggtcagaacgatgatggaaaacaaaaggagcccttgctctgttgatcatagcagtttcactcctttggcgtcgaagcgacagaagtccgacttattgatctcgacaaaggataggaaagataaggtcggtgaacgcattgtcactctgcagcagctagtttcgccatacgggaagacagatacagcttctgtcctcctgcaggcaatggagtacatacagtttcttcatgaacaagttaaggttttgagtgctccgtatcttcaaacctcaccgacaaataatatgcaggagcaagagcattatagccttagaagccaaggtttatgtcttgttccactctcgtataccatgggagttgttcatagcaatggtgctgatatttgggctcccatcaagaccgcttcaccaaaatttgacaagcctttcacacaattcaattgacatattttccttcatcggtgaccggtaggctttgaacgtttcactggaaccggttttaaaggtaaccaacttaaatcttgaatgcacaaaattttcctaatcagatgcaaaatttatagcacaaggcactgagataggatgttagtatcgagaaactagtaggattgtgtatccagaaatgcagtcctgtgcctacttagttttaagccagtgatctgcatttaatcttatattgaatttatagaaattaattgatctctccttaatcatgtattgtaaaatgtaaattgatgaacatgagttgattaaccacttttaacaaaaaaaaaaaaaaaaaaaa

SEQ ID NO: 841 - protein, 142 aa, Gossypium hirsutum
  misc_feature (1)..(142): Ceres CLONE ID no. 1839717
  misc_feature: Bit Score of  336.4 for HMM based on sequences of FIGURE 53
  misc_feature (1)..(142): Functional Homolog of  Ceres CLONE ID no.  3900
MENKRSPCSVDHSSFTPLASKRQKSDLLISTKDRKDKVGERIVTLQQLVSPYGKTDTASVLLQAMEYIQFLHEQVKVLSAPYLQTSPTNNMQEQEHYSLRSQGLCLVPLSYTMGVVHSNGADIWAPIKTASPKFDKPFTQFN

SEQ ID NO: 842 - DNA, 360 bp, Populus balsamifera subsp. trichocarpa
  misc_feature (1)..(360): Ceres ANNOT ID no. 1480628
atggaaggaagtgctttaggagaaaaggaacgaaaagagaagctcggggaacgaattgtagctctgcagcagcttgtttcaccatatgggaagactgatactgcatcggtccttatggaggcaatggagtacatacggttccttcatgaacaagttcaggtgttgagtgctccatacctccaaggcacatcaacagctcaaatgcaggagttaggtcaatacagtctaagaaacaaaggtttgtgtctcgttccgacctcgtgcactgctggcattgctcgcagcaatggagcagatatctgggcccccatcaagagcccttctcccaaattcaataaggacgtttcaccatttcattga

SEQ ID NO: 843 - protein, 119 aa, Populus balsamifera subsp. trichocarpa
  misc_feature (1)..(119): Ceres ANNOT ID no. 1480628
  misc_feature: Bit Score of 264.6 for HMM based on sequences of FIGURE 53
  misc_feature (1)..(119): Functional Homolog of  Ceres CLONE ID no.  3900
MEGSALGEKERKEKLGERIVALQQLVSPYGKTDTASVLMEAMEYIRFLHEQVQVLSAPYLQGTSTAQMQELGQYSLRNKGLCLVPTSCTAGIARSNGADIWAPIKSPSPKFNKDVSPFH

SEQ ID NO: 844 - protein, 140 aa, Lycopersicon esculentum
  misc_feature (1)..(140): Public GI no. 5669656
  misc_feature: Bit Score of 301.6 for HMM based on sequences of FIGURE 53
  misc_feature (1)..(140): Functional Homolog of  Ceres CLONE ID no.  3900
MPHKRSPISLEHSSSLTSLTPKRLKADMLISSKEKKEKFGERIVAPQQLVSPYGKTDTASVLLEAMGYIKFLHEQVKVLSAPYLGTMPMSKTQESQPYNLRSQGLCLVPVSYTVGVATSNGADIWAPIKTSQSSSPENDV

SEQ ID NO: 845 - protein, 168 aa, Triticum aestivum
  misc_feature (1)..(168): Ceres CLONE ID no. 1329861
  misc_feature: Bit Score of 334.3 for HMM based on sequences of FIGURE 53
  misc_feature (1)..(168): Functional Homolog of  Ceres CLONE ID no.  3900
MMMTQVANHSKRNHTDSYFSGKQQQQQQQAGATTTSGGSEEFAGMGSKKPRNASPRGSGGPISPKEKKDKVGERVAALQQLVSPFGKTDTASVLQEASGYIKFLHQQLEVLSSPYMRPPPAPGAEPEDPDHYSLRNRGLCLVPVEQTLQLTQSNGADLWAPANTTRRT

SEQ ID NO: 846 - protein, 167 aa, Glycine max
  misc_feature (1)..(167): Ceres CLONE ID no. 537752
  misc_feature: Bit Score of 379.7 for HMM based on sequences of FIGURE 53
  misc_feature (1)..(167): Functional Homolog of  Ceres CLONE ID no.  3900
MIASSFCNADSMFSREEGIDVRKMMEHKRRPCSVDQSSYTSIASKRQKADLSISTKERKEKIGERIVALQQLVSPYGKTDTSSVLKEAMEYIGFLHKQVKLLSAPYLESSPAAKMQGVEPCSLRSRGLCLVPVSVTIGVAESNGADIWAPIKTTTSPKFEKDVSQFH

SEQ ID NO: 847 - protein, 165 aa, Triticum aestivum
  misc_feature (1)..(165): Ceres CLONE ID no. 1322549
  misc_feature: Bit Score of  332.7 for HMM based on sequences of FIGURE 53
  misc_feature (1)..(165): Functional Homolog of  Ceres CLONE ID no.  3900
MMMTQVANHSKRNHTDSYFSGKQQQQAVATTATSSGSEEFAGMGSKKPRNASPRGGGPISPREKKDKVGERVAALQQLVSPFGKTDTASVLQEASGYIKFLHQQLEVLSSPYMRPPPSPGAEPEDPDHYSLRNRGLCLVPVEQTLQLTQSNGADLWAPANTTRRC

SEQ ID NO: 848 - DNA, 363 bp, Populus balsamifera subsp. trichocarpa
  misc_feature (1)..(363): Ceres ANNOT ID no. 1533351
atggaaaacaagagaagcccttgctcagttgaccatggcactctcacttctcttgcaactaaaagacacaaggctgatttttctatctccaccaagactgatactgcatctgtccttatggaggcgatggaatacatacggttccttcatgaacaagttcaggtgttgagtgctccatacctccaaggtacatcgacagcacaaatgcaggggttagggcaacacagtctagaaagcaaaggtttatgtcttgtaccaatctcttacactgcaggcattgctcgtagcaatggtgcagatatctgggcccccatcaagagcccttctcccaaatgtaacaagtctatttcacaatttcattga

SEQ ID NO: 849 - protein, 120 aa, Populus balsamifera subsp. trichocarpa
  misc_feature (1)..(120): Ceres ANNOT ID no. 1533351
  misc_feature: Bit Score of  241.2 for HMM based on sequences of FIGURE 53
  misc_feature (1)..(120): Functional Homolog of  Ceres CLONE ID no.  3900
MENKRSPCSVDHGTLTSLATKRHKADFSISTKTDTASVLMEAMEYIRFLHEQVQVLSAPYLQGTSTAQMQGLGQHSLESKGLCLVPISYTAGIARSNGADIWAPIKSPSPKCNKSISQFH

SEQ ID NO: 850 - protein, 162 aa, Zea mays
  misc_feature (1)..(162): Ceres CLONE ID no. 282892
  misc_feature: Bit Score of  327.8 for HMM based on sequences of FIGURE 53
  misc_feature (1)..(162): Functional Homolog of  Ceres CLONE ID no.  3900
MMMAEVAANHSKRSHNDGYFSAKAAAAAAASPEELGSMSMSSKKPRNSNSPRTAPVSPKEKKDRIGERVAALQQLVSPFGKTDTASVLQEASGYIRFLHQQLQVLSSPYMRAPPAAGAAPEDTEHYSLRSRGLCLVPVDQTLQLTQSNGADLWAPANTTRRR

SEQ ID NO: 851 - DNA, 760 bp, Arabidopsis thaliana
  misc_feature (1)..(760): Ceres CLONE ID no.  39855
  misc_feature (1)..(760): GEMINI ID 535C4
aaattttttctagggtttcctcttccgcattcgtcgtcttcagctcctcctacacagtttcttctctgaatctacttaggaagctaaaatgggtagatgtccgactagaaaagtgaagaagaggagattatctcacaaaacagctcgccgtgacaaattcgaagtcaaaggcgatgacttggtttacacagagttgcgtaaaccggagacggagattaagccgttacagcttgacgaggatttgcctggaatgggtcaattctactgcttacactgcgatcgatacttctccaacgcatcagtgagggatgatcatttcaagactaagaaacacaagaagcgtgtgaatatgatgatgggacaagcgccacactcgcaactcgatgcagatttagccgggggaatggggatgccggacaatggcccaaagctgatgtctaatttggtattcacagagttgcgtaaaccagagacggaggatttacctggaatgggtcaattcaactgcttactctgccatcgggaacttctccaatgcatcagtgatggattatcatttcaagactaagaaacacaaaaagcgtgtgaagaagatagagggaccagcgccacactcgcaactcgatgcagatttagctggtggaatgggaatgccagagctgatgtctgcctgagttttacagttattttccttatttagttaatggaacccggaattttgttgtaaaactataatctcctaaattaatgatacaggttc

SEQ ID NO: 852 - protein, 159 aa, Arabidopsis thaliana
  misc_feature (1)..(159): Ceres CLONE ID no.  39855
  misc_feature (1)..(159): GEMINI ID 535C4
MGRCPTRKVKKRRLSHKTARRDKFEVKGDDLVYTELRKPETEIKPLQLDEDLPGMGQFYCLHCDRYFSNASVRDDHFKTKKHKKRVNMMMGQAPHSQLDADLAGGMGMPDNGPKLMSNLVFTELRKPETEDLPGMGQFNCLLCHRELLQCISDGLSFQD

SEQ ID NO: 853 - protein, 118 aa, Brassica napus
  misc_feature (1)..(118): Ceres CLONE ID no. 1065335
  misc_feature (1)..(118): Functional Homolog of  Ceres CLONE ID no.  39855
  misc_feature (9)..(9): Xaa is any aa, unknown, or other
  misc_feature (113)..(113): Xaa is any aa, unknown, or other
MGRCPTRKXKKRRLSHKTARRDKFEVKGDDLVYTELRKPETETKPLELSEDLPGMGQFYCLHCDRYFCNVSVRDDHFKTKKHKKRVKLMNGPAPHSQLDADLAAGMGMPDNGXKLMAA

SEQ ID NO: 854 - DNA, 854 bp, Gossypium hirsutum
  misc_feature (1)..(854): Ceres CLONE ID no.1793747
atcctccttgttcgattagggttttctcaaggagtcctactgcaaaaccctaagttcccatcgaaaggaaacaatgggaggaaaatgtccaagcaggaaagtaaagaagcgaagattttcccacaaaacagctcgccgtgacaaattccttctcaaaggtgacgacctcgtttatgatgagctgcaaaagagtgataccgagaagaagccgttacctcgcgatgaagatttgcctggaatgggacaatattactgcttacactgcgaccgatattttgcgaattcgtctgtgagggatgaacatttcaagacgaaacgtcacaagaaacgtttgaagcaaatgtcggggcctgcaccacatactcaactcgatgctgagttggctgctgggatgggtatgccggataatggaccggcattaatgaaaatgtgagccacttttatgttttggctcccatccatgatggctggtgccatgagaggtcttccattccatgaagaccggttgcgttactgcttttaaatcaattttgcttccatatactaatgcttgtccgcgtaattggtttagttcatttgtttttcttttgtgttatcatatcttaaagtcttcagttggggtcgatgtggtggatcatatgatgaagatgatgatagatcacttattggtctccaactgtcttactgagtattatttgtttcttccttatcaggttaatgagccagtttgtaaaatatccaatgaaaactgcttgacattagcagtatttcttaaaaaaaaaaaaaaaaaaaaaaaaaaaaaaaaaagaaaaaaaaaaaaaaaaaaaaaaaaaaaaaaaaaaaaaaaaaaaaaa

SEQ ID NO: 855 - protein, 119 aa, Gossypium hirsutum
  misc_feature (1)..(119): Ceres CLONE ID no. 1793747
  misc_feature (1)..(119): Functional Homolog of  Ceres CLONE ID no.  39855
MGGKCPSRKVKKRRFSHKTARRDKFLLKGDDLVYDELQKSDTEKKPLPRDEDLPGMGQYYCLHCDRYFANSSVRDEHFKTKRHKKRLKQMSGPAPHTQLDAELAAGMGMPDNGPALMKM

SEQ ID NO: 856 - protein, 119 aa, Triticum aestivum
  misc_feature (1)..(119): Ceres CLONE ID no. 788576
  misc_feature (1)..(119): Functional Homolog of  Ceres CLONE ID no.  39855
MGGKCPHRNVKKRRYSHKTARRTKFELKGDDMVYAQLNKPDEERAPLPLDEDLPGMGQYYCLHCDRYFSNVAVRDEHFKTKRHKKRIKQMMGPAPHTQLDADVAAGMGMPDNGPKLMSM

SEQ ID NO: 857 - protein, 119 aa, Glycine max
  misc_feature (1)..(119): Ceres CLONE ID no. 465010
  misc_feature (1)..(119): Functional Homolog of  Ceres CLONE ID no.  39855
MGGKCPHRNVKKRRYSHKTARRTKFELKGDDMVYAQLNKPDQERPPLPVDEDLPGMGQYYCLHCDRYFANITVRDEHFKTKRHKKRIKQMMGPAPHTQLDADLASGMGMPDNGPKLMSM

SEQ ID NO: 858 - DNA, 922 bp, Gossypium hirsutum
  misc_feature (1)..(922): Ceres CLONE ID no.1832492
ctcgctcctcttttatcctccttgttcgattagggttttctcaaggagtcctactgcaaaaccctaagttcccaaatcccaatctaaaggaaacaatgggaggaaaatgtccaagcaggaaagtaaagaagcgaagattttcccacaaaacagctcgccgtgacaaattcctcctcaaaggtgacgacctcgtttatgatgagctgcagaagagtgataccgagaagaagccgttgcctcgcgatgaggatttgcctgaaatgggacaatattactgcttacactgcgaccgatattttgcgaattcgactgtgagggatgaacatttcaagacgaaacgtcacaagaaacgtttaaagcaaatgtcggggcctgcaccacatactcaactcgatgctgagttggctgctgggatgggtatgccggataatggactggcattaatgtcaatgtgagccacttttatgttttggctcccatccatggtggctggtgccatgagaggtcttccattccatgaagaccagttgcgttactgcttttaaatcaattttgcttctgtatgctaatgcttgtccgcgtaattggtttagttcatttgtttttcttttgtgttatcatatattaaagtcttcagttggggtcgatgtggtggatcatatgatgaagatgatgatagatcacttattggtctcctactgtcttattgagtattatttgtttcttccttatcaggttaatgagccagtttgtaaaatatccaatgaaaactgcttgacattagcagtatttcttacttggttaccatttctttgttgcttgaagaatgcttatgaaccttaaatagaaggatatactagaaagtgtagcttattaggatttaagcaagtttagaagttcttaaaaaaaaaaaaaaaaaaaa

SEQ ID NO: 859 - protein, 119 aa, Gossypium hirsutum
  misc_feature (1)..(119): Ceres CLONE ID no. 1832492
  misc_feature (1)..(119): Functional Homolog of  Ceres CLONE ID no.  39855
MGGKCPSRKVKKRRFSHKTARRDKFLLKGDDLVYDELQKSDTEKKPLPRDEDLPEMGQYYCLHCDRYFANSTVRDEHFKTKRHKKRLKQMSGPAPHTQLDAELAAGMGMPDNGLALMSM

SEQ ID NO: 860 - DNA, 718 bp, Panicum virgatum
  misc_feature (1)..(718): Ceres CLONE ID no.1801885
gtctgttcctctgccaaacgaaaaccctagccgccgccgccgatcatcttgattgagatgggtggcaagtgcccgcaccgcaaggtcaagaagcgccgcctctcgcacaagacggcgcgtcgtggcaagttcctcctcaaggccgacgatgccgtctacgaggagctcgtcaagctggccgaccaggggaaggatgcccaagccaaggacctccccgtagacgaggaccttcccggcatggggcagttctactgcctccactgcgaccgttactttgcaagcgagagcgtgaaggatgagcactaccgctcaaagcgccacaagaaaagggtgaaggtaatgtcaggaccagctccacacacgcaacttgacgctgaacttgctgctggaatgggaatgcctgacaatggcctgaagctcatgtccatgtgaagtaacaaggaacctcttgttagtacttgtaccgtgtttttcttgctgtcatatatctgaagtttctttgcttggtagctaatggagttagtagatggtgttatgtcaaagacttgttctaagagaggcttcatcagaatgagagggtttttgtgagggtcagggtttaatgcctgtatcatgaaatgtcttgtatcatttgactgcagagcgtgtgttgtcaatgaaataggaagttggctttacaggcaaaaaaaaaaaaaaacaaaaaaaaaaaaaaaaaaaa

SEQ ID NO: 861 - protein, 124 aa, Panicum virgatum
  misc_feature (1)..(124): Ceres CLONE ID no. 1801885
  misc_feature (1)..(124): Functional Homolog of  Ceres CLONE ID no.  39855
MGGKCPHRKVKKRRLSHKTARRGKFLLKADDAVYEELVKLADQGKDAQAKDLPVDEDLPGMGQFYCLHCDRYFASESVKDEHYRSKRHKKRVKVMSGPAPHTQLDAELAAGMGMPDNGLKLMSM

SEQ ID NO: 862 - protein, 124 aa, Zea mays
  misc_feature (1)..(124): Ceres CLONE ID no. 1060804
  misc_feature (1)..(124): Functional Homolog of  Ceres CLONE ID no.  39855
MGGKCPHRKVKKRRLSHKTARRGKFLLKADDAVYDELVKLADQGKDAETKELPVDEDLPGLGQFYCLHCDRYFASESVKDDHYRSKRHKKRVKVMSGPAPHTQLDAELAAGMGKPDNGLKLMSM

SEQ ID NO: 863 - protein, 155 aa, Oryza sativa
  misc_feature (1)..(155): Public GI no. 50948587
  misc_feature (1)..(155): Functional Homolog of  Ceres CLONE ID no.  39855
MGLMGFPLLSQDKSGLLLPLPAAAASASAAQMGGKCPHRKVKKRRLSHKTARRGKFLVKADDAVYDELVKLADAGKDADATQLPVDEDLPGMGQFYCLHCDRYFASESVKEEHYRSKRHKKRIKQMSGPAPHTQLDAELAAGMGMPDNGLKLMSM

SEQ ID NO: 864 - DNA, 947 bp, Arabidopsis thaliana
  misc_feature (1)..(947): Ceres CLONE ID no.  40334
  misc_feature (1)..(947): GEMINI ID 532D10
aatgttgctttaaaaccaatgctcctcttcttgttcttcatataaaccacatatcctctcctccatatcttaacaatttcatagcaaaccctaaaattgagaaagagatagagagagaaagatgggtagaggaaagatcgagataaagaggatagagaacgcaaacaacagagtggtgacgttctcaaagaggaggaatggattggtgaagaaggctaaagagatcacagttctttgtgatgcaaaagttgccctcataatctttgcaagtaatggtaagatgattgattactgttgtccttccatggatcttggtgctatgttggaccaataccagaagttatctggcaagaaactatgggatgctaagcatgagaaccttagcaatgagattgataggatcaagaaagagaatgatagcttacaactggagctcaggcatttgaagggagaagatatacagtctctcaacttgaaaaatctgatggctgtcgagcacgccattgaacatggcctcgacaaagtccgagaccaccagatggagatccttatatcaaagaggagaaatgagaagatgatggcggaggagcaacggcaactcactttccagctgcaacaacaggagatggctatagcaagcaacgcaagaggaatgatgatgagagatcatgatgggcagtttggatatagagtgcaaccgattcagccaaatcttcaggaaaagattatgtctttggtcatcgattgatcatcgagattttataatctcatcctgatcaactcctatctataatatcgtggtctttagtttgtctttatcaatctgtgtgtcttaatctcgagcaacatatatactcgctatcagactttttacttaagctatatgtgtgttgtttgcttatgacctctatgtattggttgtgttgtgtgcttaaacgtttcgaact

SEQ ID NO: 865 - protein, 208 aa, Arabidopsis thaliana
  misc_feature (1)..(208): Ceres CLONE ID no.  40334
  misc_feature (1)..(208): GEMINI ID 532D10
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENANNRVVTFSKRRNGLVKKAKEITVLCDAKVALIIFASNGKMIDYCCPSMDLGAMLDQYQKLSGKKLWDAKHENLSNEIDRIKKENDSLQLELRHLKGEDIQSLNLKNLMAVEHAIEHGLDKVRDHQMEILISKRRNEKMMAEEQRQLTFQLQQQEMAIASNARGMMMRDHDGQFGYRVQPIQPNLQEKIMSLVID

SEQ ID NO: 866 - protein, 208 aa, Brassica juncea
  misc_feature (1)..(208): Public GI no. 67043456
  misc_feature (1)..(208): Functional Homolog of  Ceres CLONE ID no.  40334
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENANNRVVTFSKRRNGLVKKAKEITVLCDAKVALIVFASNGKMTDYCCPSMDLGAMLDQYQKLSGKKLWDAKHENLSNEIDRIKKENDNLQLELRHLKGEDIQSLNLKNLMAVEHAIEHGLDKVRDHQMEYFMTKRRNEKMLAEENRQLSFQLQQQEMAIASNARGMMMRDHDGQFGYRVQPIQPNLQEKIMSLVID

SEQ ID NO: 867 - DNA, 669 bp, Populus balsamifera subsp. trichocarpa
  misc_feature (1)..(669): Ceres ANNOT ID no. 1452158
atggggagaggtaagattgagatcaagaggattgagaacgcaagcaacaggcaggtgacctactctaagaggaaaaatgggattataaaaaaagctaaggagatcacagttttatgcgatgctcaagtttctcttgtcatctttgctagttctggaaggatgcatgagtactgcagcccttccactacggtggtcgatctgttggacaagtatcaaaagcagtctggtaagaggctgtgggacgctaaacatgaggtgaacctcagcaaagagattgacagaatcaagaaagagaatgacagcatgcagattgagctgaggcacctgaaaggggaagatatctcatccttgcaccacacagagttgatggccatagaggaagccctcgatgctggccttgccgctgtctgtaaaaagcaggccagtacaatattttatagtaacaaaaatatggagtaccacagcatgttggagcaaaatgaaaagatgttggatgaggagttcaagcgcctccagttcgttctgcagcaacaagagatggctatgggagagaatgcaatggagatggaaaatgcttatcatcaacaaaggatgagggactataatttccaggtgcctttcgcattccgcgtgcagcctatccagccaaatttgcaagagagaatgtaa

SEQ ID NO: 868 - protein, 222 aa, Populus balsamifera subsp. trichocarpa
  misc_feature (1)..(222): Ceres ANNOT ID no. 1452158
  misc_feature (1)..(222): Functional Homolog of  Ceres CLONE ID no.  40334
  misc_feature (71)..(136): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENASNRQVTYSKRKNGIIKKAKEITVLCDAQVSLVIFASSGRMHEYCSPSTTVVDLLDKYQKQSGKRLWDAKHEVNLSKEIDRIKKENDSMQIELRHLKGEDISSLHHTELMAIEEALDAGLAAVCKKQASTIFYSNKNMEYHSMLEQNEKMLDEEFKRLQFVLQQQEMAMGENAMEMENAYHQQRMRDYNFQVPFAFRVQPIQPNLQERM

SEQ ID NO: 869 - protein, 211 aa, Cucumis sativus
  misc_feature (1)..(211): Public GI no. 4105097
  misc_feature (1)..(211): Functional Homolog of  Ceres CLONE ID no.  40334
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENSSNRQVTYSKRRNGIIKKAKEITVLCDAQVSLVIFASSGKMHEYCSPSTPLVDILDKYHKQSGKRLWDAKHENLSNEMDRVKKENDNMQIELRHLRGEDITSLNYKELMALEEALENGLTGVREKQSEFMKMMRTNERMMEEENKRLNYELYQKEMVAMGDSVREMDIGYNQRMRDFNSQMPFAFRVQPIQPNLQERE

SEQ ID NO: 870 - protein, 181 aa, Pisum sativum
  misc_feature (1)..(181): Public GI no. 56785938
  misc_feature (1)..(181): Functional Homolog of  Ceres CLONE ID no.  40334
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENSSNRQVTYSKRKNGILKKAKEISVLCDAQVSLILFGASGKMHEYISPSTTLIDVLDRYQRASGKTLWDAKHENLSNEIDRIQKENDSMQIELRHLKGEDITSLNYKELMSLEDALENGLTGVRDKKMEVHRMFKRNGKILEDENKELNFLLQQHLALEGVGNMHGQWI

SEQ ID NO: 871 - protein, 181 aa, Glycine max
  misc_feature (1)..(181): Ceres CLONE ID no. 1625939
  misc_feature (1)..(181): Functional Homolog of  Ceres CLONE ID no.  40334
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENSSNRQVTYSKRKNGILKKAKEISVLCDAQVSLIIFGVSGKMHEYISPYTTLIDVLDRYQRASGKTLWDAKHENLSNEIDRLKKENDSMQIELRHLKGEDITSLNYKELMALEDALENGLSGVREKKMEVHRMFKRNGKILEEQNKELSFLLQQHLAVEGIGNMHEQWI

SEQ ID NO: 872 - protein, 215 aa, Malus x domestica
  misc_feature (1)..(215): Public GI no. 12666533
  misc_feature (1)..(215): Functional Homolog of  Ceres CLONE ID no.  40334
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MGRGKVEIKRIENSSNRQVTYSKRRNGIIKKAKEITVLCDAKVSLIIYSSSGKMVEYCSPSTTLTEILDKYHGQSGKKLWDAKHENLSNEVDRVKKDNDSMQVELRHLKGEDITSLNHVELMALEEALENGLTSIRDKQSKFVDMMRDNGKALEDENKRLTYELQKQQEMKIKENVRNMENGYHQRQLGNYNNNQQQIPFAFRVQPIQPNLQERI

SEQ ID NO: 873 - protein, 208 aa, Lotus japonicus
  misc_feature (1)..(208): Public GI no. 60100344
  misc_feature (1)..(208): Functional Homolog of  Ceres CLONE ID no.  40334
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENSSNRQVTYSKRKNGILKKAKEITVLCDAQVSLIIFAASGKMHDYISPSTTLVDMLERYHKTSGKRLWDAKHENLNGEIERLKKENDGMQIELRHLKGDDINSLNYKELMALEAGLENGLESVREKQMEVYRVCRRNDKILEEENRELNFILQQRMAVEGARDADNEFDQSVRDFNSQMPFAFRVQPMQPNLQERI

SEQ ID NO: 874 - protein, 208 aa, Litchi chinensis
  misc_feature (1)..(208): Public GI no. 51832629
  misc_feature (1)..(208): Functional Homolog of  Ceres CLONE ID no.  40334
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENSSDRQVTYSKRRNGIIKKAKEITVLCDAKVSLIIFASSGKMHEYCSPSTTLVEILDQYHKQSGKKLWDPKHENLSSEIDRIKKENDSMQIKLRHLKGEDLTSLNHRELMAIEEALENGLAGLRDKQSEHVEGMRENLKELEETHKHLNFVMRQREMAMENNVRELESGYHQQPYQRAAVNHNDYNPQMPFAFREL

SEQ ID NO: 875 - protein, 208 aa, Glycine max
  misc_feature (1)..(208): Ceres CLONE ID no. 474230
  misc_feature (1)..(208): Functional Homolog of  Ceres CLONE ID no.  40334
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
  misc_feature (175)..(175): Xaa is any aa, unknown, or other
MGRGKIEIKRIENSSNRQVTYSKRKNGILKKAKEITVLCDAQVSLIIFAASGKMHDYISPSTTLIDILERYQKTSGKRIWDAKHENLNGEIERLKKENDSMQIELRHLKGEDINSLNYKELMALEDALETGLVSVREKQMDVYRMFRRNDKILEEENRELTFLWQQRLAVEGARXVDNGFDQSVRDYNSHMPFAFRVQPMQPNLQERI

SEQ ID NO: 876 - protein, 212 aa, Petunia x hybrida
  misc_feature (1)..(212): Public GI no. 454265
  misc_feature (1)..(212): Functional Homolog of  Ceres CLONE ID no.  40334
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENSSNRQVTYSKRRNGIIKKAKEITVLCDAKVSLIIFGNSGKMHEYCSPSTTLPDMLDGYQKTSGRRLWDAKHENLSNEIDRIKKENDSMQVKLRHLKGEDINSLNHKELMVLEEGLTNGLSSISAKQSEILRIVRKNDQILEEEHKQLQYALHQKEMAAMGGNMRMIEEVYHQRDRDYEYQQMPFALRVQPMQPNLHERM

SEQ ID NO: 877 - protein, 210 aa, Phalaenopsis hybrid cultivar
  misc_feature (1)..(210): Public GI no. 53988171
  misc_feature (1)..(210): Functional Homolog of  Ceres CLONE ID no.  40334
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENSTNRQVTFSKRRNGIMKKAKEISVLCDAQVSLVIFSSLGKMFEYCSPSTTLSKMLEKYQQNSGKKLWDAKHENLSAEIDRIKKENDNMQIELRHLKGEDLNSLNPKELIPIEEALQNGLTSVRDKQMDYLKMLKKNERMLEDENKRLTYLLHQQQMAMEGSMRELDIGYHHKDREYAAQMPMTFRVQPIQPNLQGNK

SEQ ID NO: 878 - protein, 212 aa, Akebia trifoliata
  misc_feature (1)..(212): Public GI no. 48727608
  misc_feature (1)..(212): Functional Homolog of  Ceres CLONE ID no.  40334
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENSTNRQVTYSKRRNGIMKKAKEITILCDAQVSLVIFSSTGKMSDYCSPSTTLTKVLDRYQKTSGKRLWDAKHEYLSTEVDRIKKENDCMQIELRHLKGEDITSLNPKELIPIEEALENGLVNVRAKQMEYLKMLKKNERYLEEENKHLRCILHHQQIEIEGNMRMEMENGYNTQKGRDYPSQMPFAFRAQPMQPNLQENK

SEQ ID NO: 879 - protein, 213 aa, Silene latifolia subsp. alba
  misc_feature (1)..(213): Public GI no. 602902
  misc_feature (1)..(213): Functional Homolog of  Ceres CLONE ID no.  40334
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENSTNRQVTYSKRRNGIIKKAGEITVLCEAKVSLIIFSNNGKMHAYHSPETAVEDILDQYHKISGKRLWDAKHENLSNEIDRVKKENDNMQIELRHLKGEDITSLPYPDLMRLEDALENGLVGVREKQMEMYKLHKKNHKMLEDENNQLAYMLHKQEMDGNMREMEAGVCSNPSDRDYHYQNPIPPYGFRVQPMQPNLQDRM

SEQ ID NO: 880 - protein, 210 aa, Elaeis guineensis
  misc_feature (1)..(210): Public GI no. 33338587
  misc_feature (1)..(210): Functional Homolog of  Ceres CLONE ID no.  40334
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENSTNRQVTFSKRRNGIIKKAREISVLCDAQVSVVIFSSSGKMSEYCSPSTTLSRILERYQHNSGKKLWDAKHESLSAEIDRIKKENDNMQIELRHLKGEDLNSLSPKELIPIEDALQNGLISVRDKQMEFLKKLKKNERLLEEENKHLTYLLHQQELAMDANVRELELGYPSKDRDFASHMPLAFHVQPIQPNLQENN

SEQ ID NO: 881 - protein, 197 aa, Gerbera hybrid cv. 'Terra Regina'
  misc_feature (1)..(197): Public GI no. 4218173
  misc_feature (1)..(197): Functional Homolog of  Ceres CLONE ID no.  40334
  misc_feature (71)..(169): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENTSNRQVTYSKRKNGIIKKAKEITVLCDANVSLVIYGSSGKMYEYCSPKTNLIDMLDRYQRLSGNKLWDAKHENLQNEIDRIKKENESMQIELRHLKGEDITSLNYEELIAYEDALENGLTNIREKKDEIPKIMRKHEQVLEEENKHLMYLVQQSEMAAMGDYQAAHEPFSFRVQPMQPNLHERM

SEQ ID NO: 882 - protein, 210 aa, Elaeis guineensis
  misc_feature (1)..(210): Public GI no. 33309888
  misc_feature (1)..(210): Functional Homolog of  Ceres CLONE ID no.  40334
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENSTNRQVTFSKRRNGIIKKAREISVLCDAQVSLVIFSSSGKMSEYCSPSTTLSRLLEKYQVNSGKKLWDVKHENLSVEIDRIKKENDNMQIELRHLKGGDLNSLNPKELILIEDVLQNGLTSVRGKQMDFLKKLKKNERLLEEENKHLTFLLHHQELAMNGNVRELELGDPLKARDFACQIPIAFRVQPIQPNLQENK

SEQ ID NO: 883 - protein, 212 aa, Verbena x hybrida
  misc_feature (1)..(212): Public GI no. 84578879
  misc_feature (1)..(212): Functional Homolog of  Ceres CLONE ID no.  40334
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENSSNRQVTYSKRRNGIMKKAKEISVLCDAQVSVIIFASSGKMHEFCSPSTTLVDMLDQYHKLSGKRLWDAKHEQLDNEINRVKKENDSMQIELRHLKGEDISTLNYKELMVLEEALENGISTLKAKQMEFVRMMRKHNEMIEEENQSLQFKLRQLHLDPMDDNVMEAQAVYDHQGVADYEAQMPFAFRVQPMQPNLQERF

SEQ ID NO: 884 - DNA, 1459 bp, Arabidopsis thaliana
  misc_feature (1)..(1459): Ceres CLONE ID no.  41634
  misc_feature (1)..(1459): GEMINI ID 534A3
atatttgattccttttctctctcatacgatctgcacaccactactaagaacaacagagctagagagacttgcaataattgtaaaacatgattggaacaagcttccccgaggatcttgattgtggcaacttctttgacaacatggatgatctcatggactttcccggtggagatatcgatgtcggtttcggcataggtgactccgactctttccctaccatctggaccactcatcacgacacgtggcccgccgcttctgatcctctcttctcttccaacaccaactctgattcatcacctgagctctatgttccgtttgaggacattgttaaggtggaaagacctccaacctttgtagaggaaacattggttgagaagaaggaagattcgttttcgacaaacactgattcatcatcttctcatagccaattcaggagctcaagtccagtgtcggttctcgagagcagctcctcctcgtctaaaaccaccaacacaacctcccttgttctccctggaaagcacggtcgtccacgcacaaaacgccctcgtccacctgtccaggataaagatagagtcaaagacaatgtgtgcggtggtgactcgcgcctcatcattagaataccgaaacagtttctctctgatcacaacaagatgatcaacaagaagaagaagaagaaggccaagattacttcttcctcttcttcgtccgggattgatcttgaagtcaatggaaacaacgtcgattcgtattcttcagagcaatatccgcttaggaaatgtatgcactgtgaggtcaccaagactccacagtggaggcttggtccaatgggtccaaagacactttgcaatgcgtgcggtgtacgttacaaatcagggaggcttttcccggagtaccgtccagctgctagtccaacatttactccagctcttcactcaaactcacacaagaaagtggctgaaatgagaaacaagagatgcagtgatggtagctacataaccgaagagaatgatctgcaaggactgattccgaacaatgcctacattggcgtagactaaaacctagagaagatgattcgatttccatgcgttgaagtgattagatatgccaggagtaggaaagagtcagtgagaagaaaagtttttagctttagaagagatgaaggaagagagcaatcaattggagggattaaaagttagatgagaattgattgtgtttgtattattttgtatttgtagtgtgaatgggcaaaaaactcttgaaacagaggaaaagtaagttgaggaagagcagaagattttgaagacattagagaatcattaggtgttgagtattacattaaatcttcctcttcttcttttgttctttcaattctttgtatttttattgtgaggattctcttttttttttttttttttgtagttgatttgtttattgtatctgataaaaagaatgttacttg

SEQ ID NO: 885 - protein, 322 aa, Arabidopsis thaliana
  misc_feature (1)..(322): Ceres CLONE ID no.  41634
  misc_feature (1)..(322): GEMINI ID 534A3
  misc_feature (231)..(266): Pfam Name: GATA Pfam Description: GATA zinc finger
MIGTSFPEDLDCGNFFDNMDDLMDFPGGDIDVGFGIGDSDSFPTIWTTHHDTWPAASDPLFSSNTNSDSSPELYVPFEDIVKVERPPTFVEETLVEKKEDSFSTNTDSSSSHSQFRSSSPVSVLESSSSSSKTTNTTSLVLPGKHGRPRTKRPRPPVQDKDRVKDNVCGGDSRLIIRIPKQFLSDHNKMINKKKKKKAKITSSSSSSGIDLEVNGNNVDSYSSEQYPLRKCMHCEVTKTPQWRLGPMGPKTLCNACGVRYKSGRLFPEYRPAASPTFTPALHSNSHKKVAEMRNKRCSDGSYITEENDLQGLIPNNAYIGVD

SEQ ID NO: 886 - protein, 322 aa, Arabidopsis thaliana
  misc_feature (1)..(322): Public GI no. 4678312
  misc_feature (1)..(322): Functional Homolog of  Ceres CLONE ID no.  41634
  misc_feature (231)..(266): Pfam Name: GATA Pfam Description: GATA zinc finger
MIGTSFPEDLDCGNFFDNMDDLMDFPGGDIDVGFGIGDSDSFPTIWTTHHDTWPAASDPLFSSNTNSDSSPELYVPFEDIVKVERPPSFVEETLVEKKEDSFSTNTDSSSSHSQFRSSSPVSVLESSSSSSQTTNTTSLVLPGKHGRPRTKRPRPPVQDKDRVKDNVCGGDSRLIIRIPKQFLSDHNKMINKKKKKKAKITSSSSSSGIDLEVNGNNVDSYSSEQYPLRKCMHCEVTKTPQWRLGPMGPKTLCNACGVRYKSGRLFPEYRPAASPTFTPALHSNSHKKVAEMRNKRCSDGSYITEENDLQGLIPNNAYIGVD

SEQ ID NO: 887 - protein, 333 aa, Zea mays
  misc_feature (1)..(333): Ceres CLONE ID no. 1360604
  misc_feature (1)..(333): Functional Homolog of  Ceres CLONE ID no.  41634
  misc_feature (232)..(267): Pfam Name: GATA Pfam Description: GATA zinc finger
MFGQSFAEDLDCGNFFDNMDDLLDFPGGDIDVGFGIGDSDSFPNIWTTHQDTWPAASDPLFASNTNSDSSPELYVPFEDIVKVERPKCFVEESLVEKKEDSFFTNTDSSSSHSQFRSSSPVSVLESSSSSSHTTNTTSLVLPGKHGRPRTKRPRPQVQEKDKVNDNVFGADSRLIIRIPKQFLSDHSKMITKKKKKKAKVVSSSSWSEIDLETNGNNNVDSCSSEQNPVRKCMHCEVTKTPQWRLGPMGPKTLCNACDVRYKSGRLFPEYRPAASPTFTPALHSNSHKKVAEMRNKRCSNGSYTNEENDLHDLVLNNAYIGIGVGKSQRVEKF

SEQ ID NO: 888 - protein, 294 aa, Zea mays
  misc_feature (1)..(294): Ceres CLONE ID no. 1380534
  misc_feature (1)..(294): Functional Homolog of  Ceres CLONE ID no.  41634
  misc_feature (233)..(254): Pfam Name: GATA Pfam Description: GATA zinc finger
MFGQSFPEDIDCGNFFDNMDDILDFPGCDMDVGFNIGDSDSFPNIWTNHQDTWPAASDPLFSSNTNSDSSPELYVPFEDIVKVERPASFVSESLVAKKEDSFSTNTDSSSSHSQFRSSSPVSVLESSSSSSQTTNATSLVLSGKHGRPRTKRPRPPVQEMDRVNVCGADSRLIVRIPKQFLSDHSKMITKKKKKKAKVTSSYSSSGIDLETNGSNNNNNVDSYDSEQHPVRKCMHCEVTKTPQWRLGPMGPKTLFATRVACVTSLEGFSRSTVQLIVQHSLQLFTQTHTRRWLK

SEQ ID NO: 889 - DNA, 1719 bp, Gossypium hirsutum
  misc_feature (1)..(1719): Ceres CLONE ID no.1844070
aaaagaagagtaaaagacagctagcaatgaaggaaaggatgctgagtgctgacctaccataaatccccccttccctctcctttttatcctttgtttccctttctctctccccttcaattttcctctctttcttcttcaaaggtatctcgaacaattctcttcattttcctggaaaattatctcctgtttccccagaaaagttttgctcacttagtaacgaaaggtttataaatttcttagagagaaattattaacataaagaaaccatgattggaccaaccaacttcatcgacgagatagattgcggcagcttcttcgaccacatagacgacctcctcgacttccctaacgaggatgtcgaagctggtttctccgccgctgattccgccgtcaacgccgccgcttttcccagcatttggactgctcaccccgagtcattcccgggttctgactcagtttttttccaacaacagcgcttccgacctctccgccgaactctctgttccgtatgaagacattgttcaattggaatggttgtcaaactttgttgaagattcaaattgtggagcaagtttgacaattaagaaacaagagcctaattcaaacaataaggactcaccatcccatcatgatcatgatcaccatcaattccagacatccagtccggtttcggtcctcgaaagcagcagctcttactccggggagaaaccggttgccgcccctgggaagtgcggacgtgcgcgtagcaaacgtccccgtcccgccactttcaaccctcgtccagcgattcaccttatctccccgtcttcgtccgtcaatgacaacgacgttcctcagtcgttgtttgttcccaaggtgccatccgactccgagaaccacgctgagtctcggcttctgatcaagttgccacgacaagttaacccggaacacaagaagaaaaagaagatcaagttgacactcccagcagcagcaccaccacctactgataacaacactactcaaaatccatctgttaggaaatgcatgcattgtgagataacaaagacacctcaatggagggcagggccaatgggaccgaaaaccctttgcaatgcatgcggagtgcggtataaatctggcaggctctttcccgagtaccgaccggcggcgagtccgacgtttatcccgtcggtgcactcgaattctcataagaaagtgctggaaatgaggaccaaatgtgggacagctgatgcaccagaaatgatcccaaataaaagcaacccagcactagattacatatgaagggagggctttggagaattttggaaccctaatgttgattgggttaaaactttcacaatgtttcccccatcccaatctcttttaatcttttttttatgtgtttatttttgttattgttatttttatctctttgttcattgttttatttttgtatagggttggaaatgggggggaaattggagcaatacatgacaaatattttagaattgtagagagggattttaatgagagaaagaaaaagggtttaggggaaaatggaaggttttaagggtagcaaaagttgtaggtttttttagtaaagagtaggtccttcaaaggttattaataattggagtcgttattttctttttaatttttttttcttcctatttggggattctttttgcagtgaaaaaaaaatcatctaaatttcccttttaaaaaaaaaaaaaaaaaaaa

SEQ ID NO: 890 - protein, 308 aa, Gossypium hirsutum
  misc_feature (1)..(308): Ceres CLONE ID no. 1844070
  misc_feature (1)..(308): Functional Homolog of  Ceres CLONE ID no.  41634
  misc_feature (223)..(258): Pfam Name: GATA Pfam Description: GATA zinc finger
MSKLVSPPLIPPSTPPLFPAFGLLTPSHSRVLTQFFSNNSASDLSAELSVPYEDIVQLEWLSNFVEDSNCGASLTIKKQEPNSNNKDSPSHHDHDHHQFQTSSPVSVLESSSSYSGEKPVAAPGKCGRARSKRPRPATFNPRPAIHLISPSSSVNDNDVPQSLFVPKVPSDSENHAESRLLIKLPRQVNPEHKKKKKIKLTLPAAAPPPTDNNTTQNPSVRKCMHCEITKTPQWRAGPMGPKTLCNACGVRYKSGRLFPEYRPAASPTFIPSVHSNSHKKVLEMRTKCGTADAPEMIPNKSNPALDYI

SEQ ID NO: 891 - DNA, 1362 bp, Populus balsamifera subsp. trichocarpa
  misc_feature (1)..(1362): Ceres ANNOT ID no. 1457905
atggcaaagttaagcatgagagaaaaagtaacagtgcggtgggaggtgggacccgtgtgggtaatcaggagagagaggagcttcaatctctctccctcttcttcattccctctctccgttttaaaactcaaacacatatcacacattcctcgtcgctcccactgtcctctctctttctctaaggtgtttaaaattacaaactcccaaaaaccccaacaagaaattcgaattaccaagaattcccttctcttctgtcaaggaaggaataaaaagttaaagaagcgaggagaagagaaaatgattggacagacaaatactactagtaatttcatggacgagatagattgtggaagctttttcgagcacatcgacgacctcctcgaattcccttctgatgatgtcgacgctactttacctgactgcaccaccacaaacaaccataccagttgtttcatgaacaacgatgataactcgtttcctggtatttggtcgactcagtccgactcgctcccgggttctgcctctgacctatctgccgagttgtccgttccttatgaagatattgttcagctggaatggctatcaaactttgtggaggattccttctctggaggaagcctgacgatgaagaaagaggagtccacaatcgtcaacaacaaggaatcgccgccacatcaccagtaccagttccagacttccagcccagtttctgtccttgagagcagtagctcctgctcaggagagaaaactgcaccgcgtagccctgaagttggtgcttctggcaaacgtgggcgtgctcgtagcaagcgtcctcgccctgctacattcactcctcgtccagcaatgcaactcatttcgcccacttcgtcaatcactgaggttccccagccattcgttccacctaagatcgctttggactctgagaactttgctgagtccagacttgtgatcaagataccgaaccatgttgacccagaacataagaagaagaagaaaattaagtttactgttccgttaggtcccgtggagatgaaccaaaactcatcaccacagcaagcagtgagaaaatgcatgcattgtgagataaccaagacaccacaatggagagcagggccaatgggaccaaaaaccctttgcaatgcttgtggtgttcgctacaagtcaggtcggcttttccccgagtaccggcccgcggctagtccaaccttcgttccttccctgcattccaattcccataagaaagttgttgagatgagagcaaagtctggggagaaaattactgtcagcagacctgctgcaatggtggccaacccgccggagttgattcctaataagagcaaccctgcaatggattacatataa

SEQ ID NO: 892 - protein, 354 aa, Populus balsamifera subsp. trichocarpa
  misc_feature (1)..(354): Ceres ANNOT ID no. 1457905
  misc_feature (1)..(354): Functional Homolog of  Ceres CLONE ID no.  41634
  misc_feature (258)..(293): Pfam Name: GATA Pfam Description: GATA zinc finger
MIGQTNTTSNFMDEIDCGSFFEHIDDLLEFPSDDVDATLPDCTTTNNHTSCFMNNDDNSFPGIWSTQSDSLPGSASDLSAELSVPYEDIVQLEWLSNFVEDSFSGGSLTMKKEESTIVNNKESPPHHQYQFQTSSPVSVLESSSSCSGEKTAPRSPEVGASGKRGRARSKRPRPATFTPRPAMQLISPTSSITEVPQPFVPPKIALDSENFAESRLVIKIPNHVDPEHKKKKKIKFTVPLGPVEMNQNSSPQQAVRKCMHCEITKTPQWRAGPMGPKTLCNACGVRYKSGRLFPEYRPAASPTFVPSLHSNSHKKVVEMRAKSGEKITVSRPAAMVANPPELIPNKSNPAMDYI

SEQ ID NO: 893 - DNA, 1212 bp, Populus balsamifera subsp. trichocarpa
  misc_feature (1)..(1212): Ceres ANNOT ID no. 1465103
atggcaaccttgtttggctgctgtgaaacaaaggaaagaactcgagaaaactcactgaatttgaaagcacaaacttccaaaattcgaataaccaagaacccccttccctccctcctcaaggaaaaaaagaagtttgagagaagtgaagagaaaatgattggacaaacaaatacttctagtggtttcatggacgagatagattgtggaagcttcttcgaccacatcgacgacctcctagacttcccgtctgatgatgtcgacgctagtttgcctgactgcaccaccacaaacaaccatgctagttgtttcattgacaacgatgataactcgtttcctggtatttggtcgtctcagtccgactcactccccggttctgcctctgacctctccgccgagttgtccgttccgtacgaagatattgttcagctggaatggctatcgaactttgtggaggattccttctctgggggaagcctgacaatgaagaaagaggagtctgcgtctgtcgacaaaaaggactcgacgccacaccaccagttccagacttccagcccagtttctgtccttgagagcagtagcgactgctcaggagagaaaaatgcacctcgcagccctgaaattgttgcttctggaaaatgtgggcgtgctcgcagcaagcgtcctcgccctgctgcgttcactcctcgccctgcaatgcaactcgtttcgccaacatcgtcgatcactgaggtgccccagcaatttgtttctcctagagtcccttcagattctgagagctttgccgagtcaagacttgtgatcaagataccagagcatgttgacccagaacacaagaagaagaagaaaattaagtttattgttccgtcaggtactgtggagatgaatcaaaactcacagccacagcaagcagttaggaaatgcatgcattgtgagataaccaagaccccacaatggagagcaggaccaatgggtccaaaaaccctttgcaatgcctgcggtgttcgatacaagtcgggccggcttttccccgagtaccggcctgcagccagtccaacctttgttccttccctgcactctaattcgcataagaaagttgttgagatgagagcaaaggctggggagaaaattactaccagcagacctgctacaatgatggtcaactcgccagagtttattccaaatgagagcaaccctgcaatggattacatgtga

SEQ ID NO: 894 - protein, 352 aa, Populus balsamifera subsp. trichocarpa
  misc_feature (1)..(352): Ceres ANNOT ID no. 1465103
  misc_feature (1)..(352): Functional Homolog of  Ceres CLONE ID no.  41634
  misc_feature (256)..(291): Pfam Name: GATA Pfam Description: GATA zinc finger
MIGQTNTSSGFMDEIDCGSFFDHIDDLLDFPSDDVDASLPDCTTTNNHASCFIDNDDNSFPGIWSSQSDSLPGSASDLSAELSVPYEDIVQLEWLSNFVEDSFSGGSLTMKKEESASVDKKDSTPHHQFQTSSPVSVLESSSDCSGEKNAPRSPEIVASGKCGRARSKRPRPAAFTPRPAMQLVSPTSSITEVPQQFVSPRVPSDSESFAESRLVIKIPEHVDPEHKKKKKIKFIVPSGTVEMNQNSQPQQAVRKCMHCEITKTPQWRAGPMGPKTLCNACGVRYKSGRLFPEYRPAASPTFVPSLHSNSHKKVVEMRAKAGEKITTSRPATMMVNSPEFIPNESNPAMDYM

SEQ ID NO: 895 - DNA, 1794 bp, Gossypium hirsutum
  misc_feature (1)..(1794): Ceres CLONE ID no.1919992
gttttccctttctctctccccttcaattttcctctctttcttcttcaaaggtatctcgaacaattctcttcattttcctggaaaattatctcctgtttccccagaaaagttttgctcacttagtaacgaaaggtttgcttcataatccctccatttttttgttcacttttgaaaatagaattttaaaaatcaataatcctcccaccttaaaaaaaacaaattttagctagcattggaccaccttgcactaacttagaaaattttaatttttacttcaccatccatttgagcaaataaaataaaaaattttggaacataaaaacaaatttgtattacaaaaaaaaatctcaaatacttccaaatttcaattcaaaattgctcaaatttgaaatttcaattttcaaaaaaattcttatgctaacatgcgccacacggctcaatcattttagcagtgaccgcttttcaataaagagagacattcacatgcaaaattaacattatgactaataaatcttacattttcttttctttacaggtttataaatttcttagagagaaattattaacataaagaaaccatgattggaccaaccaacttcatcgacgagatagattgcggcagcttcttcgaccacatagacgacctcctcgacttccctaacgaggatgtcgaagctggtttctccgccgctgattccgccgtcaacgccgccgcttttcccagcatttggactgctcaccccgagtcattcccgggttctgactcagttttttccaacaacagcgcttccgacctctccgccgaactctctgttccgtatgaagacattgttcaattggaatggttgtcaaactttgttgaagattcaaattgtggagcaagtttgacaattaagaaacaagagcctaattcaaacaataaggactcaccatcccatcatgatcatgatcaccatcaattccagacatccagtccggtttcggtcctcgaaagcagcagctcttactccggggagaaaccggttgccgcccctgggaagtgcggacgtgcgcgtagcaaacgtccccgtcccgccactttcaaccctcgtccagcgattcaccttatctccccgtcttcgtccgtcaatgacaacgacgttcctcagtcgttgtttgttcccaaggtgccatccgactccgagaaccacgctgagtctcggcttctgatcaagttgccacgacaagttaacccggaacacaagaagaaaaagaagatcaagttgacactcccagcagcagcaccaccacctactgataacaacactactcaaaatccatctgttaggaaatgcatgcattgtgagataacaaagacacctcaatggagggcagggccaatgggaccgaaaaccctttgcaatgcatgcggagtgcggtataaatctggcaggctctttcccgagtaccgaccggcggcgagtccgacgtttatcccgtcggtgcactcgaattctcataagaaagtgctggaaatgaggaccaaatgtgggacagctgatcccccagaaatgttcccaaataaaaccaccccaccactagattacatatgaagggagggcttgggagaattttggacccctaatgttgattgggttaaaactttcccaatgtttcccccatcccaatctcttttaatctttttttaaggggttaattttggtaatggtaattttaatctcttggtccattgtttaatttttgtatagggttggaaatgggggggaaatgggaccaatccatgccaaatatttt

SEQ ID NO: 896 - protein, 337 aa, Gossypium hirsutum
  misc_feature (1)..(337): Ceres CLONE ID no. 1919992
  misc_feature (1)..(337): Functional Homolog of  Ceres CLONE ID no.  41634
  misc_feature (252)..(287): Pfam Name: GATA Pfam Description: GATA zinc finger
MIGPTNFIDEIDCGSFFDHIDDLLDFPNEDVEAGFSAADSAVNAAAFPSIWTAHPESFPGSDSVFSNNSASDLSAELSVPYEDIVQLEWLSNFVEDSNCGASLTIKKQEPNSNNKDSPSHHDHDHHQFQTSSPVSVLESSSSYSGEKPVAAPGKCGRARSKRPRPATFNPRPAIHLISPSSSVNDNDVPQSLFVPKVPSDSENHAESRLLIKLPRQVNPEHKKKKKIKLTLPAAAPPPTDNNTTQNPSVRKCMHCEITKTPQWRAGPMGPKTLCNACGVRYKSGRLFPEYRPAASPTFIPSVHSNSHKKVLEMRTKCGTADAPEMIPNKSNPALDYI

SEQ ID NO: 897 - DNA, 1404 bp, Arabidopsis thaliana
  misc_feature (1)..(1404): Ceres CLONE ID no.  41875
  misc_feature (1)..(1404): GEMINI ID 536E6
cttcttctttcttctccaaccaaaatctctttctcagttctctagggttttcaatactcacaccaaagcttaatgccgatcaacgatcagtttcctagtgggttaagaatactcgttgtagacgatgatacttcatgcttgttcattctcgagaaaatgcttctccgtctcatgtaccaagttacaatttgctcacaagctgatgttgcgttaaccattctaagagaaagaaaagacagttttgatttggtgctaagtgatgttcatatgcctggtatgaatggttacaatcttcttcaacaagttggtcttcttgaaatggatcttcctgtcattatgatgtctgttgatggaagaacaactacagtcatgactggaatcaaccatggagcttgtgattatctaatcaaacctattcgtcctgaagagcttaagaacatttggcaacatgttgttagaaggaaatgtgtgatgaagaaagagcttcgaagttctcaagctttagaggataacaagaacagtggtagcctcgagactgttgttgtttcggttagtgaatgctcagaggaaagtttgatgaaatgtaggaataagaagaagaagaagaagagaagtgttgatagagatgataatgaagatgatcttcttcttgatcctggaaactcgaagaagtcacgcgttgtttggtctattgaattgcatcaacaattcgttaatgccgtaaacaaacttggaattgacaaagctgtaccaaagcggattctcgagttgatgaatgttcctggtttaagcagagaaaacgtggctagtcatttacagaagttccgattgtatttgaagagattaagcggtgaagcttcgcagagtaatgactctgagtctaccaaaagatatgaaaacattcaagctctggtttcctcaggacaattacatccacagacattagctgcattgtttggtcaaccaatagacaatcatcactctgctagttttggagtttggattcctaatgacaatcttggtagatctcaaaatgaacacttctcggttgatgtatcatccgcttctaaccgtcctgtttctgtggcggttcatggtctatcttcctcagcaaatttcagacagagaggtaacgttaacaacaacagaatcagacaagggtatggatcaaatgtcaatgaagaatcttggatcttggaaagatcttcaagacaaagatagtgaccaatatggatacgcttaagaagagaaggctctgcaactgtttcttttaaatcttcaggaatggattaatgtcagaagaaaacttgtgtgtctgcaatgttagcttaggaaagtaattatgtaaccaatattttgaattgttatctctcactttattatggttgccaaaagttttagccc

SEQ ID NO: 898 - protein, 382 aa, Arabidopsis thaliana
  misc_feature (1)..(382): Ceres CLONE ID no.  41875
  misc_feature (1)..(382): GEMINI ID 536E6
  misc_feature (11)..(125): Pfam Name: Response_reg Pfam Description: Response regulator receiver domain
  misc_feature (202)..(252): Pfam Name: Myb_DNA-binding Pfam Description: Myb-like DNA-binding domain
MPINDQFPSGLRILVVDDDTSCLFILEKMLLRLMYQVTICSQADVALTILRERKDSFDLVLSDVHMPGMNGYNLLQQVGLLEMDLPVIMMSVDGRTTTVMTGINHGACDYLIKPIRPEELKNIWQHVVRRKCVMKKELRSSQALEDNKNSGSLETVVVSVSECSEESLMKCRNKKKKKKRSVDRDDNEDDLLLDPGNSKKSRVVWSIELHQQFVNAVNKLGIDKAVPKRILELMNVPGLSRENVASHLQKFRLYLKRLSGEASQSNDSESTKRYENIQALVSSGQLHPQTLAALFGQPIDNHHSASFGVWIPNDNLGRSQNEHFSVDVSSASNRPVSVAVHGLSSSANFRQRGNVNNNRIRQGYGSNVNEESWILERSSRQR

SEQ ID NO: 899 - DNA, 1494 bp, Oryza sativa
  misc_feature (1)..(1494): Ceres CLONE ID no.  478453
  misc_feature (1)..(1494): GEMINI ID 540G8
  misc_feature: Encodes the peptide sequence at SEQ ID NO. 900
  misc_feature: Encodes the peptide sequence at SEQ ID NO. 901
agggtccacttccgagtgagccaaaaccaaaactcacacctttcgcatccgtcagctctcaatcccattcggaaccaaatttcaattccaccaaaaaccctaatttcctttctctctaactcttagatcttcacgttttagggctttctccaccttccgcaatgcacaaattgggaagaggtcatcgtgacaaactccagcagttcataacaataactggagccagcgagaaactagccctgcaggctctgaaggctagtgattggcatcttgaaggagcatttgatttcttttacagccaaccccagcttaaaacatttactgattctaggcacttggaggagctatacaatagatataaagatgcatatgttgatatgattttggcagatggtatcactctcctttgcaatgatatccaggtggatcctcaagatatagtaatgttagttctttcatggcacatgaaggctggcaccatgtgtgaattttccaagaaggagtttattgaaggtctacaatctttggggattgattctctggaaaagttccgtgaaaagataccttatatgcgctctgagctgaaagatgaacagaaattccgtgagatatataattttgcttttggctgggcaaaagagaagggtcaaaaatctcttgcattggatactgctattggtatgtggcaattattatttgctgagaagcagtggccgctggttgatcattggtgccagttcttgcaggctcggcataacaaagcaatatctasggacacatggtctcagcttttggagtttgcaaagactgttggctcaaatttatctgattatgatgccgaaggtgcttggccatatcttattgatgaatttgtggagtatctcaacgagaatggcataatccaaaatgatctgatcaatgattctagtctaaaacgatgatgcattcaaatctcaataaattgttatttaagagaatttgatggagtctcttgtgatgagttgtgctattctgtgattgaactcctctttgttattaagtgggattcggtctaaattcaaaggggacatggctgctagagcaaactcattcttactgacaagtagtagcatcatttgtgagattgttgatatggcatatgaatttccttgggaagtattgtggaattagtaatgggagcctactaattccacggtgttatagtttctggtctctttttaatttaataattaattcttgaacgatgtcttgatagaagataagagacttacgtgattgtgattggctgtccttgtttctggtctagtttcatcttgtataatatgtggcaccaagttattaaaacattcatgaaatagagaaggggaaaaaataactatgttgtgggtctgttttcctttggaactatttagaagcaataccttgcatatcggttctatatgctcctacaatatggtatgttgtttatttggatatttaaaaatttgtcatctt

SEQ ID NO: 900 - protein, 259 aa, Oryza sativa
  misc_feature (1)..(259): Ceres CLONE ID no.  478453
  misc_feature (127)..(242): Pfam Name: DUF298 Pfam Description: Domain of unknown function (DUF298)
  misc_feature (7)..(44): Pfam Name: UBA Pfam Description: UBA/TS-N domain
  misc_feature (1)..(259): GEMINI ID 540G8
  misc_feature (204)..(204): Xaa is any aa, unknown, or other
MHKLGRGHRDKLQQFITITGASEKLALQALKASDWHLEGAFDFFYSQPQLKTFTDSRHLEELYNRYKDAYVDMILADGITLLCNDIQVDPQDIVMLVLSWHMKAGTMCEFSKKEFIEGLQSLGIDSLEKFREKIPYMRSELKDEQKFREIYNFAFGWAKEKGQKSLALDTAIGMWQLLFAEKQWPLVDHWCQFLQARHNKAISXDTWSQLLEFAKTVGSNLSDYDAEGAWPYLIDEFVEYLNENGIIQNDLINDSSLKR

SEQ ID NO: 901 - protein, 259 aa, Glycine max; identical to SEQ ID NO: 900
  misc_feature (1)..(259): Ceres CLONE ID no. 478453
  misc_feature (1)..(259): Functional Homolog of  Ceres CLONE ID no.  478453
  misc_feature (1)..(259): GEMINI ID 540G8
  misc_feature (127)..(242): Pfam Name: DUF298 Pfam Description: Domain of unknown function (DUF298)
  misc_feature (7)..(44): Pfam Name: UBA Pfam Description: UBA/TS-N domain
  misc_feature (204)..(204): Xaa is any aa, unknown, or other

SEQ ID NO: 902 - protein, 259 aa, Glycine max
  misc_feature (1)..(259): Ceres CLONE ID no. 480964
  misc_feature (1)..(259): Functional Homolog of  Ceres CLONE ID no.  478453
  misc_feature (127)..(242): Pfam Name: DUF298 Pfam Description: Domain of unknown function (DUF298)
MHKLGRGHRDKLQQFITITGASEKIALQALKASDWHLEGAFDFFYNQPQLKTFTDSRHLEELYNRYKDAYVDMILADGITVLCNDIQVDPQDIVMLVLSWHMKAGTMCEFSKKEFIEGLQSLGIDSLDKFREKIPYMRSELKDEQKFREIYNFAFGWAKEKGQKSLALDTAIGMWQLLFAEKQWPLVDHWCQFLQARHNKAISRDTWSQLLEFAKTVGSNLSDYDAEGAWPYLIDEFVEYLNENGIIQNGLINDSSLKW

SEQ ID NO: 903 - DNA, 1269 bp, Gossypium hirsutum
  misc_feature (1)..(1269): Ceres CLONE ID no.1923578
acccttttttatatttaaaaaaaaaaatcctctctcgtttcttctgaaacggaagggaggaaaagaaatttaaaggaaaaaaaaaatcattgcaatttcctcctccttctctctgtccctgcaacaatcgttcgacgatctataaaccttctctcctcaggattttagggtttttttcattttctactgtaaactccaaaatgcataaactgggcagaggtcatcgggacaaagtccagcagttcatgactataactggagcgagtgaaagacttgctcttcaagctttgaaggcgagtgattggcatcttgaaggagcttttgattttttctatggccagcagtctcatattaaaagttataccgatactacatatttggaagaactttataaaagatataaagatccttacacagatatgatactgcctgatggtattactcttctatgcaacgacctgcaggtggatccccaagatattgttatgttagttgtttcatggcacatgaaggcctccaccatgtgtgaatattccaaggaggaatttttcactgggttgcaggcactagggatagattctttggagaagtttcgtgagaggataccatttatgcgttctgagctgaaagatgaacaaaagttccgtgagatatataactttgcatttggctgggcaaaagaaaagggtcagaaatctttggcattggatactgcaatcggtatgtggcagttgctgttcgctgagaagcagtggccattggttgaccattggtgccagtttttacaggctcgacataacaaagcgatctctcgggacacatggtctcaacttttggagtttgctagaacggtagaccctgcactatcgaactacgatgccgaaggtgcatggccctatcttatagatgaattcgtggaatacttgaatgagaatggcatcattcaaagtggacagttcaagtgattggggagccataaatgataaaaaaggactgctcagtgccggccacggttgataatatcgtggaatttttgcaatctatcgttagtgcggtccgtattgtgatgccaatgacggaggtaagtgtttgatctttctgaaaaataagatgcaagatacctggtgtgattttattatatatggacttttagtgacaattggtacacaagtcacattatttttagtttcatgggattgttaatatggtttgtgaattttctttttaaattaatagattgagtttgattaaaaaaaaaaaaaaaaaaaa

SEQ ID NO: 904 - protein, 254 aa, Gossypium hirsutum
  misc_feature (1)..(254): Ceres CLONE ID no. 1923578
  misc_feature (1)..(254): Functional Homolog of  Ceres CLONE ID no.  478453
  misc_feature (128)..(243): Pfam Name: DUF298 Pfam Description: Domain of unknown function (DUF298)
  misc_feature (7)..(44): Pfam Name: UBA Pfam Description: UBA/TS-N domain
MHKLGRGHRDKVQQFMTITGASERLALQALKASDWHLEGAFDFFYGQQSHIKSYTDTTYLEELYKRYKDPYTDMILPDGITLLCNDLQVDPQDIVMLVVSWHMKASTMCEYSKEEFFTGLQALGIDSLEKFRERIPFMRSELKDEQKFREIYNFAFGWAKEKGQKSLALDTAIGMWQLLFAEKQWPLVDHWCQFLQARHNKAISRDTWSQLLEFARTVDPALSNYDAEGAWPYLIDEFVEYLNENGIIQSGQFK

SEQ ID NO: 905 - protein, 250 aa, Oryza sativa
  misc_feature (1)..(250): Public GI no. 51535194
  misc_feature (1)..(250): Functional Homolog of  Ceres CLONE ID no.  478453
  misc_feature (126)..(241): Pfam Name: DUF298 Pfam Description: Domain of unknown function (DUF298)
  misc_feature (7)..(44): Pfam Name: UBA Pfam Description: UBA/TS-N domain
MHKLGRGSRDKVQQFMTITGASEKVALQALKASDWHLEGAFDFFYSQPQISLTNSRHLEDLYNRYKEPDVDMIMVEGVSQFCTDLQVDPQDIVMLVISWHMKAATMCEFTRQEFIGGLQSIGVDSIEKLREKLPSLRAEIKDDHKFREIYNFAFAWAREKGQKSLALETALGMWQLLFAERHWPLIDHWCQFLQVRHNKAISRDTWSQLLEFVKTIDPQLSNYDEEGAWPYLIDEFVEYLTENGFVQLRK

SEQ ID NO: 906 - DNA, 1006 bp, Panicum virgatum
  misc_feature (1)..(1006): Ceres CLONE ID no.1956222
gagagagaggaataaaaaggagaggggcgagccggcgagagagcgctagaggccaaacagctcgagagcttctccgcgaaaccccacccctagcgccgccccttcccctccccgggcatcctccccgcgctccgatccaagatgtataagctggggagaggaaaccgcgacaaggtgcagcagttcatgaccataaccggcgccagtgagaaggttgcccttcaggcactgaaagctagtgattggcacttggaaggtgctttcgacttcttctatagccaacctcagatttctgcagtcaatgctcggcatcttgaagaaattttcaatagatacaaagaacctgatgctgatatgatcatggtggagggagtatctcaactttgcaatgatctgcaggtggatcctcaggatattgtcatgcttgtcatatcatggcacatgaaagccgccacaatgtgtgaatttactcgccaggaattcattggtggactgcagtctattggggtagattcaattgagaaatttcgtgcaaagttaccatcattacgagctgaactaaaagatgacaataagttccgtgagatatacaacttcgcgttcacttgggcaagagaaaagggtcaaaagtctctttcactggagactgctattgggatgtggcagttgctatttgctgacaggaactggcctcttctggatcattggtgccagtttttacaggtcaggcacaataaagccatatctagagacacgtgggcacaactgctggaatttgtaaagtcgattgatccacagctatccaactatgacgacgaaggtgcttggccctacctcatagatgaatttgtggaatacctgactgagaatgggttggttcagcgcaaaaagtgaactgcaacggggaggcctcgttcctcaccgaacaatggttgggctgtacaaacacaattcatctcggtgtatacgatgcccaggacccgacgttggcactcctgctcaatcc

SEQ ID NO: 907 - protein, 250 aa, Panicum virgatum
  misc_feature (1)..(250): Ceres CLONE ID no. 1956222
  misc_feature (1)..(250): Functional Homolog of  Ceres CLONE ID no.  478453
  misc_feature (126)..(241): Pfam Name: DUF298 Pfam Description: Domain of unknown function (DUF298)
  misc_feature (7)..(44): Pfam Name: UBA Pfam Description: UBA/TS-N domain
MYKLGRGNRDKVQQFMTITGASEKVALQALKASDWHLEGAFDFFYSQPQISAVNARHLEEIFNRYKEPDADMIMVEGVSQLCNDLQVDPQDIVMLVISWHMKAATMCEFTRQEFIGGLQSIGVDSIEKFRAKLPSLRAELKDDNKFREIYNFAFTWAREKGQKSLSLETAIGMWQLLFADRNWPLLDHWCQFLQVRHNKAISRDTWAQLLEFVKSIDPQLSNYDDEGAWPYLIDEFVEYLTENGLVQRKK

SEQ ID NO: 908 - protein, 250 aa, Zea mays
  misc_feature (1)..(250): Ceres CLONE ID no. 291139
  misc_feature (1)..(250): Functional Homolog of  Ceres CLONE ID no.  478453
  misc_feature (126)..(241): Pfam Name: DUF298 Pfam Description: Domain of unknown function (DUF298)
  misc_feature (7)..(44): Pfam Name: UBA Pfam Description: UBA/TS-N domain
MYKLGRGNRDKVQQFMTITGASEKVALQALKASDWHLEGAFDFFYSQPQVSVVNTRHLEDIFNRYKEPDADMIMVEGISQFCNDLQVDPQDIVMLVISWHMKAATMCEFTRQEFIGGLQSIGVDSIEKFRGKLPSLRAELKDDNKFRDIYNFAFTWAREKGQKSLSLETSIGMWQLLFAERNWPLLDHWCQFLQVRHNKAISRDTWSQLLEFVKTTDPQLSNYDDEGAWPYLIDEFVEYLTENGLVQRKR

SEQ ID NO: 909 - protein, 246 aa, Zea mays
  misc_feature (1)..(246): Ceres CLONE ID no. 689194
  misc_feature (1)..(246): Functional Homolog of  Ceres CLONE ID no.  478453
  misc_feature (126)..(241): Pfam Name: DUF298 Pfam Description: Domain of unknown function (DUF298)
  misc_feature (7)..(44): Pfam Name: UBA Pfam Description: UBA/TS-N domain
MHKLGRGSRDKVQQFMAITGASEKAALQALKASDWHLEGAFDVFYSQPQIAVANTRHLEELYNRYKEPDADMIMVEGISQICNDLQVDPQDIVMLVISWHMKASTMCEFTRQEFIGGLQSIGVDSIEKLQAKLPSLRAELKDDQKFHEIYNFAFAWAREKGQKSLALETAIGMWQLLFAERSWPLIDYWCQFLQVRHNKAISRDTWAQLLEFVKTIDPQLTNYDEEGAWPYLIDEFVDYLKENGLA

SEQ ID NO: 910 - protein, 247 aa, Triticum aestivum
  misc_feature (1)..(247): Ceres CLONE ID no. 569584
  misc_feature (1)..(247): Functional Homolog of  Ceres CLONE ID no.  478453
  misc_feature (123)..(238): Pfam Name: DUF298 Pfam Description: Domain of unknown function (DUF298)
  misc_feature (7)..(44): Pfam Name: UBA Pfam Description: UBA/TS-N domain
MHKLGRGSRDKVQQFMAITGASEKVALQALKASDWHLEGSFDYFYSQPQISVTNSRHLYSRYKERDADMIMVEGTSQLCNDLLVDPQDVVMLVISWHMKAATMCEFTRQEFIDGLQSIGVDSIEKLREKLPSLRAEIKDDNKFREIYNFAFAWAREKGQKSLPLETAIGMWRLLFAERHWPLIDHWCQFLQVRHNKAISRDTWSQLLEFVKTIDPQLSNYDEEGAWPYLIDEFVEYLTENGCVQRNK

SEQ ID NO: 911 - DNA, 1190 bp, Panicum virgatum
  misc_feature (1)..(1190): Ceres CLONE ID no.1724040
ggccaacagctcgagcttctccgcgaaccccacccctagcgccgccccttcccttccccgggcgccctccccggcatcctccccgctctccgatccaagatgtataagctggggagaggaaaccgcgacaaggtgcagcagttcatggccataaccggcgccagtgagaaggttgcccttcaggcactgaaagctagtgattggcacttggaaggagcttttgacttcttctatagccaacctcagatttctgctgtcaatactcggcatcttgaagacattttcaatagatacaaagaacctgatgctgatatgatcatggtggagggagtatctcagctttgcaatgatctgcaggtggagcctcaggatattgtcatgcttgtcatatcatggcacatgaaagccgccacaatgtgtgaatttactcgccaggaattcattggtggactgcagtctattggggtagattcaatcgagaaatttcgtgcaaagttaccatcattacgagctgagctaaaagatgataataagttccgtgagatatacaacttcgcgttcacttgggcaagagaaaagggtcaaaagtctctctcactggagactgctattgggatgtggcagttgctatttgctgaaaggaactggcctcttctggatcattggtgccaatttttacaggtcaggcacaataaagccatatctagagacacctgggcgcagctgctggaatttgtaaagtcgattgatccacagctatccaactatgacgacgaaggtgcttggccctacctcatagatgaatttgtggaatacctgactgacaatgggttggttcagcgcacgaaatgaactgcaatggggaggattcgcccctcaccgaacaaacggttgggctgtacaaacacgattcatcttggtgtatacggtgcccaggacccgatgttggcactcctgctcaatccactcgccaaactgttggcctatcattgcatgacagaatttgctgataaacgcggagaaaacgcaacctaagcctgggaagtggtggtcccgagcctgccatcgtgaactactccaaaatgcactggggagtttgggactctggttaacgtacaagttgtttcggatgtatcactgtcacttgctactatatttctattatccctcaaaaaaaaaaaaaaaaaaaa

SEQ ID NO: 912 - protein, 250 aa, Panicum virgatum
  misc_feature (1)..(250): Ceres CLONE ID no. 1724040
  misc_feature (1)..(250): Functional Homolog of  Ceres CLONE ID no.  478453
  misc_feature (126)..(241): Pfam Name: DUF298 Pfam Description: Domain of unknown function (DUF298)
  misc_feature (7)..(44): Pfam Name: UBA Pfam Description: UBA/TS-N domain
MYKLGRGNRDKVQQFMAITGASEKVALQALKASDWHLEGAFDFFYSQPQISAVNTRHLEDIFNRYKEPDADMIMVEGVSQLCNDLQVEPQDIVMLVISWHMKAATMCEFTRQEFIGGLQSIGVDSIEKFRAKLPSLRAELKDDNKFREIYNFAFTWAREKGQKSLSLETAIGMWQLLFAERNWPLLDHWCQFLQVRHNKAISRDTWAQLLEFVKSIDPQLSNYDDEGAWPYLIDEFVEYLTDNGLVQRTK

SEQ ID NO: 913 - DNA, 1560 bp, Oryza sativa
  misc_feature (1)..(1560): Ceres CLONE ID no.  479006
  misc_feature (1)..(1560): GEMINI ID 540B6
atcacaaatatggaagaagaagctcctccagtgccacctgcaccgcccatagtggccatgctgccatcccctggcatgggccacctaatcccaatgatcgagttcgccaagcgagcggtgcgctaccataacctggccgtcaccttcgtcatccccactgacggcccaccttctaaagcccaaaaggccgtcttccaggccctcccggactccatttcccacaccttcctccctccggtcaatctctccgactttccaccgggcaccaaaattgaaaccctgatctcccacaccgtcctcctctccctcccttccctccgccaagccttccactccctctcctccacatacaccctcgccgccgtcgtcgtcgacctcttcgccaccgacgccttcgacgtcgccgccgaattcaatgcctccccctacgtcttctacccctccacagccaccgtcctctccatcgccctccacctccccaccctcgacaagcaggtccagtgcgagttccgagacctcccggaaccggtcaccatccccggttgcattcctcttcccgtcaaggactttctagacccggttctggagcgcaccaacgaggcctacaagtgggtcctacaccactccaagcgctaccgagaagccgagggaatcatcgagaacagcttcgccgaactcgaaccgggcgcctggaacgagctgcagagggaacaaccgggacggcctccggtttatgcggtcgggccgcttgtgagaatggaacccggtcccgccgactccgagtgcttgaggtggttggacgagcagccacgtggcagcgtgttgtttgtttccttcggaagcggtgggaccctctccagcgcccagatcaacgaactggctctcgggttggaaaatagccagcaacggttcttgtgggtggtgaagagcccaaacgatgcaatagccaacgcgacttacttcaacgcggagagccacgaggatcccttgcagttcttaccagaagggttcgtggagagaacaaaaggaaggggctttttggttaagtcatgggctccgcagccacaggttctggcccatcaatcaacgggaggattcttgagccattgcggctggaactctatactggagagcgtggtgaacggcgtgcctttaatagcctggcctctgttcgcggagcagaggaccaacgcgtttatgctcatgcatgaagtcaaggtggcgctgaggcccaaagttgccgaggacactggacttgtccagagccaggaaatagccagcgttgtcaagtgcctcatggaaggccatgaagggaagaagcttcgttaccgaatcaaggatctcaaggaggctgcggctaaggctctctctccaaatggttcctccaccgaccatatctccaatttggttctcaagtggaccaacaaaaccaccatctctactagtggctagcttttatttttcttcttcttcttcctgtaattttattatctgcacttataaaatgtcgctttatgtatttattttatctgggatgatgataaaggtttggtttggttc

SEQ ID NO: 914 - protein, 480 aa, Oryza sativa
  misc_feature (1)..(480): Ceres CLONE ID no.  479006
  misc_feature (1)..(480): GEMINI ID 540B6
  misc_feature (259)..(395): Pfam Name: UDPGT Pfam Description: UDP-glucoronosyl and UDP-glucosyl transferase
MEEEAPPVPPAPPIVAMLPSPGMGHLIPMIEFAKRAVRYHNLAVTFVIPTDGPPSKAQKAVFQALPDSISHTFLPPVNLSDFPPGTKIETLISHTVLLSLPSLRQAFHSLSSTYTLAAVVVDLFATDAFDVAAEFNASPYVFYPSTATVLSIALHLPTLDKQVQCEFRDLPEPVTIPGCIPLPVKDFLDPVLERTNEAYKWVLHHSKRYREAEGIIENSFAELEPGAWNELQREQPGRPPVYAVGPLVRMEPGPADSECLRWLDEQPRGSVLFVSFGSGGTLSSAQINELALGLENSQQRFLWVVKSPNDAIANATYFNAESHEDPLQFLPEGFVERTKGRGFLVKSWAPQPQVLAHQSTGGFLSHCGWNSILESVVNGVPLIAWPLFAEQRTNAFMLMHEVKVALRPKVAEDTGLVQSQEIASVVKCLMEGHEGKKLRYRIKDLKEAAAKALSPNGSSTDHISNLVLKWTNKTTISTSG

SEQ ID NO: 915 - protein, 487 aa, Glycine max
  misc_feature (1)..(487): Ceres CLONE ID no. 1054168
  misc_feature (1)..(487): Functional Homolog of  Ceres CLONE ID no.  479006
  misc_feature (261)..(397): Pfam Name: UDPGT Pfam Description: UDP-glucoronosyl and UDP-glucosyl transferase
  misc_feature (331)..(331): Xaa is any aa, unknown, or other
  misc_feature (457)..(457): Xaa is any aa, unknown, or other
MEVSKEEARVAPAPALVAMLPSPGMGHLIPMIEFAKRVVCYHNLAVSFVIPTDGPPSKAQKAVLEALPDSISHTFLPPVNLSDFPPDTKIETLISHTVLRSLPSLRQAFHSLSATNTLSAVVVDLFSTDAFDVAAEFNASPYVFYPSTATVLSLFFHLPTLDQQVQCEFRDLPEPVSIPGCIPLPGKDLLDPVQDRKNEAYKWILHHCKRYKEAEGIIGNSFEELEPGAWNELQKEEQGRPPVYAVGPLVRMEAGQADSECLRWLDEQPRGSVLFVSFGSGGTLSSAQINELALGLEKSEQRFLWVVKSPNEEIANATYFSAESQADPLQXLPEGFVERTKGRGFLVQSWAPQPQVLGHPSTGGFLTHCGWNSILESVVNGVPFIAWPLFAEQRTNAFMLTHDVKVALRPNVAESGLVERQEIASLVKCLMEGEQGKKLRYRIKDIKEAAAKALAQXWFLHHQHLPIWLSSGPTNSTSSFFLSIICT

SEQ ID NO: 916 - DNA, 1410 bp, Populus balsamifera subsp. trichocarpa
  misc_feature (1)..(1410): Ceres ANNOT ID no. 1444387
atggcacaaacagatgcaccagcccatgtagcaattttaccgagtccggggatgggtcatctcatccctctcgttgagctagccaagagactcgttcaccaacacaacttttcaatcactttcgttatcccaacagacggttctacctctaaggcacagagatcagttcttggatcactccctagcgcaattcactcagtatttctcccccaagttaatctaagtgacctccctgaagatgtcaagattgaaaccacaattagccatacagtcgcccggtcactcccttctctacgtgatgttttcaggtctctagttgatggaggcgccagggttgtggccttggttgttgatctttttgggactgatgcatttgacgttgctagagaattcaatgtctctccttacattttctttccttctacggccatggctctgtctttattctttcatttgccaaagcttgatgagatggtttcttgcgaatacagagagatgcaagaacccgtgaaaatacccgggtgcttaccgattcatgggggagagttgcttgacccgactcaagatcgaaagaatgacgcgtacaaatggcttctttaccatacaaataggtatagaatggctgagggtgtgatggtaaatagcttcatggacttggaaaagggagctctaaaggctttgcaagaggtagaacctggtaaaccaaccgtttaccccgtcggtccactggtgaatatggattccagtgctggcgttgaagggtctgagtgtttgaggtggctagatgatcagccacacggctcagtattatttgtttcatttgggagtggtgggaccctctctttggatcagataactgaattggctttgggtttggaaatgagcgagcagagatttttgtgggttgtgaggagcccaaatgataaagtatctaatgccacatttttttctgtggatagccacaaagacccttttgatttcttaccgaagggtttttcggacaggaccaaagggagaggtctagcagtgccgtcatgggcgccacaaccacaggtgttgggtcacgggtcaacaggagggttcttaacccattgtggctggaattccacccttgaaagtgtcgtgaatggtgtgccattaatcgtgtggccactctatgctgagcagaaaatgaatgcatggatgttgactaaggatattaaagtggccttaagaccaaaggccagcgaaaatggcctcattggaagagaggagattgcaaatgctgtgaggggtctaatggaaggtgaagaagggaagagggtccgcaacagaatgaaggacctaaaagaggcagcagccagggtgctcagtgaagatggatctctatctgagctggctcacaagtggaagaaccaaaaatgcacttag

SEQ ID NO: 917 - protein, 469 aa, Populus balsamifera subsp. trichocarpa
  misc_feature (1)..(469): Ceres ANNOT ID no. 1444387
  misc_feature (1)..(469): Functional Homolog of  Ceres CLONE ID no.  479006
  misc_feature (346)..(393): Pfam Name: UDPGT Pfam Description: UDP-glucoronosyl and UDP-glucosyl transferase
MAQTDAPAHVAILPSPGMGHLIPLVELAKRLVHQHNFSITFVIPTDGSTSKAQRSVLGSLPSAIHSVFLPQVNLSDLPEDVKIETTISHTVARSLPSLRDVFRSLVDGGARVVALVVDLFGTDAFDVAREFNVSPYIFFPSTAMALSLFFHLPKLDEMVSCEYREMQEPVKIPGCLPIHGGELLDPTQDRKNDAYKWLLYHTNRYRMAEGVMVNSFMDLEKGALKALQEVEPGKPTVYPVGPLVNMDSSAGVEGSECLRWLDDQPHGSVLFVSFGSGGTLSLDQITELALGLEMSEQRFLWVVRSPNDKVSNATFFSVDSHKDPFDFLPKGFSDRTKGRGLAVPSWAPQPQVLGHGSTGGFLTHCGWNSTLESVVNGVPLIVWPLYAEQKMNAWMLTKDIKVALRPKASENGLIGREEIANAVRGLMEGEEGKRVRNRMKDLKEAAARVLSEDGSLSELAHKWKNQKCT

SEQ ID NO: 918 - DNA, 1597 bp, Gossypium hirsutum
  misc_feature (1)..(1597): Ceres CLONE ID no.1886347
cttcgtgccaaaaactacaccctataaacagtagagaaaggaaggcaagaaagagtagttccgttttagttttcattttcatggcaaagttgcaaacaccccatatagccattctgccgagtcctggaatgggtcacctcattccactcgttcagttcgccaggtcactcgttcaccaacacaacttcattgtcacctttgttatccccaccaatgattctccttctaaagctcaaaaatcagttcttgactctcttcccacctccattactcatatctttcttcatcctgctgacttgtctgaccttcccctggattcaaagattgaaactgtcatttctttaaccctggctcgttccctttctttccttcgggatgctttcaagtctatggttgataaaactaacctagttgctttggtggttgatcttttcgggactgacgcattcgatgttgcgagagaattcaatgtttccccctatatatttttccctgccacggccatgactttgtctctgtttctttacttaccaaagctcgaccaaatggttccatgcgaatacagggaccggccggaactggtgagaattccagggtgcataccgattcacggtaaagaattgttggacccgactcaagacaggaaaaacgatgcttacaagtggcttcttcttcatacaaagcggtatagattggctgaaggaattatggtcaacagtttcgtggacttggaagcgggtgcaataaaggctttgcaggagaaagaaccgggtaagcctccagtttatccggttgggccacttgttaacattgaccccagtaaagtggatgatggttcggattgtctgaagtggctagatgatcagccacatgggtcggttttgtatgtctcatttgggagcggggggaccctttcttataaccagatacatgagttggctttggggttggaaatgagtgagcagcgatttctatgggtggtgagaagtccaaatgatgcggttgcaaacgccacatatttcagcgtagagagtgagaaggacccttttgattttctacccaagggatttctcgagagaaccaaaggacgggggctagtggtggcatcgtgggcaccacaggctcaggtgctgagccacggctctacaggtgggtttttgacccattgtggatggaactcgactcttgaaagtgtcgtgaatggggtgccgctaatcgcatggccactctacgcggaacagaagatgaatgccctgatgctaattgaggatattaaagttgcattgagaccaaaacccaatgaaaacggtttagtttgccaagacgagatcgcaaaggctgttaaggttctaatggaaggtgaagagggtaaaggtgttcgaaacagaatgaaacacctcaaggaagcagcttcgaagttactgggtgaaaatgggtgttccaccaaggcactctctcaggtggctagtaagtggaggaatcagactgccatctagaatccgaaaccgcacccatttccatttaccataaagttactgtcaatttaatgaaaaaaataaagtacaaaatatttgttgaaaaaaaaaaaaaaaaaaaa

SEQ ID NO: 919 - protein, 471 aa, Gossypium hirsutum
  misc_feature (1)..(471): Ceres CLONE ID no. 1886347
  misc_feature (1)..(471): Functional Homolog of  Ceres CLONE ID no.  479006
  misc_feature (266)..(391): Pfam Name: UDPGT Pfam Description: UDP-glucoronosyl and UDP-glucosyl transferase
MAKLQTPHIAILPSPGMGHLIPLVQFARSLVHQHNFIVTFVIPTNDSPSKAQKSVLDSLPTSITHIFLHPADLSDLPLDSKIETVISLTLARSLSFLRDAFKSMVDKTNLVALVVDLFGTDAFDVAREFNVSPYIFFPATAMTLSLFLYLPKLDQMVPCEYRDRPELVRIPGCIPIHGKELLDPTQDRKNDAYKWLLLHTKRYRLAEGIMVNSFVDLEAGAIKALQEKEPGKPPVYPVGPLVNIDPSKVDDGSDCLKWLDDQPHGSVLYVSFGSGGTLSYNQIHELALGLEMSEQRFLWVVRSPNDAVANATYFSVESEKDPFDFLPKGFLERTKGRGLVVASWAPQAQVLSHGSTGGFLTHCGWNSTLESVVNGVPLIAWPLYAEQKMNALMLIEDIKVALRPKPNENGLVCQDEIAKAVKVLMEGEEGKGVRNRMKHLKEAASKLLGENGCSTKALSQVASKWRNQTAI

SEQ ID NO: 920 - DNA, 1494 bp, Populus balsamifera subsp. trichocarpa
  misc_feature (1)..(1494): Ceres ANNOT ID no. 1471286
atggcagaaacagattcaccaccccatgtagcaattttacctagtccagggatgggtcatctcatcccactcgttgagttagccaagagacttgttcaccaacacaacttgtcagtcaccttcatcattccgacagacggttctccctctaaagctcaaagatcagttcttggatcactccctagcactattcactcagtatttctcccccctgtaaatttaagtgacctccctgaagatgtcaagattgaaaccttaattagccttaccgtggctcgctcccttccttctctacgtgatgttcttagttctctagtcgccagtggtactagagttgtggccttggttgttgatctttttgggactgatgcatttgatgttgctagagaattcaaagcctctccttacattttctatcctgctccagccatggctttgtctttattcttttatttgccaaagcttgatgagatggtttcttgcgagtacagtgagatgcaagaaccagttgagattcccgggtgcttaccgattcacgggggggagttgctcgacccaacccgagatcgaaagaacgatgcgtataaatggcttcttcaccattcaaagaggtatagattggctgagggggtgatggtaaatagcttcattgacttggaaaggggggctctaaaggctttgcaagaggtagaacccggtaagccacccgtttacccggttggtccactcgtcaatatggattccaatactagtggggttgaagggtccgagtgtttgaagtggctagatgatcagccacttggctcagtgctatttgtttcgttcgggagtggcgggaccctctcgtttgatcagataactgaattggctctgggtttggaaatgagcgagcaaagatttttgtgggttgcgagggttccaaatgataaagtagctaatgccacatatttttccgtggataatcataaggacccttttgatttcttaccaaaaggttttttggataggaccaaggggagaggtctagtggtgccatcatgggcaccacaagcacaagtgctgagtcacgggtcaacaggtgggttcttaacccactgtggttggaattccacccttgaaagtgttgtgaatgctgtgccattaatcgtatggccactctatgctgagcagaaaatgaatgcatggatgctaaccaaggacgttgaagtagccttgaggcctaaggccagtgaaaatggtctaattggaagagaggagattgcaaatattgtgaggggtctaatggaaggtgaggaagggaagagggtccgcaacagaatgaaggacctgaaagacgcagccgccgaggtactcagcgaagctggatcttctacgaaggcactatctgaggtggctcgcaagtggaagaaccacaaatgcactcaggatttgaagtcattggcactaggaggaggatcaaatgaggtaggtggctggatattggcacctcaataa

SEQ ID NO: 921 - protein, 497 aa, Populus balsamifera subsp. trichocarpa
  misc_feature (1)..(497): Ceres ANNOT ID no. 1471286
  misc_feature (1)..(497): Functional Homolog of  Ceres CLONE ID no.  479006
  misc_feature (269)..(394): Pfam Name: UDPGT Pfam Description: UDP-glucoronosyl and UDP-glucosyl transferase
MAETDSPPHVAILPSPGMGHLIPLVELAKRLVHQHNLSVTFIIPTDGSPSKAQRSVLGSLPSTIHSVFLPPVNLSDLPEDVKIETLISLTVARSLPSLRDVLSSLVASGTRVVALVVDLFGTDAFDVAREFKASPYIFYPAPAMALSLFFYLPKLDEMVSCEYSEMQEPVEIPGCLPIHGGELLDPTRDRKNDAYKWLLHHSKRYRLAEGVMVNSFIDLERGALKALQEVEPGKPPVYPVGPLVNMDSNTSGVEGSECLKWLDDQPLGSVLFVSFGSGGTLSFDQITELALGLEMSEQRFLWVARVPNDKVANATYFSVDNHKDPFDFLPKGFLDRTKGRGLVVPSWAPQAQVLSHGSTGGFLTHCGWNSTLESVVNAVPLIVWPLYAEQKMNAWMLTKDVEVALRPKASENGLIGREEIANIVRGLMEGEEGKRVRNRMKDLKDAAAEVLSEAGSSTKALSEVARKWKNHKCTQDLKSLALGGGSNEVGGWILAPQ

SEQ ID NO: 922 - protein, 470 aa, Rauvolfia serpentina
  misc_feature (1)..(470): Public GI no. 13508844
  misc_feature (1)..(470): Functional Homolog of  Ceres CLONE ID no.  479006
  misc_feature (342)..(389): Pfam Name: UDPGT Pfam Description: UDP-glucoronosyl and UDP-glucosyl transferase
MEHTPHIAMVPTPGMGHLIPLVEFAKRLVLRHNFGVTFIIPTDGPLPKAQKSFLDALPAGVNYVLLPPVSFDDLPADVRIETRICLTITRSLPFVRDAVKTLLATTKLAALVVDLFGTDAFDVAIEFKVSPYIFYPTTAMCLSLFFHLPKLDQMVSCEYRDVPEPLQIPGCIPIHGKDFLDPAQDRKNDAYKCLLHQAKRYRLAEGIMVNTFNDLEPGPLKALQEEDQGKPPVYPIGPLIRADSSSKVDDCECLKWLDDQPRGSVLFISFGSGGAVSHNQFIELALGLEMSEQRFLWVVRSPNDKIANATYFSIQNQNDALAYLPEGFLERTKGRCLLVPSWAPQTEILSHGSTGGFLTHCGWNSILESVVNGVPLIAWPLYAEQKMNAVMLTEGLKVALRPKAGENGLIGRVEIANAVKGLMEGEEGKKFRSTMKDLKDAASRALSDDGSSTKALAELACKWENKISST

SEQ ID NO: 923 - protein, 480 aa, Arabidopsis thaliana
  misc_feature (1)..(480): Public GI no. 14532902
  misc_feature (1)..(480): Functional Homolog of  Ceres CLONE ID no.  479006
  misc_feature (237)..(393): Pfam Name: UDPGT Pfam Description: UDP-glucoronosyl and UDP-glucosyl transferase
MEESKTPHVAIIPSPGMGHLIPLVEFAKRLVHLHGLTVTFVIAGEGPPSKAQRTVLDSLPSSISSVFLPPVDLTDLSSSTRIESRISLTVTRSNPELRKVFDSFVEGGRLPTALVVDLFGTDAFDVAVEFHVPPYIFYPTTANVLSFFLHLPKLDETVSCEFRELTEPLMLPGCVPVAGKDFLDPAQDRKDDAYKWLLHNTKRYKEAEGILVNTFFELEPNAIKALQEPGLDKPPVYPVGPLVNIGKQEAKQTEESECLKWLDNQPLGSVLYVSFGSGGTLTCEQLNELALGLADSEQRFLWVIRSPSGIANSSYFDSHSQTDPLTFLPPGFLERTKKRGFVIPFWAPQAQVLAHPSTGGFLTHCGWNSTLESVVSGIPLIAWPLYAEQKMNAVLLSEDIRAALRPRAGDDGLVRREEVARVVKGLMEGEEGKGVRNKMKELKEAACRVLKDDGTSTKALSLVALKWKAHKKELEQNGNH

SEQ ID NO: 924 - protein, 480 aa, Arabidopsis thaliana; identical to SEQ ID NO: 923
  misc_feature (1)..(480): Ceres CLONE ID no. 1204
  misc_feature (1)..(480): Functional Homolog of  Ceres CLONE ID no.  479006
  misc_feature (237)..(393): Pfam Name: UDPGT Pfam Description: UDP-glucoronosyl and UDP-glucosyl transferase

SEQ ID NO: 925 - protein, 462 aa, Arabidopsis thaliana
  misc_feature (1)..(462): Public GI no. 2191136
  misc_feature (1)..(462): Functional Homolog of  Ceres CLONE ID no.  479006
  misc_feature (219)..(375): Pfam Name: UDPGT Pfam Description: UDP-glucoronosyl and UDP-glucosyl transferase
MEESKTPHVAIIPSPGMGHLIPLVEFAKRLVHLHGLTVTFVIAGEGPPSKAQRTVLDSLPSSISSVFLPPVDLTDLSSSTRIESRISLTVTRSNPELRKVFDSFVEGGRLPTALVVDLFGTDAFDVAVEFHVPPYIFYPTTANVLELTEPLMLPGCVPVAGKDFLDPAQDRKDDAYKWLLHNTKRYKEAEGILVNTFFELEPNAIKALQEPGLDKPPVYPVGPLVNIGKQEAKQTEESECLKWLDNQPLGSVLYVSFGSGGTLTCEQLNELALGLADSEQRFLWVIRSPSGIANSSYFDSHSQTDPLTFLPPGFLERTKKRGFVIPFWAPQAQVLAHPSTGGFLTHCGWNSTLESVVSGIPLIAWPLYAEQKMNAVLLSEDIRAALRPRAGDDGLVRREEVARVVKGLMEGEEGKGVRNKMKELKEAACRVLKDDGTSTKALSLVALKWKAHKKELEQNGNH

SEQ ID NO: 926 - DNA, 1871 bp, Panicum virgatum
  misc_feature (1)..(1871): Ceres CLONE ID no.1858581
aacccaccaccaccggatcagctgctagcttcctcctcccacatcaggcggcgccagccgaggacaccgtcggagcccacaaccacccacccgaataaggcacccgcacaccccacctccggccggccggaaacaccgcgcgcccggaatggagaacggcaacggcgcgtcgccgtgctgcaacggcaacggcaacggcaacggcgcggcggcggcggcgccgccgccgcacgtggcgatgctggtgacgccggggatgggccacctgatcccgctggcggagctggccaagcggctggcgcggcggcacggcgcgacggcgacgctcctcacgttcgcgtcggcggcgtcggccacgcagcgcgcgttcctggcgtcgctgccgcccgccgtcacctccctggcgctcccgcccgtcgacctctccgacctgccccgcggcgccgccatcgagacgctcatgtccgaggagtgcgcgcgcagcgtgccggcgctcaccgacatcctccgggacctgcggcggcgcacccgcctcgtcgccttcgtcgccgacctcttcggcgccgactcgttcgacgccgcgcgcgccgcgggggtcgcccggcggtacctcttcttcccctccaacctccacgcgctcacgctcttcctccacctcccggagctcgacgccgccgtgcccggcgagttccgcgacctcgccgagccgctgcgcctccccgggtgcgtgcccatcccggggcccgacgtgctcatgccgctgcaggacaagtccaacccctgctacaggtggatggtccaccacggcgccaagtaccgcgaggccgacgccatcctcgtcaactccttcgacgccgccgagccgggccccgccaagatcctccggcagccggcgcccgggcgccccgccgtgttccccgtcggcccgctcatccaggccgaccgcggcggcagcgacgggccgtgcccgtgcctcgagtggctcgaccggcagccggcccggtcggtcatcttcgtctccttcggctccggcggcgcgctgccggccgagcagatgcgggagctcgcgctcgggctggagctcagcgggcagcgcttcctgtgggtggtgcggagccccagcgacgagggcgccgtcaacgacaactactacgacgccgagagcaagaaggaccccttcgcgtacctgcccgagggcttcgtcgaccggacccgcgacgtgggcctcgtggtgccctcgtgggccccgcagataaaggtcctggcccacggggccaccggcgggttcctgacgcactgcgggtggaactcggtgctggagagcctcgtgtacggcgtgcccatggtggcgtggccgctctacgccgagcagcggcagaacgcggtgatgctgtcggagggggtcggcgtcgcgatccgcgtccccgagtccaaggggcgggagaagatcgcggcggcggtgcaggaggtgatggagggtgagggcagaggcgccgcagtgcgggccaaggtggcggagctgcagaaggccgcggcggaggggctccaggaaggcggcgccgccacggcggcgctcgccgaggtggtggagaagtggacgtgcgaggagaactagagatgatgctgagctgagtgtgcagctgccaatccatcccattcacagctactatcctccccctccagcaccaccatctttggggcctagccggctccatggtttgtccgtttgtaaattattccaaacttttgatttgtattttgtatcttatcatacaacctgtaactatccatgcatgtcctactccattggtaggtaggagtatactaataaggtagctttgtgcgtatcagaaaaaaaaaaaaaaaaaaaa

SEQ ID NO: 927 - protein, 488 aa, Panicum virgatum
  misc_feature (1)..(488): Ceres CLONE ID no. 1858581
  misc_feature (1)..(488): Functional Homolog of  Ceres CLONE ID no.  479006
  misc_feature (272)..(445): Pfam Name: UDPGT Pfam Description: UDP-glucoronosyl and UDP-glucosyl transferase
MENGNGASPCCNGNGNGNGAAAAAPPPHVAMLVTPGMGHLIPLAELAKRLARRHGATATLLTFASAASATQRAFLASLPPAVTSLALPPVDLSDLPRGAAIETLMSEECARSVPALTDILRDLRRRTRLVAFVADLFGADSFDAARAAGVARRYLFFPSNLHALTLFLHLPELDAAVPGEFRDLAEPLRLPGCVPIPGPDVLMPLQDKSNPCYRWMVHHGAKYREADAILVNSFDAAEPGPAKILRQPAPGRPAVFPVGPLIQADRGGSDGPCPCLEWLDRQPARSVIFVSFGSGGALPAEQMRELALGLELSGQRFLWVVRSPSDEGAVNDNYYDAESKKDPFAYLPEGFVDRTRDVGLVVPSWAPQIKVLAHGATGGFLTHCGWNSVLESLVYGVPMVAWPLYAEQRQNAVMLSEGVGVAIRVPESKGREKIAAAVQEVMEGEGRGAAVRAKVAELQKAAAEGLQEGGAATAALAEVVEKWTCEEN

SEQ ID NO: 928 - DNA, 1720 bp, Panicum virgatum
  misc_feature (1)..(1720): Ceres CLONE ID no.1769251
agccaacccaccaccaccggatcagcttcctcccggattaggcggcgccagccgaggacaccgtcggaaccaaccaaccacccgaacaaggcgcccagaatggagaacggcaacggcggcccgtcgtcgtgctgcaacggcaacggctcggtggcgccgccgcacgtggcgatgctggtgacgccggggatggggcacctgatcccgctggcggagctggccaagcggctggcgtcgcggcacggcgccacggcgacgctcctcacgttcgcgtcgacggcgtcggccacgcagcgcgcgttcctggcgtcgctgccgcccgccgtgtcgtcccgggcgctcccgcccgtcgacctctccgacctgccccgcggcgccgccatcgagacgctcatgtccgaggagtgcgcgcgcagcgtgccggcgctcaccggcatcctccgggacctgcggcggaccacccgcctcgtcgcgttcgtcgccgacctcttcggcgcggactcgttcgacgccgcgcgcgccgcgggggtcgcccggaggtacatcttcttcccgaccaacctccacgtgctcacgctcctcctccacctcccggagctcgacgcctccgtgcccggcgagttccgggacctcgccgagccgctccgcctccccgggtgcgtgcccatcccggggcccgacgtgctcatgccgctgcaggacaagtccaacccctgctacaagtggatggtccaccacggcgccaagtaccgcgaggccgacgccatcctcgtcaactccttcgacgccgtcgagccgggccccgccaagatcctccggcagccggcgcccgggaacccggcggtgttccccatcggcccgctcatccaggccgaccgcggcggcagcgacgacgggccgtgcccgtgcctggagtggctcgaccggcagccggcccgctcggtcatcttcgtctccttcggctccggcggcgcgctgccggccgagcagatgcgggagctcgccctcggcctggagctcagcgggcagcgcttcctgtgggtggtgcgcagccccagcgacgagggcgccgtcaacgacaactactacgacgccgagagcaagaaggaccccttcgcgtacctgcccgaaggcttcgtcgagcggacccgggccgtgggcctcgtggtgccctcgtgggccccgcagataaaggtgctggcccacggggccacgggcgggttcctgacgcactgcgggtggaactcggtgctggagagcctcgtctacggcgtgcccatggtggcgtggccgctctacgccgagcagcggcagaacgcggcgatgctgtcggaaggggtcggcgccgcgatccgcgtccccgagtccaaggggcgggagaagatcgcggcggcggtgcgggaggtgatgcagggggaaggccgaggtgccgcggtgcgagctaaggtggcggagctgcagaaggccgcggcggaagggctccgggaaggcggcgccgcggccgcggcgctcgccgaggtggtggagaagtggacgtgcggggagaactagacgatgctgagcctgaactgtgtgcagctaccaccaatccatcccagctgcccctccaccatccttgggctggggccccaccatgcatggtttgtccttttgtaaactattccagacttttggtttgtatttttggccacagtttcggcaaaaaaaaaaaaaaaaaaaa

SEQ ID NO: 929 - protein, 483 aa, Panicum virgatum
  misc_feature (1)..(483): Ceres CLONE ID no. 1769251
  misc_feature (1)..(483): Functional Homolog of  Ceres CLONE ID no.  479006
  misc_feature (267)..(440): Pfam Name: UDPGT Pfam Description: UDP-glucoronosyl and UDP-glucosyl transferase
MENGNGGPSSCCNGNGSVAPPHVAMLVTPGMGHLIPLAELAKRLASRHGATATLLTFASTASATQRAFLASLPPAVSSRALPPVDLSDLPRGAAIETLMSEECARSVPALTGILRDLRRTTRLVAFVADLFGADSFDAARAAGVARRYIFFPTNLHVLTLLLHLPELDASVPGEFRDLAEPLRLPGCVPIPGPDVLMPLQDKSNPCYKWMVHHGAKYREADAILVNSFDAVEPGPAKILRQPAPGNPAVFPIGPLIQADRGGSDDGPCPCLEWLDRQPARSVIFVSFGSGGALPAEQMRELALGLELSGQRFLWVVRSPSDEGAVNDNYYDAESKKDPFAYLPEGFVERTRAVGLVVPSWAPQIKVLAHGATGGFLTHCGWNSVLESLVYGVPMVAWPLYAEQRQNAAMLSEGVGAAIRVPESKGREKIAAAVREVMQGEGRGAAVRAKVAELQKAAAEGLREGGAAAAALAEVVEKWTCGEN

SEQ ID NO: 930 - protein, 484 aa, Triticum aestivum
  misc_feature (1)..(484): Ceres CLONE ID no. 630211
  misc_feature (1)..(484): Functional Homolog of  Ceres CLONE ID no.  479006
  misc_feature (273)..(440): Pfam Name: UDPGT Pfam Description: UDP-glucoronosyl and UDP-glucosyl transferase
MEANGISGGTAEAAARRPPHVAMLVTPGMGHLIPLAELAKRLAARHGVTATLITFASTASATQRAFLASLPPGISSLSLPPVDLSDLPPDASIEMLMSEECVRLVPALTEALSRLMETTRLVAYFADLFGADSFDAAVAAGVPRRYLFFPGNLQGLTLILHLPELDVSMPGEFRDLAEPVRLPGCVPIPGADILSPLQDKSSPSYRWMVHHGARYREAHAILVNSFDVLEPDAAKVLGRPEPGRPPVYSIGPIIRTDAAPVATDAPRAACLDWLDRQPPKSVIFVSFGSGGSLPTEQMHELALGLELSGQRFLCVVRSPSDEGAVNANYYDAESKKDPLAYLPAGFVERTKGVGLLVPSWAPQTEVLAHEATGCFLVHCGWNSVLESLVHGVPMVAWPLFAEQRQNAVMLSQGVGAAVRVPATKKKEEIAAAVREVMAGPGKGAEVRAKVATLQKAAIEGLLEGGAAMAALDEVASKWTGAEHA

SEQ ID NO: 931 - protein, 491 aa, Zea mays
  misc_feature (1)..(491): Ceres CLONE ID no. 1534695
  misc_feature (1)..(491): Functional Homolog of  Ceres CLONE ID no.  479006
  misc_feature (272)..(412): Pfam Name: UDPGT Pfam Description: UDP-glucoronosyl and UDP-glucosyl transferase
MENANASSCRNGDGTQTPPPHVAMLATPGMGHLIPLAELAKRLAQRHGVTSTLITFASTASATQRAFLASMPPAVASMALPPVDMSDLPRDAAIETLMSEECVRAVPALTEALLSLKQRPTTTGRLVAFVTDLFGADAFDAARAAGVQRRYLFFPTNLTALTLMLHLPELDASIPGEFRDLAEPLRLPGCVPLPGTETMKPLQDKSNPSYRWMVHHGAKFREATAILVNSFDAVEPGPAEVLRQPEPGRPPVRTIGPLVRAEDGGGSKDDAPCPCVEWLDRQPAKSVIFVSFGSGGTLPAEEMRELALGLELSGQRFLWVVRSPSEGGVGNDNYYDSASKKDPFSYLPQGFLERTKDVGLVVPSWAPQPKVLAHQSTGGFLTHCGWNSTLESLVHGVPMLAWPLFADQRQNAVLLCDGVGAALRVPGAKGREDIAAVVRELMTAEGKGAAVRAKVEELQKAAAEGLRDGGATAAALAEVVKEWTSADDSVY

SEQ ID NO: 932 - protein, 490 aa, Oryza sativa
  misc_feature (1)..(490): Public GI no. 77551916
  misc_feature (1)..(490): Functional Homolog of  Ceres CLONE ID no.  479006
  misc_feature (280)..(427): Pfam Name: UDPGT Pfam Description: UDP-glucoronosyl and UDP-glucosyl transferase
MENGKCNGSSTTKCNGAAAAAMHVAMLVTPGMGHLIPLAELAKRLAARHGVTSTLLTFASTASATQREFLASLPPAIESVSLPPVDLSDLPADAAIETLMSEECVRLVPALTAILSGIRERRRLVAFVADLFGADSFDAARDAGVPRRYLFFPTNLHALTLLLHLPDLDVSIPGEFRDLDEPVRLPGCVPIPGKDILMPLQDKSRACYGWMVHHGTRYRDADAILVNSFDAVEPDAARVLRHPKPGVPPVFPIGPLIQTHCAGDDDAAAPPSPRAACLDWLDRQPDRSVIFVSFGSGGALPTEHMRELALGLELSGQRFLWVVRSPSDEGEVSANYYDAETKKNPFGYLPEGFVERTKEVGLLVPSWAPQTKVLAHRATGGFLTHCGWNSVLESLVHGVPMVAWPLFAEQRQNAVMLTEGAGAAIRVPESKGKEKIAAVVREMMVGEGRGAAVRAKVAELQKMATDGLRDGGAATSALDEVVDKWTGGEK

SEQ ID NO: 933 - DNA, 1296 bp, Oryza sativa
  misc_feature (1)..(1296): Ceres CLONE ID no.  479015
  misc_feature (1)..(1296): GEMINI ID 540B2
ggcgtgaggagtgaggtgctccgggtgagtttatcatatgccgttgataagaggagagagagagattgaccgtttgttaatcttatcttttcttatcccaaacaaactgaaactcaactcctgaaaggcaagagtgagagagaaatggagaatgcggaggagatgatgcagcaaaacgacgaggttttgtcggttgaacttccagctccttccggttggaataaactgtttttccctaagaaactgggaacaccaagaaaaagtgagattgtattcattgctccaactggagaggagatcagtaccaaaaaacaattggagcagtacctaaaggcacatcctggcaatcctgtcatttcagagtttgactggggaactggtgagacccctaggcgatcagcaaggatcagtgagaaggtcaagtcaactccaccagcagatagtgatactccaaagaaacgagctcggaaatcatcaggatcaaagaaggataacaaagaaactgaatctgcatcagaggaaggcaaggcaaagtctgatactgaagatcccaaggctgcagaggaggagaaaaatgaaggaaatgataactctaattctggaggaaagcaacttgagaatggagataaaactgaacaaattgatgaacaggccaagaagccagatgtagatatggaagaaaatgatctgaatgatacaaacaataaattagaaaatgattcagatgaaattaagaacagtcatgtgaacggcgaaaatgtgattgctgaaaggcctgaaggtgaagaagctcaaaagcaagaagttgaaccagcagagaaagttgccgaagaagctgctaatactgcggagactgaaaaatccctactgactgaattagaaaaagaaaagaatgaggagaaaacagatactgcgactctagaggctaatgggggaggcgagaaagagaatcctaatgctgcacaaatgtaatatggttatttggagctgtgcacagtgaaacacttcaacatttgtcataccgttgtgtaagctgcataaatgtaacaccattgccctagtgccccatgacttttgcgatgctattttagttattttgtggccttatggatgactgtagtctcgtatttcatctaaagatttggttgtactttctacctaggattaggaaattaaatgagtcttccttttagtttagattaggacatctgattttacttagtgcagctacgtagattgtagactttctgtgacacatttgtgtttctagtcatttaaatttcacattccccatct

SEQ ID NO: 934 - protein, 275 aa, Oryza sativa
  misc_feature (1)..(275): Ceres CLONE ID no.  479015
  misc_feature (1)..(275): GEMINI ID 540B2
  misc_feature (11)..(84): Pfam Name: MBD Pfam Description: Methyl-CpG binding domain
MENAEEMMQQNDEVLSVELPAPSGWNKLFFPKKLGTPRKSEIVFIAPTGEEISTKKQLEQYLKAHPGNPVISEFDWGTGETPRRSARISEKVKSTPPADSDTPKKRARKSSGSKKDNKETESASEEGKAKSDTEDPKAAEEEKNEGNDNSNSGGKQLENGDKTEQIDEQAKKPDVDMEENDLNDTNNKLENDSDEIKNSHVNGENVIAERPEGEEAQKQEVEPAEKVAEEAANTAETEKSLLTELEKEKNEEKTDTATLEANGGGEKENPNAAQM

SEQ ID NO: 935 - DNA, 1291 bp, Arabidopsis thaliana
  misc_feature (1)..(1291): Ceres CLONE ID no.  531573
  misc_feature (1)..(1291): GEMINI ID 540A4
gctttgatcactaatccaattcatcagtgattcaattgcactccatctcctagtctctattgtttttcccattccctttcttcacctaatcctgctcctatttccccactaatcacgcaggttttacctggcgtgggttggattgaaacatgtcaggtttgaactggttagtggaatttaatattttaaggtaaaccccatctctttgcggctatttgggggcttgtttccttggggagaaaggtcatccatgtcataggtggcatcccaggtttccaaattttttttaaagtttgattatttttaagaatatcttaagagattatgtctccaatcaggaaatgggttgttggaagatatgtatttcactcctttcatttgatcacatatttcatcctctgtaattgaaaaaaaaaacgagcttttttaggtggggtttgtactttgtactgtggcattgtcaggagtatcttgagagtgaacaatttgttaatggatcaacatagaggtgaggtattggatccggttcatgataggaatttgagtcattcggttgaaggtgttgcaattgcaagagctagtataagtggagaagtaggagaggtggatgaggatttgggatctgataaggaactaaaggacgatgttaagggtcaagacaagcatgatcaagaaaatattagtgataaattgcctggggttgatcaggggactagttataattcaaacaatttggttaatcaggaagtgatagaaactgtggttgtaattgagtctgttcagaccgagtatgccaatgaagataatacgaaactggaagcaaaagttgatgaatcagggttgagcttggtatccatgaaagcaccaaaaggggtgtctgaaactgataaaaattcatgtgtgattgatataaagtgcagcagccgcaaaaaaatttacaagagttctgaaggttaaagaatttgtaggatttgccatctgacttctgggcagtcatcggatgcaacaactgttggcacttctgatagtgctacaagcgcagatttgattcagcttggttgtgcgtgtaaaggcaagccaggcattgcacacgttcattgtgctctggcgtggttcaagcttaaggggaacatgtatctgttcttgccaaatatcagtttgattatcaacaataacattagtgttattttttaggctttgcattgaaccttttaacatttattatgttcctggtattgtctacttattttgaattcctaaacatatagtgatttataagttcctgtcacgt

SEQ ID NO: 936 - protein, 154 aa, Arabidopsis thaliana
  misc_feature (1)..(154): Ceres CLONE ID no.  531573
  misc_feature (1)..(154): GEMINI ID 540A4
MDQHRGEVLDPVHDRNLSHSVEGVAIARASISGEVGEVDEDLGSDKELKDDVKGQDKHDQENISDKLPGVDQGTSYNSNNLVNQEVIETVVVIESVQTEYANEDNTKLEAKVDESGLSLVSMKAPKGVSETDKNSCVIDIKCSSRKKIYKSSEG

SEQ ID NO: 937 - DNA, 2077 bp, Glycine max
  misc_feature (1)..(2077): Ceres CLONE ID no.  534281
  misc_feature (1)..(2077): GEMINI ID 540F4
gaagaacctcataaaaccttttctctctcttacatcactctctctctctctctctctagatctgttcaaatccgaaaccatttccgctccaatttccaagagcaaatcctaaccccttctctctgtatgatactagatttcccctcctcaaaggcgtagtttttgtgtcgatttgtaaattcattcggtagcttaggttagaatttttgtgtcaagtttttagggttttgaatcggtgagatgaatcacaacaacagcaacaacagcaacaacaatagagcgaggtaccctcctgggatgggacttgggcgcgggggtttcaatccgaacctgagccagaacccgaaccagaaccagaatcatcacgcgttccaggctcggccgccgtaccaccaacagcaacaggcgcaatatgtgcagaggcatttgttgcagcagcagcagcagcagcagtggctgagaagggatgccaacgccgtcgacgaggttgagaagaccgtgcagtctgaagccgtggattcgagttcccaagatkggaaagcaagactaaagattccacctgctgatactcgctataagacagaggatgtaacggcaactaaaggaaatgagtttgaggattactttttgaagcgtgagctgctaatgggaatatatgagaagggttttgaaaggccttctcccatccaagaagaaagcattccaattgctcttactggtagtgacattcttgctagggctaaaaatggaactggcaaaacagctgcattttgcattcctgcattggaaaaaattgatcaggacaataatgttattcaagttgttatactggtcccaacccgagaattggcattgcaaacttctcaagtgtgcaaagagcttggaaagcacttgaaaattcaagttatggttacaacaggtggtaccagcctgaaagatgatatactgcgcttatatcaaccggttcatttactagttggaactccaggaagaatattagatcttaccaagaaaggtgtttgtattctgaaagattgcgctatgcttgttatggatgaggccgataagcttctgtccccagagtttcaaccatctatagagcagctgattcattttcttcctacaacccgtcaaatcttgatgttttcagccacatttcctgttactgtaaaggatttcaaagataggtatcttcaaaagccttatgtcatcaatcttatggatgagctaactttgaagggtattacacaattttatgcattcgtggaagagagacagaaagtccactgcctaaatactctattttctaagctgcaaataaaccagtctatcatcttctgcaattcagtgaatcgggttgaactacttgccaagaaaatcacggaacttgggtattcatgtttctacattcatgcaaagatgttgcaagaccatcgtaacagagtgtttcatgacttccgcaatggtgcatgtcgaaatcttgtttgtactgatctttttactagaggaatagacattcaagcagttaatgttgttattaattttgattttccaaagaatgcagagacttatttgcacagggttggtcgttcagggaggtttgggcaccttggtttagcagtgaacttgattacctatgaggatcgctttaatttatataggattgaacaagaacttggaactgaaataaagcagattcccccacaaattgatcaggcaatttattgtcggtgattggctgtaaataccatggttgtgtttacaattgtggctaatagcagtggttagtgtgaccgtggctcaagtaggtggaagaggatttgcagagctagtgacaaattgtgtattattggaacctggcatgagaggatgcactgtcgaaaactgggtattattggacccattgttgagtgctttcggattaatgctggttttaagagccctgaaacattattgggacctttaaaaagtttaataactgccagatagttgcttggtccggtttgtgtttctgttgattacatttgcagatcgatcattttaaataaatctaaataattttagtgtgtttggactg

SEQ ID NO: 938 - protein, 497 aa, Glycine max
  misc_feature (1)..(497): Ceres CLONE ID no.  534281
  misc_feature (147)..(313): Pfam Name: DEAD Pfam Description: DEAD/DEAH box helicase
  misc_feature (379)..(455): Pfam Name: Helicase_C Pfam Description: Helicase conserved C-terminal domain
  misc_feature (1)..(497): GEMINI ID 540F4
  misc_feature (99)..(99): Xaa is any aa, unknown, or other
MNHNNSNNSNNNRARYPPGMGLGRGGFNPNLSQNPNQNQNHHAFQARPPYHQQQQAQYVQRHLLQQQQQQQWLRRDANAVDEVEKTVQSEAVDSSSQDXKARLKIPPADTRYKTEDVTATKGNEFEDYFLKRELLMGIYEKGFERPSPIQEESIPIALTGSDILARAKNGTGKTAAFCIPALEKIDQDNNVIQVVILVPTRELALQTSQVCKELGKHLKIQVMVTTGGTSLKDDILRLYQPVHLLVGTPGRILDLTKKGVCILKDCAMLVMDEADKLLSPEFQPSIEQLIHFLPTTRQILMFSATFPVTVKDFKDRYLQKPYVINLMDELTLKGITQFYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKNAETYLHRVGRSGRFGHLGLAVNLITYEDRFNLYRIEQELGTEIKQIPPQIDQAIYCR

SEQ ID NO: 939 - protein, 516 aa, Medicago truncatula
  misc_feature (1)..(516): Public GI no. 92877732
  misc_feature (1)..(516): Functional Homolog of  Ceres CLONE ID no.  534281
  misc_feature (166)..(332): Pfam Name: DEAD Pfam Description: DEAD/DEAH box helicase
  misc_feature (398)..(474): Pfam Name: Helicase_C Pfam Description: Helicase conserved C-terminal domain
MNNNNRGRYPPGIGLGRGSGGGGLNSNPNNANAGFQQRPHYQQQQYVQRHLMQNQNQHQQHYQHHQQNQQQYQQQNQQQQQQQWLRRNQLGGGTDTNVVEEVEKTVQSETNDPSSQDWKEKLKLPPADTRYRTEDVTATKGNEFEDYFLKRELLMGIYEKGFERPSPIQEESIPIALTGSDILARAKNGTGKTAAFSIPALEKIDQDNNIIQVVILVPTRELALQTSQVCKELGKHLQIQVMVTTGGTSLKDDIMRLYQPVHLLVGTPGRILDLAKKGVCVLKDCSMLVMDEADKLLSPEFQPSIEQLIQFLPPTRQILMFSATFPVTVKDFKDRYLRKPYIINLMDELTLKGITQFYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKNSETYLHRVGRSGRFGHLGLAVNLITYEDRFNLYRIEQELGTEIKQIPPFIDQAVYCR

SEQ ID NO: 940 - protein, 514 aa, Medicago truncatula
  misc_feature (1)..(514): Public GI no. 92877736
  misc_feature (1)..(514): Functional Homolog of  Ceres CLONE ID no.  534281
  misc_feature (164)..(330): Pfam Name: DEAD Pfam Description: DEAD/DEAH box helicase
  misc_feature (396)..(472): Pfam Name: Helicase_C Pfam Description: Helicase conserved C-terminal domain
MNNNNRGRYPPGIGLGRGGSGGGGGGLTSNSNTGFQQRPHHQYQQQQQYVQRHMMQNQHQQHYQNQQQNQQQNQQQQQQQQWLRRNQLGGGTDTNVVEEVEKTVQSEANDSSSQDWKARLKLPPADTRYRTEDVTATKGNEFEDYFLKRELLMGIYEKGFERPSPIQEESIPIALTGSDILARAKNGTGKTAAFSIPALEKIDQDNNIIQVVILVPTRELALQTSQVCKELGKHLQIQVMVTTGGTSLKDDIMRLYQPVHLLVGTPGRILDLAKKGVCVLKDCSMLVMDEADKLLSPEFQPSIEQLIQFLPPTRQILMFSATFPVTVKDFKDRYLRKPYIINLMDELTLKGITQFYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKNSETYLHRVGRSGRFGHLGLAVNLITYEDRFNLYRIEQELGTEIKQIPPFIDQAIYCR

SEQ ID NO: 941 - protein, 523 aa, Medicago truncatula
  misc_feature (1)..(523): Public GI no. 92877733
  misc_feature (1)..(523): Functional Homolog of  Ceres CLONE ID no.  534281
  misc_feature (173)..(339): Pfam Name: DEAD Pfam Description: DEAD/DEAH box helicase
  misc_feature (405)..(481): Pfam Name: Helicase_C Pfam Description: Helicase conserved C-terminal domain
MNNNNRGRYPPGIGLGRGSGSGSGGGGGGLNSNPNNANAGFQQRPHYQQQQQQQYVQRHMMQNQNQHQQHYQHHQQNQQQYQQQQQQQQQWLRRNQLGGGTDTNVVEEVEKTVQSETNDPSSQDWKARLKIPAADTRYRTEDVTATKGNEFEDYFLKRELLMGIYEKGFERPSPIQEESIPIALTGSDILARAKNGTGKTAAFSIPALEKIDQDKNVIQVVILVPTRELALQTSQVCKELGKHLQIQVMVTTGGTSLKDDIMRLYQPVHLLVGTPGRILDLAKKGVCVLKDCSMLVMDEADKLLSPEFKPSIEQLIQFLPSNRQILLFSATFPVTVKDFNDRYLRKPYIINLMDELTLKGITQFYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKNSETYLHRVGRSGRFGHLGLAVNLVTYEDRFNLYRIEQELGTEIKQIPPFIDQAIYCR

SEQ ID NO: 942 - DNA, 1518 bp, Populus balsamifera subsp. trichocarpa
  misc_feature (1)..(1518): Ceres ANNOT ID no. 1471100
atgaacaacaacaatagaggaaggtatccgccagggatcggcgccggtagaggcggaggtatgagtgcgaaccctaattttcaatccagggtgccgcaacagcagtacgtgcagagacattttgggcagaatcatcaccaacaacaatataatcaacatcaacagaatcacaatcagcaacagcaacagcaacagcaacagcaacaacatcagcagcagcagtggttgaggaggagtcagctagctgctgccgattcgagcgttgacgaggtcgaaaagactgttcagtctgaggccgttgactcgagttcacaagattggaaggcaaagctaaagataccaccagctgacacacgataccaaactgaggatgtgacagccacaaaagggaatgattttgaggattattttctgaagcgtgagttgcttatgggaatatatgagaagggttttgaaagaccatctcctattcaggaagagagcataccaattgctcttactggcagtgatattctagctagagctaaaaatgggacagggaaaacagcggcattttgcattcctgccttggaaaagattgaccaagataacaattttattcaagttgtgattcttgtgccaacacgtgagttggctcttcagacatcacaggtttgcaaggagcttgggaagcatttgaaaattcaagtgatggccaccactggcggtactagtttaaaagatgacattatgcgtttatatcaaccagtccatttacttgttgggactccaggaagaatactagatcttgcaaaaaagggcgtgtgcattttgaaagattgttcaatgcttgttttggatgaggccgataagcttttgtctccagagtttcaaccttcaatagagcagcttattcgttttcttccttcaagtcgtcagattttgatgttttcagctacatttcctgttactgttaaggacttcaaagatagatatctagagaagccttatgttatcaatcttatggatgaacttactctcaagggtattacacaatattatgctttcgttgaagaacgacagaaagtccattgcttgaacactcttttctctaagctgcaaataaaccaatcaatcatcttttgcaactcagtgaatcgggtagaattactggccaaaaagatcacagaacttggctattcctgtttctatatccatgcaaagatgttgcaagaccatcgtaacagagtatttcatgacttccgcaatggtgcatgcaggaatcttgtctgcaccgatcttttcaccaggggtatagacatccaagcggtgaatgttgttataaacttcgactttcccaagaactcagaaacataccttcacagggttggtcgatcaggaaggttcggacaccttggtttggctgtgaatttgatcacgtacgaggaccgctttaacttgtataggattgagcaggaacttggaactgaaattaaacaaattcctccacatattgatcaggcaatctattgccaataa

SEQ ID NO: 943 - protein, 505 aa, Populus balsamifera subsp. trichocarpa
  misc_feature (1)..(505): Ceres ANNOT ID no. 1471100
  misc_feature (1)..(505): Functional Homolog of  Ceres CLONE ID no.  534281
  misc_feature (155)..(321): Pfam Name: DEAD Pfam Description: DEAD/DEAH box helicase
  misc_feature (387)..(463): Pfam Name: Helicase_C Pfam Description: Helicase conserved C-terminal domain
MNNNNRGRYPPGIGAGRGGGMSANPNFQSRVPQQQYVQRHFGQNHHQQQYNQHQQNHNQQQQQQQQQQQHQQQQWLRRSQLAAADSSVDEVEKTVQSEAVDSSSQDWKAKLKIPPADTRYQTEDVTATKGNDFEDYFLKRELLMGIYEKGFERPSPIQEESIPIALTGSDILARAKNGTGKTAAFCIPALEKIDQDNNFIQVVILVPTRELALQTSQVCKELGKHLKIQVMATTGGTSLKDDIMRLYQPVHLLVGTPGRILDLAKKGVCILKDCSMLVLDEADKLLSPEFQPSIEQLIRFLPSSRQILMFSATFPVTVKDFKDRYLEKPYVINLMDELTLKGITQYYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKNSETYLHRVGRSGRFGHLGLAVNLITYEDRFNLYRIEQELGTEIKQIPPHIDQAIYCQ

SEQ ID NO: 944 - DNA, 1500 bp, Populus balsamifera subsp. trichocarpa
  misc_feature (1)..(1500): Ceres ANNOT ID no. 1497192
atgaacaacaacaatagaggaaggtatccgccggggatcggtgccggtagaggcggaggtatgaacgcgaaccctaattttcaatcaagggttccgcaacagcagtatgtgcagagaaatttcgggcaaaatcatcaccaacaacaatactatcagcatcaacagcatcacaatcagcagcagcagcagcagcagcagcagcagtggttgaggaggaatcagttaactgctgcggattcgagtattgatgaggtcgaaaagactgttcagtctgaggctgttgactcgagttcacaagattggaaggcaaagctaaagataccaccagcagatacgcgatacagaactgaggatgtgacagccacaaaggggaatgatttcgaggactattttctgaagcgtgagttgcttatgggaatatacgagaagggttttgaaagaccatctcctattcaggaagagagcataccaattgctcttactggtagcgatattcttgctagagctaaaaatgggacagggaaaacagctgcattttgcgtccctgccctggaaaaaattgaccaagataacaattttattcaagttgtgatacttgtgccaacacgtgagttggctcttcagacatcacaggtttgtaaggagctagggaagcatttgaaaattcaagtgatggccaccactggcggtacgagtctaaaagatgacattatgcgtttatatcaaccagtccatttacttgtcggaactccaggaagaatacttgatcttgcaaaaaagggcgtgtgtattttgaaaaactgttcaatgcttgttttggatgaggccgataagcttttgtctccagagtttcaaccttcaatagagcagcttattcgttttcttccttcaaatcgtcagattttgatgttttcagctacatttccagttactgttaaggattttaaagatagatatctagagaagccttatgttatcaatcttatggatgaacttactctcaagggtattacacaatattatgctttcgttgaagaacgacagaaagtccattgcctgaacactcttttctctaagctgcaaataaaccaatcaatcatcttttgcaactcagtgaaccgggtagaattactggccaagaagatcacagaacttggctattcatgtttctatatccatgcaaagatgttacaggaccatcgcaacagagtatttcatgacttccgcaatggtgcatgcaggaatcttgtctgtactgatctttttaccaggggtatagacatccaagcagtgaatgttgttataaactttgacttccccaagaacgcagagacataccttcacagggttggtcgatcaggaaggtttggacaccttggtttagctgtgaatttgatcacttatgaggaccgttttaacctgtataggattgagcaggaacttggaactgaaattaaacaaattcctccacatattgatcagacaatatattgccaataa

SEQ ID NO: 945 - protein, 499 aa, Populus balsamifera subsp. trichocarpa
  misc_feature (1)..(499): Ceres ANNOT ID no. 1497192
  misc_feature (1)..(499): Functional Homolog of  Ceres CLONE ID no.  534281
  misc_feature (149)..(315): Pfam Name: DEAD Pfam Description: DEAD/DEAH box helicase
  misc_feature (381)..(457): Pfam Name: Helicase_C Pfam Description: Helicase conserved C-terminal domain
MNNNNRGRYPPGIGAGRGGGMNANPNFQSRVPQQQYVQRNFGQNHHQQQYYQHQQHHNQQQQQQQQQQWLRRNQLTAADSSIDEVEKTVQSEAVDSSSQDWKAKLKIPPADTRYRTEDVTATKGNDFEDYFLKRELLMGIYEKGFERPSPIQEESIPIALTGSDILARAKNGTGKTAAFCVPALEKIDQDNNFIQVVILVPTRELALQTSQVCKELGKHLKIQVMATTGGTSLKDDIMRLYQPVHLLVGTPGRILDLAKKGVCILKNCSMLVLDEADKLLSPEFQPSIEQLIRFLPSNRQILMFSATFPVTVKDFKDRYLEKPYVINLMDELTLKGITQYYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKNAETYLHRVGRSGRFGHLGLAVNLITYEDRFNLYRIEQELGTEIKQIPPHIDQTIYCQ

SEQ ID NO: 946 - protein, 505 aa, Arabidopsis thaliana
  misc_feature (1)..(505): Public GI no. 21280839
  misc_feature (1)..(505): Functional Homolog of  Ceres CLONE ID no.  534281
  misc_feature (155)..(321): Pfam Name: DEAD Pfam Description: DEAD/DEAH box helicase
  misc_feature (387)..(463): Pfam Name: Helicase_C Pfam Description: Helicase conserved C-terminal domain
MNNRGRYPPGIGAGRGAFNPNPNYQSRSGYQQHPPPQYVQRGNYAQNHQQQFQQAPSQPHQYQQQQQQQQQWLRRGQIPGGNSNGDAVVEVEKTVQSEVIDPNSEDWKARLKLPAPDTRYRTEDVTATKGNEFEDYFLKRELLMGIYEKGFERPSPIQEESIPIALTGRDILARAKNGTGKTAAFCIPVLEKIDQDNNVIQAVIIVPTRELALQTSQVCKELGKHLKIQVMVTTGGTSLKDDIMRLYQPVHLLVGTPGRILDLTKKGVCVLKDCSVLVMDEADKLLSQEFQPSVEHLISFLPESRQILMFSATFPVTVKDFKDRFLTNPYVINLMDELTLKGITQFYAFVEERQKIHCLNTLFSKLQINQSIIFCNSVNRVELLAKKITELGYSCFYIHAKMLQDHRNRVFHDFRNGACRNLVCTDLFTRGIDIQAVNVVINFDFPKNAETYLHRVGRSGRFGHLGLAVNLITYEDRFNLYRIEQELGTEIKQIPPHIDQAIYCQ

SEQ ID NO: 947 - protein, 508 aa, Oryza sativa
  misc_feature (1)..(508): Public GI no. 50911116
  misc_feature (1)..(508): Functional Homolog of  Ceres CLONE ID no.  534281
  misc_feature (158)..(324): Pfam Name: DEAD Pfam Description: DEAD/DEAH box helicase
  misc_feature (390)..(466): Pfam Name: Helicase_C Pfam Description: Helicase conserved C-terminal domain
MDPRARYPPGIGNGRGGNPNYYNRGPPLQQQHNHHQQQQTSAPHHQQYVQRQPQQHHHHNHHQQHQQQQQQWLRRNQIAREAAGTDRNSEPKAVAQSPAVDGIDSSSQDWKAQLKLPPQDTRYRTEDVTATKGNEFEDYFLKRELLMGIYEKGFERPSPIQEESIPIALTGSDILARAKNGTGKTAAFCIPALEKIDQEKNAIQVVILVPTRELALQTSQVCKELGKHLKIQVMVTTGGTSLKDDIIRLYQPVHLLVGTPGRILDLTKKGICILKDCSMLIMDEADKLLSPEFQPSVEQLIRYLPASRQILMFSATFPVTVKEFKDKYLPKPYVINLMDELTLKGITQFYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKTAETYLHRVGRSGRFGHLGLAVNLITYEDRFNLYRIEQELGTEIKPIPPQIDQAIYCQ

SEQ ID NO: 948 - protein, 505 aa, Arabidopsis thaliana
  misc_feature (1)..(505): Public GI no. 3775993
  misc_feature (1)..(505): Functional Homolog of  Ceres CLONE ID no.  534281
  misc_feature (155)..(321): Pfam Name: DEAD Pfam Description: DEAD/DEAH box helicase
  misc_feature (387)..(463): Pfam Name: Helicase_C Pfam Description: Helicase conserved C-terminal domain
MNNRGRYPPGIGAGRGAFNPNPNYQSRSGYQQHPPPQYVQRGNYAQNHQQQFQQAPSQPHQYQQQQQQQQQWLRRGQIPGGNSNGDAVVEVEKTVQSEVIDPNSEDWKARLKLPAPDTRYRTEDVTATKGNEFEDYFLKRELLMGIYEKGFERPSPIQEESIPIALTGRDILARAKNGTGKTAAFCIPVLEKIDQDNNVIQAVIIVPTRELALQTSQVCKELGKHLKIQVMVTTGGTSLKDDIMRLYQPVHLLVGTPGRILDLTKKGVCVLKDCSVLVMDEADKLLSQEFQPSVEHLISFLPESRQILMFSATFPVTVKDFKDRFLTNPYVINLMDELTLKGITQFYAFVEERQKIHCLNTLFSKLQINQSIIFCNSVNRVELLAKKITELGYSCSYIHAKMLQDHRNRVFHDFRNGACRNLVCTDLFTRGIDIQAVNVVINFDFPKNAETYLHRVGRSGRFGHLGLAVNLITYEDRFNLYRIEQELGTEIKQIPPHIDQAIYCQ

SEQ ID NO: 949 - protein, 498 aa, Oryza sativa
  misc_feature (1)..(498): Public GI no. 50926692
  misc_feature (1)..(498): Functional Homolog of  Ceres CLONE ID no.  534281
  misc_feature (148)..(314): Pfam Name: DEAD Pfam Description: DEAD/DEAH box helicase
  misc_feature (380)..(456): Pfam Name: Helicase_C Pfam Description: Helicase conserved C-terminal domain
MDPRARYPPGIGNGRGGNPNYYGRGPPPSQHQQHQHQHQQPPHPHHHQYVQRQPQPQQTPHNSQHQQWLRRNQIAAEAAGASEQKAPPVADGIDSSSQDWKAQLKLPPQDTRYRTEDVTATKGNEFEDYFLKRELLMGIYEKGFERPSPIQEESIPIALTGSDILARAKNGTGKTAAFCIPALEKIDQDKNAIQVVILVPTRELALQTSQVCKELGKHLKIQVMVTTGGTSLKDDIVRLYQPVHLLVGTPGRILDLTKKGVCVLKNCSMLVMDEADKLLSPEFQPSIQELIRYLPSNRQILMFSATFPVTVKEFKDKYLPKPYVINLMDELTLKGITQFYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKSAETYLHRVGRSGRFGHLGLAVNLITYEDRFNLYRIEQELGTEIKPIPPQIDRAIYCQ

SEQ ID NO: 950 - protein, 517 aa, Zea mays
  misc_feature (1)..(517): Ceres CLONE ID no. 1580901
  misc_feature (1)..(517): Functional Homolog of  Ceres CLONE ID no.  534281
  misc_feature (167)..(333): Pfam Name: DEAD Pfam Description: DEAD/DEAH box helicase
  misc_feature (399)..(475): Pfam Name: Helicase_C Pfam Description: Helicase conserved C-terminal domain
MDPRARYPSGMGNGRGGTPNYYGRGPPPQQPHQHHHQQQQQTSGAHHHQQYAQRQQQQHRHSHNHQQQQQQHQSQQQQQQWLRRNQIAREAAGAAVTSEPKALAPSTAADGVNSSSQDWKTQLKLPPPDTRYRTEDVTATKGNEFEDYFLKRELLMGIYEKGFERPSPIQEESIPIALTGSDILARAKNGTGKTAAFCIPALEKIDQEKNAIQVVILVPTRELALQTSQVCKELGKHLKIQVMVTTGGTSLKDDIVRLYQPVHLIVGTPGRILDLTKKGVCILKDCSMLIMDEADKLLSPEFQPSIEQLIRYLPASRQILMFSATFPVTVKEFKDKYLPKPYVINLMDELTLKGITQFYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKNSETYLHRVGRSGRFGHLGLAVNLITYEDRFNLYRIEQELGTEIKPIPPQIDQAIYCQ

SEQ ID NO: 951 - protein, 517 aa, Zea mays
  misc_feature (1)..(517): Ceres CLONE ID no. 236189
  misc_feature (1)..(517): Functional Homolog of  Ceres CLONE ID no.  534281
  misc_feature (167)..(333): Pfam Name: DEAD Pfam Description: DEAD/DEAH box helicase
  misc_feature (399)..(475): Pfam Name: Helicase_C Pfam Description: Helicase conserved C-terminal domain
MDPRARYPSDMGNGRGGTPNYYGRGPPPQQPHQHHHQQQQQTSGAHHHQQYAQRQQQQHRHSHNHQQQQQQHQSQQQQQQWLRRNQIAREAAGAAVTSEPKALAPSTAADGVNSSSQDWKTQLKLPPPDTRYRTEDVTATKGNEFEDYFLKRELLMGIYEKGFERPSPIQEESIPIALTGSDILARAKNGTGKTAAFCIPALEKIDQEKNAIQVVILVPTRELALQTSQVCKELGKHLKIQVMVTTGGTSLKDDIVRLYQPVHLIVGTPGRILDLTKKGVCILKDCSMLIMDEADKLLSPEFQPSIEQLIRYLPASRQILMFSATFPVTVKEFKDKYLPKPYVINLMDELTLKGITQFYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKNSETYLHRVGRSGRFGHLGLAVNLITYEDRFNLYRIEQELGTEIKPIPPQIDQAIYCQ

SEQ ID NO: 952 - protein, 483 aa, Oryza sativa
  misc_feature (1)..(483): Public GI no. 50911118
  misc_feature (1)..(483): Functional Homolog of  Ceres CLONE ID no.  534281
  misc_feature (133)..(299): Pfam Name: DEAD Pfam Description: DEAD/DEAH box helicase
  misc_feature (365)..(441): Pfam Name: Helicase_C Pfam Description: Helicase conserved C-terminal domain
MDPRARYPPGIGNGRGGNPNYYNRGPPLQQHHHHNHHQQHQQQQQQWLRRNQIAREAAGTDRNSEPKAVAQSPAVDGIDSSSQDWKAQLKLPPQDTRYRTEDVTATKGNEFEDYFLKRELLMGIYEKGFERPSPIQEESIPIALTGSDILARAKNGTGKTAAFCIPALEKIDQEKNAIQVVILVPTRELALQTSQVCKELGKHLKIQVMVTTGGTSLKDDIIRLYQPVHLLVGTPGRILDLTKKGICILKDCSMLIMDEADKLLSPEFQPSVEQLIRYLPASRQILMFSATFPVTVKEFKDKYLPKPYVINLMDELTLKGITQFYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKTAETYLHRVGRSGRFGHLGLAVNLITYEDRFNLYRIEQELGTEIKPIPPQIDQAIYCQ

SEQ ID NO: 953 - protein, 499 aa, Arabidopsis thaliana
  misc_feature (1)..(499): Public GI no. 7267405
  misc_feature (1)..(499): Functional Homolog of  Ceres CLONE ID no.  534281
  misc_feature (155)..(315): Pfam Name: DEAD Pfam Description: DEAD/DEAH box helicase
  misc_feature (381)..(457): Pfam Name: Helicase_C Pfam Description: Helicase conserved C-terminal domain
MNNRGRYPPGIGAGRGAFNPNPNYQSRSGYQQHPPPQYVQRGNYAQNHQQQFQQAPSQPHQYQQQQQQQQQWLRRGQIPGGNSNGDAVVEVEKTVQSEVIDPNSEDWKARLKLPAPDTRYRTEDVTATKGNEFEDYFLKRELLMGIYEKGFERPSPIQEESIPIALTGRDILARAKNGTGKTAAFCIPVLEKIDQDNNVIQGNCVLDHTSQVCKELGKHLKIQVMVTTGGTSLKDDIMRLYQPVHLLVGTPGRILDLTKKGVCVLKDCSVLVMDEADKLLSQEFQPSVEHLISFLPESRQILMFSATFPVTVKDFKDRFLTNPYVINLMDELTLKGITQFYAFVEERQKIHCLNTLFSKLQINQSIIFCNSVNRVELLAKKITELGYSCFYIHAKMLQDHRNRVFHDFRNGACRNLVCTDLFTRGIDIQAVNVVINFDFPKNAETYLHRVGRSGRFGHLGLAVNLITYEDRFNLYRIEQELGTEIKQIPPHIDQAIYCQ

SEQ ID NO: 954 - protein, 508 aa, Triticum aestivum
  misc_feature (1)..(508): Ceres CLONE ID no. 703763
  misc_feature (1)..(508): Functional Homolog of  Ceres CLONE ID no.  534281
  misc_feature (158)..(324): Pfam Name: DEAD Pfam Description: DEAD/DEAH box helicase
  misc_feature (390)..(466): Pfam Name: Helicase_C Pfam Description: Helicase conserved C-terminal domain
MDQRARHPPGIGNGRGGNPNYHGRGPPPTQQHHQQPSPPSPQQAQGHPQQYMQRQSQHSQHSQHHSQQLQHQQWLRRNQTAGEAASGAARASEHHAPAAADDADLSSQDWKAQLKLPPPDTRYQTEDVTATKGNEFEDYFLKRELLMGIYEKGFERPSPIQEESIPIALTGSDILARAKNGTGKTAAFCIPALEKIDQDKNAIQVVILVPTRELALQTSQVCKELGKHLKIQVMVTTGGTSLKDDIVRLYQPVHLLVGTPGRVLDLTKKGICILNDCSMLIMDEADKLLSPEFQPSVEQLIRYLPSSRQILMFSATFPVTVKAFKDKYLPKPYVINLMDELTLKGITQFYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKTAETYLHRVGRSGRFGHLGLAVNLITYEDRFNLYRIEQELGTEIKPIPPQIDRTIYCQ

SEQ ID NO: 955 - protein, 501 aa, Triticum aestivum
  misc_feature (1)..(501): Ceres CLONE ID no. 777111
  misc_feature (1)..(501): Functional Homolog of  Ceres CLONE ID no.  534281
  misc_feature (151)..(317): Pfam Name: DEAD Pfam Description: DEAD/DEAH box helicase
  misc_feature (383)..(459): Pfam Name: Helicase_C Pfam Description: Helicase conserved C-terminal domain
MDQRARYPPGIGNGRGGNPNYHGRGPPPTQQHQHQQQQQAQGHQQQHMERQSQRSQHHNQQLQHQQWLRRNQTASEAAAGAAKASEHHAPAAADDADLSPQDWKAQLKLPPPDTRYQTEDVTATKGNEFEDYFLKRELLMGIYEKGFERPSPIQEESIPIALTGSDILARAKNGTGKTAAFCIPALEKIDQDKNAIQVVILVPTRELALQTSQVCKELGKHLKIQVMVTTGGTSLKDDIVRLYQPVHLLVGTPGRVLDLTKKGICILKDCSMLIMDEADKLLSPEFQPSVEHLIRYLPSSRQILMFSATFPVTVKAFKDKYLPKPYVINLMDELTLKGITQFYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKTAETYLHRVGRSGRFGHLGLAVNLITYEDRFNLYRIEQELGTEIKPIPPQIDRTIYCQ

SEQ ID NO: 956 - protein, 521 aa, Oryza sativa
  misc_feature (1)..(521): Public GI no. 37535822
  misc_feature (1)..(521): Functional Homolog of  Ceres CLONE ID no.  534281
  misc_feature (171)..(337): Pfam Name: DEAD Pfam Description: DEAD/DEAH box helicase
  misc_feature (403)..(479): Pfam Name: Helicase_C Pfam Description: Helicase conserved C-terminal domain
MHHPRARYPPGYTSGGGGGGGGGGGGGRGNGGGGFGGGGGGGGGNHGYYGRGPQPQPQQQHYHHQAQQLHQHQQQQQHAQRNSSSQQQQWLRRDQATAAAASGEVAARTAAQLEAVDSSSEDWKAQLNLPAPDTRYRTEDVTATKGNEFEDYFLKRELLMGIYEKGFERPSPIQEESIPIALTGSDILARAKNGTGKTAAFCIPALEKIDPEKNAIQVVILVPTRELALQTSQVCKELGKYLNIQVMVSTGGTSLKDDIMRLYQPVHLLVGTPGRILDLTRKGICVLKDCSMLVMDEADKLLAPEFQPSIEQLIHFLPANRQLLMFSATFPVTVKDFKEKYLPRPYVINLMDELTLKGITQYYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKTSETYLHRVGRSGRFGHLGLAVNLITYEDRFNLYRIEQELGTEIKTIPPQIDLAVYCQ

SEQ ID NO: 957 - protein, 521 aa, Arabidopsis thaliana
  misc_feature (1)..(521): Public GI no. 78708877
  misc_feature (1)..(521): Functional Homolog of  Ceres CLONE ID no.  534281
  misc_feature (171)..(337): Pfam Name: DEAD Pfam Description: DEAD/DEAH box helicase
  misc_feature (403)..(479): Pfam Name: Helicase_C Pfam Description: Helicase conserved C-terminal domain
MHHPRARYPPGYTSGGGGGGGGGGGGGRGNGGGGFGGGGGGGGGNHGYYGRGPQPQPQQQHYHHQAQQLHQHQQQQQHAQRNSSSQQQQWLRRDQATAAAASGEVAARTAAQLEAVDSSSEDWKAQLNLPAPDTRYRTEDVTATKGNEFEDYFLKRELLMGIYEKGFERPSPIQEESIPIALTGSDILARAKNGTGKTAAFCIPALEKIDPEKNAIQVVILVPTRELALQTSQVCKELGKYLNIQVMVSTGGTSLKDDIMRLYQPVHLLVGTPGRILDLTRKGICVLKDCSMLVMDEADKLLAPEFQPSIEQLIHFLPANRQLLMFSATFPVTVKDFKEKYLPRPYVINLMDELTLKGITQYYAFVEERQKVHCLNTLFLKLQINQSIIFCNSVNRVELLAKKITELGYSCFYIHAKMLQDHRNRVFHDFRNGACRNLVCTDLFTRGIGIQAVNVVINFDFPKTSETYLHRVGRSGRFGHLGLAVNLITYEDRFNLYRIEQELGTEIKTIPPQIDLAVYCQ

SEQ ID NO: 958 - DNA, 2045 bp, Panicum virgatum
  misc_feature (1)..(2045): Ceres CLONE ID no.1795581
ctacctggcaaccttcgaaaccgggcgctcccggatccacccccgaagtccaaaagcgaagcccaccagcgccgcaacggcgaaaccatcggaaccctagatccctctcgcctgaggtccagaaccctagatccaccatgcaccagcccagagcccgctacccgcccggctacggcggaggcggcggcgtaggaggaggaggcggcggcggcggaaatcacaactactacggccgaaacccgcagccgcagccgcaccaccaccaacactaccagcaccagcagccgccaccgcagcaacaaccgcagcagcacgcgcataggaactcatcgcatcagcatcagcagtggctgcggcgagatcagggccccgcctccgccgcggggtctggagatgctgcggtgaggacggcggcgcagctcgacgctgtagactcgagttctcaagattggaaggcgcaattgaatataccagctccggatacacgctacaggacagaggatgtcactgcaacaaaaggcaatgagttcgaagattattttttgaaacgtgagctgcttatgggaatctatgaaaagggctttgaaaggccatcccctattcaagaagaaagcattccgattgcactgactggaagtgatattcttgcaagagcgaaaaatgggactgggaagactgcggcattttgcattccagcacttgaaaaaattgatcccgagaaaaatgccattcaagttgttatactggtaccaacaagggaactggctctgcagacttcacaagtctgtaaggagctcgggaagtacctgaacattcaagttatggtcagcactggtggaaccagcttgagggatgacatcatgcgtttgtaccaacctgttcatttacttgttgggactcctggccgtatactggatcttaccaggaagggcatttgtgtgctgaaagattgttcaatgcttgtcatggatgaggctgacaagctattagctccagagttccagccttctgtagaggcacttattcatttccttccacctagtcggcaactgttgatgttttcggcaacctttcctgttactgtcaaggaattcaaagagaaatacctgcctaaaccttacgttattaatcttatggatgaactgaccctgaaagaaatcactcaatactatgcttttgtcgaagaaagacagaaagttcattgcctgaatacacttttctctaagcttcaaattaatcaatccattatattctgcaactccgttaatagagttgagctactagctaagaaaataactgaacttggttattcatgcttctacattcatgctaagatgttgcaagaccacagaaaccgagtgtttcatgattttcgcaatggtgcttgcagaaaccttgtgtgtacagatctgtttaccagaggaattgacatccaggctgttaatgtggtcattaactttgacttccccaagacctctgagacatacttgcacagggttggtcgttctggtcgatatggacaccttggtttggcagtgaacttgatcacttatgaggatcgtttcaacttgtatatgattgagcaagaactcggaacagaaattaagacaatacccccacaaattgacctggccgtgtattgccaatgatcagcgctgcagtttccaaaacatcaatgcatttattttcatgaaaaacttgtcaggaaaatacagatgtacatagcacccatcaaggttcgctttggtgccttggtgatgtttctaagcttacttcaagtagtagaggaagggtttcctgtcggcactgataccattcagtttaactgagggcatgggcactgggcttgcttgagaggtccggaacatcgatcagagaaaacagttcttacttcatagatcctgttaacattttcattgtacttgtttgcctaagcacctcttgattcgtcagttttttttttcattttctttccttctgttatgacacatggatatttttttttagccagcttattttgtgtttaaaaaaaaaaaaaaaaaaaa

SEQ ID NO: 959 - protein, 503 aa, Panicum virgatum
  misc_feature (1)..(503): Ceres CLONE ID no. 1795581
  misc_feature (1)..(503): Functional Homolog of  Ceres CLONE ID no.  534281
  misc_feature (153)..(319): Pfam Name: DEAD Pfam Description: DEAD/DEAH box helicase
  misc_feature (385)..(461): Pfam Name: Helicase_C Pfam Description: Helicase conserved C-terminal domain
MHQPRARYPPGYGGGGGVGGGGGGGGNHNYYGRNPQPQPHHHQHYQHQQPPPQQQPQQHAHRNSSHQHQQWLRRDQGPASAAGSGDAAVRTAAQLDAVDSSSQDWKAQLNIPAPDTRYRTEDVTATKGNEFEDYFLKRELLMGIYEKGFERPSPIQEESIPIALTGSDILARAKNGTGKTAAFCIPALEKIDPEKNAIQVVILVPTRELALQTSQVCKELGKYLNIQVMVSTGGTSLRDDIMRLYQPVHLLVGTPGRILDLTRKGICVLKDCSMLVMDEADKLLAPEFQPSVEALIHFLPPSRQLLMFSATFPVTVKEFKEKYLPKPYVINLMDELTLKEITQYYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKTSETYLHRVGRSGRYGHLGLAVNLITYEDRFNLYMIEQELGTEIKTIPPQIDLAVYCQ

SEQ ID NO: 960 - protein, 503 aa, Zea mays
  misc_feature (1)..(503): Ceres CLONE ID no. 290675
  misc_feature (1)..(503): Functional Homolog of  Ceres CLONE ID no.  534281
  misc_feature (153)..(319): Pfam Name: DEAD Pfam Description: DEAD/DEAH box helicase
  misc_feature (385)..(461): Pfam Name: Helicase_C Pfam Description: Helicase conserved C-terminal domain
MHQPRARYPPGYGSSGGGGGGGGGSGGGRGGSGGGGNHNYYGRNTHPQHQHHYQQQQQHSHRNSSHQQQWLRRDQGPAVAGPVSGNAVPKTAPQLDAVDSSSQDWKAQLNIPAPDTRYRTEDVTATKGNEFEDYFLKRELLMGIYEKGFERPSPIQEESIPIALTGSDILARAKNGTGKTAAFCIPALEKIDPENNAIQVVILVPTRELALQTSQVCKELGKYLNIEVMVSTGGTSLKDDIMRLYQPVHLLVGTPGRILDLTRKGICVLKDCSMLVMDEADKLLAPEFQPSVEALIHFLPPSRQLLMFSATFPVTVKEFKEKYLPRPYVINLMDELTLKGITQYYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKTSETYLHRVGRSGRYGHLGLAVNLITYEDRFNLYRIEQELGTEIKTIPPQIDLAVYCQ

SEQ ID NO: 961 - protein, 532 aa, Oryza sativa
  misc_feature (1)..(532): Public GI no. 62733592
  misc_feature (1)..(532): Functional Homolog of  Ceres CLONE ID no.  534281
  misc_feature (171)..(337): Pfam Name: DEAD Pfam Description: DEAD/DEAH box helicase
  misc_feature (403)..(472): Pfam Name: Helicase_C Pfam Description: Helicase conserved C-terminal domain
MHHPRARYPPGYTSGGGGGGGGGGGGGRGNGGGGFGGGGGGGGGNHGYYGRGPQPQPQQQHYHHQAQQLHQHQQQQQHAQRNSSSQQQQWLRRDQATAAAASGEVAARTAAQLEAVDSSSEDWKAQLNLPAPDTRYRTEDVTATKGNEFEDYFLKRELLMGIYEKGFERPSPIQEESIPIALTGSDILARAKNGTGKTAAFCIPALEKIDPEKNAIQVVILVPTRELALQTSQVCKELGKYLNIQVMVSTGGTSLKDDIMRLYQPVHLLVGTPGRILDLTRKGICVLKDCSMLVMDEADKLLAPEFQPSIEQLIHFLPANRQLLMFSATFPVTVKDFKEKYLPRPYVINLMDELTLKGITQYYAFVEERQKVHCLNTLFLKLQINQSIIFCNSVNRVELLAKKITELGYSCFYIHAKMLQDHRNRVFHDFRNGACRNLVCTDLFTRGIGIQAVNVVINFDFPKTSETYLHRICYTYGFCLFTNKNFNTKIKSRVASCMSDGDLPLCSLLLLLQGWSFREIWTPWFGGELNHL

SEQ ID NO: 962 - protein, 498 aa, Arabidopsis thaliana
  misc_feature (1)..(498): Public GI no. 23197660
  misc_feature (1)..(498): Functional Homolog of  Ceres CLONE ID no.  534281
  misc_feature (148)..(314): Pfam Name: DEAD Pfam Description: DEAD/DEAH box helicase
  misc_feature (380)..(456): Pfam Name: Helicase_C Pfam Description: Helicase conserved C-terminal domain
MNTNRGRYPPGVGTGRGAPPNPDYHQSYRQQQPPQDQQYVQRGYSQNPQQMQLQQQHQQQQQQQQWSRRPQLPGNASNANEVVQQTTQPEASSDANGQDWKATLRLPPPDTRYQTADVTATKGNEFEDYFLKRDLLKGIYEKGFEKPSPIQEESIPIALTGSDILARAKNGTGKTGAFCIPVLEKIDPNNNVIQAMILVPTRELALQTSQVCKELSKYLNIQVMVTTGGTSLRDDIMRLHQPVHLLVGTPGRILDLTKKGVCVLKDCAMLVMDEADKLLSAEFQPSLEELIQFLPQNRQFLMFSATFPVTVKAFKDRHLRKPYVINLMDQLTLMGVTQYYAFVEERQKVHCLNTLFSKLQINQSIIFCNSVNRVELLAKKITELGYSCFYIHAKMVQDHRNRVFHEFRNGACRNLVCTDLFTRGIDIQAVNVVINFDFPRTSESYLHRVGRSGRFGHLGLAVNLVTYEDRFKMYQTEQELGTEIKPIPSNIDQAIYCQ

SEQ ID NO: 963 - DNA, 2662 bp, Arabidopsis thaliana
  misc_feature (1)..(2662): Ceres CLONE ID no.  539801
  misc_feature (1)..(2662): GEMINI ID 553H3
actcagtcactcttgtgttcgttcagttcagttcctgcttttctctgagtgaagaaaaaaaaaaaacgaacgttacgagagagagagccatggaagcaatactcgtagattgcgcgcagaagagtcttcgccatttcatgcactccaatgccatcttcatctcgcagcgtctctgtgctcagtttccctccgagacaaacttgcaattgttagctggctgttatttgcagagcaatcaagcttattgtgcataccatatcttaaagggaacccaaatggctcaatctcggtacttgtttgcgatatcttgctttcatatggatcttcttagcgaagctgaagctgcattacgtcctgccgatgagcctggtgcagaggttccaaacggtgcagctggtcattatctattagggctcatttacagatgcactgacagaaggaaaaatgccatacaacatttcaagcaggcactgtcaatggatcctcttatgtgggctgcatatgaggagttgtgtatattaggtgctgctgaagaagcaactgtagtttttggtgaagcagcagctttttgcttacaaaagcaatacctgaattgttcaacctctccaaactcacatatgtcacctgaacatagtaatgaagttgccgcaagaccttgtatgtctgaagaagcgagtccaaggcaactcaaacaaatgcaaagtctcaaggatattgctacatatcatcatggagcatctattttaggaggagctgctggtcaacctattaatagcagttcatctaacatgtcatattataacaccccatctccaatggttgcacagttgtcaagtgttgctccaccgccgttgtgtaggaatgtgctgccaaatggccaaaatcttactacacttagtactgacagttctcctaagtcaacagtaaactctcctattcaagcccctcgaagaaagtttgtgggtgaaggaaagttacgaaagatttcgggtagattgttttctgattctggtcctcggcgtagttcacgactttctagtgactcaagtgtaaacacaaatgctaattcaactgttgtatctggaaatggaaccaataactcttacaagggaggttcaaagctaaaccatatggcatttcgtaccatggcaattcgtaaagggcagtcatgggccaatgaaaacattgatgaaggaatttgtaatgatgttccagatgattcttctttaaatcgtacatctataaattcttgttcatctcctgtcattgaagccaaatcttatgagcaagaagcagcaacttttcacattggtgggcaagtaacaagtggttctaaggtcatcactggcacttcagaaatattaacccttctaagagttcttggtgaaggctatagacttgcctgtttatataggtgccaggatgctctggatacctatctgaaacttccacagaagcattacaacactggctgggttctttctcaggttgggaaagcatactttgagctagttgattatttagaagctgattgtgcctttagtcgtgctcgtcagattacaccttatagtttggaaggaatggatatacactcgacagtcctttatcatttaaaggaagatatgaagctaagttacctggcacaggaactgatttcaactgatcgcttagctcctcaatcttggtgtgccatgggtaattgctacagtctacagaaagatcatgaaactgcactgaagaattttcaacgagctgttcaactgaatcccagatttgcatatgcacacaccctttgtggacatgagtatgttgcactagaagattttgaaaatgggattaagtgctaccatagtgcactcagggttgattcaaggcactacaacgcatggtatggacttggaatgctatatcttcgccaagagaagtatgagttctctgaacatcatttccatatggcctaccaaatcaacccacgatcttctgttatattgtcataccttggaactgctttgcatgctttaaagagaagcggggaagcattggccataatggagaaggctatattggaagataagaaaaatccacttcccatgtatcaaaaagccagcatactcgtaagcttagaaagaattgacgaggctttggatgtccttgaggagctgaaagaggcgcaacctcgtgaaagtagtgtctatgctttgatgggcaatatctatagaaggcgtcacatgcatgagagagcaatgtttcattatggtgttgctttggatttgaaaccatctataacagatgctgctatgattaaggctgctgttgagaaattgattatacctgatgagttccaagacgaagatgactcttagctctacctttgaagtgcaagatttgaattataaggatttgatttccggctagttgtgtatacaagcagcacaaatgctcgagtgagtattcattcaatgttcaaacaatcatcagtccatctaattttcgaaactttagaactgcacacagttttgtaggaaagtcgaatagggttagagatgatgtaacagaggtaccgagaagctcctatacttgtacaaatagttgcattagggataaataggtgtaccataagtttatctattcatttgtctataaatcaatgctttagtctatc

SEQ ID NO: 964 - protein, 757 aa, Arabidopsis thaliana
  misc_feature (1)..(757): Ceres CLONE ID no.  539801
  misc_feature (1)..(757): GEMINI ID 553H3
  misc_feature (529)..(562): Pfam Name: TPR_1 Pfam Description: Tetratricopeptide repeat
MEAILVDCAQKSLRHFMHSNAIFISQRLCAQFPSETNLQLLAGCYLQSNQAYCAYHILKGTQMAQSRYLFAISCFHMDLLSEAEAALRPADEPGAEVPNGAAGHYLLGLIYRCTDRRKNAIQHFKQALSMDPLMWAAYEELCILGAAEEATVVFGEAAAFCLQKQYLNCSTSPNSHMSPEHSNEVAARPCMSEEASPRQLKQMQSLKDIATYHHGASILGGAAGQPINSSSSNMSYYNTPSPMVAQLSSVAPPPLCRNVLPNGQNLTTLSTDSSPKSTVNSPIQAPRRKFVGEGKLRKISGRLFSDSGPRRSSRLSSDSSVNTNANSTVVSGNGTNNSYKGGSKLNHMAFRTMAIRKGQSWANENIDEGICNDVPDDSSLNRTSINSCSSPVIEAKSYEQEAATFHIGGQVTSGSKVITGTSEILTLLRVLGEGYRLACLYRCQDALDTYLKLPQKHYNTGWVLSQVGKAYFELVDYLEADCAFSRARQITPYSLEGMDIHSTVLYHLKEDMKLSYLAQELISTDRLAPQSWCAMGNCYSLQKDHETALKNFQRAVQLNPRFAYAHTLCGHEYVALEDFENGIKCYHSALRVDSRHYNAWYGLGMLYLRQEKYEFSEHHFHMAYQINPRSSVILSYLGTALHALKRSGEALAIMEKAILEDKKNPLPMYQKASILVSLERIDEALDVLEELKEAQPRESSVYALMGNIYRRRHMHERAMFHYGVALDLKPSITDAAMIKAAVEKLIIPDEFQDEDDS

SEQ ID NO: 965 - DNA, 2283 bp, Populus balsamifera subsp. trichocarpa
  misc_feature (1)..(2283): Ceres ANNOT ID no. 1531585
atggaagcgatactagtagactgtgtaaaccacagtcttcgccatttcatgcatcgaaacgccatattcatgtgcgaacggctctgcgccgagttcccttccgagacaaatttgcaattgttagcaggatgttatctgcaaaataatcaagcatactctgcgtatcatattctaaaaggaacacaaatggctcaatcccgctacttgtttgcgatatcatgctttcaaatggatcttctaaatgaagctgaagctgcattatgtcctacaaatgagcctggtttagaggttccaaatggtgcacctgggcactaccttcttgggcttatctacaggtatactgatagaaggaaaagtgccatccatcactttaagcaagctttatctatagatcctttattctgggctgcctacgaggagctttgtatattaggtgctgctgaagaagcagctgcagtttttgatgaagcagctgctctttgtattcaaaagcagcacatgaatcatgcatcagcatcccagaacttgagcatatccaatgaggatcgtaatttagtttctgctcgaaactttggcttggaagatggaagtccaaggcagtcaaaacacccacaagggaataacctaagagatattcctggaaattatcatggagccactacgttaggaggatctgctagtcagccttcaaatggtggccttccaaacctgtcattttataacactccttcaccaatggccacacagttgtcgagtgttgccccaccaccactgtgtagaaacatgcagccaaatggttccaatcttagcatgcctggttttgataacagtgcaaggtcaactttgaattctaatatgcaggcccctcgaagaaagtttgttgatgaagggaaattgcggaagatttctgggaggttattttctgattctggccctcggcgaagtacaaggcttgccgcagaagcaggatccaaccaaaatactagttctacactggttgcagggaatggaactaacaactctcctaaatatcttgggggttccaagtttagttccatggcaatacgttcagtgacagttcgcaagggacagtcatgggtcaatgaaaattatgatgaagggatacggaatgaggcttttgatgattcacgtgcaaataatacatcatcaaattgtagtctatcactcaccggggattctagatctcttgaaacagaagtagcaaccatgcccgttggtggggttatcgcaagtccttcatgtatcttaagtggtgctttagaaatattaggcctcctgagaactcttggggaaggttatagactttcttgcatgtacagatgtcaggatgcactggatgtctacatgaaactaccacacaagcattataatacaggctgggtgctttgccaggttggaaaagcatatgttgaattagtggattatttggaagctgatagagccttcagtcttgcccggcgagcatcaccttacagtttagaaggattggatgtatattctacggttctttatcatttgaaggaagacatgaagttaagttacctggctcaagaactgatatcaactgatcgtttagctcctcaatcttggtgtgctattggaaattgctatagtctgcagaaagaccatgaaactgccttgaaaaattttcagcgagctgtacagcttgattcaagatttgcatatgcacacaccttgtgcggtcatgaatatgttgccttggaggattttgagaatggaattaagagttaccagagtgccctaaggatagatgctagacattacaattcctggcatgggcttgggatggtctatcttcggcaagagaaaaacgagttttctgagcatcacttccgaatggctttccaaataaatccgtgttcttcggtgataatgtcttatcttgggactgctttacatgccttaaagagaaatgaggaagctctggagatgatggagagggcaattttagctgataagaagaaccctcttcccatgtatcaaaaggctaatatacttgtgagcttggaaagctttgatgaagctttagaagtcctagaggagctgaaagagtatgctcctcgtgaaagcagtgtttatgctttgatgggtaaaatttataagaggcgtaacatgcatgagaaggcaatgtttcactttggtcttgctttggatttgaaaccatcagcgactgacgtggctacaataaaggctgccattgagaagctgcatgtaccagatgaattagaagacagcttgtag

SEQ ID NO: 966 - protein, 760 aa, Populus balsamifera subsp. trichocarpa
  misc_feature (1)..(760): Ceres ANNOT ID no. 1531585
  misc_feature (1)..(760): Functional Homolog of  Ceres CLONE ID no.  539801
  misc_feature (101)..(134): Pfam Name: TPR_2 Pfam Description: Tetratricopeptide repeat
  misc_feature (534)..(567): Pfam Name: TPR_1 Pfam Description: Tetratricopeptide repeat
MEAILVDCVNHSLRHFMHRNAIFMCERLCAEFPSETNLQLLAGCYLQNNQAYSAYHILKGTQMAQSRYLFAISCFQMDLLNEAEAALCPTNEPGLEVPNGAPGHYLLGLIYRYTDRRKSAIHHFKQALSIDPLFWAAYEELCILGAAEEAAAVFDEAAALCIQKQHMNHASASQNLSISNEDRNLVSARNFGLEDGSPRQSKHPQGNNLRDIPGNYHGATTLGGSASQPSNGGLPNLSFYNTPSPMATQLSSVAPPPLCRNMQPNGSNLSMPGFDNSARSTLNSNMQAPRRKFVDEGKLRKISGRLFSDSGPRRSTRLAAEAGSNQNTSSTLVAGNGTNNSPKYLGGSKFSSMAIRSVTVRKGQSWVNENYDEGIRNEAFDDSRANNTSSNCSLSLTGDSRSLETEVATMPVGGVIASPSCILSGALEILGLLRTLGEGYRLSCMYRCQDALDVYMKLPHKHYNTGWVLCQVGKAYVELVDYLEADRAFSLARRASPYSLEGLDVYSTVLYHLKEDMKLSYLAQELISTDRLAPQSWCAIGNCYSLQKDHETALKNFQRAVQLDSRFAYAHTLCGHEYVALEDFENGIKSYQSALRIDARHYNSWHGLGMVYLRQEKNEFSEHHFRMAFQINPCSSVIMSYLGTALHALKRNEEALEMMERAILADKKNPLPMYQKANILVSLESFDEALEVLEELKEYAPRESSVYALMGKIYKRRNMHEKAMFHFGLALDLKPSATDVATIKAAIEKLHVPDELEDSL

SEQ ID NO: 967 - DNA, 2283 bp, Populus balsamifera subsp. trichocarpa
  misc_feature (1)..(2283): Ceres ANNOT ID no. 1537203
atggaggcgattctaatagactgtgtaaacaacagtcttcgccatttcatgtatcgaaactccattttcatgtgtgaacgactctgcgctgagtttccttccgagacaaatttacaattgttagccggatgttatttgcaaaatagtcaagcttactctgcatatcatattctaaaaggaacacaaatggctcaatctcgctacttgtttgcgatatcatgctttcagatggatcttctaaatgaagctgaagcggcattatgtcctcctaatgagcctggtgctgaggttccaaatggtgcacctgggcatttccttcttgggcttatctacaggtataccgatagaaggaaaagtgccatccatcactttaagcaggctttatctatagatcctttattctgggccgcctatgaacagctttgtatattaggtgctgctgaagaagcagctgcagtttttgatgaagcagctgctctttgcattcaaaagcagtacatgaattgtgcgtcagcatcccataacttgagcatatccaatgaggatcataatttagtttctgctcgaaactttggcttggaagatggaagtccaaggcagttgaaacacttacaagggaataacctcagagatattcctggaaattaccatggagcctctacattaggagggcctgttagtcagccttcaaatggtgttcctccaaacctgtcattttataacactccttcaccaatggccacacagttgtcaggtgtcgcgccaccaccattgtgcagtaacttgcagccaaattgttcaaatcctagtacacttggttctgataactttcctaggtcgattgtgagttctaatattcaggcccctcgtaaaaagtttgttgatgaagggaaattgcggaagatttctgggaggttattttttgattctggccctcggcgaagcacaaggcttgctgcagaagcaggagccaaccaaaatactagtgctacactggttgcagggtatggaactaacaactcatctaaatatctcgggggttccaagttgagttctatggcaatacgttcagtgacagttcgtaagggacagtcatgggccaatgaaaattatgatgaaggtatacggaatgaggcttttgatgattcacgtgcaaataatacatcttcaaattgtagttcatcgcctcctggggattctagacctcttgaaacagaagtagcaaccatgcctgttggtggagtaatcataagtgcttcatgtatcttaaatggtgctttagaaatattaggcctcctgagaactcttggggaaggttatagacttttttgcatgtacagatgccaggatgcactggatgtgtacatgaaactaccacacaagcattataatacaggctgggtgctttgccaggttggaaaagcttatgttgaattagtggattatttggaagctgatagagccttcagtcttgcccgtcgagcatcaccttacagtttagaaggattggatgtatattctacagttctttatcatttgaaggaagaaatgaagttaagttacctggctcaggaactgatatcaactgatcgtttagctcctcaatcttggtgtgccatgggaaattgctatagtctgcagaaagaccatgaaactgccttgaaaaatttccagagagctgtacaacttgattcgagatttgcatatgcacacaccttatgtggtcatgaatatgttgccttggatgattttgagaatggaattaagagttaccagagtgctctacggatagatgctaggcattacaagtcctggcatgggcttgggatggtctatcttcgacaagagaaaaacgagttttctgagcatcacttccaaatggctttccaaataaatccacattcttctgtgataatgtcttatcttgggacggctttgcatgccttgaagagaaacgaggaagctctagagatgatggagagggcaattttagctgataagaagaaccctcttcccatgtatcagaaggctaatatacttgtgagcttggaaagctttgatgaagctctagatgtcctagaagagctgaaagagtatgctccacgtgaaagcagtgtttatgctttgatgggtaagatttataagaggcgtaacatgtatgagaaggcaatgcttcactttggtcttgcgttggatttcaaaccatcagcaaccgatgttgctacaattaaggctgacatagagaagctgcatgtaccagatgaattagaagacagcttgtag

SEQ ID NO: 968 - protein, 760 aa, Populus balsamifera subsp. trichocarpa
  misc_feature (1)..(760): Ceres ANNOT ID no. 1537203
  misc_feature (1)..(760): Functional Homolog of  Ceres CLONE ID no.  539801
  misc_feature (101)..(134): Pfam Name: TPR_2 Pfam Description: Tetratricopeptide repeat
  misc_feature (534)..(567): Pfam Name: TPR_1 Pfam Description: Tetratricopeptide repeat
MEAILIDCVNNSLRHFMYRNSIFMCERLCAEFPSETNLQLLAGCYLQNSQAYSAYHILKGTQMAQSRYLFAISCFQMDLLNEAEAALCPPNEPGAEVPNGAPGHFLLGLIYRYTDRRKSAIHHFKQALSIDPLFWAAYEQLCILGAAEEAAAVFDEAAALCIQKQYMNCASASHNLSISNEDHNLVSARNFGLEDGSPRQLKHLQGNNLRDIPGNYHGASTLGGPVSQPSNGVPPNLSFYNTPSPMATQLSGVAPPPLCSNLQPNCSNPSTLGSDNFPRSIVSSNIQAPRKKFVDEGKLRKISGRLFFDSGPRRSTRLAAEAGANQNTSATLVAGYGTNNSSKYLGGSKLSSMAIRSVTVRKGQSWANENYDEGIRNEAFDDSRANNTSSNCSSSPPGDSRPLETEVATMPVGGVIISASCILNGALEILGLLRTLGEGYRLFCMYRCQDALDVYMKLPHKHYNTGWVLCQVGKAYVELVDYLEADRAFSLARRASPYSLEGLDVYSTVLYHLKEEMKLSYLAQELISTDRLAPQSWCAMGNCYSLQKDHETALKNFQRAVQLDSRFAYAHTLCGHEYVALDDFENGIKSYQSALRIDARHYKSWHGLGMVYLRQEKNEFSEHHFQMAFQINPHSSVIMSYLGTALHALKRNEEALEMMERAILADKKNPLPMYQKANILVSLESFDEALDVLEELKEYAPRESSVYALMGKIYKRRNMYEKAMLHFGLALDFKPSATDVATIKADIEKLHVPDELEDSL

SEQ ID NO: 969 - protein, 717 aa, Arabidopsis thaliana
  misc_feature (1)..(717): Ceres CLONE ID no. 1209672
  misc_feature (1)..(717): Functional Homolog of  Ceres CLONE ID no.  539801
  misc_feature (518)..(551): Pfam Name: TPR_1 Pfam Description: Tetratricopeptide repeat
  misc_feature (716)..(716): Xaa is any aa, unknown, or other
MEAMLVDCVNNSLRHFVYKNAIFMCERLCAEFPSEVNLQLLATSYLQNNQAYSAYHLLKGTQMAQSRYLFALSCFQMDLLNEAESALCPVNEPGAEIPNGAAGHYLLGLIYKYTDRRKNAAQQFKQSLTIDPLLWAAYEELCILGAAEEATAVFGETAALSIQKQYMQQLSTSLGLNTYNEERNSTSTKNTSSEDYSPRQSKHTQSHGLKDISGNFHSHGVNGGVSNMSFYNTPSPVAAQLSGIAPPPLFRNFQPAVANPNSLITDSSPKSTVNSTLQAPRRKFVDEGKLRKISGRLFSDSGPRRSSRLSADSGANINSSVATVSGNVNNASKYLGGSKLSSLALRSVTLRKGHSWANENMDEGVRGEPFDDSRPNTASTTGSMASNDQEDETMSIGGIAMSSQTITIGVSEILNLLRTLGEGCRLSYMYRCQEALDTYMKLPHKHYNTGWVLSQVGKAYFELIDYLEAEKAFRLARQASPYCLEGMDIYSTVLYHLKEDMKLSYLAQELISTDRLAPQSWCAMGNCYSLQKDNETALRNFLRAVQLNPRFAYAHTLCGHEYTTLEDFENGMKSYQNALRVDTRHYNAWYGLGMIYLRQEKLEFSEHHFRMAFLINPSSSVIMSYLGTSLHALKRSEEALEIMEQAIVADRKNPLPMYQKANILVCLERLDEALEVLEELKEYAPSESSVYALMGRIYKRRNMHDKAMLHFGLALXM

SEQ ID NO: 970 - protein, 744 aa, Arabidopsis thaliana
  misc_feature (1)..(744): Public GI no. 21304447
  misc_feature (1)..(744): Functional Homolog of  Ceres CLONE ID no.  539801
  misc_feature (518)..(551): Pfam Name: TPR_1 Pfam Description: Tetratricopeptide repeat
MEAMLVDCVNNSLRHFVYKNAIFMCERLCAEFPSEVNLQLLATSYLQNNQAYSAYHLLKGTQMAQSRYLFALSCFQMDLLNEAESALCPVNEPGAEIPNGAAGHYLLGLIYKYTDRRKNAAQQFKQSLTIDPLLWAAYEELCILGAAEEATAVFGETAALSIQKQYMQQLSTSLGLNTYNEERNSTSTKNTSSEDYSPRQSKHTQSHGLKDISGNFHSHGVNGGVSNMSFYNTPSPVAAQLSGIAPPPLFRNFQPAVANPNSLITDSSPKSTVNSTLQAPRRKFVDEGKLRKISGRLFSDSGPRRSSRLSADSGANINSSVATVSGNVNNASKYLGGSKLSSLALRSVTLRKGHSWANENMDEGVRGEPFDDSRPNTASTTGSMASNDQEDETMSIGGIAMSSQTITIGVSEILNLLRTLGEGCRLSYMYRCQEALDTYMKLPHKHYNTGWVLSQVGKAYFELIDYLEAEKAFRLARLASPYCLEGMDIYSTVLYHLKEDMKLSYLAQELISTDRLAPQSWCAMGNCYSLQKDHETALKNFLRAVQLNPRFAYAHTLCGHEYTTLEDFENGMKSYQNALRVDTRHYNAWYGLGMIYLRQEKLEFSEHHFRMAFLINPSSSVIMSYLGTSLHALKRSEEALEIMEQAIVADRKNPLPMYQKANILVCLERLDEALEVLEELKEYAPSESSVYALMGRIYKRRNMHDKAMLHFGLALDMKPPATDVAAIKAAMEKLHVPDEIDESP

SEQ ID NO: 971 - protein, 761 aa, Oryza sativa
  misc_feature (1)..(761): Public GI no. 51090847
  misc_feature (1)..(761): Functional Homolog of  Ceres CLONE ID no.  539801
  misc_feature (101)..(134): Pfam Name: TPR_2 Pfam Description: Tetratricopeptide repeat
  misc_feature (597)..(628): Pfam Name: TPR_1 Pfam Description: Tetratricopeptide repeat
METLMVDRVHGSLRLFMHRNAVFLCERLCAQFPAETNVQLLATCYLHNNQPYAAYHILKGKKLPESRYLFAMSCFRMNLLREAEEALCPVNEPNIEVPSGATGHYLLGVIYRYTGRVEAAAEQFVQALTLDPLLWAAYEELCILGVAEDANECFSEATALRLQQELTSTSNVEKSNFVNENRFLSSNVSASFGDSPKQIKQLHANTTAEVSGYPHVKSTALHMQNGAPSNLSQFDTPSPTSTQASGIAPPPLFRNMHAYQNTAGGNAPSKPKVNAPNLTLRRKYIDEAGLKKVSGRLFNQSSDSVPRRSARLSRDTTINSNSNISQFGGNGTDHSSGKLRVNSSTPSKLCSTALRSVQVRKGKPQATENFDEGNRYHVVDEMWTDNVTSTSSSTSIVDGRYPEQEKSERVLSQDSKLAIGIRELMALLRTLGEGYRLSCLFKCQEALEVYRKLPEAQFNTGWVLCQVGKTYFELVNYLEADHFFELAHRLSPCTLEGMDIYSTVLYHLNEEMRLSYLAQDLVSIDRLSPQAWCAVGNCFALRKDHETALKNFQRAVQLDSRVAYAHTLCGHEYSALEDYENSIKLYRSALQVDERHYNAWYGLGVVYLRQEKFEFAEHHFRRAFQINPCSSVLMCYLGMALHALKRNEEALEMMENAIFADKKNPLPKYQKALILLGLQKYPDALDELERLKEIAPHESSMYALMGKIYKQLNILDKAVFCFGIALDLKPPAADVAIIKSAMEKVHLPDELMDDDDDDDEI

SEQ ID NO: 972 - DNA, 2283 bp, Populus balsamifera subsp. trichocarpa; identical to SEQ ID NO: 965
  misc_feature (1)..(2283): Ceres ANNOT ID no. 1531585

SEQ ID NO: 973 - protein, 760 aa, Populus balsamifera subsp. trichocarpa; identical to SEQ ID NO: 966
  misc_feature (1)..(760): Ceres ANNOT ID no. 1531585
  misc_feature (1)..(760): Functional Homolog of  Ceres CLONE ID no.  539801
  misc_feature (101)..(134): Pfam Name: TPR_2 Pfam Description: Tetratricopeptide repeat
  misc_feature (534)..(567): Pfam Name: TPR_1 Pfam Description: Tetratricopeptide repeat

SEQ ID NO: 974 - DNA, 2283 bp, Populus balsamifera subsp. trichocarpa; identical to SEQ ID NO: 967
  misc_feature (1)..(2283): Ceres ANNOT ID no. 1537203

SEQ ID NO: 975 - protein, 760 aa, Populus balsamifera subsp. trichocarpa; identical to SEQ ID NO: 968
  misc_feature (1)..(760): Ceres ANNOT ID no. 1537203
  misc_feature (1)..(760): Functional Homolog of  Ceres CLONE ID no.  539801
  misc_feature (101)..(134): Pfam Name: TPR_2 Pfam Description: Tetratricopeptide repeat
  misc_feature (534)..(567): Pfam Name: TPR_1 Pfam Description: Tetratricopeptide repeat

SEQ ID NO: 976 - protein, 717 aa, Arabidopsis thaliana; identical to SEQ ID NO: 969
  misc_feature (1)..(717): Ceres CLONE ID no. 1209672
  misc_feature (1)..(717): Functional Homolog of  Ceres CLONE ID no.  539801
  misc_feature (518)..(551): Pfam Name: TPR_1 Pfam Description: Tetratricopeptide repeat
  misc_feature (716)..(716): Xaa is any aa, unknown, or other

SEQ ID NO: 977 - protein, 744 aa, Arabidopsis thaliana; identical to SEQ ID NO: 970
  misc_feature (1)..(744): Public GI no. 21304447
  misc_feature (1)..(744): Functional Homolog of  Ceres CLONE ID no.  539801
  misc_feature (518)..(551): Pfam Name: TPR_1 Pfam Description: Tetratricopeptide repeat

SEQ ID NO: 978 - protein, 761 aa, Oryza sativa; identical to SEQ ID NO: 971
  misc_feature (1)..(761): Public GI no. 51090847
  misc_feature (1)..(761): Functional Homolog of  Ceres CLONE ID no.  539801
  misc_feature (101)..(134): Pfam Name: TPR_2 Pfam Description: Tetratricopeptide repeat
  misc_feature (597)..(628): Pfam Name: TPR_1 Pfam Description: Tetratricopeptide repeat

SEQ ID NO: 979 - DNA, 832 bp, Arabidopsis thaliana
  misc_feature (1)..(832): Ceres CLONE ID no.  542773
  misc_feature (1)..(832): GEMINI ID 540F9
ttctagctccatcttccagttatcctttttcagttccataattttcaaatggggagaggaaagatcgtgattcgaaggattgacaattccactagccggcaagtgacgttttccaagagaagaaatgggttagtgaagaaagctagagagctatctattctgtgtgatgcagaagttggattgattgtgttctccagcactggcaagctttatgactatgcaagcaccagcatgaaatctgttattgagcgctataacaaggtcaaagaagaccatcaacagttaataaatcctgcatcagaagtcaagctttggcagagagaagtagcaagcttgcggcaacaagtgcagtacatgcaagaatgtcacaggcaaatgatgggccaagagctttctggattgggtatcgaagagttaggaaatctggaaaagcgactggagatgagtttaaagggtgttcgcatgaagaaggatcaaattctgattgatgaggtcaaagaactacaccaaaagggaagccttgctcatcaagaaaatgtagaacttaatagaaagataaatctcatccgcaaggaaaatgaagaactacaaaaggttattgaagctaagtgtagaaaaggtgttgcagcatccaatcctccattcactatcaactatggatgtaatatgcttgctcctatcagtctccagctaagcctgccagagtcaacgtagtaagccatcagccaaagcaatgaaattgggatattccctcaaactataactattgcctaggtctataaatatgtttaaggtccttattaatatactaaattttggttttagactatct

SEQ ID NO: 980 - protein, 221 aa, Arabidopsis thaliana
  misc_feature (1)..(221): Ceres CLONE ID no.  542773
  misc_feature (1)..(221): GEMINI ID 540F9
  misc_feature (74)..(172): Pfam Name: K-box Pfam Description: K-box region
  misc_feature (9)..(59): Pfam Name: SRF-TF Pfam Description: SRF-type transcription factor (DNA-binding and dimerisation domain)
MGRGKIVIRRIDNSTSRQVTFSKRRNGLVKKARELSILCDAEVGLIVFSSTGKLYDYASTSMKSVIERYNKVKEDHQQLINPASEVKLWQREVASLRQQVQYMQECHRQMMGQELSGLGIEELGNLEKRLEMSLKGVRMKKDQILIDEVKELHQKGSLAHQENVELNRKINLIRKENEELQKVIEAKCRKGVAASNPPFTINYGCNMLAPISLQLSLPEST

SEQ ID NO: 981 - DNA, 1111 bp, Gossypium hirsutum
  misc_feature (1)..(1111): Ceres CLONE ID no.1845589
atttttgctaagtttttatcatttctctctagcttttttgtcggatatcgagagttttaatttttttttcacttttttttggttgtataattagaaaagcttactcgtttttgagtacttcgctgagctataaaaggtatgggtagagggaaaatagtgataaggaggatcgataactcaacgagtaggcaagtaactttttcgaaacgaaggaacggattgttgaaaaaagctaaggagcttgcgatcttgtgtgatgctgaagttggagtaacgatcttctccagcactggaaagctctacgattttgctagcaccagcatgagatctataattgagcgatacaacaaagcaaaggaggaacatcagcaactggggagcccaacctcagaagtcaagttctggcagagggaggcagcaattctgagacagaaattgcaaaacctgcaagaaaatcacaggcaaatgatgggtgaagaactttctggattgggtgtaaaagagttacagaatttggagagccaattggaaatgagccttcgcggtgttcgtatgaagaaggatcaaattttaatgaatgaaattcaagaattgaacagaaaggggaacataattcatcaagaaaatgtggaactctataagaaggtttatggaacaagggatgtcgatggtgcaaacaaagactcccttcttacaaatggtttaggcattggagaggattcacaagttccagtttgtctccagctgtgccagccacagcaacaaagctatgaaacaccaacaagagctacaaacttgggcagactgcaattgcagtagcaaaagcagatgtacagaaatgggattggatgtcactcaacttctatcaacaaatatctcatggttccaaagttatgcttctcatagtaagatgtggtatgttaaaaccaccaatcattcagcaaacattggtttgaaatgtttaaacaaatgaactttagcatgtgtgtgatgatcaagaaaaccatctagttatgtaaagataatttaagctaataaataaatatatatatataagaaggagaaaccagcattaacttttttgaagtttcaaaaaaaaaaaaaaaaaaaa

SEQ ID NO: 982 - protein, 226 aa, Gossypium hirsutum
  misc_feature (1)..(226): Ceres CLONE ID no. 1845589
  misc_feature (1)..(226): Functional Homolog of  Ceres CLONE ID no.  542773
  misc_feature (75)..(172): Pfam Name: K-box Pfam Description: K-box region
  misc_feature (9)..(59): Pfam Name: SRF-TF Pfam Description: SRF-type transcription factor (DNA-binding and dimerisation domain)
MGRGKIVIRRIDNSTSRQVTFSKRRNGLLKKAKELAILCDAEVGVTIFSSTGKLYDFASTSMRSIIERYNKAKEEHQQLGSPTSEVKFWQREAAILRQKLQNLQENHRQMMGEELSGLGVKELQNLESQLEMSLRGVRMKKDQILMNEIQELNRKGNIIHQENVELYKKVYGTRDVDGANKDSLLTNGLGIGEDSQVPVCLQLCQPQQQSYETPTRATNLGRLQLQ

SEQ ID NO: 983 - protein, 235 aa, Oryza sativa
  misc_feature (1)..(235): Public GI no. 50924820
  misc_feature (1)..(235): Functional Homolog of  Ceres CLONE ID no.  542773
  misc_feature (73)..(172): Pfam Name: K-box Pfam Description: K-box region
  misc_feature (9)..(59): Pfam Name: SRF-TF Pfam Description: SRF-type transcription factor (DNA-binding and dimerisation domain)
MGRGKIVIRRIDNSTSRQVTFSKRRNGIFKKAKELAILCDAEVGLVIFSSTGRLYEYASTSMKSVIDRYGRAKEEQQHVANPNSELKFWQREAASLRQQLHSLQENHRQLMGQDLSGLGVKELQTLENQLEMSIRCIRTKKDQLMIDEIHELNRKGSLIHQENMELYRKVNLIRQENAELYKKLYETGAENEANRDSTTPYNFAVIEEANTPARLELNPPSQQNDAEQTTPPKLG

SEQ ID NO: 984 - protein, 238 aa, Petunia x hybrida
  misc_feature (1)..(238): Public GI no. 34452085
  misc_feature (1)..(238): Functional Homolog of  Ceres CLONE ID no.  542773
  misc_feature (73)..(171): Pfam Name: K-box Pfam Description: K-box region
  misc_feature (9)..(59): Pfam Name: SRF-TF Pfam Description: SRF-type transcription factor (DNA-binding and dimerisation domain)
MGRGKIVIQRIDNTTSRQVTFSKRRSGLLKKAKELSILCDAQVGLIIFSSTGKLYEFASNSMRSVIERYYKMKEEHHLMSPMSEVKYWQREVASLRQQLHYLQENHRQLLGEKLSGLGIKDLTHLENKLEMSLKGVRKQKEQILTDEIKEITRKGNLIHQENIELYKKVNLIRQENTDLQKKVYEKGCGSEPNEGVQATFAISNGYDLHAPIYLQLRPPQTQKNQTSTSVMQFGLQLH

SEQ ID NO: 985 - protein, 234 aa, Antirrhinum majus
  misc_feature (1)..(234): Public GI no. 1816459
  misc_feature (1)..(234): Functional Homolog of  Ceres CLONE ID no.  542773
  misc_feature (74)..(172): Pfam Name: K-box Pfam Description: K-box region
  misc_feature (9)..(59): Pfam Name: SRF-TF Pfam Description: SRF-type transcription factor (DNA-binding and dimerisation domain)
MGRGKIVIQRIDKSTSRQVTFSKRRSGLLKKAKELAILCDAEVGVVIFSSTGKLYEFSSTSMKSIIERHTKTKEDHHQLLNHGSEVKFWQREAATLRQQLQDLQENHRKLMGEELQGLNVEDLHRLENQLEMSLRGVRMKKVQMLTDEVHELRRKGHLIHQENNELYEKVKLLQQENKELCKKAYGTRDVSAANGTALVPFGFAIGREQFEPIQLHLSQPEPENIETSRASGSK

SEQ ID NO: 986 - protein, 218 aa, Ipomoea batatas
  misc_feature (1)..(218): Public GI no. 15081463
  misc_feature (1)..(218): Functional Homolog of  Ceres CLONE ID no.  542773
  misc_feature (74)..(173): Pfam Name: K-box Pfam Description: K-box region
  misc_feature (9)..(59): Pfam Name: SRF-TF Pfam Description: SRF-type transcription factor (DNA-binding and dimerisation domain)
MGRGKVEIRRIEKSTNRRVTFWKRRNGLLKKAMEMGILCDAEVGLMIFSSTGKLHEFATTSIRSVIERYNKTQGDSLQSPLDPTLELKFWQIEVAILRQQLHNMQEDHRKVMGEVYGLSVKDLQNLENQLEMSLSGIRMKKEQILIEQIQELTHKQGSFVHQENFELFNKFQAYGTSDPNAVNGDTISPYDFTISEESQGHIHFQLPQNFSDLARALY

SEQ ID NO: 987 - protein, 234 aa, Arabidopsis thaliana
  misc_feature (1)..(234): Public GI no. 2959320
  misc_feature (1)..(234): Functional Homolog of  Ceres CLONE ID no.  542773
  misc_feature (75)..(173): Pfam Name: K-box Pfam Description: K-box region
  misc_feature (9)..(59): Pfam Name: SRF-TF Pfam Description: SRF-type transcription factor (DNA-binding and dimerisation domain)
MGRGKIVIRRIDNSTSRQVTFSKRRSGLLKKAKELSILCDAEVGVIIFSSTGKLYDYASNSSMKTIIERYNRVKEEQHQLLNHASEIKFWQREVASLQQQLQHLQECHRKLVGEELSGMNANDLQNLEDQLVTSLKGVRLKKDQLMTNEIRELNRKGQIIQKENHELQNIVDIMRKENIKLQKKVHGRTNVIEGNSSVDPISNGTTTYAPPQLQLIQLQPAPREKSIRLGLQLS

SEQ ID NO: 988 - protein, 240 aa, Zea mays
  misc_feature (1)..(240): Public GI no. 29611976
  misc_feature (1)..(240): Functional Homolog of  Ceres CLONE ID no.  542773
  misc_feature (73)..(172): Pfam Name: K-box Pfam Description: K-box region
  misc_feature (9)..(59): Pfam Name: SRF-TF Pfam Description: SRF-type transcription factor (DNA-binding and dimerisation domain)
MGRGKIVIRRIDNSTSRQVTFSKRRNGIFKKAKELAILCDAEVGLVIFSSTGRLYEYSSTSMKSVIDRYGKAKEEQQDVANPNSELKFWQREAASLRQQLHNLQENYRQLTGDDLSGLNVKELQSLENQLETSLRGVRAKKDHLLIDEIHDLNRKASLFHQENTDLYNKINLIRQENDELHKKIYETEGPSGVNRESPTPFNFAVVETRDVPVQLELSTLPQQNNIEPSTAPKLGLQLIP

SEQ ID NO: 989 - protein, 240 aa, Zea mays
  misc_feature (1)..(240): Public GI no. 9964296
  misc_feature (1)..(240): Functional Homolog of  Ceres CLONE ID no.  542773
  misc_feature (73)..(172): Pfam Name: K-box Pfam Description: K-box region
  misc_feature (9)..(59): Pfam Name: SRF-TF Pfam Description: SRF-type transcription factor (DNA-binding and dimerisation domain)
MGRGKIVIRRIDNSTSRQVTFSKRRNGIFKKAKELAILCDAEVGLVIFSSTGRLYEYSSTSMKSVIDRYGKAKEEQQVVANPNSELKFWQREAASLRQQLHNLQENYRQLTGDDLSGLNVKELQSLENQLETSLRGVRAKKDHLLIDEIHDLNRKASLFHQENTDLYNKINLIRQENDELHKKIYETEGPSGVNRESPTPFNFAVVETRDVPVQLELSTLPQQNNIEPSTAPKLGLQLIP

SEQ ID NO: 990 - protein, 240 aa, Oryza sativa
  misc_feature (1)..(240): Public GI no. 30313677
  misc_feature (1)..(240): Functional Homolog of  Ceres CLONE ID no.  542773
  misc_feature (73)..(172): Pfam Name: K-box Pfam Description: K-box region
  misc_feature (9)..(59): Pfam Name: SRF-TF Pfam Description: SRF-type transcription factor (DNA-binding and dimerisation domain)
MGRGKIVIRRIDNSTSRQVTFSKRRNGIFKKAKELAILCDAEVGLMIFSSTGRLYEYSSTSMKSVIDRYGKSKDEQQAVANPNSELKFWQREAASLRQQLHNLQENHRQLMGEDLSGLNVKELQSLENQLEISLRSVRTKKDHVLIDEIHELNRKGSLVHQENMELYKKISLIRQENAELYKKIYETEGPSEVNRDSPTPYNFAVIEKTNVPVQLGLSTLPQHSDAEQSTAPKLGLQLNP

SEQ ID NO: 991 - protein, 234 aa, Arabidopsis thaliana
  misc_feature (1)..(234): Public GI no. 29028834
  misc_feature (1)..(234): Functional Homolog of  Ceres CLONE ID no.  542773
  misc_feature (75)..(173): Pfam Name: K-box Pfam Description: K-box region
  misc_feature (9)..(59): Pfam Name: SRF-TF Pfam Description: SRF-type transcription factor (DNA-binding and dimerisation domain)
MGRGKIVIRRIDNSTSRQVTFSKRRSGLLKKAKELSILCDAEVGVIIFSSTGKLYDYASNSSMKTIIERYNRVKEEQHQLLNHASEIKFWQREVASLQQQLQYLQECHRKLVGEELSGMNANDLQNLEDQLVTSLKGVRLKKDQLMTNEIRELNRKGQIIQKENHELQNIVDIMRKENIKLQKKVHGRTNAIEGNSSVDPISNGTTTYAPPQLQLIQLQPAPREKSIRLGLQLS

SEQ ID NO: 992 - protein, 218 aa, Ipomoea batatas
  misc_feature (1)..(218): Public GI no. 63079855
  misc_feature (1)..(218): Functional Homolog of  Ceres CLONE ID no.  542773
  misc_feature (74)..(173): Pfam Name: K-box Pfam Description: K-box region
  misc_feature (9)..(59): Pfam Name: SRF-TF Pfam Description: SRF-type transcription factor (DNA-binding and dimerisation domain)
MGRGKVEIRRIEKSTNRRVTFWKRRNGLLKKAMEMGILCDAEVGLMIFSSTGKLHEFATTSIRSVIERYNKTQGDGLQSPLDPTLELKFWQIKVAILRKQLHNMQEDHRKAMGEVYGLSVKDLLNLENQLEMSMSSIIMKKEQLLIDQILELTHQQRSIVLQENFELFNKFQAYGTSDPNAVNGDTISPYDFTISEESQGHIHFQLPQNFSDLARALY

SEQ ID NO: 993 - DNA, 998 bp, Arabidopsis thaliana
  misc_feature (1)..(998): Ceres CLONE ID no.  543118
  misc_feature (1)..(998): GEMINI ID 540H5
gacttcgttcgttccttctccttccaagttctaaccatttcccactgtcttcgattttagggcattaaatctgccatggcagcagcacccgctagagctcgtgccgattacgattacctcatcaagcttcttcttatcggcgacagcggtgtggggaagagttgtctacttttgaggttttctgatggctcattcacaaccagttttatcaccaccattggtatcgattttaagataagaaccattgaactagacagcaaacggattaagttacaaatctgggatactgctggtcaggagcggttccgaactattaccacagcttattaccgtggagccatgggtatcttgctggtttatgatgttactgatgaagcatctttcaataatattaggaattggatccgcaatattgaacaacatgcttctgacaatgtaaacaaratacttgttggcaacaaggctgatatggatgaaagtaaaagggctgtacctacctccaaagggcaagcacttgctgatgagtatggtatcaagttctttgaaactagtgcaaaaaccaacatgaacgtggaagaggtcttcttttcaatagcaagagatattaagcaaaggcttgcagacacagattcaagagctgagcctcagactatcaagattaaccaacctgaccaggcaaccagtggtggtcaacctgcgcaaaagtcggcttgctgtggttcatgaaaagaatcagtatctgtagaaagaggtgcacaggtttctgcaatagcactcatctgggtgctaatgttattctgatgacattataagtgggagcatgtatttgtccctctgtatctcccaactgcagatgtcttattttaaagttaatattttaaattctttgctcactgacttggtggaatttgttgtgactagtaatttgcttcaatttcctattttcatttgtagtgtgactcttaaaaggtatcttgattagatgcggatagattatc

SEQ ID NO: 994 - protein, 216 aa, Arabidopsis thaliana
  misc_feature (1)..(216): Ceres CLONE ID no.  543118
  misc_feature (17)..(179): Pfam Name: Ras Pfam Description: Ras family
  misc_feature (1)..(216): GEMINI ID 540H5
  misc_feature (123)..(123): Xaa is any aa, unknown, or other
MAAAPARARADYDYLIKLLLIGDSGVGKSCLLLRFSDGSFTTSFITTIGIDFKIRTIELDSKRIKLQIWDTAGQERFRTITTAYYRGAMGILLVYDVTDEASFNNIRNWIRNIEQHASDNVNXILVGNKADMDESKRAVPTSKGQALADEYGIKFFETSAKTNMNVEEVFFSIARDIKQRLADTDSRAEPQTIKINQPDQATSGGQPAQKSACCGS

SEQ ID NO: 995 - protein, 215 aa, Pisum sativum
  misc_feature (1)..(215): Public GI no. 871508
  misc_feature (1)..(215): Functional Homolog of  Ceres CLONE ID no.  543118
  misc_feature (17)..(179): Pfam Name: Ras Pfam Description: Ras family
MAAAPARARADYDYLIKLLLIGDSGVGKSCLLLRFSDGSFTTSFITTIGIDFKIRTIELDGKRIKLQIWDTAGQERFRTITTAYYRGAMGILLVYDVTDEASFNNIRNWIRNIEQHASDNVNKILVGNKADMDESKRAVPTSKGQALADEYGIKFFETSAKTNMNVEEVFFSIARDIKQRLADTDSRSEPQTIKINQQDPAANGGQAATKSACCG

SEQ ID NO: 996 - protein, 216 aa, Lotus japonicus
  misc_feature (1)..(216): Public GI no. 1370190
  misc_feature (1)..(216): Functional Homolog of  Ceres CLONE ID no.  543118
  misc_feature (18)..(180): Pfam Name: Ras Pfam Description: Ras family
MAGAPAARARADYDYLIKLLLIGDSGVGKSCLLLRFSDGSFTTSFITTIGIDFKIRTIELDGKRIKLQIWDTAGQERFRTITTAYYRGAMGILLVYDVTDEASFNNIKNWIRNIEQHASDNVNKILVGNKADMDESKRAVPTSKGQALADEYGIKFFETSAKTNLNVEEVFFSIARDIKQRLADTDSRAEPQTIQINQPDASASGGQAAQKSCCGS

SEQ ID NO: 997 - protein, 215 aa, Pisum sativum
  misc_feature (1)..(215): Public GI no. 871506
  misc_feature (1)..(215): Functional Homolog of  Ceres CLONE ID no.  543118
  misc_feature (17)..(179): Pfam Name: Ras Pfam Description: Ras family
MAAAPARARADSDYLIKLLLIGDSGVGKSCLLLRFSDGSFTTSFITTIGIDFKIRTIELDGKRIKLQIWDTAGQERFRTITTAYYRGAMGILLVYDVTDEASFNNIRNWIRNIEQHASDNVNKILVGNKADMDESKRAVPTSKGQALADEYGIKFFETSAKTNMNVEEVFFSIARDIKQRLADTDSKSEPQTIKINQQDPAANGGQAATKSACCG

SEQ ID NO: 998 - protein, 222 aa, Brassica rapa
  misc_feature (1)..(222): Public GI no. 1654144
  misc_feature (1)..(222): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEEVFFSIGRDIKQRLSDTDSRAEPATIRISQTDQELDCAGHTEVCMLWKLKTNYIN

SEQ ID NO: 999 - protein, 216 aa, Nicotiana tabacum
  misc_feature (1)..(216): Public GI no. 18447913
  misc_feature (1)..(216): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNMNVEEVFFSIARDIKQRLAESDNRAEPQTIRINQPDQGAGGAQTAQKSACCGS

SEQ ID NO: 1000 - protein, 216 aa, Medicago truncatula
  misc_feature (1)..(216): Public GI no. 92897911
  misc_feature (1)..(216): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNLNVEEVFFSIARDIKQRLADTDSKSEPQTIKINQPDQGAGAAQAAQKSACCGS

SEQ ID NO: 1001 - protein, 216 aa, Nicotiana tabacum
  misc_feature (1)..(216): Public GI no. 18447921
  misc_feature (1)..(216): Functional Homolog of  Ceres CLONE ID no.  543118
  misc_feature (17)..(179): Pfam Name: Ras Pfam Description: Ras family
MATPPARARADYDYLIKLLLIGDSGVGKSCLLLRFSDGSFTTSFITTIGIDFKIRTIELDSKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNMNVEEVFFSIARDIKQRLAESDSKAEPQTIRINQPDQAAGAAQSAQKSACCGS

SEQ ID NO: 1002 - protein, 215 aa, Pisum sativum
  misc_feature (1)..(215): Public GI no. 871514
  misc_feature (1)..(215): Functional Homolog of  Ceres CLONE ID no.  543118
  misc_feature (17)..(179): Pfam Name: Ras Pfam Description: Ras family
MAAAPARARADYDYLIKLLLIGDRRVGKSCLLLRFSDGSFTTSFIATIGIDFKIRTIELDGKPIKLQIWDTAGQERFRTITTAYYRGAMGILLVYDVTDEASFNNIRNWIRNIEQHASDNVNKILVGNKADMDESKRAVPTSKGQALADEYGIKFFETSAKTNMNVEEVFFSIARDIKQRLADTDSRSEPQTIKINQQDPAANGGQAATKSACCG

SEQ ID NO: 1003 - protein, 212 aa, Lotus japonicus
  misc_feature (1)..(212): Public GI no. 1370194
  misc_feature (1)..(212): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTIELDGKRIKLQIWDTAGQERVRTITTAYYRGAKGILLVYDVTDESSFNNIRNWIRNIEQHASDNVNKILVGNKADMDESKRAVPTSKGQALADEYGIKFFETSAKTNLNVEEVFFSIARDIKQRLADTDSKAEPQTIKINQPDQPAAAQNSTCCGS

SEQ ID NO: 1004 - protein, 216 aa, Nicotiana tabacum
  misc_feature (1)..(216): Public GI no. 18447917
  misc_feature (1)..(216): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNMNVEEVFFSIARDIKQRLAESDSKAEPQTIRINQPDQAAGASQSVQKSACCGS

SEQ ID NO: 1005 - protein, 216 aa, Arabidopsis thaliana
  misc_feature (1)..(216): Public GI no. 28973447
  misc_feature (1)..(216): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPKSKGQALADEYGIKFFETSAKTNLNVEEVFFSIAKDIKQRLADTDSRAEPATIKISQTDQAAGAGQATQKSACCGS

SEQ ID NO: 1006 - DNA, 771 bp, Populus balsamifera subsp. trichocarpa
  misc_feature (1)..(771): Ceres ANNOT ID no. 1458068
atggctacatgtagcccaaattcaacctcatctaatggccaattgtcggattgcattgaactttttggtgcaatggaaatcatcaagaaaaactgggtggataagtggtttaaagttaataaaaaagatgagttcagggaggagaaagtttgtgtggggaagagttgtctgcttttgcgtttttctgatggttccttcacaaccagtttcattaccaccatcggcattgatttcaagataagaaccattgagcttgatggtaaacggattaaactacaaatatgggatacagcaggccaggaacgtttccgaactatcacaacagcctattaccgaggagccatggggattttgctcgtttatgatgttactgatgaatcatctttcaacaatattaggaactggattcgcaacattgaacagcatgcttctgacaatgtcaacaagatactggtgggaaacaaagcagacatggatgagagcaaaagggctgtgcctacctccaagggtcaagctcttgcagacgagtatgggatcaagttctttgaaactagtgctaagacaaatttgaacgtggaggaggttttcttttcaattgcaagggatatcaagcaaaggatctcggaaactgattccagggcagagcctcaaacaatcaagattaaccaaccagatccatcagccagtggtggccaagctgcccaaaacttgtaccatgccgccgctacatgtggctggctgaatgctgaatatactggccatactcattga

SEQ ID NO: 1007 - protein, 232 aa, Populus balsamifera subsp. trichocarpa
  misc_feature (1)..(232): Ceres ANNOT ID no. 1458068
  misc_feature (1)..(232): Functional Homolog of  Ceres CLONE ID no.  543118
  misc_feature (27)..(181): Pfam Name: Ras Pfam Description: Ras family
MEIIKKNWVDKWFKVNKKDEFREEKVCVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNLNVEEVFFSIARDIKQRISETDSRAEPQTIKINQPDPSASGGQAAQNLYHAAATCGWLNAEYTGHTH

SEQ ID NO: 1008 - protein, 215 aa, Glycine max
  misc_feature (1)..(215): Ceres CLONE ID no. 636809
  misc_feature (1)..(215): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTIEQDGKRIKLQIWDTAGQERFRTITTAYYRGAMGILLVYDVTDESSFNNIRNWIRNIEQHASDNVNKVLVGNKADMDESKRVVPTSKGQALADEYGIKFFETSAKTNLNVEEVFFSIARDIKQRLADTDSKAEPAGIKINNQLDHATAGEVAQKSACCG

SEQ ID NO: 1009 - protein, 216 aa, Nicotiana tabacum
  misc_feature (1)..(216): Public GI no. 18447919
  misc_feature (1)..(216): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNMNVEEVFFSIARDIKQRLSESDSKTEPQAIRINQSDQAGTSGQAAQKSSCCGS

SEQ ID NO: 1010 - DNA, 1162 bp, Gossypium hirsutum
  misc_feature (1)..(1162): Ceres CLONE ID no.1895506
attcattcattctcttcaaccagctattttctcttcgttgacgaattaaaaaagaagtaaagaaaaaaccgcccgttagattcacacagatctgaacactaaatattaatccaacggttgggactgcggagtcgaatccaataacttatttcttgaatttattcctcttttcttcaaaaattattttctccctaagaaaaaaaattaaacagccgaccggtgctgacgtaccagagacgtttcaccagatctcacttttctcatccctgatctgggtttattcgttagttccgataaatttattctattcccatggctgctccacctgcaagagctcgagccgattatgactacctcataaagctccttttgatcggcgacagcggtgtgggtaagagttgcctgcttttgcgtttttcggatggctcattcactacaagttttatcacgacaattggaattgactttaagataaggaccatagagcttgatggaaaaaggatcaagctgcaaatttgggatactgctgggcaagagaggtttcgtacaattacaactgcttactaccgtggagccatgggcatattgcttgtgtatgacgtgactgatgaatcatctttcaataacattagaaactggattcgaaatattgaacagcatgcttcagacaatgtgaacaagattctagtgggtaataaggctgacatggatgaaagtaaaagggctgtccctacctcaaagggccaagctcttgctgacgaatatggcatcaagttctttgagactagtgcaaaaacaaacttaaatgtcgaggaggttttcttttcaatagccagggacatcaagcaaagacttgctgacactgactcaaaggctgagccacaggcaatcaaaattaaccaacaagaccagggagctggggctgcggcagctgctcaaaaatcatcttgctgtggagcttgaacaaactacattgcggatgagatctgaagggtacattttcttctctatggtgccattttgatcctgggaaaactaatttgttacaactattttgtttatattctcctgcatatcattattttacagctgctactgtctggtgtgaaatgttattagatcttggtattttgcaatattaattatattagatcatttgttt

SEQ ID NO: 1011 - protein, 216 aa, Gossypium hirsutum
  misc_feature (1)..(216): Ceres CLONE ID no. 1895506
  misc_feature (1)..(216): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNLNVEEVFFSIARDIKQRLADTDSKAEPQAIKINQQDQGAGAAAAAQKSSCCGA

SEQ ID NO: 1012 - protein, 216 aa, Arabidopsis thaliana
  misc_feature (1)..(216): Public GI no. 14334918
  misc_feature (1)..(216): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEEVFFSIGRDIKQRLSDTDSRAEPATIKISQTDQAAGAGQATQKSACCGT

SEQ ID NO: 1013 - protein, 216 aa, Pisum sativum
  misc_feature (1)..(216): Public GI no. 871510
  misc_feature (1)..(216): Functional Homolog of  Ceres CLONE ID no.  543118
  misc_feature (17)..(179): Pfam Name: Ras Pfam Description: Ras family
MAAPPARARSDYDYLIKLLLIGDSGVGKSCLLLRFSDGSFTTSFITTIGIDFKIRTIELDGKRIKLQIWDTAGQERFRTITTAYYRGAMGILLVYDVTDESSFNNIKNWIRNIEQHASDNVNKILVGNKADMDESKRAVPTSKGQALADEYGIKFFETSAKTNMNVDEVFFSIARDIKQRLAETDSKTEPQTLKINQPDQGAGSAQATQKSACCGS

SEQ ID NO: 1014 - protein, 216 aa, Arabidopsis thaliana
  misc_feature (1)..(216): Ceres CLONE ID no. 256151
  misc_feature (1)..(216): Functional Homolog of  Ceres CLONE ID no.  543118
  misc_feature (17)..(179): Pfam Name: Ras Pfam Description: Ras family
  misc_feature (183)..(183): Xaa is any aa, unknown, or other
  misc_feature (189)..(189): Xaa is any aa, unknown, or other
  misc_feature (198)..(198): Xaa is any aa, unknown, or other
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEEVFFSIGRDIKQRLSXTDSRAXPATIKISQXDQATGAGQATQKSACCGT

SEQ ID NO: 1015 - DNA, 669 bp, Populus balsamifera subsp. trichocarpa
  misc_feature (1)..(669): Ceres ANNOT ID no. 1461863
atggctgctccccctgctagagcccgagccgattatgactatctcattaagcttctcttgatcggcgatagcggatcccatgatttcaattcaggtgtgggcaagagttgccttcttttgcgtttctctgatggttccttcacaactagttttatcactaccattggtattgactttaagataagaaccattgagcttgatggcaaaaggattaagcttcaaatttgggatacagctgggcaggagcggttccgaacaatcacaactgcttattatcgtggagctatgggtattttgctggtctatgatgttactgatgaatcatctttcaacaacattaggaattggattcgcaacattgagcaacatgcttctgataatgttaacaagatattggtagggaacaaggctgacatggatgaaagcaaacgggctgtaccaacatcgaagggccaagcactcgctgatgagtacgggatcaaattctttgaaactagtgcaaagacgaatcaaaatgtggagcaagttttcttttcaatagcaagggatataaagcaaaggctttctgacactgacaccaaggctgagcctgcaacatcaaagattcatctagaccaggcgtctggagctggtccagctgcccagaaatcagcttgttgcggttcttaa

SEQ ID NO: 1016 - protein, 222 aa, Populus balsamifera subsp. trichocarpa
  misc_feature (1)..(222): Ceres ANNOT ID no. 1461863
  misc_feature (1)..(222): Functional Homolog of  Ceres CLONE ID no.  543118
  misc_feature (17)..(186): Pfam Name: Ras Pfam Description: Ras family
MAAPPARARADYDYLIKLLLIGDSGSHDFNSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNQNVEQVFFSIARDIKQRLSDTDTKAEPATSKIHLDQASGAGPAAQKSACCGS

SEQ ID NO: 1017 - protein, 214 aa, Lotus japonicus
  misc_feature (1)..(214): Public GI no. 1370196
  misc_feature (1)..(214): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTIELDGKRVKLQIWDTAGQERFRTITTAYYRGAMGILLVYDVTDEASFNNIRNWLRNIEQHASDNVNKILVGNKADMDESKRAVPTSKGQALADEYGIKFFETSAKTNLNVEEVFFSIARDIKQRLADTDHKAEPTTLKINQDSAAGAGEAANKSSCCG

SEQ ID NO: 1018 - protein, 215 aa, Lotus japonicus
  misc_feature (1)..(215): Public GI no. 1370198
  misc_feature (1)..(215): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIKNWIHNIEQHASDNVNKILVGNKADMDESKRAVPTSKGQALADEYGIKFFETSAKTNLNVEEVFFSIARDIKQRLADTDSSKTEPTGIKINPQDKGSAGEAAQKSACCG

SEQ ID NO: 1019 - protein, 215 aa, Beta vulgaris subsp. vulgaris
  misc_feature (1)..(215): Public GI no. 974776
  misc_feature (1)..(215): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEEVFFSIARDIKQRLADSDTRQEAQPSITIKPADQSGNQAAAKSACCGS

SEQ ID NO: 1020 - protein, 216 aa, Lycopersicon esculentum
  misc_feature (1)..(216): Public GI no. 5669640
  misc_feature (1)..(216): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSLTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEQVFFSIARDIKQRLADTDSKAEPSTLKINQPEAGAGGSQTSQKSACCGS

SEQ ID NO: 1021 - protein, 216 aa, Zea mays
  misc_feature (1)..(216): Ceres CLONE ID no. 1390343
  misc_feature (1)..(216): Functional Homolog of  Ceres CLONE ID no.  543118
  misc_feature (17)..(179): Pfam Name: Ras Pfam Description: Ras family
MAAPPARTRADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPAAKGQALADEYGIKFFETSAKTNLNVEEVFFSIGRDIKQRLSDTDSKAEPATIKISQTDQADGAGQATQKSACCGS

SEQ ID NO: 1022 - protein, 216 aa, Arabidopsis thaliana
  misc_feature (1)..(216): Public GI no. 21555222
  misc_feature (1)..(216): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDSVNKILVGNKADMDESKRAVPKSKGQALADEYGMKFFETSAKTNLNVEEVFFSIAKDIKQRLADTDARAEPQTIKINQSDQGAGTSQATQKSACCGT

SEQ ID NO: 1023 - protein, 214 aa, Triticum aestivum
  misc_feature (1)..(214): Ceres CLONE ID no. 683923
  misc_feature (1)..(214): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTIELDQKRIKLQIWDTAGQERFRTITTAYYRGAMGILLVYDVTDESSFNNIRNWIRNIEQHASDNVNKILIGNKADMDESKRAVPTAKGQALADEYGIKFFETSAKTNLNVEQVFFSIARDIKQRLAETDSKPEDKTIKINKAEGGDAPAASGSACCGS

SEQ ID NO: 1024 - protein, 216 aa, Lycopersicon esculentum
  misc_feature (1)..(216): Public GI no. 313029
  misc_feature (1)..(216): Functional Homolog of  Ceres CLONE ID no.  543118
  misc_feature (17)..(179): Pfam Name: Ras Pfam Description: Ras family
MAAPPARARADYDYLIKLLLIGDTGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNLNVEEVFFSIGKDIKQRLSESDSKTEPQSIRINQSDQAGTAGQGAQKSSCCGS

SEQ ID NO: 1025 - protein, 216 aa, Musa acuminata
  misc_feature (1)..(216): Ceres CLONE ID no. 1725800
  misc_feature (1)..(216): Functional Homolog of  Ceres CLONE ID no.  543118
  misc_feature (17)..(179): Pfam Name: Ras Pfam Description: Ras family
MAAPPVRARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEQVFFSIARDIKQRLAETDSKPEDRTIKINKPDQAAAEGTAAPRSACCGS

SEQ ID NO: 1026 - protein, 216 aa, Daucus carota
  misc_feature (1)..(216): Public GI no. 2808638
  misc_feature (1)..(216): Functional Homolog of  Ceres CLONE ID no.  543118
  misc_feature (17)..(179): Pfam Name: Ras Pfam Description: Ras family
MAAPPARPRADYDYLIKLLLIGDSGVGKSCLLLRFSDGSFTTSFITTIGIDFKIRTIEMDGKRIKLQIWDTAGQERFRTITTAYYRGAMGILLVYDVTDESSFNNIRNWIRNIEQHASDNVNKILVGNKADMDESKRAVPTSKGQALADEYGIKFFEASAKTNMNVEEVFFSIAKDIKQRLAETDSKTEPQTIKINQQEQGAGTSAASQKSACCGS

SEQ ID NO: 1027 - DNA, 1085 bp, Gossypium hirsutum
  misc_feature (1)..(1085): Ceres CLONE ID no.1851155
ctctttctctctcgcatgtgctttgctatcttcagcgtctcagataagaggatatattattatatatttttgaattgtgttttttgtgcgtgatttttgaggatcaatggctgcaccaccagctagagctcgtgctgattatgattacctcattaagcttcttttaattggtgatagtggtgtgggaaagagttgtcttcttctacgattttctgatggctcctttaccactagtttcataacgaccattggcattgattttaagataagaaccattgagcttgatggtaagaggatcaaactacaaatctgggacacagctggtcaagagcgattccgaactattacgacagcttactatcgtggagccatggggattttgctggtttatgatgttactgatgagtcatctttcaacaatattaggaattggattcgcaacattgaacaacatgcttccgacaatgtcaacaaggtactggttgggaacaaggctgacatggatgagagcaaaagggctgtgcctacatccaagggtcaagctcttgctgacgagtacggtatcaagttctttgaaactagtgcaaagacgaatttgaatgttgaggaggttttcttctcaatagcccgggatattaaacaaaggctcaccgaatctgataataaggccgagcccacggcactaaaaattaatcaacaagacgctgcagcaagtgttgatcaagctgctcaaaagtcgggttgctgcggaggttaaaaggaattaacaaaagtataccagattcttggtggaagctttggcttttggcagtccctcaaatgtaaaatcgaattgtgacgacattatggtgaattcatgtatttactttcctgttaattctttttctccaactaccaggcttaggctttattcttcttgaactcaaatgaccctttgttatgtatttcagtatttgtctttatagctttgaaaaaaaaagtatttgctttatgtaagataatctaaattcaagtttttttttcctcttgaaaagaaaaaaacaataaaaaaatctggaagttcttaaaaaaaaaaaaaaaaaaaa

SEQ ID NO: 1028 - protein, 216 aa, Gossypium hirsutum
  misc_feature (1)..(216): Ceres CLONE ID no. 1851155
  misc_feature (1)..(216): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKVLVGNKADMDESKRAVPTSKGQALADEYGIKFFETSAKTNLNVEEVFFSIARDIKQRLTESDNKAEPTALKINQQDAAASVDQAAQKSGCCGG

SEQ ID NO: 1029 - protein, 215 aa, Oryza sativa
  misc_feature (1)..(215): Public GI no. 50935375
  misc_feature (1)..(215): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNLNVEQVFFSIARDIKQRLAETDSKTEDRTIKINKPEGDAEATTLQKSACCGS

SEQ ID NO: 1030 - DNA, 1106 bp, Panicum virgatum
  misc_feature (1)..(1106): Ceres CLONE ID no.1802574
acggaaaaaaaaaatcccgtctcgctccccccctccgtctgcgcagcccccagatccggcgccgcccgctcctcgatacccgcgccccacgcccgcaggtcggggggtttgcgcgccccgggcaccggaggaagaggggcggcatggcggcgccgccggcgagggcccgggccgactacgactaccttattaagctgctcctcattggggatagcggtgttggcaagagttgcctcctattgcggttctccgatggttccttcactacaagctttattaccacaattggtattgattttaagataagaacaatagagttggatggcaagcgcatcaagctacagatttgggacacagcgggccaagaacgcttccggaccattaccactgcatactaccgaggagctatgggcatcctgttggtttatgatgtcaccgatgagtcttcttttaacaacatccgaaactggattcggaacattgagcaacatgcctctgataatgtcaacaaaatattggtcggcaataaggcagatatggatgagagcaaaagggctgtacctactgcaaaaggacaagcgcttgctgatgagtacgggatcaagttctttgaaactagtgccaagacaaaccttaacgtcgagcaagtgtttttctcaattgcacgtgatatcaagcagaggcttgcggagactgattctaagcctgaggagaaggcaatcaagattaacaagccagatcagggtaccgagcaagcagctggtcagcgatccacttgctgcggctcataagcaatgtgtgatgtccatgatcattggttatttgacgttatttatttcccgcttggctgttataggaagaatttgaagaagccacttatgatatactgatgtggttgtactcgtgtttgcttccattctttgaagcaatcacctcttgctgttgacgtagctattgctattgctgggagctattgcactctggatttcggtccgttgaaaaaactctcccctccctacagtgtgtaatgaatgaaatccatgtcgttgggtttgcattttatctatcaatgcatggaataacgtgaaaaaaaaaaaaaaaaaaaa

SEQ ID NO: 1031 - protein, 215 aa, Panicum virgatum
  misc_feature (1)..(215): Ceres CLONE ID no. 1802574
  misc_feature (1)..(215): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEQVFFSIARDIKQRLAETDSKPEEKAIKINKPDQGTEQAAGQRSTCCGS

SEQ ID NO: 1032 - protein, 214 aa, Oryza sativa
  misc_feature (1)..(214): Public GI no. 50919469
  misc_feature (1)..(214): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTVELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNLNVEQVFFSIARDIKQRLSETDSKPEDRTIKIKSEGEAEAAAAQKSACCGS

SEQ ID NO: 1033 - protein, 214 aa, Zea mays
  misc_feature (1)..(214): Ceres CLONE ID no. 1281221
  misc_feature (1)..(214): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTVELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNLNVEQVFFSIARDIKQRLSETDSKPEDRTIKIKAEGEADAAEAQKSACCGS

SEQ ID NO: 1034 - DNA, 1053 bp, Panicum virgatum
  misc_feature (1)..(1053): Ceres CLONE ID no.1724467
ctcctccgatcgagccgggaccgccaggcaaacctggtgctccccttctccgtcaccgcgacgcctcggcctccccgctccaccgcctccgctcctcgtgaggcgacgccacgcctatagatcgcgtgcccaagcacggacgccaccccgctcggtgctgggaggtagagcgcgatggcagcgccgccggcgagggctcgagccgactacgactacctcatcaagctgcttctcatcggagacagcggtgttggaaaaagttgtcttctcttacggttttcagatggctccttcaccactagcttcatcactactattggtattgacttcaagataaggactgtcgagttggatggcaaacggattaagttgcagatctgggatactgcaggccaagaacgtttccgcacgattacaactgcctattacaggggagctatgggcattttacttgtgtatgacgtcacagacgagtcgtcttttaataatataagaaattggatcagaaacattgaacaacatgcctcggataatgtgaacaaagttctggtaggcaataaagctgatatggatgaaagcaaacgggctgttcccacttccaaggggcaagctcttgccgatgaatatgggataaaattctttgaaacgagtgcaaagacaaacctgaacgtcgagcaggttttcttttctattgcaagggatatcaaacaaagactctcggagactgattcgaagcctgaggatcgaactatcaagatcaaggccgaaggggaagctgatgcagcagatgcacagaaatcagcttgctgcggctcctaaacagttgttacagcaagatttggtgttactgctcatgtaatttttatcgttttattctttgccagcaactctccttgtgtgtttctcaagtcatcgcaattgttgggatttggacaaacgggtgttaagtcagaacatttacttgctatattggtgggaaactgtggtcttgataacgatgagcgcgtatagaattgggtggcttggtttgatctaaaaaaaaaaaaaaaaaaa

SEQ ID NO: 1035 - protein, 214 aa, Panicum virgatum
  misc_feature (1)..(214): Ceres CLONE ID no. 1724467
  misc_feature (1)..(214): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTVELDGKRIKLQIWDTAGQERFRTITTAYYRGAMGILLVYDVTDESSFNNIRNWIRNIEQHASDNVNKVLVGNKADMDESKRAVPTSKGQALADEYGIKFFETSAKTNLNVEQVFFSIARDIKQRLSETDSKPEDRTIKIKAEGEADAADAQKSACCGS

SEQ ID NO: 1036 - protein, 214 aa, Glycine max
  misc_feature (1)..(214): Ceres CLONE ID no. 1076158
  misc_feature (1)..(214): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILIGNKADMDESKRAVSTAKGQALADEYGIQFFETSAKTNLNVEQVFFSIARDIKQRLAETDSKPEDQTIKINKTEGSENPESQKSACCGS

SEQ ID NO: 1037 - protein, 215 aa, Zea mays
  misc_feature (1)..(215): Ceres CLONE ID no. 689414
  misc_feature (1)..(215): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTVELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNLNVEQVFFSIARDIKQRLSETDSKPEDRTIKIKAEGEAEAAAAAQNSACCGS

SEQ ID NO: 1038 - protein, 215 aa, Zea mays; identical to SEQ ID NO: 1037
  misc_feature (1)..(215): Ceres CLONE ID no. 1290569
  misc_feature (1)..(215): Functional Homolog of  Ceres CLONE ID no.  543118
  misc_feature (17)..(179): Pfam Name: Ras Pfam Description: Ras family

SEQ ID NO: 1039 - protein, 214 aa, Glycine max
  misc_feature (1)..(214): Ceres CLONE ID no. 1021031
  misc_feature (1)..(214): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTVELDGKRIKLQIWDTAGQERFRTITTAYYRGAMGILLVYDVTDEASFNNIRNWIKNIEQHASDNVSKILVGNKADMDESKRAVPTSKGQALADEYGIQFFEASAKTNMNVEQVFFSIARDIKQRLSEADSKAEGGTIKINTEGDASAAAGQKSACCGS

SEQ ID NO: 1040 - protein, 216 aa, Oryza sativa
  misc_feature (1)..(216): Public GI no. 50931689
  misc_feature (1)..(216): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEQVFFSIARDIKQRLAETDSKPEDKTIKINNKTDQGADKPAASGSACCGS

SEQ ID NO: 1041 - protein, 214 aa, Zea mays
  misc_feature (1)..(214): Ceres CLONE ID no. 239853
  misc_feature (1)..(214): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTVELDGKRVKLQIWDTAGQERFRTITTAYYRGAMGILLVYDVTDESSFNNIRNWIRNIEQHASDNVNKILVGNKADMDESKRAVPTSRGQALADEYGIKFFETSAKTNLNVEQVFFSIARDIKQRLAESDSKPEDRTISINRPEGGEASASQKSACCGS

SEQ ID NO: 1042 - protein, 214 aa, Oryza sativa
  misc_feature (1)..(214): Public GI no. 46326983
  misc_feature (1)..(214): Functional Homolog of  Ceres CLONE ID no.  543118
  misc_feature (17)..(179): Pfam Name: Ras Pfam Description: Ras family
MAAPPARARADYDYLIKLLLIGDSGVGKSCLLLRFSDGSFTTSFITTIGIDFKIRTVELDGKRIKLQIWDTAGQERFRTITTAYYRGAMGILLVYDVTDESSFNNIRNWIRNIEQHASDNVNKILVGNKADMDESKRAVPPSKGQAFADEYGIKFFETSAKTNLNVEQVFFFIARDIKQRLSETDSKPEGRTIKIKSEGEAEAAAAQKSACCGS

SEQ ID NO: 1043 - protein, 216 aa, Arabidopsis thaliana
  misc_feature (1)..(216): Public GI no. 15810625
  misc_feature (1)..(216): Functional Homolog of  Ceres CLONE ID no.  543118
  misc_feature (17)..(179): Pfam Name: Ras Pfam Description: Ras family
MAVAPARARSDYDYLIKLLLIGDSGVGKSCLLLRFSDDTFTTSFITTIGIDFKIRTVELDGKRIKLQIWDTAGQERFRTITTAYYRGAMGILLVYDVTDESSFNNIRNWMKNIEQHASDNVNKILVGNKADMDESKRAVPTAKGQALADEYGIKFFETSAKTNLNVENVFMSIAKDIKQRLTETDTKAEPQGIKITKQDTAASSSTAEKSACCSYV

SEQ ID NO: 1044 - protein, 216 aa, Arabidopsis thaliana
  misc_feature (1)..(216): Public GI no. 21592670
  misc_feature (1)..(216): Functional Homolog of  Ceres CLONE ID no.  543118
  misc_feature (17)..(179): Pfam Name: Ras Pfam Description: Ras family
MAVAPARARSDYDYLIKLLLIGDSGVGKSCLLLRFSDDTFTTSFITTIGIDFKIRTVELDGKRIKLQIWDTAGQERFRTITTAYYRGAMGILLVYDVTDESSFNNIRNWMKNIEQHASDNFNKILVGNKADMDESKRAVPTAKGQALADEYGIKFFETSAKTNLNVENVFMSIAKDIKQRLTETDTKAEPQGIKITKQDTAASSSTAEKSACCSYV

SEQ ID NO: 1045 - protein, 216 aa, Arabidopsis thaliana; identical to SEQ ID NO: 1044
  misc_feature (1)..(216): Ceres CLONE ID no. 3115
  misc_feature (1)..(216): Functional Homolog of  Ceres CLONE ID no.  543118
  misc_feature (17)..(179): Pfam Name: Ras Pfam Description: Ras family

SEQ ID NO: 1046 - protein, 218 aa, Arabidopsis thaliana
  misc_feature (1)..(218): Public GI no. 6681329
  misc_feature (1)..(218): Functional Homolog of  Ceres CLONE ID no.  543118
  misc_feature (17)..(179): Pfam Name: Ras Pfam Description: Ras family
MAVAPARARSDYDYLIKLLLIGDSGVGKSCLLLRFSDDTFTTSFITTIGIDFKIRTVELDGKRIKLQIWDTAGQERFRTITTAYYRGAMGILLVYDVTDESSFNNIRNWMKNIEQHASDSVNKILVGNKADMDESKRAVPTSKGQALADEYGIKFFETSAKTNQNVEQVFLSIAKDIKQRLTESDTKAEPQGIKITKQDANKASSSSTNEKSACCSYV

SEQ ID NO: 1047 - protein, 218 aa, Arabidopsis thaliana
  misc_feature (1)..(218): Ceres CLONE ID no. 10506
  misc_feature (1)..(218): Functional Homolog of  Ceres CLONE ID no.  543118
  misc_feature (17)..(179): Pfam Name: Ras Pfam Description: Ras family
  misc_feature (187)..(187): Xaa is any aa, unknown, or other
MAVAPARARSDYDYLIKLLLIGDSGVGKSCLLLRFSDDTFTTSFITTIGIDFKIRTVELDGKRIKLQIWDTAGQERFRTITTAYYRGAMGILLVYDVTDESSFNNIRNWMKNIEQHASDSVNKILVGNKADMDESKRAVPTSKGQALADEYGIKFFETSAKTNQNVEQVFLSIAKDIKQRLTESDTXAEPQGIKITKQDANKASSSSTNEKSACCSYV

SEQ ID NO: 1048 - protein, 217 aa, Volvox carteri
  misc_feature (1)..(217): Public GI no. 549809
  misc_feature (1)..(217): Functional Homolog of  Ceres CLONE ID no.  543118
  misc_feature (15)..(177): Pfam Name: Ras Pfam Description: Ras family
MARIPGRPDYDALIKLLLVGDSGVGKSCLLLRFTDDMFTSSFITTIGIDFKIKKVDVDGKLVKLQIWDTAGQERFRTITSAYYRGAQGIILVYDITDEASFNNVRNWMRNIEQHASDNVNKILVGNKLDLAEDKRVVSIARGQALADEFGFRFYETSAKDNVHVEEAFIAVAKDVLARMEGEHANQQLLQQQQLSAAQPVRLTSGSPSPAQGKSCCR

SEQ ID NO: 1049 - DNA, 1250 bp, Arabidopsis thaliana
  misc_feature (1)..(1250): Ceres CLONE ID no.  545182
  misc_feature (1)..(1250): GEMINI ID 552G4
attttgttacatgttagaccttaaatcatgtcttcctcgtgaaacctgaattagttcctataaaacaaatgccttagttgagaccaattgtcgttggtcccctaaaaggattgagatggcaacaagggttattgttgaggccttgaaaagaacagagtttaaatgggtttcaagacaagaagttagagatgctgctcgtgcatacattagtgacacaagtttggtagattttgtgttgaggtcactaggaaaccatgttgaaggaaactacttggttcgctgaagcttgaaccttgtgaccaaagtcttggaatattgtttagaggacatttctgatgtgtacccttataatgaaggcttggttatgagtaacaaagtgaaggacaagtataagatcacaagggctcaactaatgaaggacatgctttatttgtataagtacattcttatagattaaaaccaattatgaggtcagaatttctttcagctataccattggcagctaggataattcttggcactaagtattttattaaagattactttggagatattcctcaccaagttgaattaggctccgatgataaactcaacatttattgtacaatttggttgagaaacaatgttggcagtggttagtacttaaacaaggccattatgccaccccatgaatgtatcacattgaaaagaaatgctactatcaatgacttgaagctagaagttgaaagggattttagagaaatttgttgagagttaaggagttttatggtggaatcatttgggaatttgagtgtcaacaatgagacaatggcttttggtctaattgaagtgggtggaaaagttgtccttgagggttggcatggtgacatatgaataaacatgattgagcaaatatgtgaaagtgatatgaacaatggtataatggattgcacttgtggaactatagaagatgatggtgagaggatggtctcgtgtgatatttgtgaaatttggcaacatactaggtgtgtttgaattcccaatgatgaagaaattcctcatatttttttaatgcaaaaagtgtgagcaagaaattgtcttgtttccttcattgccatagttatacaattataatttttttgatgatgcttaatcattcactttttgtttaaaggacgcctttgagattgaacaattaaaattgctttttagctacattgaattcatgtaaatttaatctaacatgtaagtaataaaaatatttctatttc

SEQ ID NO: 1050 - protein, 57 aa, Arabidopsis thaliana
  misc_feature (1)..(57): Ceres CLONE ID no.  545182
  misc_feature (1)..(57): GEMINI ID 552G4
MRSEFLSAIPLAARIILGTKYFIKDYFGDIPHQVELGSDDKLNIYCTIWLRNNVGSG

SEQ ID NO: 1051 - DNA, 1270 bp, Arabidopsis thaliana
  misc_feature (1)..(1270): Ceres CLONE ID no.  557009
  misc_feature (1)..(1270): GEMINI ID 540H7
ggagtacacagtcaataacggtcacatgcgctttgctacttctctaaacgtgaaaacatttacaccaacctacactccttgctcctacatatcccgcgccttacatgcagttccaagtatcaccaaaccaagcagtgtgatactcatactcagtactcacagcaccactttcaagtgttcaaagttcaactatcccaatatcaacgaaccatggatacttgcaagaagtcccctttgaagccatggaagaaagggccaacaagggggaaaggcgggccccagaacgcctcctgcgagtaccgaggcgttcggcagcgaacttggggcaaatgggttgctgagataagagagccaaagaagagaaccaggctctggcttggttcttttgccacagctgaagaagctgccatggcttatgatgaggctgctaggagactctatggtccagatgcataccttaatctcccccacctgcaacccaggtccacttcaactatcacgtcaggaaagttcaaatggttcccttccaagaacttcatttcaatgtttccttcctgtggattactcaatgtaaatgctcaacctagtgttcatttaatccatcagaggctgcaagagcttaagcgaaattcagttgtgagtcaatcctcatctagttcatccaatgatccaaaggcagaaattcagaatgtagacagcaaaaatcacggagaagatgaaaatcctccaaaagatgttcaaacatcatcagaggaggtgcttggagatcttcaggagaaaccccagatagacctccatgagtttcttcaacagatgggaatacttaaagaagaaagacagtcagaaagaactgatagctcaggaagttcaacagtgcgtgaagctgtgttgacagatgactgtgatcatttgggagtgttttctgacaagagtgttaactgggaggcattgattgagatgcatggacttgcaggtattcaggaatcagaagtcactcagcttgaagcatatgagccaaatgatgatctaactttctcaacttccatttggaacttttaagaaacttagcatataagcctaagcaatagatcacaaggttttggttatccaactactctagtcctgtatatgtctgcagcatttcaatctgtcggcagcactgtaagagtaagaaagtagctagaatagaagactactagtgagaaaggagcttatttcagtagttgtgacagcaaatggagaaaataatatcagtctgcgtattattagc

SEQ ID NO: 1052 - protein, 282 aa, Arabidopsis thaliana
  misc_feature (1)..(282): Ceres CLONE ID no.  557009
  misc_feature (1)..(282): GEMINI ID 540H7
  misc_feature (28)..(79): Pfam Name: AP2 Pfam Description: AP2 domain
MDTCKKSPLKPWKKGPTRGKGGPQNASCEYRGVRQRTWGKWVAEIREPKKRTRLWLGSFATAEEAAMAYDEAARRLYGPDAYLNLPHLQPRSTSTITSGKFKWFPSKNFISMFPSCGLLNVNAQPSVHLIHQRLQELKRNSVVSQSSSSSSNDPKAEIQNVDSKNHGEDENPPKDVQTSSEEVLGDLQEKPQIDLHEFLQQMGILKEERQSERTDSSGSSTVREAVLTDDCDHLGVFSDKSVNWEALIEMHGLAGIQESEVTQLEAYEPNDDLTFSTSIWNF

SEQ ID NO: 1053 - protein, 288 aa, Medicago truncatula
  misc_feature (1)..(288): Public GI no. 92897616
  misc_feature (1)..(288): Functional Homolog of  Ceres CLONE ID no.  557009
  misc_feature (28)..(79): Pfam Name: AP2 Pfam Description: AP2 domain
MDNSKKSPLKPWKKGPTRGKGGPQNASCEYRGVRQRTWGKWVAEIREPKKRTRLWLGSFATAEEAAMAYDEAARRLYGPDAYLNLPHMQTHSNSTMKTGKFKWLPSKNFISMFPSCGLLNVNAQPSVHLIHQRLQEFKQNAVVASQSSFSSSSNDPKAEEIQKVDSKKSHTEDPLPKETIVQTSANKMLGDLQEEKPQIDLNEFLQQMGILKEGSHSEQTESSGSSTVHEVLPRDDNDQLGIFSDMSVNWEALIEMHEFAGIEESEATHLEAYDPNDHLNFSTSIWDF

SEQ ID NO: 1054 - DNA, 861 bp, Populus balsamifera subsp. trichocarpa
  misc_feature (1)..(861): Ceres ANNOT ID no. 1474923
atggaaaattgcagaaggtctccattgaagccgtggaagaaaggtccaacaagaggcaaaggcggtcctcaaaatgccatgtgtgagtaccgaggggttcgtcaaagaacatggggcaaatgggtggcagaaataagagaacccaagaagagaaccagactgtggttgggttcttttgccactgctgaagaagctgctatggcctatgatgaggctgcaagaagattgtatggaccggatgcttatcttaatctacctcaccttcagtctaactttaatcctctaaacaaatcacagaagctcaaatggattccttccaagaacttcatttccatgttcccttcttgtgggctgcttaatatacatgcacagcctagcgttcatgtcatccatcagcggctcgaagaactcaagaataacaggccccttcatcaatcctctgtcgcttctagttcttcctcctctgaatccagaaatgaagtgatgattgtaagtgacgaaaaccatgtagcaaatctcgccgtagcagagaaagatgtggaaatatcatcagagaagatgctgctaagaaatcatgacgagaaaccacagattgatctgaacgagttccttcagcagctgggcatactgaaagaagagaaacagccagatagcaatgatgtcgaagaatgtctcacggtgccagaatcttcacaaaaatatgaaaacgaacttgcagcattggcagacaagagtttcaattgggattcactgattgaaatgcatggaattacagatcatcaagcagcagaattaaatagttttccagtttatgacgtccaagatgagccggctttcccaacttccatttggaacttctag

SEQ ID NO: 1055 - protein, 286 aa, Populus balsamifera subsp. trichocarpa
  misc_feature (1)..(286): Ceres ANNOT ID no. 1474923
  misc_feature (1)..(286): Functional Homolog of  Ceres CLONE ID no.  557009
  misc_feature (28)..(79): Pfam Name: AP2 Pfam Description: AP2 domain
MENCRRSPLKPWKKGPTRGKGGPQNAMCEYRGVRQRTWGKWVAEIREPKKRTRLWLGSFATAEEAAMAYDEAARRLYGPDAYLNLPHLQSNFNPLNKSQKLKWIPSKNFISMFPSCGLLNIHAQPSVHVIHQRLEELKNNRPLHQSSVASSSSSSESRNEVMIVSDENHVANLAVAEKDVEISSEKMLLRNHDEKPQIDLNEFLQQLGILKEEKQPDSNDVEECLTVPESSQKYENELAALADKSFNWDSLIEMHGITDHQAAELNSFPVYDVQDEPAFPTSIWNF

SEQ ID NO: 1056 - protein, 277 aa, Arabidopsis thaliana
  misc_feature (1)..(277): Public GI no. 21592849
  misc_feature (1)..(277): Functional Homolog of  Ceres CLONE ID no.  557009
  misc_feature (26)..(77): Pfam Name: AP2 Pfam Description: AP2 domain
MEKSSSMKQWKKGPARGKGGPQNALCQYRGVRQRTWGKWVAEIREPKKRARLWLGSFATAEEAAMAYDEAALKLYGHDAYLNLPHLQRNTRPSLSNSQRFKWVPSRKFISMFPSCGMLNVNAQPSVHIIQQRLEELKKTGLLSQSYSSSSSSTESKTNTSFLDEKTSKGETDNMFEGGDQKKPEIDLTEFLQQLGILKDENEAEPSEVAECHSPPPWNEQEETGSPFRTENFSWDTLIEMPRSETTTMQFDSSNFGSYDFEDDVSFPSIWDYYGSLD

SEQ ID NO: 1057 - DNA, 1377 bp, Arabidopsis thaliana
  misc_feature (1)..(1377): Ceres CLONE ID no.  558003
  misc_feature (1)..(1377): GEMINI ID 540B5
gttttggctttgcttctttcttttctcaaagtacctgctcctccattgccattacccggtttctataatcacaataacaatcacaaatacttgttctgcaacccactctgaattccgaacaagagaaaaaaaaaagtgatcactctcctttggcctttcctctcgtaccttaaaccaaaacaaacaatatatacattgtagaaaacaacgaagggacatgtcttcttccacacaggacgaaatctcctttgtcctgcgtcagtttcttcttcgttcctctgtcacaacccacgagagtaacgacgacgcacgcaattccatgtccaaaactgctctaccagatgggatctcagcctacaagggttcttctgctgccaacgtgtcttctctgtcggtggcagcgagtgagaatgaaactgatgacttcgactgcgagagtgaggaagaagaggttccaactccaccaaagtcgattcgttctaggagttcctccaaaaggaacagagttgcggaagttcataacctctctgaaaagcggaggaggagtaggatcaatgagaaattgaaggctttgcaaaatcttattccaaattctaacaagactgataaggcttcaatgcttgatgaagctattgaatatcttaaacagcttcatctcaaagtacagatgctgtcaatgagaaatgggttgagtttgcatactatgttctttcaagaaggtttgcaacctctgcaattgtctcaggtgccgagaatggattcaggtgaagaaagcagacttatcccttcaaacccaacagcttctctgcctatgcaccaagaaaaccccatgcactatttgtccaatctacctaacaaactcgccatggcagatcagcaatccgtgccaactccatcatatataatcaactcagaaacttctttcaggctggaatctcctattccagaaaatataagatcatttcaactccgaagatttcccgagatgtgcagggaagacatattgcagcaccagcatttaaatgcaaaccattaagataccaatccattaggcacattggctacatcatcactttcctttgatatgcaaacatctgcagttaaggacaacagcactttggaaaatggcatcattggaagtgatcaatcaaaagtgataccaagaaatagtgagcccaacattgttctgaccccgcggttaagtggaatgttatgagctagaacaacaatgtttgatgtatatctcaatgtctcaaattttgttggtatgagatttttgtaagactacacataggggcaaagcgcttgcaatggtaacaagacattggagtttgtcaggtttgataccaatgcctaaggattttgggtttccttgtt

SEQ ID NO: 1058 - protein, 272 aa, Arabidopsis thaliana
  misc_feature (1)..(272): Ceres CLONE ID no.  558003
  misc_feature (1)..(272): GEMINI ID 540B5
  misc_feature (97)..(146): Pfam Name: HLH Pfam Description: Helix-loop-helix DNA-binding domain
MSSSTQDEISFVLRQFLLRSSVTTHESNDDARNSMSKTALPDGISAYKGSSAANVSSLSVAASENETDDFDCESEEEEVPTPPKSIRSRSSSKRNRVAEVHNLSEKRRRSRINEKLKALQNLIPNSNKTDKASMLDEAIEYLKQLHLKVQMLSMRNGLSLHTMFFQEGLQPLQLSQVPRMDSGEESRLIPSNPTASLPMHQENPMHYLSNLPNKLAMADQQSVPTPSYIINSETSFRLESPIPENIRSFQLRRFPEMCREDILQHQHLNANH

SEQ ID NO: 1059 - DNA, 1445 bp, Arabidopsis thaliana
  misc_feature (1)..(1445): Ceres CLONE ID no.  560765
  misc_feature (1)..(1445): GEMINI ID 537H3
cttatcataatttctttttctctataattgttttctagcaccaggtgtctctccatcatttttctaaaattttagatggccaacgcaaatagtactgtagttcccaatccattatatttcaataataaccccattaattaattatttactgaattaatgtgagctcagtgcaacacaacacaacaccaccaatctataaacttgcttggcgttgaacttccttattatccaaaccatgtccaattcaaactccaatccgacccgaatacttcactctcagtcccaggatccgaatactaccaccgcggatcctcatgttctgcttcagaacctttccctggttcggaccagaatggattctctacaacacttcctatctcaatccatcaacaccaacactcccctcgccgtcgatcaaatcgccatggtctccagccagatcgtctcctccatccatcaattgatcgtcaacggctcagctctcgtctcttactctcaaaattccaccgccgcctccggagcaccggatccaccgttgtatccgaagaagccggagccggaaccttcagtcgccgataaagcgaagcaaatactcgattccaaatttgggcctctcgaagacgacgacgacgacgacggcggcgccgaagacttcgacgacggtagcggaatcgtggagctcgacgccatagaaatcctcgccgagcacatgcacttctgcgagatctgcgcgaaaggcttccggcgcgactcgaacctccgcatgcacatgcgcgcgcacggagaacagttcaagacggtggaggcgctggcgaagccttcggagaccactgcgcagcggcgcgcgacgcggttttcgtgtccgttcgaaggctgcaaccggaacaagctccaccggcggtttcggccgctgaaatcggtgatttgcgtgaagaaccacttcaagcggagccactgcccgaagatgtacacgtgcgarccggtgccgcaagaagcacttctcggttctctcggatttgaggagccacgcgaagcactgcggaggagaggccaggtggaagtgcacgtgcgggaccacgttctcgagaaaggacaaattgtttggtcacattgcgctgtttgatggccacgcgcctgctctcgcgtgtgacgaagagggtaaagggaaacaagtggtggaggatgacgaagatccgatgttgatgaatgaaagtgaatttgaatcggataattgccttttgaatcaagaattgccggaagggttctttgatgattttgggtccattgatgactactgtttaaaggaagtgttaggttttcctagtaattgactttgcatatctatttttaggaaatactgtattcatattatattctattgctagatttgtatttatgtctttatgttgttgagggattaaaattaaacagtgtttataggatgg

SEQ ID NO: 1060 - protein, 295 aa, Arabidopsis thaliana
  misc_feature (1)..(295): Ceres CLONE ID no.  560765
  misc_feature (160)..(182): Pfam Name: zf-C2H2 Pfam Description: Zinc finger, C2H2 type
  misc_feature (1)..(295): GEMINI ID 537H3
  misc_feature (248)..(248): Xaa is any aa, unknown, or other
MSNSNSNPTRILHSQSQDPNTTTADPHVLLQNLSLVRTRMDSLQHFLSQSINTNTPLAVDQIAMVSSQIVSSIHQLIVNGSALVSYSQNSTAASGAPDPPLYPKKPEPEPSVADKAKQILDSKFGPLEDDDDDDGGAEDFDDGSGIVELDAIEILAEHMHFCEICAKGFRRDSNLRMHMRAHGEQFKTVEALAKPSETTAQRRATRFSCPFEGCNRNKLHRRFRPLKSVICVKNHFKRSHCPKMYTCXPVPQEALLGSLGFEEPREALRRRGQVEVHVRDHVLEKGQIVWSHCAV

SEQ ID NO: 1061 - DNA, 1033 bp, Arabidopsis thaliana
  misc_feature (1)..(1033): Ceres CLONE ID no.  560961
  misc_feature (1)..(1033): GEMINI ID 552A8
atgggaccccaaacctaaacgaggaaaaaaaaaatatggaaaagaaacaagattaagaattggggtttgaagaagccggtggtgtctccttgcttgttctcgatcgatcttgttattgtaaaatataataacttttttatatcgtgatcaagatgcgccgagggagagccaccgccgccgtcgtggatccgacggcggagcaggcgaaggagacgcggttccgcggcgtcaggaagcggccgtgggggcgattcgcggcggagattcgagatccgtggaagaagcagcgcgtgtggctggggacgttcgattccgccgaggatgccgcgcgggcttacgacaaggctgcccgatccttccgcgggcccaaggccaagaccaatttcccctccttccccggcccgacggaccaccactcctcgcagcagattccgccgctctaccggcccacgggctttccaccaagttcgagcccgcccaggtgaaccggcccaccaccagcggcatgagcagcaccgtggagtccttcagcgggcctagggttcccccctcctcctcctcctctcgcaagccccttgtggttgttaaccctatcatccctctcgacgacgacgacgacgattgccacagcgattgcgactcttcttcctccgtcgtcgacgaccaggactgcgtcctcacctcctccttccggcaaccgcttcccttcgatctaaacctcccgccgcccgatgccgcctacgacgacgacgacgacgacgacgtccccgccaccgcgctgtgcctctgatgaagaagagcctcttctcggtataatcataattttcttgttgttgttgttgttgttgttgttgactatctctggtttaattaattgaagttgttagattgtgttgtggtgttgtagagtaatattataatataggcatggagatggatggatggatggaaggttgtgttgttgtaagttatttggatccatagcattggacctcatctggaaaactggttgctgcttctgctttcttcatgg

SEQ ID NO: 1062 - protein, 110 aa, Arabidopsis thaliana
  misc_feature (1)..(110): Ceres CLONE ID no.  560961
  misc_feature (1)..(110): GEMINI ID 552A8
  misc_feature (21)..(72): Pfam Name: AP2 Pfam Description: AP2 domain
MRRGRATAAVVDPTAEQAKETRFRGVRKRPWGRFAAEIRDPWKKQRVWLGTFDSAEDAARAYDKAARSFRGPKAKTNFPSFPGPTDHHSSQQIPPLYRPTGFPPSSSPPR

SEQ ID NO: 1063 - DNA, 961 bp, Arabidopsis thaliana
  misc_feature (1)..(961): Ceres CLONE ID no.  6042
  misc_feature (1)..(961): GEMINI ID 107E8
  misc_feature (1)..(961): GEMINI ID 531B4
attcacaccggacattttgaaatctcaacaagaaccaaaccaaacaacaaaaaaacattcttaataattctctttctgttatgtcgatgacggcggattctcaatctgattatgcttttcttgagtccatacgacgacacttactaggagaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagacccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataaggggttgacggtgaagtgcgaggttgttgaagtggcacgtggcgactgtttattggttttataattttgatttttctttgttggatgattatatgattcttcaaaaaagaagaacgttaataaaaaaattcgtttatt

SEQ ID NO: 1064 - protein, 268 aa, Arabidopsis thaliana
  misc_feature (1)..(268): Ceres CLONE ID no.  6042
  misc_feature (1)..(268): GEMINI ID 107E8
  misc_feature (1)..(268): GEMINI ID 531B4
  misc_feature (146)..(198): Pfam Name: AP2 Pfam Description: AP2 domain
MSMTADSQSDYAFLESIRRHLLGESEPILSESTASSVTQSCVTGQSIKPVYGRNPSFSKLYPCFTESWGDLPLKENDSEDMLVYGILNDAFHGGWEPSSSSSDEDRSSFPSVKIETPESFAAVDSVPVKKEKTSPVSAAVTAAKGKHYRGVRQRPWGKFAAEIRDPAKNGARVWLGTFETAEDAALAYDRAAFRMRGSRALLNFPLRVNSGEPDPVRIKSKRSSFSSSNENGAPKKRRTVAAGGGMDKGLTVKCEVVEVARGDCLLVL

SEQ ID NO: 1065 - protein, 282 aa, Mesembryanthemum crystallinum
  misc_feature (1)..(282): Public GI no. 32401273
  misc_feature (1)..(282): Functional Homolog of  Ceres CLONE ID no.  6042
  misc_feature (136)..(188): Pfam Name: AP2 Pfam Description: AP2 domain
MSLIANFESDFAVLESIRRHLLEDWDPRAGAPAITTGSGPVYHRNSSFSSLYPCLTDNWGELPLKEDDSEDMVLFGVLRDAVHTGWSPQSGSESGSGSPAPVTVKPEPVDSPVSSPAPVRVAGGEAPVAAAPARGKHYRGVRRRPWGKFAAEIRDPAKNGARVWLGTFETAEDAALAYDRAAFRMRGSKALLNFPLRVNSGEPDPVRITSKRSSPERSVSSSSSESASPKRRKKEEVVVGPVAGQARPGLQQVGNVVEGMQVGVGCQVGVGTMPLGDQLLVT

SEQ ID NO: 1066 - protein, 244 aa, Lycopersicon esculentum
  misc_feature (1)..(244): Public GI no. 28274828
  misc_feature (1)..(244): Functional Homolog of  Ceres CLONE ID no.  6042
  misc_feature (105)..(157): Pfam Name: AP2 Pfam Description: AP2 domain
MYQLPTSTELTFFPAEFPVYCRSSSFSSLMPCLTESWGDLPLKVNDSEDMVIYGFLQDAFSIGWTPSNLTSEEVKLEPREEIEPAMSTSVSPPTVAPAALQPKGRHYRGVRQRPWGKFAAEIRDPAKNGARVWLGTYESAEEAALAYGKAAFRMRGTKALLNFPHRIGLNEPEPVRVTVKRRLSESASSSVSSASESGSPKRRRKGVAAKQAELEVESRGPNVMKVGCQMFQLASSYWLVKIWS

SEQ ID NO: 1067 - DNA, 1741 bp, Gossypium hirsutum
  misc_feature (1)..(1741): Ceres CLONE ID no.1926437
aaaagattcagactcctaacttctcacatttcttctcttttattctttaattcattcatttttttcctaaaaaaaaacaaaacaaaaccaaccccaaattcctcaatcaattactcaagatttaacaggtttcgttatggagatgcatccgagtagcaacgagaccgatttagcaatgttggactcaattcggcgacacttactcggggagtcatcagacttccgattcgatgcttccgttgattgtaccactaccacggctccccccgtgttttgcagaagctcaagcttcaaccgcttgtacccatgtttggctgaaacctggggtgaccttcctcttaaagaaaacgattctgaagatatgctcgtttttgagttcctccgagatgctttaaccgtaggctgggcgccctccgataactcttctatcaaatatacgccgattaaaccggagccgcaggagattttagttgaggctccagctgcgaatacggttgttcccgcggtggttccgaccaaagcgaggcattacagaggagttaggcaaaggccgtgggggaagttcgcagctgagataagggacccggctaaaaatggggctcgggtttggttaggtacttttgaaacagctgaggatgcggctttggcttatgataaagcagcttataggatgcgcgggtccaaggctttgttgaatttcccattgagggtgaattccggggagcctgacccagtgagggtaacgtcaaagagagcatcacccgagccgtccaatttttcatcatccggctcagagcaggggttaccgaaaaggaggagaaaggtggctccctcagctccggttgtgggtgaagcctggttagatatgagttcagcagctgcagttgagtatgaaattggatcacgtactaacagcaatcaactattaatcagctaatggattaatgaaagaagcagggaaaatgagggtctgaaatatttgtaaacttgtgttggctttgtgcatacaaagaaattgatattatttcatggttgtttcgctaaatgagaaaattttattctttaataaaaaatgatgtaagcaatatggttgaaaatggacattccaatgcagcaagatactgtaaaaacctagttttgatgtaggaagaagcatacaatcaaaatgtagatgtaggcgttggtatctcagccatttgaagatgacaaatccagaccagcttggcgttaggcctataataaaaggtagctgctcttctttctaacatgtgtttattttaccaatattctagaacatatggcgtcaagctgaaggaacaaggacgcacgtacacgaacgttgcgcggttagaaaaggacagttgacttttgggcaaagatggaatagctttatcctctatccaaacactaattgcttttttgaccttatacattcaaactgtttgacttttcagacttttcttccgacttctaaccaccaggattctttgttcacaatgagaaaaatgttttcacattgagtttggaaaggagatatgtttgagagtataggtgggtgggaatttgattggttgttgttttctattgattttctacaactacataattcatttggatttcataaaataacttctcgacgtcacccgctcgcttatgggaaaggaatcctcctacatgggatttcatttagatcaaatttgatcaaagctcaaatcaacatctacatgtcgaagcaaaaaac

SEQ ID NO: 1068 - protein, 266 aa, Gossypium hirsutum
  misc_feature (1)..(266): Ceres CLONE ID no. 1926437
  misc_feature (1)..(266): Functional Homolog of  Ceres CLONE ID no.  6042
  misc_feature (130)..(182): Pfam Name: AP2 Pfam Description: AP2 domain
MEMHPSSNETDLAMLDSIRRHLLGESSDFRFDASVDCTTTTAPPVFCRSSSFNRLYPCLAETWGDLPLKENDSEDMLVFEFLRDALTVGWAPSDNSSIKYTPIKPEPQEILVEAPAANTVVPAVVPTKARHYRGVRQRPWGKFAAEIRDPAKNGARVWLGTFETAEDAALAYDKAAYRMRGSKALLNFPLRVNSGEPDPVRVTSKRASPEPSNFSSSGSEQGLPKRRRKVAPSAPVVGEAWLDMSSAAAVEYEIGSRTNSNQLLIS

SEQ ID NO: 1069 - protein, 268 aa, Arabidopsis thaliana
  misc_feature (1)..(268): Public GI no. 92878372
  misc_feature (1)..(268): Functional Homolog of  Ceres CLONE ID no.  6042
  misc_feature (143)..(195): Pfam Name: AP2 Pfam Description: AP2 domain
MYGNSNFDSDLALLDSIRRHLLGESEFIFGAPTNVSGNTRVFSRSSSFSSLYPCLSDNWGELPLKEDDSEDMVLYGVLRDAVNVGWVPSLEVGSPESVSSVFPLEMTVKPEPDVMPVENVLPVASTAEQVVPEGPKAAPVKGKHYRGVRQRPWGKFAAEIRDPAKNGARVWLGTFETAEDAALAYDRAAYRMRGSRALLNFPLRVNSGEPDPVRIASKRSSPERSSSSESNSPAKRKKVMTAQSGLKTGQVGSQVAQQCTRGGQLLVS

SEQ ID NO: 1070 - DNA, 843 bp, Populus balsamifera subsp. trichocarpa
  misc_feature (1)..(843): Ceres ANNOT ID no. 1446840
atgtacgggcagagcttacttgatcagcccgattatgcctttcttgatcccgttcgcttgcatttgcaaggcgaaactgtttctactgctcccaccactacttgcagctacactccagcaattacaacgacgacggctgctccagctgctaattatactccaccccttgtttattgcaggagcacaagcttcagcagcttgtatccttgcttaacagaaaactggggagacttgccactcaaggtcgacgattccgaggatatgttcctttatgctgtcctccgcgacgccgtcaccgttgggtgggtcccatcactcaaaaccgatcaactggtgcagcccaatttcccactagtgaaattggaacccacagagaatctggctgtctcgccgccctccacggcggttccagtggctgagcctgcggtgcttccgtccaaggggaagcattaccggggtgtgaggcagcggccttgggggaagttcgcagcggagattagggacccagcgaagaacggggcccgggtttggctggggacgttcgagacggcggaggatgcggcgttggcttacgaccgtgctgcctatagaatgcgtgggtcgagggcgttgttgaatttcccgttgagggtgaattccggtgagcctgatccggttagagtgacttcgaagaggtcttctccggagccatcatcgtcggtggacagcgggtcaccgaagaggaggaagaaggttggtggcacggcgggtgctgctacagtggtggctaaagctgggttggaaattgggaatggggttggatgtcaagtgggtacccatggcgagcaaatgttggttatctag

SEQ ID NO: 1071 - protein, 280 aa, Populus balsamifera subsp. trichocarpa
  misc_feature (1)..(280): Ceres ANNOT ID no. 1446840
  misc_feature (1)..(280): Functional Homolog of  Ceres CLONE ID no.  6042
  misc_feature (149)..(201): Pfam Name: AP2 Pfam Description: AP2 domain
MYGQSLLDQPDYAFLDPVRLHLQGETVSTAPTTTCSYTPAITTTTAAPAANYTPPLVYCRSTSFSSLYPCLTENWGDLPLKVDDSEDMFLYAVLRDAVTVGWVPSLKTDQLVQPNFPLVKLEPTENLAVSPPSTAVPVAEPAVLPSKGKHYRGVRQRPWGKFAAEIRDPAKNGARVWLGTFETAEDAALAYDRAAYRMRGSRALLNFPLRVNSGEPDPVRVTSKRSSPEPSSSVDSGSPKRRKKVGGTAGAATVVAKAGLEIGNGVGCQVGTHGEQMLVI

SEQ ID NO: 1072 - protein, 255 aa, Glycine max
  misc_feature (1)..(255): Ceres CLONE ID no. 582684
  misc_feature (1)..(255): Functional Homolog of  Ceres CLONE ID no.  6042
  misc_feature (136)..(188): Pfam Name: AP2 Pfam Description: AP2 domain
MYGQSSSSSSSYESDLALLDSIRHHLLGESESIFGAPNFGSGRSSSFSSLDSCLSDNWGELPFKEDDTEDMVLYGVLRDAVNVGWVPSLDAGSPESVSSGFPAVKLEPDLMPALISPCPPPAAAAEEKKVVPAKGKHYRGVRQRPWGKFAAEIRDPAKNGARVWLGTFETAEDAALAYDRAAYRMRGSRALLNFPLRVNSGEPDPVRVKSKRSSSPESAAALPAKRKKVVVVGTVQEQVGSQVAECTRGEQLLVS

SEQ ID NO: 1073 - protein, 233 aa, Nicotiana tabacum
  misc_feature (1)..(233): Public GI no. 1208498
  misc_feature (1)..(233): Functional Homolog of  Ceres CLONE ID no.  6042
  misc_feature (97)..(149): Pfam Name: AP2 Pfam Description: AP2 domain
MYQPISTELPPTSFSSLMPCLTDTWGDLPLKVDDSEDMVIYGLLSDALTAGWTPFNLTSTEIKAEPREEIEPATIPVPSVAPPAETTTAQAVVPKGRHYRGVRQRPWGKFAAEIRDPAKNGARVWLGTYETAEEAALAYDKAAYRMRGSKALLNFPHRIGLNEPEPVRLTAKRRSPEPASSSISSALENGSPKRRRKAVAAKKAELEVQSRSNAMQVGCQMEQFPVGEQLLVS

SEQ ID NO: 1074 - protein, 237 aa, Nicotiana sylvestris
  misc_feature (1)..(237): Public GI no. 8809571
  misc_feature (1)..(237): Functional Homolog of  Ceres CLONE ID no.  6042
  misc_feature (101)..(153): Pfam Name: AP2 Pfam Description: AP2 domain
MYQPISTEFPVYHRTSSFSSLMPCLTDTWGDLPLKVDDSEDMVIYGLLSDALTTGWTPFNLTSTEIKAEPREEIEPATSPVPSVAPPAETTTAQAVVPKGRHYRGVRQRPWGKFAAEIRDPAKNGARVWLGTYETAEEAALAYDKAAYRMRGSKALLNFPHRIGLNEPEPVRLTVKRRSPEPASSSISPASENSLPKRRRKAVAAKQAELEVQSRSNVMQVGCQMEQFPVGEQLLVS

SEQ ID NO: 1075 - protein, 275 aa, Zea mays
  misc_feature (1)..(275): Ceres CLONE ID no. 1443683
  misc_feature (1)..(275): Functional Homolog of  Ceres CLONE ID no.  6042
  misc_feature (133)..(185): Pfam Name: AP2 Pfam Description: AP2 domain
MLLNPASEASVLVTIRQHLLEEPAAAEARPADESFGSLVADQWSGSLPFRTDDADDMVVFGALQDAFAYGWLPDGSFVHVKPEPVRSPDSSSYPCSYDGSSCFGLLDPEPLTPGTTTPGRGQEEAAAAMARGKHYRGVRQRPWGKFAAEIRDPARNGARVWLGTYDTAEDAALAYHRAAYRMRGSRALLNFPLRIGSGDKRPSPAPPEPATSSDSSSSWASGSHKRRKRGEAAAANMAMALVPPPSQLNRPAQPWFPAAPVEQAAMAPRVEQLVV

SEQ ID NO: 1076 - protein, 303 aa, Oryza sativa
  misc_feature (1)..(303): Public GI no. 50911399
  misc_feature (1)..(303): Functional Homolog of  Ceres CLONE ID no.  6042
  misc_feature (147)..(199): Pfam Name: AP2 Pfam Description: AP2 domain
MLLNPASREVAALDSIRHHLLEEEEETPATAPAPTRRPVYCRSSSFGSLVADQWSESLPFRPNDAEDMVVYGALRDAFSSGWLPDGSFAAVKPESQDSYDGSSIGSFLASSSSEAGTPGEVTSTEATVTPGIREGEGEAVAVASRGKHYRGVRQRPWGKFAAEIRDPAKNGARVWLGTFDSAEEAAVAYDRAAYRMRGSRALLNFPLRIGSEIAAAAAAAAAGNKRPYPDPASSGSSSPSSSSSSSSSSSSGSPKRRKRGEAAAASMAMALVPPPPPPAQAPVQLALPAQPWFAAGPIQQLVS

SEQ ID NO: 1077 - DNA, 1618 bp, Panicum virgatum
  misc_feature (1)..(1618): Ceres CLONE ID no.1809375
gccgttcaactcgatcactccacacccagacccacccagctcacttgggtcgcgtcagctcataaaccaaacagagagacctcgtcgccaggggccaccagcccggagcagccagagagagcagcagagggggccaaatcaggaaggcgcgatgatgctggacgccatccgggagcacctgctggaggagccgtcggaggcgctggtgctggacaccatccggcagcacctcctggaggagccggcggaggcgcggccggcgtaccggcggagcgagagcttcgggagcctcgtggcggaccagtggagcggctcgctgccgttccgcaccgacgacgccgacgacatggtcgtgttcggggcgctgcgggacgcgttcgcctacggctggctccccgacggcgccttcgcgcgggtcaagcccgagccgctcccgtccccgggctcctccgactactcctacgacggcctcggcctcctgtacccggacccggagccgatgacgccgagcagcgacgccgcgacgcccaagacggaggaggccgcggcgggcgtggcgaggggcaagcactaccgcggggtgcggcagcgcccctggggcaagttcgcggcggagatcagggaccccgccaagaacggcgcgcgcgtgtggctcggcacctacgacaccgccgaggacgccgcgctcgcctacgaccgcgcggcctaccgcatgcgcggctcccgcgcgctcctcaacttcccgctccgcatcggctcggagatcgcggccgccacagccgccgccgcagccgcccccggggacaagaggccgtcgcccgagcccgcgacgtcatcggactcgtccttctccacgtcctcctcgtcctcttgctcgacgagcggctcgacgaagcggcggaagcgaggcgaggccgcggccgcgacgatggccatggccctggtgcccccgccttcccagctcaaccggccggcccagccatggttccccgctgcggcggccgagccggcggccatggcgccgcgcgtcgagcagctggtcatctgaggcgccgaccggaccaccagctcatgccgtccaccgggcgcgcggccaaggcaatgaggcgtgccacaacggactcaccctcaccggcagaggcgcggcgccggaattggacgaggctcctggcgtcgcacctgcacggtgccgcgcgactggcgacgcgaatgcgacggcggggggcgggacgcgcgcatcccggtgaaagctcccccggatggaacgcgataagatcgggagcaacttggcggggcaattcgcagctctggatggtgctgctgcgccgggcgactcgcccaagtgaaagaagctgtgtgtaatcaagtgtcgtcgtgtctagttgtctgcgaattttgggcccccaaggttctgccgttcagtgtttgcatcattgtcagagtgcttgtgcttctgataagtgataagattttcaaaaaatgtacaaaagtagtagggagacgatgagatttggaacaatccgctttgttctttgtcaacccccaatgggtgcggcatcgtctgataataaataaataaatacgaatatcacactgccaaaaaaaaaaaaaaaaaaaa

SEQ ID NO: 1078 - protein, 297 aa, Panicum virgatum
  misc_feature (1)..(297): Ceres CLONE ID no. 1809375
  misc_feature (1)..(297): Functional Homolog of  Ceres CLONE ID no.  6042
  misc_feature (138)..(190): Pfam Name: AP2 Pfam Description: AP2 domain
MLDAIREHLLEEPSEALVLDTIRQHLLEEPAEARPAYRRSESFGSLVADQWSGSLPFRTDDADDMVVFGALRDAFAYGWLPDGAFARVKPEPLPSPGSSDYSYDGLGLLYPDPEPMTPSSDAATPKTEEAAAGVARGKHYRGVRQRPWGKFAAEIRDPAKNGARVWLGTYDTAEDAALAYDRAAYRMRGSRALLNFPLRIGSEIAAATAAAAAAPGDKRPSPEPATSSDSSFSTSSSSSCSTSGSTKRRKRGEAAAATMAMALVPPPSQLNRPAQPWFPAAAAEPAAMAPRVEQLVI

SEQ ID NO: 1079 - protein, 289 aa, Triticum aestivum
  misc_feature (1)..(289): Ceres CLONE ID no. 555364
  misc_feature (1)..(289): Functional Homolog of  Ceres CLONE ID no.  6042
  misc_feature (138)..(190): Pfam Name: AP2 Pfam Description: AP2 domain
MLLNPASEALVLDSIRQHLMEDTAAPAPEARRQRPAYCRSASFGSLVADQWSESLPFRADDSDDMVVYGALRDAFSCGWLPDGSFAAVKPEPLLPSPDSCYVGFLEPETPPATSPGESEEEAAAAFMGEAAAAAARGKHYRGVRQRPWGKFAAEIRDPAKNGARVWLGTYDTAEDAAVAYDRAAYRMRGSRALLNFPLRIGSEIAAAHAAAAAAGDKRPSPEPATSDSSSSSSSSGSPKRRKRGEAAAASMAMALVPPPSQLSRPAQAWYPAAPVEQVAMAPRAQQLVS

SEQ ID NO: 1080 - DNA, 839 bp, Glycine max
  misc_feature (1)..(839): Ceres CLONE ID no.  626054
  misc_feature (1)..(839): GEMINI ID 555B4
atatccagccccatccaatataacaccttcctcaacttagctagctagaagacatagtaatcattatatctaacacagataataataacttagcaacgttttttccttctttctttctttctatactttttgtggttctgattattaagttctaagagaataacaatggagggtggaagatcatctgcttcaaatgggaattgtgaggttcggtatagagggattagaagaaggccatggggcaagtttgcagcagagattcgtgaccctacgagaaaagggacaaggatatggcttggaacatttgacactgcggaacaagctgctcgagcttatgatgctgctgcttttcattttcgtggtcatagarcaattctcaacttcccaaatgagtaccaatctcataatccaaactyttctttgcctatgcctctaattgtgcctcctccttcttattcttcttctttcacttctaattattctggtgatgataataaccaccttgtgagacctggagaaataatgcaaggtggtgatyttgatgacacttttgagttggagtacttggataataagttgctcgaggaactccttcagatgcaagataacagacmcttytacaagtkaaatataacmcaagccaaccagstaggtagtactgctatgtatggcatgaaataaaatgcaaaaattgttgttgattttatttaatattttgtttgctttgtttttgtagctgatcaaagttyttygaaatgagatcgggcatttgttattattgtaagaactcagttgtgagaataataagcgacatggaaatttaatatccttgttttggc

SEQ ID NO: 1081 - protein, 171 aa, Glycine max
  misc_feature (1)..(171): Ceres CLONE ID no.  626054
  misc_feature (15)..(67): Pfam Name: AP2 Pfam Description: AP2 domain
  misc_feature (1)..(171): GEMINI ID 555B4
  misc_feature (69)..(69): Xaa is any aa, unknown, or other
  misc_feature (84)..(84): Xaa is any aa, unknown, or other
  misc_feature (125)..(125): Xaa is any aa, unknown, or other
  misc_feature (150)..(150): Xaa is any aa, unknown, or other
  misc_feature (151)..(151): Xaa is any aa, unknown, or other
  misc_feature (154)..(154): Xaa is any aa, unknown, or other
  misc_feature (157)..(157): Xaa is any aa, unknown, or other
  misc_feature (162)..(162): Xaa is any aa, unknown, or other
MEGGRSSASNGNCEVRYRGIRRRPWGKFAAEIRDPTRKGTRIWLGTFDTAEQAARAYDAAAFHFRGHRXILNFPNEYQSHNPNXSLPMPLIVPPPSYSSSFTSNYSGDDNNHLVRPGEIMQGGDXDDTFELEYLDNKLLEELLQMQDNRXXYKXNIXQANQXGSTAMYGMK

SEQ ID NO: 1082 - DNA, 1377 bp, Arabidopsis thaliana
  misc_feature (1)..(1377): Ceres CLONE ID no.  6639
  misc_feature (1)..(1377): GEMINI ID 533B10
aaaaaacttcaaagagagagagagagagagttttgtgaactcaagaaaataaaaaaagttatagttaatgggattcggcttagagagtatcaaatcaatctccggcggatggggcgcggcggcgcgttcctgtgacgcttgtaaatcagttaccgccgccgtgttctgtcgagttgactcagctttcttatgcatagcatgtgacacaagaatccattccttcactcgccacgagcgcgtgtgggtttgtgaagtttgtgaacaagctcccgccgccgtcacttgcaaagccgacgccgccgctctttgcgtcacttgtgatgccgatattcactctgctaatcctctcgctagccgtcacgaacgtgtccccgtcgaaactttcttcgactcagccgaaaccgccgtcgccaaaatctcagcttcttcgacttttggtatccttggctcatccaccaccgttgatttaaccgctgttccggttatggctgatgatctcggtttatgtccgtggttacttcctaatgatttcaacgaaccggctaaaatcgaaatcggaactgaaaacatgaaaggttcttctgactttatgttttctgatttcgatcggcttattgatttcgagtttccgaattcgttcaatcatcatcaaaacaacgccggaggagatagtcttgttccggttcagacgaaaacagagcctctcccgttaactaacaatgatcattgcttcgatattgatttctgcagatcaaagctctctgctttcacttacccttctcaatcagtcagccacagtgtttcgacttcttctattgaatacggtgtagttcctgacggaaacacaaacaactctgttaaccggagcacgatcactagctcgacgactggtggtgatcatcaagcgagctctatggatagagaagctagggttttgaggtacagagagaagagaaagaacaggaaatttgagaagacgattcgttacgcttcgaggaaagcttatgcagagtcacggccaaggatcaaaggccggtttgcgaaaagaacagagacagaaaacgacgacattttccttagtcatgtttatgcttcagcagcacacgcacagtacggtgtcgtaccaacgttctgattcgaatctacggtggataaacaatcaacctgaagacttcatatcttccaccgttgatttacagtcggtgtataataagtatagtgagtcttaccgtagacaaacatcttatcctctttaccgttttaattactttttttttacgcgctctcactgccactgtaactcttttttttttcttcctatatatgtatgcttatttttatttagaaaatgttatgaaatcatataatttggtaatc

SEQ ID NO: 1083 - protein, 355 aa, Arabidopsis thaliana
  misc_feature (1)..(355): Ceres CLONE ID no.  6639
  misc_feature (1)..(355): GEMINI ID 533B10
  misc_feature (285)..(329): Pfam Name: CCT Pfam Description: CCT motif
  misc_feature (56)..(103): Pfam Name: zf-B_box Pfam Description: B-box zinc finger
MGFGLESIKSISGGWGAAARSCDACKSVTAAVFCRVDSAFLCIACDTRIHSFTRHERVWVCEVCEQAPAAVTCKADAAALCVTCDADIHSANPLASRHERVPVETFFDSAETAVAKISASSTFGILGSSTTVDLTAVPVMADDLGLCPWLLPNDFNEPAKIEIGTENMKGSSDFMFSDFDRLIDFEFPNSFNHHQNNAGGDSLVPVQTKTEPLPLTNNDHCFDIDFCRSKLSAFTYPSQSVSHSVSTSSIEYGVVPDGNTNNSVNRSTITSSTTGGDHQASSMDREARVLRYREKRKNRKFEKTIRYASRKAYAESRPRIKGRFAKRTETENDDIFLSHVYASAAHAQYGVVPTF

SEQ ID NO: 1084 - DNA, 1352 bp, Gossypium hirsutum
  misc_feature (1)..(1352): Ceres CLONE ID no.1834027
ttaaaatcaataacaaacacttcaaaccctccacgtttgatccaaacataatatttttttatttccattgctttgatttgattcgcgattatgggaatcgaaataagcggcggcacgatcattccaggaggttggggggccgccgccatggctgtcgcggctaagacatgcgacgcatgtaaatcatcggcggcagctatcttttgtcgtactgattgggtctttttatgcttgaattgtgattccaatttccattccggtcacgaaagggtgtctatgtgtgaagtttgcgaacaagctccggcggctgtcacttgtaaagccgacgcggcggctctttgtgtcacttgcgacgccgatatccattcagcgaacccactggctcgccgtcacgaacgtgtacccatcgaacctttctacgactccgctgattccatcgtcaaatcttccccttttagcttccttgtgccgacgacggatcataatggtactaattgtaaacaagaaattgaatctaacaaaggggatttttttttcacagaaatggatcggtttatcgatttcgggtacccgaattcatctcaacatcttcatgatgccgccatggatagcgttgttccagttcaaactccaaaaccagtcattccactgatcaacgatggaagctgtttcgatactttcagctatcaaactcaatcatctctcagtcatagcgtttcatcatcgtcgcttgaagtagaaacagttccagatgggaattaccacgcaacacaagtgggtggttcaatcgatcgagaagctagggttttaaggtacaaagagaagagaaagaacaggaaattcgagaagacaatacgatacgcttcaagaaaggcttacgctgaatcaagaccaagaatcaaaggtcgatttgctaaaagaacagaaacccacaacgatgatgttgatcacatgttcaataactcttctttcgctgttggtcctgctggtttcatggcggaaacagactatggtgtcgttccatcgttttgaatgttgatgttttatgtttggtttaatctgtaatgtattaaattatttaatccaatttccagcaaagtagaaataaccttatggccattgaaaatcaaggaagaaagatgcttagttctttgattaatcattaaagtttctgatgtataaaaaacagtgtatcggtggagttcgtcgtatgttcgccatggttgatttgcaggattcctgcaagggagatatattagttttcataaaaatgtttatttcaatctctgaataaaaccagatatatggtaagtaaatgcttcaatttagttcaaaaaaaaaaaaaaaaaaaa

SEQ ID NO: 1085 - protein, 313 aa, Gossypium hirsutum
  misc_feature (1)..(313): Ceres CLONE ID no. 1834027
  misc_feature (1)..(313): Functional Homolog of  Ceres CLONE ID no.  6639
  misc_feature (235)..(279): Pfam Name: CCT Pfam Description: CCT motif
  misc_feature (64)..(106): Pfam Name: zf-B_box Pfam Description: B-box zinc finger
MGIEISGGTIIPGGWGAAAMAVAAKTCDACKSSAAAIFCRTDWVFLCLNCDSNFHSGHERVSMCEVCEQAPAAVTCKADAAALCVTCDADIHSANPLARRHERVPIEPFYDSADSIVKSSPFSFLVPTTDHNGTNCKQEIESNKGDFFFTEMDRFIDFGYPNSSQHLHDAAMDSVVPVQTPKPVIPLINDGSCFDTFSYQTQSSLSHSVSSSSLEVETVPDGNYHATQVGGSIDREARVLRYKEKRKNRKFEKTIRYASRKAYAESRPRIKGRFAKRTETHNDDVDHMFNNSSFAVGPAGFMAETDYGVVPSF

SEQ ID NO: 1086 - DNA, 1155 bp, Populus balsamifera subsp. trichocarpa
  misc_feature (1)..(1155): Ceres ANNOT ID no. 1482536
atgggaattgaagttgagagcttaaagaacttgaccggaggatggagtgttgcggctaaacgttgcgactcgtgcaaaacggcagctgcagctgcgttttgccgggcggactctgcttttttgtgtctgaattgtgacaccaagattcaccatagtggggtgaacagcaagatcatgtcaaggcacgagcgtgtgtggatgtgtgaggtttgcgagcaagcacccgctgcggttacctgtaaggctgatgcagctgctctttgtgttacttgtgatgctgacatccactctgctaaccctcttgctcgccgtcatgaacgagtccccgtggagcctttttatgactctgctgaatcaattgttaagacttcctcggcgtttaattttctagtgcctggtgatcaaaatggtgtgtctgcatatgatcataacgatgagatcgagggtgtttcgtggttgttgcacggtaatcacacaacacatgaccttaataccaagatcaacatcgagaatcctgttgtcaagactggagatatgtttttctgtgaaatggatccctttcttgattttgagtatcagaattcgatggatgggaggtacaagcagagtcatggtgggggtggtgctggagctgatagcgttgtgcctgtgcaaaacaaaccagctccgcttcccgtgatcgatcataaaaactgctttgatattgatttctgtagatcgaaactcacctctttcagcagctacccctctcagtcccttagccacagcgtttcttcgtcttccctcgatgttggtgttgttcctgatgggaattctatgtccgatatttcgtatcccttcggccgaagcatgaatacttataccgatccaagcatgcccatctcaggttccactacaaatcaagcagcagctcagttagctgggattgaccgcgaagctagagttttgaggtacagagagaaaagaaagaaccgtaaattcgaaaaaaccatacggtatgcttcacgtaaagcttacgcagaaaccaggccaagaatcaaaggccgattcgcgaagcgaaccgaaatggaatccgatatggacaccctatataactctccgagctctgtccctttcctggccgatactcattacggtgtcgttccctcgttttga

SEQ ID NO: 1087 - protein, 384 aa, Populus balsamifera subsp. trichocarpa
  misc_feature (1)..(384): Ceres ANNOT ID no. 1482536
  misc_feature (1)..(384): Functional Homolog of  Ceres CLONE ID no.  6639
  misc_feature (311)..(355): Pfam Name: CCT Pfam Description: CCT motif
  misc_feature (63)..(110): Pfam Name: zf-B_box Pfam Description: B-box zinc finger
MGIEVESLKNLTGGWSVAAKRCDSCKTAAAAAFCRADSAFLCLNCDTKIHHSGVNSKIMSRHERVWMCEVCEQAPAAVTCKADAAALCVTCDADIHSANPLARRHERVPVEPFYDSAESIVKTSSAFNFLVPGDQNGVSAYDHNDEIEGVSWLLHGNHTTHDLNTKINIENPVVKTGDMFFCEMDPFLDFEYQNSMDGRYKQSHGGGGAGADSVVPVQNKPAPLPVIDHKNCFDIDFCRSKLTSFSSYPSQSLSHSVSSSSLDVGVVPDGNSMSDISYPFGRSMNTYTDPSMPISGSTTNQAAAQLAGIDREARVLRYREKRKNRKFEKTIRYASRKAYAETRPRIKGRFAKRTEMESDMDTLYNSPSSVPFLADTHYGVVPSF

SEQ ID NO: 1088 - protein, 374 aa, Glycine max
  misc_feature (1)..(374): Ceres CLONE ID no. 463157
  misc_feature (1)..(374): Functional Homolog of  Ceres CLONE ID no.  6639
  misc_feature (302)..(346): Pfam Name: CCT Pfam Description: CCT motif
  misc_feature (60)..(107): Pfam Name: zf-B_box Pfam Description: B-box zinc finger
MGIERGGFKGFRSAWSVPPKPCDSCKLASAALFCRPDSAFLCIACDSNIHCSNKLASRHERVWMCEVCEQAPAAVTCKADAAALCVTCDSDIHSANPLAQRHERVPVEPFFDSAESIVKASAAATFGFIVPSDDGGASDAFAPDDSDAAAWLIPNPNFGSKLMDAPEIKSKEIFFSEMDPFLDFDYSNSFQNNNSAGNDSVVPVQKPSLAPPLINNHHHHQSETCFDVDFCRSKLSSFNYPSNSLSQSVSSSSLDVGVVPDGNTVSDMSYSFGRNSSDSSGIVVVSGNSVGQGATQLCGMDREARVLRYREKRKNRKFEKTIRYASRKAYAETRPRIKGRFAKRTEIDSDVERLYSPGPAVLMLDTPYGVVPSF

SEQ ID NO: 1089 - protein, 375 aa, Medicago truncatula
  misc_feature (1)..(375): Public GI no. 92875402
  misc_feature (1)..(375): Functional Homolog of  Ceres CLONE ID no.  6639
  misc_feature (298)..(342): Pfam Name: CCT Pfam Description: CCT motif
  misc_feature (60)..(107): Pfam Name: zf-B_box Pfam Description: B-box zinc finger
MGIERGGLKSLRGGWSVPPKLCDSCKLTPAALFCRSDSAFLCINCDSTIHSANKLSSRHERVWMCEVCEQAPASVTCKADAAALCVTCDSDIHSANPLARRHERVPVEPFFDSAESVVKSSSAAAAAAASFNFVVPTDDGYGQDDAEAAAWLIPNPNFGSKLNETQDIKTREMFFSDMDPFLDFDYSNNFQNNNCSNAMNDSVVPVQTKPTPAPMMNHNSEGCFDIDFCRSKLSSFNYPSHSISHSVSSSSLDVGVVPDGNTVSEISYNFGSESMVSGGVNSSNQGVQGATQLCGMDREARVMRYREKRKNRKFEKTIRYASRKAYAETRPRIKGRFAKRTEIDSDVDRLYNPADPLSVPSSMLMDCPYGVVPTF

SEQ ID NO: 1090 - DNA, 1143 bp, Populus balsamifera subsp. trichocarpa
  misc_feature (1)..(1143): Ceres ANNOT ID no. 1478227
atgggaattgaagtcgagagcttaaagaacttaaccggaggatggagtgttgcggctaaacgttgtgactcgtgcaaaaccgcggctgcagctgcgttttgcagggccgactctgcttttttgtgtctgaattgtgataccaagattcaccatagccaggtgaatagcaaaatcatgtccaggcatgagcgtgtgtggatgtgtgaggtctgcgagcaagcaccagctgcggttacttgcaaagctgatgcagctgctctttgtgtcacttgtgacgctgacatccactctgctaaccctcttgctcgccgtcatgaacgagtcccaatcgagcccttttataactctgctgaatcaattgttaagacttccacggcgtttaatattctaatacctggtgaaaatggtgtgtctggatatgatcagaacgatgatgtagagggtgtttcgtggctattacagagtaatcacacaacacacgaccataattcaaagctccaaatcgagaatcctgttgtgaagactggagacatgtttttctctgaaattgatccgtttcttgaattggagtatcagaattccattgatgcgagctatgagaagattcatggtggtgctggtgctgatagcgttgtgcctgtgcaaaccaaaccagctccgcttccggtgatcaatcatgaaagttgctttgacattgatttctgtagatctaaactcacttctttcagctactcatctcagtctcttagccacagcgtttcttcttcttccctagatgttggtgttgttcctgatgggaattctatgtccgacatatcctatcctttcagccgaagcatgaatactactaccgatccaagcatgcccctctcaggctggactgcgaatcaagcagcaactcaattagctgggattgaccgtgaagctagagttttgaggtacagagagagaaggaagaaccgaaagttcgaaaagaccatacggtatgcttcccgaaaagcttacgctgaaaccagaccgagaatcaaaggccgattcgcaaaacgaaccgaaatggaatccgatatggacaacctatataactctccgagctctgtccctttcatggccgatacccaatacggtgtcgttccctcgttttga

SEQ ID NO: 1091 - protein, 380 aa, Populus balsamifera subsp. trichocarpa
  misc_feature (1)..(380): Ceres ANNOT ID no. 1478227
  misc_feature (1)..(380): Functional Homolog of  Ceres CLONE ID no.  6639
  misc_feature (307)..(351): Pfam Name: CCT Pfam Description: CCT motif
  misc_feature (63)..(110): Pfam Name: zf-B_box Pfam Description: B-box zinc finger
MGIEVESLKNLTGGWSVAAKRCDSCKTAAAAAFCRADSAFLCLNCDTKIHHSQVNSKIMSRHERVWMCEVCEQAPAAVTCKADAAALCVTCDADIHSANPLARRHERVPIEPFYNSAESIVKTSTAFNILIPGENGVSGYDQNDDVEGVSWLLQSNHTTHDHNSKLQIENPVVKTGDMFFSEIDPFLELEYQNSIDASYEKIHGGAGADSVVPVQTKPAPLPVINHESCFDIDFCRSKLTSFSYSSQSLSHSVSSSSLDVGVVPDGNSMSDISYPFSRSMNTTTDPSMPLSGWTANQAATQLAGIDREARVLRYRERRKNRKFEKTIRYASRKAYAETRPRIKGRFAKRTEMESDMDNLYNSPSSVPFMADTQYGVVPSF

SEQ ID NO: 1092 - protein, 323 aa, Hordeum vulgare subsp. vulgare
  misc_feature (1)..(323): Public GI no. 21667487
  misc_feature (1)..(323): Functional Homolog of  Ceres CLONE ID no.  6639
  misc_feature (236)..(280): Pfam Name: CCT Pfam Description: CCT motif
  misc_feature (61)..(103): Pfam Name: zf-B_box Pfam Description: B-box zinc finger
MEGEEKPVVGGAYWGVGARACDSCATEAARLFCRADAAFLCAGCDARAHGSGSRHARVWLCEVCEHAPAAVTCKADAAVLCASCDADIHAANPLARRHERVPVAPFFGAAADAHKPFPSSGAQAGAAASAEDDGSNDAEAASWLLPEPDHKDGANGATADVFFADSDHYLDLDFARSMDDIKAISVQLNGQPEIDLNGGNKGFYSDHSMNHSLSSSEAAVVPDAAAAPVVSRGREREARLMRYREKRKSRRFEKTIRYASRKAYAETRPRVKGRFAKRTGTADADALEEHEEMYSSAAAAVAALMAPGPDHDYGVDGVVPTLV

SEQ ID NO: 1093 - DNA, 680 bp, Panicum virgatum
  misc_feature (1)..(680): Ceres CLONE ID no.1755065
aaccatttccgacgcagaacccccgggggccggaatccgtgacacccacccggaggagagcagagcagaggcatcaggcatggccgccgcggtggagctggagcagaagccggcggtggggtactggggcgtggccggcgcgcggccctgcgacgcgtgcgccgcggagccggcgcggctgcactgccgcgcggacggcgcgttcctgtgccccgggtgcgacgcccgcgcgcacggcgccgggtcgcgccacgcgcgcgtctggctctgcgaggtctgtgagcacgctcccgccgccgtcacgtgccgcgccgacgccgccgcgctctgcgcggcctgcgacgccgacatccactcggccaacccgctcgcgcgccgccacgagcggctccccgtcgcgcccttcttcggcgcgctcgccgacgcgccgcagccgttcccgtccgcggccttcgccaccgcggggggccagtcccagggggacgcggcggcggcggcggcggcggacgacgacgggagcaacgaggccgaggccgcctcatggctcctccccgagcccgacaccagccacgaggacagcgcagccgccaccgacgccttcttcscggactccgacaagtacctcggcgtcsacctcgacttcgccccggtccatggacggcatcaaggcccatcsgcgt

SEQ ID NO: 1094 - protein, 334 aa, Panicum virgatum
  misc_feature (1)..(334): Ceres CLONE ID no. 1755065
  misc_feature (1)..(334): Functional Homolog of  Ceres CLONE ID no.  6639
  misc_feature (253)..(297): Pfam Name: CCT Pfam Description: CCT motif
  misc_feature (64)..(106): Pfam Name: zf-B_box Pfam Description: B-box zinc finger
MAAAVELEQKPAVGYWGVAGARPCDACAAEPARLHCRADGAFLCPGCDARAHGAGSRHARVWLCEVCEHAPAAVTCRADAAALCAACDADIHSANPLARRHERLPVAPFFGALADAPQPFPSAAFATAGGQSQGDAAAAAAADDDGSNEAEAASWLLPEPDTSHEDSAAATDAFFADSDKYLGVDLDFARSMDGIKAIGVPVAPPELDIAAGAFYYPEHSMNHSVSSSEVAVVPDVLAGGVPAVPVASRGKEREARLMRYREKRKNRRFDKTIRYASRKAYAETRPRIKGRFAKRCSAEAEDEDEALLEHEEGACFSPAVSAPAASDGVVPSFC

SEQ ID NO: 1095 - DNA, 673 bp, Arabidopsis thaliana
  misc_feature (1)..(673): Ceres CLONE ID no.  7774
  misc_feature (1)..(673): GEMINI ID 532C9
aaatttccacttagagatcatcgagagggcaagagagaaaaatgggaaaggcacgtacggtgggagtgggaatggactattctccgacgagcaaattagctctccggtgggcggcggagaatctccttgaagacggcgacaccgtcatcttgattcacgtccaaccacaaaacgccgatcatacccgcaaaatcctcttcgaggaaaccggttcaccgctaattcctttggaggaatttagagaggttaatttgtctaaacagtatggacttgcttacgatcctgaggttcttgatgttcttgatactctctctagggctaaaaaggtgaaggttgtagcaaaggtgtattggggagatccaagggagaaactttgtgatgctgtcgaaaatctaaaactcgattccattgttcttggcagtcgaggtttgggttctctcaaaaggatcttgctgggtagtgtgagcaatcatgtggtgacaaatgcaacatgtcctgtcacagttgttaaggctaattaaagtgtctcttgttctttaattggacccagttaataacattagtagttacgtgtgtcactcatgcattgttttgacatttatacgtttgttgccttctacaaatttgtgtgaaactgattggtactgtttcattaataaatttcagttaaatg

SEQ ID NO: 1096 - protein, 159 aa, Arabidopsis thaliana
  misc_feature (1)..(159): Ceres CLONE ID no.  7774
  misc_feature (1)..(159): GEMINI ID 532C9
  misc_feature (3)..(157): Pfam Name: Usp Pfam Description: Universal stress protein family
MGKARTVGVGMDYSPTSKLALRWAAENLLEDGDTVILIHVQPQNADHTRKILFEETGSPLIPLEEFREVNLSKQYGLAYDPEVLDVLDTLSRAKKVKVVAKVYWGDPREKLCDAVENLKLDSIVLGSRGLGSLKRILLGSVSNHVVTNATCPVTVVKAN

SEQ ID NO: 1097 - DNA, 486 bp, Populus balsamifera subsp. trichocarpa
  misc_feature (1)..(486): Ceres ANNOT ID no. 1449565
atggaaaaggcacgaacggttggtatcggcatggattactcttctacaagcaaagcagccctgcgttgggcggctgagaatttgataggtgaaggtgaccgaattattctgatccaagttcagcctcctaacgctgatcataccaggaagcagctttttgagggcactggatcacccttagtgccactcgcggaattcagggatatcaatttttcaaagcaatacgggcttacttatgatcctgaagttcttgatattcttgatacagtttcaaggaccaagggggctgaagtggtggcgaaggtctactggggagatccaagggagaagttgattgatgctgtggaagatcttaagttggattctcttgttatgggaagtaggggtttaggtgctatcaaaagggtgttgcttgggagtgtcagcaactacgtggtgacaaatgctccatgtccagtcactgtagttaagggatccaaaccttga

SEQ ID NO: 1098 - protein, 161 aa, Populus balsamifera subsp. trichocarpa
  misc_feature (1)..(161): Ceres ANNOT ID no. 1449565
  misc_feature (1)..(161): Functional Homolog of  Ceres CLONE ID no.  7774
  misc_feature (3)..(157): Pfam Name: Usp Pfam Description: Universal stress protein family
MEKARTVGIGMDYSSTSKAALRWAAENLIGEGDRIILIQVQPPNADHTRKQLFEGTGSPLVPLAEFRDINFSKQYGLTYDPEVLDILDTVSRTKGAEVVAKVYWGDPREKLIDAVEDLKLDSLVMGSRGLGAIKRVLLGSVSNYVVTNAPCPVTVVKGSKP

SEQ ID NO: 1099 - protein, 167 aa, Medicago truncatula
  misc_feature (1)..(167): Public GI no. 92875130
  misc_feature (1)..(167): Functional Homolog of  Ceres CLONE ID no.  7774
  misc_feature (3)..(158): Pfam Name: Usp Pfam Description: Universal stress protein family
MAKAHIVGVAMDFSPTSKLALRWAVDNLINKNDQIIMINVQPPSADHTRKELFEDTGSPLVPLEELREINFTKQYGIAKDPEVIDILETASKIKGQAKVVAKVYWGDPREKLCNAVEDLHLDSLVIGSRGLGTIKSVLLGSVSKHVVTNASCPVTVVKGMQSSKSRH

SEQ ID NO: 1100 - protein, 162 aa, Musa acuminata
  misc_feature (1)..(162): Ceres CLONE ID no. 1728645
  misc_feature (1)..(162): Functional Homolog of  Ceres CLONE ID no.  7774
  misc_feature (5)..(159): Pfam Name: Usp Pfam Description: Universal stress protein family
MAAEGSRTVGIGMDYSPTSKVAVRWAVDNLVCAGDHVVLIHVLSKSDHHTEKQLWEEHGSPLIPLGEFEDMNLTVRYGISPDGEVLDILHTASETKGVKVVSKIYWGDPREKICDAVEELKLDSLVVGSRGLGAIKRVLLGSVSNYVVVHATCPVTVVKSNA

SEQ ID NO: 1101 - protein, 165 aa, Triticum aestivum
  misc_feature (1)..(165): Ceres CLONE ID no. 892214
  misc_feature (1)..(165): Functional Homolog of  Ceres CLONE ID no.  7774
  misc_feature (5)..(158): Pfam Name: Usp Pfam Description: Universal stress protein family
MAAGKRTIGLAMDYSPSSKAATRWVVENLVKAGDRIILIHVLPKGADASHKGLWKSTGSPLIPLLEFMEMNVQARYGVNPDKEVLEILQAESKSKQVEILAKIYWGDAREKLCEAVDDLKVDSVVLGCRGLGPLKRALLGSVSNYVVNNATCPVTVVRGPNGSLA

SEQ ID NO: 1102 - protein, 165 aa, Oryza sativa
  misc_feature (1)..(165): Public GI no. 50913251
  misc_feature (1)..(165): Functional Homolog of  Ceres CLONE ID no.  7774
  misc_feature (5)..(158): Pfam Name: Usp Pfam Description: Universal stress protein family
MAAEKRTIGLGMDYSPSSKAAAKWAVDNLVKAGDRIILVHVLPKGADASHKELWKSTGSPLIPLLEFMEMNVQARYGINPDKEVLEILQAESKSKQVEVLAKVYWGDAREKLCEAVDDLKVNTFVLGCRGLGPLKRALLGSVSNYVVNNATCPVTVVRAPTVSNA

SEQ ID NO: 1103 - DNA, 1257 bp, Arabidopsis thaliana
  misc_feature (1)..(1257): Ceres CLONE ID no.  8334
  misc_feature (1)..(1257): GEMINI ID 533F11
aaagaaactcaactttttttctttatctttaacatcaaaaaactttatcgatatctttacaaccattaaacaaaaaatttggccactacaagttgaaaaagttttgattatatctaatcgctgaaatggattacaaggtatcaagaagtggggagatagtagaaggagaagtagaagattcagaaaagattgatttaccacctggtttcagatttcacccaactgatgaagaacttataacacactatctaagaccaaaggttgtaaactcttttttctctgctatagctattggtgaagttgatctcaacaaagtcgagccttgggacttgccttggaaggctaagcttggggaaaaagagtggtacttcttttgcgtaagagaccgaaaatacccgactggtttaagaacgaatcgtgctactaaagccggttattggaaagctacagggaaagataaagagatcttcaaagggaaatctcttgttggtatgaagaaaacattggttttctacaaaggaagagctcctaaaggagtaaaaacaaattgggtcatgcatgagtatcgattagaaggcaaatacggtatcgataatctccctaaaaccgctaagaacgaatgtgttattagtcgtgtttttcataaacggactgatggtacgaaggagcatatgtccgttggtttacctccgctgatggattcttctccatatctaaagagtagaggacaagactctttagccgggaccacccttggtgggttgttgtctcacgttacctacttctccgaccaaacaaccgatgacaagagtcttgtggccgattttaaaactaccatgtttggttccggatcgactaactttttaccaaacataggttctctactagacttcgatcctctgtttctacaaaacaattcttcagtactaaagatgttgcttgacaatgaagaaacccaatttaagaagaatcttcacaattcaggttcatcagagagtgaactaacagcgagttcttggcaaggtcacaattcttatggttccactggtccagtgaatcttgattgcgtttggaaattctgaatttggaaaatcgaaaatttggatgttaactagggggtatatagggtttttaaaaacagtgtatatatgcgttatgtgttagctttagattctaggatatacaaagatgacactaatagattcttataacattttgtaaaaaaaaatcattgtagtgaatactctcttgccattt

SEQ ID NO: 1104 - protein, 318 aa, Arabidopsis thaliana
  misc_feature (1)..(318): Ceres CLONE ID no.  8334
  misc_feature (1)..(318): GEMINI ID 533F11
  misc_feature (24)..(150): Pfam Name: NAM Pfam Description: No apical meristem (NAM) protein
MDYKVSRSGEIVEGEVEDSEKIDLPPGFRFHPTDEELITHYLRPKVVNSFFSAIAIGEVDLNKVEPWDLPWKAKLGEKEWYFFCVRDRKYPTGLRTNRATKAGYWKATGKDKEIFKGKSLVGMKKTLVFYKGRAPKGVKTNWVMHEYRLEGKYGIDNLPKTAKNECVISRVFHKRTDGTKEHMSVGLPPLMDSSPYLKSRGQDSLAGTTLGGLLSHVTYFSDQTTDDKSLVADFKTTMFGSGSTNFLPNIGSLLDFDPLFLQNNSSVLKMLLDNEETQFKKNLHNSGSSESELTASSWQGHNSYGSTGPVNLDCVWKF

SEQ ID NO: 1105 - protein, 318 aa, Arabidopsis thaliana
  misc_feature (1)..(318): Public GI no. 30984532
  misc_feature (1)..(318): Functional Homolog of  Ceres CLONE ID no.  8334
  misc_feature (24)..(150): Pfam Name: NAM Pfam Description: No apical meristem (NAM) protein
MDYKVSRSGEIVEGEVEDSEKIDLPPGFRFHPTDEELITHYLRPKVVNSFFSAIAIGEVDLNKVEPWDLPWKAKLGEKEWYFFCVRDRKYPTGLRTNRATKAGYWKATGKDKEIFKGKSLVGMKKTLVFYKGRAPKGVKTNWVMHEYRLEGKFAIDNLSKTAKNECVISRVFHTRTDGTKEHMSVGLPPLMDSSPYLKSRGQDSLAGTTLGGLLSHVTYFSDQTTDDKSLVADFKTTMFGSGSTNFLPNIGSLLDFDPLFLQNNSSVLKMLLDNEETQFKKNLHNSGSSESELTASSWQGHNSYGSTGPVNLDCVWKF

SEQ ID NO: 1106 - protein, 158 aa, Arabidopsis thaliana
  misc_feature (1)..(158): Ceres CLONE ID no. 114858
  misc_feature (1)..(158): Functional Homolog of  Ceres CLONE ID no.  8334
  misc_feature (16)..(142): Pfam Name: NAM Pfam Description: No apical meristem (NAM) protein
METFCGFQKEEEQMDLPPGFRFHPTDEELITHYLHKKVLDTSFSAKAIGEVDLNKSEPWELPWMAKMGEKEWYFFCVRDRKYPTGLRTNRATEAGYWKATGKDKEIYRGKSLVGMKKTLVFYRGRAPKGQKTNWVMHEYRLEKNSLPITCRKPQRMNG

SEQ ID NO: 1107 - protein, 132 aa, Brassica napus
  misc_feature (1)..(132): Ceres CLONE ID no. 1296788
  misc_feature (1)..(132): Functional Homolog of  Ceres CLONE ID no.  8334
  misc_feature (16)..(132): Pfam Name: NAM Pfam Description: No apical meristem (NAM) protein
MESFCEFQKEEEQIDLPPGFRFHPTDEELITQYLHKKVLDISFSAKAVGEVDFNKSEPWELPWMAKMGEKEWYFFCVRDKKYPTGLRTNRATEAGYWKATGKDKEIYRGKSLVGMKKTLVFYRGRAPKGQKT

SEQ ID NO: 1108 - DNA, 664 bp, Gossypium hirsutum
  misc_feature (1)..(664): Ceres CLONE ID no.1927853
aacggccttcccttcatttcatcttctgcaagctagcttcacatcttctatagttcttctgctctctataacagctcccttttgtgttatttatacttgtttgtttctgggtttgttttttgtttaatatttccatggaagaagctattgttgtgaacaaaggagacgacgaactcatcgatttgcctcctgggtttcggttccatcccactgatgaggagatcataactcattatctcacagagaaggtgatgaacagcaacttcagtgcaagcgctattggtgaagttgatttgaacaagtgtgagccttgggatttacctaagaaagctaagatgggagagaagcaatggtacttcttttgtcagagagacaggaagtacccgacagggatgagaacaaaccgagcaactgaagctggttattggaaggcaactggcaaagacaaagagattttcaaagggaaaggttgccttgttgggatgaagaagacccttgttttctacaaagggagagctcccaaaggagagaaatctaattgggtcatgcatgaatacagacttgaaggcaaattctcttactataatctccccaaaggtgcaaaggatgaatgggttgtttgtagggttttcgataagaataatacagggaccaagaaaagtcc

SEQ ID NO: 1109 - protein, 176 aa, Gossypium hirsutum
  misc_feature (1)..(176): Ceres CLONE ID no. 1927853
  misc_feature (1)..(176): Functional Homolog of  Ceres CLONE ID no.  8334
  misc_feature (17)..(144): Pfam Name: NAM Pfam Description: No apical meristem (NAM) protein
MEEAIVVNKGDDELIDLPPGFRFHPTDEEIITHYLTEKVMNSNFSASAIGEVDLNKCEPWDLPKKAKMGEKQWYFFCQRDRKYPTGMRTNRATEAGYWKATGKDKEIFKGKGCLVGMKKTLVFYKGRAPKGEKSNWVMHEYRLEGKFSYYNLPKGAKDEWVVCRVFDKNNTGTKKS

SEQ ID NO: 1110 - protein, 350 aa, Glycine max
  misc_feature (1)..(350): Ceres CLONE ID no. 673567
  misc_feature (1)..(350): Functional Homolog of  Ceres CLONE ID no.  8334
  misc_feature (16)..(142): Pfam Name: NAM Pfam Description: No apical meristem (NAM) protein
MENVPVVCKEDDQMDLPPGFRFHPTDEELISHYLYKKVIDTKFCARAIGEVDLNKSEPWDLPWKAKMGEKEWYFFCVRDRKYPTGLRTNRATEAGYWKATGKDKEIFRGKSLVGMKKTLVFYRGRAPKGEKSNWVMHEYRLEGKFSVHNLPKTAKNEWVICRVFQKSSAGKKTHISGIMRLDSFADELGSSALPPLSDSSPSIGNTKPLNDTAYVPCFSNPIDVQRNQEGVFDSFTNSIYAVSSNPMGILPRMPPSGSFYSTQGVQAAPNLAFPGSVYTLQDHTILRTLCENNGYKPERDMISVSQETGLTTDINAETSSNFDMGRRPFENHNHASVSVAPLDLDGLWNY

SEQ ID NO: 1111 - protein, 97 aa, Brassica napus
  misc_feature (1)..(97): Ceres CLONE ID no. 1306145
  misc_feature (1)..(97): Functional Homolog of  Ceres CLONE ID no.  8334
  misc_feature (16)..(97): Pfam Name: NAM Pfam Description: No apical meristem (NAM) protein
  misc_feature (85)..(85): Xaa is any aa, unknown, or other
METFCGFQKEEEQMDLPPGFRFHPTDEELISHYLHKKVLDISFSAKAIGEVDLNKSEPWELPWMAKMGEKEWYFFCVRDRKYPTXLRTNRATEAGYW

SEQ ID NO: 1112 - protein, 334 aa, Oryza sativa
  misc_feature (1)..(334): Public GI no. 27529810
  misc_feature (1)..(334): Functional Homolog of  Ceres CLONE ID no.  8334
  misc_feature (3)..(129): Pfam Name: NAM Pfam Description: No apical meristem (NAM) protein
MDLPPGFRFHPTDEELITHYLAKKVADARFAALAVAEADLNKCEPWDLPSLAKMGEKEWYFFCLKDRKYPTGLRTNRATESGYWKATGKDKDIFRRKALVGMKKTLVFYTGRAPKGEKSGWVMHEYRLHGKLHAAALGFLHGKPASSKNEWVLCRVFKKSLVEVGAAGGKKAAVVTMEMARGGSTSSSVADEIAMSSVVLPPLMDMSGAGAGAVDPATTAHVTCFSNALEGQFFNPTAVHGHGGGDSSPFMASFTQYGQLHHGVSLVQLLESCNGYGGLVDMAASGSQLQPAACGGERERLSASQDTGLTSDVNPEISSSSGQKFDHEAALWGY

SEQ ID NO: 1113 - protein, 343 aa, Oryza sativa
  misc_feature (1)..(343): Public GI no. 50924810
  misc_feature (1)..(343): Functional Homolog of  Ceres CLONE ID no.  8334
  misc_feature (12)..(138): Pfam Name: NAM Pfam Description: No apical meristem (NAM) protein
MEQHQGQAGMDLPPGFRFHPTDEELITHYLAKKVADARFAALAVAEADLNKCEPWDLPSLAKMGEKEWYFFCLKDRKYPTGLRTNRATESGYWKATGKDKDIFRRKALVGMKKTLVFYTGRAPKGEKSGWVMHEYRLHGKLHAAALGFLHGKPASSKNEWVLCRVFKKSLVEVGAAGGKKAAVVTMEMARGGSTSSSVADEIAMSSVVLPPLMDMSGAGAGAVDPATTAHVTCFSNALEGQFFNPTAVHGHGGGDSSPFMASFTQYGQLHHGVSLVQLLESCNGYGGLVDMAASGSQLQPAACGGERERLSASQDTGLTSDVNPEISSSSGQKFDHEAALWGY

SEQ ID NO: 1114 - protein, 108 aa, Triticum aestivum
  misc_feature (1)..(108): Ceres CLONE ID no. 900490
  misc_feature (1)..(108): Functional Homolog of  Ceres CLONE ID no.  8334
  misc_feature (19)..(108): Pfam Name: NAM Pfam Description: No apical meristem (NAM) protein
  misc_feature (91)..(91): Xaa is any aa, unknown, or other
MSDVTAVMDLEVEEPRLSLPPGFRFHPTDEEVVTHYLTPKAVNNAFSCLVIADVDLNKTEPWDLPGKAKMGEKEWYFFVHKDRKYPTGTRXNRATEKGYWKATGKDKE

SEQ ID NO: 1115 - protein, 203 aa, Zea mays
  misc_feature (1)..(203): Ceres CLONE ID no. 1564140
  misc_feature (1)..(203): Functional Homolog of  Ceres CLONE ID no.  8334
  misc_feature (78)..(203): Pfam Name: NAM Pfam Description: No apical meristem (NAM) protein
VQAPLPSFSAHLSLSRTPLSLSLSLSVFLPEAAISSSDRGEAWSGRRLLVLGTAEMSEVSVINQAEVEDAGAGQLMDLPPGFRFHPTDEEIISHYLTHKALDHRFVSGVIGEVDLNRIEPWDLPGRAKMGEKEWYFFCHKDRKYPTGTRTNRATETGYWKATGKDKEIFRGRGVLVGMKKTLVFYRGRAPRGEKTGWVMHEFR

SEQ ID NO: 1116 - DNA, 681 bp, Panicum virgatum
  misc_feature (1)..(681): Ceres CLONE ID no.1862399
agtccaagcccattgccttcttcctcaacccacctctctctttcacacacgcctctccctcctcctctctctttctttctctgtgaggcagccatttccgcttcctgtcgtgggggcttgcagcggaaggagggagagaaaagggggctgctgctactgctgctgctgtttcggtgcggcggagatgtctgaggtgtcggtgataaaccaggcggaggtggaggacgccggccagctggacctgccgccgggcttccgcttccaccccaccgacgaggagatcatcacgcactacctcacccacaaggccctcgaccaccgctacacctccggcgtcatcggcgaggtcgacctcaacaagtgcgagccgtggcacctcccaggcagggccaagatgggggagaaggagtggtacttcttctgccacaaggatcgcaagtacccgacggggacccggaccaaccgcgccacggagaccggctactggaaggccaccggcaaggacaaggagatcttcaggggccgcggcatcctcgtcggcatgaagaagaccctcgtcttctaccgcggccgcgccccccgcggggagaagaccggctgggtcatgcacgagttccgcctcgagggcaagctgccccacccgctcccgcgctccgccaaggtccggcgggccccgtcccg

SEQ ID NO: 1117 - protein, 165 aa, Panicum virgatum
  misc_feature (1)..(165): Ceres CLONE ID no. 1862399
  misc_feature (1)..(165): Functional Homolog of  Ceres CLONE ID no.  8334
  misc_feature (20)..(147): Pfam Name: NAM Pfam Description: No apical meristem (NAM) protein
MSEVSVINQAEVEDAGQLDLPPGFRFHPTDEEIITHYLTHKALDHRYTSGVIGEVDLNKCEPWHLPGRAKMGEKEWYFFCHKDRKYPTGTRTNRATETGYWKATGKDKEIFRGRGILVGMKKTLVFYRGRAPRGEKTGWVMHEFRLEGKLPHPLPRSAKVRRAPS

SEQ ID NO: 1118 - protein, 353 aa, Triticum aestivum
  misc_feature (1)..(353): Ceres CLONE ID no. 835085
  misc_feature (1)..(353): Functional Homolog of  Ceres CLONE ID no.  8334
  misc_feature (19)..(149): Pfam Name: NAM Pfam Description: No apical meristem (NAM) protein
MSDVTAVMDLEVEEPRLSLPPGFRFHPTDEEVVTHYLTPKAVNNAFSCLVIADVDLNKTEPWDLPGKAKMGEKEWYFFVHKDRKYPTGTRTNRATEKGYWKATGKDKEVFRGKGRDAVLVGMKKTLVFYTGRAPRGDKTPYVMHEYRLEGQLPHRLPRSARNDWAVCRVFDKDLAAKNAPPQTASAAVGVMEDPYAFLDVDDFFNNPDLPMLMDSPSGADDFAGASSSTSSAAVPLEPDMEHLSIKTEPPVPQQQMQSPNYFFMPATTANGNHGGGAYSPYQAMGEQQSAIRRHCKPEAASSSALLSPSLGFDTGALAGGDTSFVIPSSRSYLDLEELCRGEPPMDYSNMWKI

SEQ ID NO: 1119 - protein, 348 aa, Zea mays
  misc_feature (1)..(348): Ceres CLONE ID no. 1562064
  misc_feature (1)..(348): Functional Homolog of  Ceres CLONE ID no.  8334
  misc_feature (22)..(149): Pfam Name: NAM Pfam Description: No apical meristem (NAM) protein
MSEVSVINQAEVEDAGAGQLDLPPGFRFHPTDEEIISHYLAHKALNHRFVSGVIGEVDLNKCEPWDLPGRAKMGEKEWYFFCHKDRKYPTGTRTNRATETGYWKATGKDKEIFRGRGVLVGMKKTLVFYRGRAPRGEKTGWVMHEFRLEGKLPERLPRSAKDEWAVCKVFNKELAARTEPIMAAAGAGELERVGSLGFLSELLDSAELPALIGADVDEVIDFNGPASTSGAPGTSHSHLPVKMEEHALLHMQYQPPPPPTSYYSSQYFSLPAMNSGDVLPPAIRRYCKAEQQVVSGQTAASEVSPSRETGLSADPNAEISSAVTPSSSHQFLPEFDDPVLNLADLWKY

SEQ ID NO: 1120 - protein, 351 aa, Triticum sp.
  misc_feature (1)..(351): Public GI no. 4218537
  misc_feature (1)..(351): Functional Homolog of  Ceres CLONE ID no.  8334
  misc_feature (19)..(149): Pfam Name: NAM Pfam Description: No apical meristem (NAM) protein
MSDVTAVMDLEVEEPQLALPPGFRFHPTDEEVVTHYLTRKVLRESFSCQVITDVDLNKNEPWELPGLAKMGEKEWFFFAHKGRKYPTGTRTNRATKKGYWKATGKDKEIFRGKGRDAVLVGMKKTLVFYTGRAPSGGKTPWVMHEYRLEGELPHRLPRTAKDDWAVCRVFNKDLAARNAPQMAPAADGGMEDPLAFLDDLLIDTDLFDDADLPMLMDSPSGADDFAGASSSTCSAALPLEPDAELPVLHPQQQQSPNYFFMPATANGNLGGAEYSPYQAMGDQQAAIRRYCKPKAEVASSSALLSPSLGLDTAALAGAETSFLMPSSRSYLDLEELFRGEPLMDYSNMWKI

SEQ ID NO: 1121 - DNA, 687 bp, Panicum virgatum
  misc_feature (1)..(687): Ceres CLONE ID no.1821898
gtccaagcccattgccttcttcctcaacccacctctctctttcacacacgcctctccctcctcctctctctttctttctctgtgaggcagccatttccgcttcctgtcgtgggggcttgcagcggaaggagggagagaaaagggggctgctgctactgctgctgctgtttcggtgcggcggagatgtctgaggtgtcggtgataaaccaggcggaggtggaggacgccggccagctggacctgccgccgggcttccgcttccaccccaccgacgaggagatcatcacgcactacctcacccacaaggccctcgaccaccgctacacctccggcgtcatcggcgaggtcgacctcaacaagtgcgagccgtggcacctcccaggcagggccaagatgggggagaaggagtggtacttcttctgccacaaggatcgcaagtacccgacggggacccggaccaaccgcgccacggagaccggctactggaaggccaccggcaaggacaaggagatcttcaggggccgcggcatcctcgtcggcatgaagaagaccctcgtcttctaccgcggccgcgccccccgcggggagaagaccggctgggtcatgcacgagttccgcctcgagggcaagctgccccacccgctcccgcgctccgccaaggacgagtgggccgtgtgcaaggtgttc

SEQ ID NO: 1122 - protein, 168 aa, Panicum virgatum
  misc_feature (1)..(168): Ceres CLONE ID no. 1821898
  misc_feature (1)..(168): Functional Homolog of  Ceres CLONE ID no.  8334
  misc_feature (20)..(147): Pfam Name: NAM Pfam Description: No apical meristem (NAM) protein
MSEVSVINQAEVEDAGQLDLPPGFRFHPTDEEIITHYLTHKALDHRYTSGVIGEVDLNKCEPWHLPGRAKMGEKEWYFFCHKDRKYPTGTRTNRATETGYWKATGKDKEIFRGRGILVGMKKTLVFYRGRAPRGEKTGWVMHEFRLEGKLPHPLPRSAKDEWAVCKVF

SEQ ID NO: 1123 - protein, 335 aa, Elaeis guineensis
  misc_feature (1)..(335): Public GI no. 82400209
  misc_feature (1)..(335): Functional Homolog of  Ceres CLONE ID no.  8334
  misc_feature (14)..(142): Pfam Name: NAM Pfam Description: No apical meristem (NAM) protein
MGSRRRDAEAELNLPPGFRFHPTDEELVVHYLCKKVACQRLPVPIIAEVDLYKYDPWDLPEKALFGLKEWYFFTPRDRKYPNGSRPNRAAGRGYWKATGADKPVTPKGSSRPLGIKKALVFYSGKAPRGVKTDWIMHEYRLADTNRAANKKGSLRVCHRQSEIHKFFGFLGFFMNIDSDEKIHEFMQLDDWVLCRLYNKKNTWEKMQQQKEAASFGETMDSVDDTGSDSFRTPESDIDNDVMFPDFDDMAQVGAHPPQAFNGMQGVRVNNITGYQPAIEQRPKEENDWFTDLNLDDFHSTCMAFGSTPALDMSDHDYYYSNLPQLRSNQSDLLPF

SEQ ID NO: 1124 - DNA, 1459 bp, Gossypium hirsutum
  misc_feature (1)..(1459): Ceres CLONE ID no.1923641
acttcctttttttcttaacaccatcgccaccaccttttcacttcatatcttccatctcttttcctcttcctttatccaccttctccctcactttttgtcctttgagtttggcttttcattgttttatccatcttataaaaactggggttatcctttcttaatttgattcgtataattgttgaagtcgtctaagctgaggagtaagcgaagggttttgaaatggaaaacgtttctagctttaggaacgaagatgaacaaatggaactgcctccaggatttcgattccaccccacagatgaagagctgataacacactttctctccaagaaagttgttgacagcttcttctctgctatcgccattggtgaggttgatttgaacaagtgtgaaccttgggatttgccttggagagccaaaatgggtgaaaaggaatggtacttcttctgtgttagggaccggaaatacccgactggtttgagaacaaacagggcaacggatgccggttattggaaagccacgggaaaagataaagagatattcaaggggaaatcacttgttgggatgaagaaaactttggttttctacaaagggagagcacccaaaggtcaaaaaaccaattgggtcatgcatgaatttcgtttagaaggccagtattccgtttacaatcttcccaaaacagccaagaacgagtgggttatttgtagagtattccaaaagagtcccaatggcaaaaaggtacatatttcaggtttgcctccactaatggacccctcaccgcacaccagcgaagcaagaacggtggtgggcgccggcgagacgtcaaacgtgacctgcttctccgatccgatagaagaccgtaaagcagtggaagaaatgatggacagcttcgacacttcccttgtaccttgttcatcatcctctgtgaattctcttcaaaaggcttcctacaccaccaaccaaatcaagtcgaacatgggaaacttgcagtacccggattgtttttggattcaagaaccgtccttattaaagacattaatccaaagccaaggagggcggtcgaagcagaatctgaaaccagagttttcccaggattcaaccgtgtccaaccctgaaatgattcaacttccttcatgttctgcaggagcaataaacctgggttacttctggggttactaaaattgaatattcaaaactgaaaaaaggaaaaatcaagggatgtaaatggattgaaagagttggaagaatattattgtcatgtgtgcatagataacattagtaggggaagtcaagaaaatgattgtgttgtaaaagtagttaaaactctgttaaggttttcattgccatattaggatttcactcgattatctcatcccatgcctttgtttgatacacaactattgtaattcctaccatattttaattcccatttaattctccaatatgttcgaaaatgtgaagc

SEQ ID NO: 1125 - protein, 318 aa, Gossypium hirsutum
  misc_feature (1)..(318): Ceres CLONE ID no. 1923641
  misc_feature (1)..(318): Functional Homolog of  Ceres CLONE ID no.  8334
  misc_feature (16)..(142): Pfam Name: NAM Pfam Description: No apical meristem (NAM) protein
MENVSSFRNEDEQMELPPGFRFHPTDEELITHFLSKKVVDSFFSAIAIGEVDLNKCEPWDLPWRAKMGEKEWYFFCVRDRKYPTGLRTNRATDAGYWKATGKDKEIFKGKSLVGMKKTLVFYKGRAPKGQKTNWVMHEFRLEGQYSVYNLPKTAKNEWVICRVFQKSPNGKKVHISGLPPLMDPSPHTSEARTVVGAGETSNVTCFSDPIEDRKAVEEMMDSFDTSLVPCSSSSVNSLQKASYTTNQIKSNMGNLQYPDCFWIQEPSLLKTLIQSQGGRSKQNLKPEFSQDSTVSNPEMIQLPSCSAGAINLGYFWGY

SEQ ID NO: 1126 - protein, 163 aa, Arabidopsis thaliana
  misc_feature (1)..(163): Public GI no. 53749461
  misc_feature (1)..(163): Functional Homolog of  Ceres CLONE ID no.  8334
  misc_feature (9)..(135): Pfam Name: NAM Pfam Description: No apical meristem (NAM) protein
MVGKISSDLPPGFRFHPTDEELIMYYLRYQATSRPCPVSIIPEIDVYKFDPWELPEKAEFGENEWYFFTPRDRKYPNGVRPNRAAVSGYWKATGTDKAIYSANKYVGIKKALVFYKGKPPKGVKTDWIMHEYRLSDSKSQTYSKQSGSMRVRTSLICRLIASN

SEQ ID NO: 1127 - protein, 156 aa, Parthenium argentatum
  misc_feature (1)..(156): Ceres CLONE ID no. 1603975
  misc_feature (1)..(156): Functional Homolog of  Ceres CLONE ID no.  8334
  misc_feature (9)..(135): Pfam Name: NAM Pfam Description: No apical meristem (NAM) protein
MVGRDNSNLPPGFRFHPTDEELIMFYLRNQALSKPCPVSIIPKVDIYKFDPWELPEKTEFGEKEWYFFTPRDRKYPNGIRPNRAAVSGYWKATGTDKAIYSGSKYVGVKKALVFYKGRPPKGTKTDWIMHEYRLNESRSQPTKKFGSMRLDDWVFM

SEQ ID NO: 1128 - DNA, 1310 bp, Arabidopsis thaliana
  misc_feature (1)..(1310): Ceres CLONE ID no.  93825
  misc_feature (1)..(1310): GEMINI ID 554D11
agaatcagaagagagtacatgagtttcctcttctgcctctttggtgattcttagcatttattattactcactcatcttcttttcattacattacataccaaacaagagctctcaaatggaaaggtttcaaggacacatcaacccctgtttcttcgatcgaaaaccggatgtgagaagcctcgaggttcaaggatttgcagaggctcaaagctttgctttcaaagaaaaagaggaagaaagcttactaagatacagttctatttctacagatgctgcaaagtgaagacccctcatcgtttttttcaatcaaagagccaaactttctgacgctactgtctcttcaaaccctcaaggagccttgggaactcgaaagatatctttcacttgaggattcacaatttcattcaccggtccaatctgagaccaaccgcttcatggaaggagccaatcaagctgtgtcaagccaagaaattccctttagccaagcaaacatgacactcccttcttctacctcatcaccactcagtgcacattcaagacgaaagcgcaaaatcaaccacttgctgcctcaagaaatgactagagaaaagagaaagaggaggaaaacaaaaccaagtaaaaacaatgaagagattgagaatcaaagaataaaccacattgctgttgaacgaaacagaagacgtcaaatgaacgaacatatcaactctctccgggcccttctcccaccttcctacatccaacgaggagaccaagcttccatagtaggaggagcaataaactacgtgaaggtcctcgagcaaatcatacaatctctcgaatcgcaaaagagaacgcaacaacaaagtaacagtgaggtagtagaaaacgcacttaatcatctcttaggcatttcgtcgaacgacctgtggacaactcttgaagatcaaacttgtatccccaagatcgaagctacagtgatacaaaaccatgtcagccttaaagttcaatgtgagaagaaacaaggacaacttctcaaaggaatcatatcacttgaaaagcttaaactcactgttcttcatctcaatatcactacttcgtctcattcctctgtttcttattccttcaacctcaagatggaagatgagtgcgacttagagtcagccgacgagattacggcggctgttcatcggattttcgatattccgacaatttgattaaacacatataattccaaaaatattaacagctgacaaaatggtatcttttttttttttcctacttgtaccatttttttaagaattaagagaataaaaaaatttcgtttttcgttc

SEQ ID NO: 1129 - protein, 307 aa, Arabidopsis thaliana
  misc_feature (1)..(307): Ceres CLONE ID no.  93825
  misc_feature (1)..(307): GEMINI ID 554D11
  misc_feature (125)..(176): Pfam Name: HLH Pfam Description: Helix-loop-helix DNA-binding domain
MLQSEDPSSFFSIKEPNFLTLLSLQTLKEPWELERYLSLEDSQFHSPVQSETNRFMEGANQAVSSQEIPFSQANMTLPSSTSSPLSAHSRRKRKINHLLPQEMTREKRKRRKTKPSKNNEEIENQRINHIAVERNRRRQMNEHINSLRALLPPSYIQRGDQASIVGGAINYVKVLEQIIQSLESQKRTQQQSNSEVVENALNHLLGISSNDLWTTLEDQTCIPKIEATVIQNHVSLKVQCEKKQGQLLKGIISLEKLKLTVLHLNITTSSHSSVSYSFNLKMEDECDLESADEITAAVHRIFDIPTI

SEQ ID NO: 1130 - DNA, 993 bp, Brassica napus
  misc_feature (1)..(993): Ceres CLONE ID no.  963031
  misc_feature (1)..(993): GEMINI ID 552B2
actcatcgattctctcaacctcaacaaaaagattatattctctccttccgatctagaaaaaaaaagaaagagatggccggtggtcgtggatcttcgaaatcaactgcgcccaaggcgaggaagagagtggaagctgaatccaaacccgaaaccactaacaataacaacatcaataccttgcttcgcgccaaagatggcagcgcctttgctaaatgtgaaggatgcaacaagaacgtagctgtggcgcttatcagtatgcacgattgtagcctcgacgctaaaattcgagtcaatctcgaagcacaagttgttgagacacaaaccgaggctaagaagaaacctgttgagaggaagaagtcaacatctgatgaacctaaggcaaagagactcaggaaggccaaggatgatagtaagaagaagagctcctcttcctctaacaagcccaagcgacctctcactgscttcttcatcttcatggstgatttccgcaaaactttcaaagaagagaatcctgacgctggcgttaaggatgttgcaaagcagggtggtgaaaagtggaagtctttggatgaggaagagaagaaagtttatttggataaagctgctgaactaaaggcagagtataacaagtcmcttgagagcagcaacgatgctgatgaggaagaagctgatgatgctgatgagaaacagtctgatgaggctgaggagaagcmagctgatgatgaggaggctaaggagaatgaagctgagaagaaagaggctgaaggtaaagaagaggaagatgagattttggatgactactagatatgtttaaatctttctttggtttaatctccaatgaaatggattcaactctttatcctgtgatggtgcattgtaaattttcaactttcattagttatcttaagatggttgtgtgagcagcatgtgaggtttttgtagttcactctttttttgtttagacaagtattgaagattaatgtttttagtttc

SEQ ID NO: 1131 - protein, 243 aa, Brassica napus
  misc_feature (1)..(243): Ceres CLONE ID no.  963031
  misc_feature (124)..(186): Pfam Name: HMG_box Pfam Description: HMG (high mobility group) box
  misc_feature (1)..(243): GEMINI ID 552B2
  misc_feature (130)..(130): Xaa is any aa, unknown, or other
  misc_feature (136)..(136): Xaa is any aa, unknown, or other
  misc_feature (187)..(187): Xaa is any aa, unknown, or other
  misc_feature (214)..(214): Xaa is any aa, unknown, or other
MAGGRGSSKSTAPKARKRVEAESKPETTNNNNINTLLRAKDGSAFAKCEGCNKNVAVALISMHDCSLDAKIRVNLEAQVVETQTEAKKKPVERKKSTSDEPKAKRLRKAKDDSKKKSSSSSNKPKRPLTXFFIFMXDFRKTFKEENPDAGVKDVAKQGGEKWKSLDEEEKKVYLDKAAELKAEYNKXLESSNDADEEEADDADEKQSDEAEEKXADDEEAKENEAEKKEAEGKEEEDEILDDY

SEQ ID NO: 1132 - protein, 241 aa, Arabidopsis thaliana
  misc_feature (1)..(241): Public GI no. 21554154
  misc_feature (1)..(241): Functional Homolog of  Ceres CLONE ID no.  963031
  misc_feature (115)..(183): Pfam Name: HMG_box Pfam Description: HMG (high mobility group) box
MAGPSTTSNAPKQRKRVEAETSSNTSTTLRRAKDGSAFALCEGCNKSVAVALISMHNCSLDAKIRVNLEAQVVETQAEAKKKPAEKKKTTSDGPKPKRLKKTNDEKKSSSTSNKPKRPLTAFFIFMSDFRKTFKSEHNGSLAKDAAKIGGEKWKSLTEEEKKVYLDKAAELKAEYNKSLESNDADEEEEDEEKQSDDVDDAEEKQVDDDDEVEEKEVENTDDDKKEAEGKEEEEEEILDDY

SEQ ID NO: 1133 - DNA, 1008 bp, Arabidopsis thaliana
  misc_feature (1)..(1008): Ceres CLONE ID no.  97001
  misc_feature (1)..(1008): GEMINI ID 216G3
acataagtctctctcttacattttgaaaccctaatttctcaaaaaaaatgtctgaagttgagtaccggtgctttgtcggcggccttgcctgggccaccaatgatgaagatcttcaaaggacgttctcacagttcggcgacgttatcgattctaaggtctgttacacgagagatcggtctcccggatcgagccgattccgatgattctgatcctcgacggatctcattccgatctgtttctctgttacttgattcgattactgttactatgttctctctcgttctttgttactgttacttaatttgtcccatcggtacgttcatcttcctgcttctatgagctcggagatcgatcgatttttgctttattttcatcgctttgttttatattccttccacgattgtttttgctgatgtgtatgattttgtttgtttacagatcattaacgaccgcgagagtggaagatcaaggggattcggattcgtcaccttcaaggacgagaaagccatgagggatgcgattgaagagatgaacggtaaagagctcgatggacgtgtcatcaccgtgaacgaggctcagtcgagaggtagcggcggtggcggaggaggccgtggtggaagcggtggtggttaccgcagcggaggcggtggtggatactcaggaggcggtggcggcggatactcaggaggaggcggtggtggttacgagagacgtagcggaggttacggatctggtggaggcggtggtggccgaggatacggtggtggtggacgccgtgagggaggtggctacggaggcggtgatggtggaagttacggcggcggtggtggcggctggtaatcaaagatagagttgtttgcgtgctgctgctctgtttttggtttagatttggatttgtgtcaccacttctggtttggttatcgttcgtttggtttacttttttgatgaaacagtttcgtttaagtcttctttgtctggatcgaaatgttaattcgcgtgttgtttact

SEQ ID NO: 1134 - protein, 110 aa, Arabidopsis thaliana
  misc_feature (1)..(110): Ceres CLONE ID no.  97001
  misc_feature (1)..(110): GEMINI ID 216G3
  misc_feature (1)..(20): Pfam Name: RRM_1 Pfam Description: RNA recognition motif. (a.k.a. RRM, RBD, or RNP domain)
MRDAIEEMNGKELDGRVITVNEAQSRGSGGGGGGRGGSGGGYRSGGGGGYSGGGGGGYSGGGGGGYERRSGGYGSGGGGGGRGYGGGGRREGGGYGGGDGGSYGGGGGGW

SEQ ID NO: 1135 - DNA, 949 bp, Arabidopsis thaliana
  misc_feature (1)..(949): Ceres CLONE ID no.  9804
  misc_feature (1)..(949): GEMINI ID 536F6
acaaaacagtagagagagaaagagatatagagatagagagagatagggctttgagattattctcttccacgcaaagaagaagatctaaagatgtcgtcatcatcatataacacaagcgttattccttcatcatcatcctctgctcagcctttcttcatcaccagctccggcaccggagataacgactttaaccggaaagatacttttatgtcaatgattcaacaacctaactcctcagctccaccacccaagaaacgaagaaaccaacccggaaacccaaatcctgatgcggaagtggtagcattatctccaaagacactaatggctacaaacagattcatatgcgatgtatgtaacaaagggtttcaaagagaacaaaatctacagcttcaccgaagaggacacaatctcccatggaagctgaaacaaaaatcaaccaaagaagtgaagaggaaagtgtatctttgtccggagccaacgtgcgttcaccatgacccgtcacgtgctctcggagacctcaccggaatcaagaagcattattaccgtaaacatggcgaaaagaagtggaaatgtgagaaatgttctaagcgttacgctgttcaatcggattggaaagcgcactctaagacttgtggtactaaagagtatcgatgtgactgtggtaccatcttctctaggttcccctttttacgaaactcctcttcatttgtggaccctcttcttatctctttctctctctatgtatgtttatatatacgtacatagatacatacatatttggtaagagtgcgttacttatatttattacagtgttctggtgaacactttaatgctcttctagggtttctttctatattttcatggtttgagtaatatacgttgttgcagaatgtgactgacttatattaacattcatgggttttgcattaaatgaagaaggtctttcact

SEQ ID NO: 1136 - protein, 224 aa, Arabidopsis thaliana
  misc_feature (1)..(224): Ceres CLONE ID no.  9804
  misc_feature (1)..(224): GEMINI ID 536F6
  misc_feature (83)..(105): Pfam Name: zf-C2H2 Pfam Description: Zinc finger, C2H2 type
MSSSSYNTSVIPSSSSSAQPFFITSSGTGDNDFNRKDTFMSMIQQPNSSAPPPKKRRNQPGNPNPDAEVVALSPKTLMATNRFICDVCNKGFQREQNLQLHRRGHNLPWKLKQKSTKEVKRKVYLCPEPTCVHHDPSRALGDLTGIKKHYYRKHGEKKWKCEKCSKRYAVQSDWKAHSKTCGTKEYRCDCGTIFSRFPFLRNSSSFVDPLLISFSLYVCLYIRT

SEQ ID NO: 1137 - protein, 85 aa, Brassica napus
  misc_feature (1)..(85): Ceres CLONE ID no. 1303137
  misc_feature (1)..(85): Functional Homolog of  Ceres CLONE ID no.  9804
  misc_feature (6)..(28): Pfam Name: zf-C2H2 Pfam Description: Zinc finger, C2H2 type
MATNRFICDVCKKGFQREQNLQLHRRGHNLPWKLKQKSTKEVKRKVYLCPEPTCVHHDPSRALGDLTGIKKHYYRKHGEKEVEVR

SEQ ID NO: 1138 - DNA, 612 bp, Gossypium hirsutum
  misc_feature (1)..(612): Ceres CLONE ID no.1832735
tacatacatctgattatggtctgtttgctgagcagaaaaaaaatattatggtttgtttgtttgttttcttttccctaaggctttttagctcaagtatccaatgagtaaagtcaatagagaaagagggtttatgttcttgttcttgttcactcctttctttcttttttttattaaaaaaatgaatattacctctcaatgaaccctaatctaaaaatttgtcagttttcatcatgatttaatcttgacagttctcagatggttattctttcactccctcgattaagccttatatatatattgtttttcatcccctatttttctgatttgttgtttgtcatttctcaatagcagatccagatgcggaagtgatagcactatctcccaagactctaatggcaacaaacaggttcatttgtgaggtatgcaacaaagggttccaaagggagcaaaatttacagctccacagaagaggacacaatctgccttggaagctaagacaaaagacaacaaaagaagtgaagaggaaagtttatctttgcccagaacccacatgcgtccaccatgacccttctaaggcacttggcgacctcactggcatcaaaaagcattact

SEQ ID NO: 1139 - protein, 73 aa, Gossypium hirsutum
  misc_feature (1)..(73): Ceres CLONE ID no. 1832735
  misc_feature (1)..(73): Functional Homolog of  Ceres CLONE ID no.  9804
  misc_feature (6)..(28): Pfam Name: zf-C2H2 Pfam Description: Zinc finger, C2H2 type
MATNRFICEVCNKGFQREQNLQLHRRGHNLPWKLRQKTTKEVKRKVYLCPEPTCVHHDPSKALGDLTGIKKHY

SEQ ID NO: 1140 - protein, 516 aa, Arabidopsis thaliana
  misc_feature (1)..(516): Public GI no. 29028906
  misc_feature (1)..(516): Functional Homolog of  Ceres CLONE ID no.  9804
  misc_feature (83)..(105): Pfam Name: zf-C2H2 Pfam Description: Zinc finger, C2H2 type
MSSSSYNTSVIPSSSSSAQPFFITSSGTGDNDFNRKDTFMSMIQQPNSSAPPPKKRRNQPGNPNPDAEVVALSPKTLMATNRFICDVCNKGFQREQNLQLHRRGHNLPWKLKQKSTKEVKRKVYLCPEPTCVHHDPSRALGDLTGIKKHYYRKHGEKKWKCEKCSKRYAVQSDWKAHSKTCGTKEYRCDCGTIFSRRDSYITHRAFCDALIQETARNPTVSFTSMTAASSGVGSGGIYGRLGGGSALSHHHLSDHPNFGFNPLVGYNLNIASSDNRRDFIPQSSNPNFLIQSASSQGMLNTTPNNNNQSFMNQHGLIQFDPVDNINLKSSGTNNSFFNLGFFQENTKNSETSLPSLYSTDVLVHHREENLNAGSNVSATALLQKATQMGSVTSNDPSALFRGLASSSNSSSVIANHFGGGRIMENDNNGNLQGLMNSLAAVNGGGGSGGSIFDVQFGDNGNMSGSDKLTLDFLGVGGMVRNVNRGGGGGGRGSARGGVSLDGEAKFPEQNYPFGRG

SEQ ID NO: 1141 - protein, 439 aa, Arabidopsis thaliana
  misc_feature (1)..(439): Public GI no. 4038045
  misc_feature (1)..(439): Functional Homolog of  Ceres CLONE ID no.  9804
  misc_feature (6)..(28): Pfam Name: zf-C2H2 Pfam Description: Zinc finger, C2H2 type
MATNRFICDVCNKGFQREQNLQLHRRGHNLPWKLKQKSTKEVKRKVYLCPEPTCVHHDPSRALGDLTGIKKHYYRKHGEKKWKCEKCSKRYAVQSDWKAHSKTCGTKEYRCDCGTIFSRRDSYITHRAFCDALIQETARNPTVSFTSMTAASSGVGSGGIYGRLGGGSALSHHHLSDHPNFGFNPLVGYNLNIASSDNRRDFIPQSSNPNFLIQSASSQGMLNTTPNNNNQSFMNQHGLIQFDPVDNINLKSSGTNNSFFNLGFFQENTKNSETSLPSLYSTDVLVHHREENLNAGSNVSATALLQKATQMGSVTSNDPSALFRGLASSSNSSSVIANHFGGGRIMENDNNGNLQGLMNSLAAVNGGGGSGGSIFDVQFGDNGNMSGSDKLTLDFLGVGGMVRNVNRGGGGGGRGSARGGVSLDGEAKFPEQNYPFGRG

SEQ ID NO: 1142 - DNA, 1123 bp, Gossypium hirsutum
  misc_feature (1)..(1123): Ceres CLONE ID no.1832094
aaaaaaaggaaacttgatactactactacgaactagaccacaaagtatcgagaaagagagatcctacttttactattcatatgggatgaccttatgtatgtatttgtttatgcatatgggatagcttttgattctttctctttctccttatatactttcttcttggtattttgttgggtttttactctaagtttttcttttcttttttttttttttgccttgttgtttcttattggattgaaaagattttcaaagaagttaagggaggacccagaagaagaactgaaagaaatagcagcttggctaaccacaagaaactagaaacgatagcaagcaagctaataaaattaataagctttgaagatggccgccgcctcatcgtccaaacctttttttggaaccagggaagaaaatcaaaaccagatgatgcaagaacaatcatccatcgctacacccacttcgtcaactgctccaaccactgcacctcagaagagaaagagaaatcaccctggaacatcatatccagatgcggaagtgatagcactatctcccaagactctaatggcaacaaacaggttcatttgtgaggtatgcaacaaagggttccaaagggagcaaaatttacagctccacagaagaggacacaatctgccttggaagctaatacaaaagacaacaaaagaagtgaagaggaaagtttatctttgcccagaacccacatgcgttcaccatgacccttctaaggcacttggcgacctcactggcatcaaaaagcattactcaagaaaacatggtgagaagaaatggaagtgtgagaagtgttccaagaggtatgccgtgcaatcggattggaaagctcattcaaagacttgcggcactagagagtacagatgtgattgtggcactcttttctcaaggtaattaatcattaacgttatcaggaaggaagctcatgtgagttttctgtacgtatgtttaccgccttggttttgatcttcccctttgccctttgctgctaagtccttggtttttgcccaccgtaaaaaaaatacttacaaagaaaaaaaaaaaaaaaaaaaaaaaaaaaaaaaaaaaaaaaaataaaaaaaaaaaaaaaaaaaaa

SEQ ID NO: 1143 - protein, 165 aa, Gossypium hirsutum
  misc_feature (1)..(165): Ceres CLONE ID no. 1832094
  misc_feature (1)..(165): Functional Homolog of  Ceres CLONE ID no.  9804
  misc_feature (52)..(74): Pfam Name: zf-C2H2 Pfam Description: Zinc finger, C2H2 type
MMQEQSSIATPTSSTAPTTAPQKRKRNHPGTSYPDAEVIALSPKTLMATNRFICEVCNKGFQREQNLQLHRRGHNLPWKLIQKTTKEVKRKVYLCPEPTCVHHDPSKALGDLTGIKKHYSRKHGEKKWKCEKCSKRYAVQSDWKAHSKTCGTREYRCDCGTLFSR

SEQ ID NO: 1144 - protein, 134 aa, Glycine max
  misc_feature (1)..(134): Ceres CLONE ID no. 624726
  misc_feature (1)..(134): Functional Homolog of  Ceres CLONE ID no.  9804
  misc_feature (67)..(89): Pfam Name: zf-C2H2 Pfam Description: Zinc finger, C2H2 type
  misc_feature (111)..(111): Xaa is any aa, unknown, or other
  misc_feature (112)..(112): Xaa is any aa, unknown, or other
  misc_feature (119)..(119): Xaa is any aa, unknown, or other
GEQNLQLHRRGHNLPWKLKQKSTTKEPKRKVYLCPEPTCVHHDPSRALGDLTGIKKHYYRKHGEKKWKCEKCSKKYAVQSDWKAHSKTCGTREYRCDCGTLFSRRDSFITXXAFCDALXQESARFPSGLNSLGT

SEQ ID NO: 1145 - protein, 602 aa, Arabidopsis thaliana
  misc_feature (1)..(602): Public GI no. 19698935
  misc_feature (1)..(602): Functional Homolog of  Ceres CLONE ID no.  9804
  misc_feature (81)..(103): Pfam Name: zf-C2H2 Pfam Description: Zinc finger, C2H2 type
MAASSSSAASFFGVRQDDQSHLLPPNSSAVVPPPPPPHHQAPLPPLEAPPQKKKRNQPRTPNSDAEVIALSPKTLMATNRFICEVCNKGFQREQNLQLHRRGHNLPWKLKQKSTKEVKRKVYLCPEPSCVHHDPSRALGDLTGIKKHYYRKHGEKKWKCDKCSKRYAVQSDWKAHSKTCGTKEYRCDCGTLFSRRDSFITHRAFCDALAQESARHPTSLTSLPSHHFPYGQNTNNSNNNASSMILGLSHMGAPQNLDHQPGDVLRLGSGGGGGGAASRSSSDLIAANASGYFMQEQNPSFHDQQDHHHHHQQGFLAGNNNIKQSPMSFQQNLMQFSHDNHNSAPSNVFNLSFLSGNNGVTSATSNPNAAAAAAVSSGNLMISNHYDGENAVGGGGEGSTGLFPNNLMSSADRISSGSVPSLFSSSMQSPNSAPHMSATALLQKAAQMGSTSSNNNNGSNTNNNNNASSILRSFGSGIYGENESNLQDLMNSFSNPGATGNVNGVDSPFGSYGGVNKGLSADKQSMTRDFLGVGQIVKSMSGSGGFQQQQQQQQQQQQQQQHGNSRERVGSSSDSADRSSMNVNTGGGPASTSPPYGIHHASF

SEQ ID NO: 1146 - protein, 602 aa, Arabidopsis thaliana
  misc_feature (1)..(602): Public GI no. 15810271
  misc_feature (1)..(602): Functional Homolog of  Ceres CLONE ID no.  9804
  misc_feature (81)..(103): Pfam Name: zf-C2H2 Pfam Description: Zinc finger, C2H2 type
MAASSSSAASFFGVRQDDQSHLLPPNSSAAAPPPPPPHHQAPLPPLEAPPQKKKRNQPRTPNSDAEVIALSPKTLMATNRFICEVCNKGFQREQNLQLHRRGHNLPWKLKQKSTKEVKRKVYLCPEPSCVHHDPSRALGDLTGIKKHYYRKHGEKKWKCDKCSKRYAVQSDWKAHSKTCGTKEYRCDCGTLFSRRDSFITHRAFCDALAQESARHPTSLTSLPSHHFPYGQNTNNSNNNASSMILGLSHMGAPQNLDHQPGDVLRLGSGGGGGGAASRSSSDLIAANASGYFMQEQNPSFHDQQDHHHHHQQGFLAGNNNIKQSPMSFQQNLMQFSHDNHNSAPSNVFNLSFLSGNNGVTSATSNPNAAAAAAVSSGNLMISNHYDGENAVGGGGEGSTGLFPNNLMSSADRISSGSVPSLFSSSMQSPNSAPHMSATALLQKAAQMGSTSSNNNNGSNTNNNNNASSILRSFGSGIYGENESNLQDLMNSFSNPGATGNVNGVDSPFGSYGGVNKGLSADKQSMTRDFLGVGQIVKSMSGSGGFQQQQQQQQQQQQQQQHGNSRERVGSSSDSADRSSMNVNTGGGPASTSPPYGIHHASF

SEQ ID NO: 1147 - protein, 188 aa, Zea mays
  misc_feature (1)..(188): Ceres CLONE ID no. 1551497
  misc_feature (1)..(188): Functional Homolog of  Ceres CLONE ID no.  9804
  misc_feature (84)..(106): Pfam Name: zf-C2H2 Pfam Description: Zinc finger, C2H2 type
MASNSSAAFFGVRDGDQQDQIKPLISPQQQLAAALPGLAGGVPAASGQGAPPAQPPPKKKRTMPDPDAEVIALSPKTLMATNRFVCEVCNKGFQREQNLQLHRRGHNLPWKLKQKNPLQAQRRRVYLCPEPTCVHHDPARALGDLTGIKKHFCRKHGEKKWKCDKCSKRYAVQSDWKAHSKICGTREY

SEQ ID NO: 1148 - DNA, 1584 bp, Populus balsamifera subsp. trichocarpa
  misc_feature (1)..(1584): Ceres ANNOT ID no. 1516953
atggccgccgcttcgtcatctgcacctttcttcggccggttccaaccacaggacctcaaaagaagagaagaaatcaacctggaacaccaagcaaatccagatgcagaagtgatagcactatctcccaagactctaatggcaacaaacaggttcatatgtgaggtatgcaacaaagggttccaaagggagcaaaacctacagctccacagaagaggacacaacctgccttggaagctaaagcagaagactacaaaagaagtgaagaggaaggtgtatctgtgtcccgagcccacatgtgttcaccatgatccttctagggctcttggtgaccttactggcataaaaaagcactactttagaaagcacggtgagaagaaatggaagtgtgagaaatgctcaaaaagatatgctgttcaatctgattggaaagcccattctaagacttgcggtactagagaatacagatgtgactgtggcactcttttctcaaggcgtgatagttttatcacacatagagctttttgtgacgcactagctcaggaaagtgcaaggcatcctaccagcttaaatactataggaagtcatctgtatggaaataaccacatgagcttaggcttctctcaagtgggttcccaaatttcccatttacaagatcaccacccatctggtaataacatgttacggctgggcagtgctggggcagccaatttcgagcatctaatccctccacctaaccctccttcaatgcccatgatgcctccatctggtttcttcatgggagatgcaaaccaagggccatttccaaacaaatctttacatgggctaatgcaacttcctgatcttcaaagcaacactaacaacccctcctcggcttccaatctgtttaacttcggcttcttttcaaataatagtaacacaggccgtacaagtaacaatgacaatgccaacactggaagcacaaccacaaacttagcgagtcccggattgttaaatgctacccagttcaacaacgtcaatggtgctggccaaaggacatcagttttccccaccaacatgagtggtgatcatgttggatcggctatgtcttcctttttcaatacttcaatgcaacaagagaacatcacaccgcatgtgtctgccactgcattgcttcaaaaagcggctcagatgggttcaactactagcagcaacagtccaagtggtttactgagaagcttggggagttcttcaacaactggtgctaaatctattaggccacttgtttccaccaactttggcagcagtttcagcaatgcaaatgtaggtgaaagcttagaaacacacatggaaagtgaaagccaacttcaaggattgatgaattctcttgccaatggaagctcatcaatttttggaaatgaacaggacaacagctacactgggtttgatagctcaagttttagcaaagcagacgaaggaaatatgcatcaaggtcttgctgggtcagataaactgaccttggattttttgggtgttgggggcagagtaagaaacattggtggagggtttccacaaagacagcaacaaaatggcatcaataatatataa

SEQ ID NO: 1149 - protein, 527 aa, Populus balsamifera subsp. trichocarpa
  misc_feature (1)..(527): Ceres ANNOT ID no. 1516953
  misc_feature (1)..(527): Functional Homolog of  Ceres CLONE ID no.  9804
  misc_feature (51)..(73): Pfam Name: zf-C2H2 Pfam Description: Zinc finger, C2H2 type
MAAASSSAPFFGRFQPQDLKRREEINLEHQANPDAEVIALSPKTLMATNRFICEVCNKGFQREQNLQLHRRGHNLPWKLKQKTTKEVKRKVYLCPEPTCVHHDPSRALGDLTGIKKHYFRKHGEKKWKCEKCSKRYAVQSDWKAHSKTCGTREYRCDCGTLFSRRDSFITHRAFCDALAQESARHPTSLNTIGSHLYGNNHMSLGFSQVGSQISHLQDHHPSGNNMLRLGSAGAANFEHLIPPPNPPSMPMMPPSGFFMGDANQGPFPNKSLHGLMQLPDLQSNTNNPSSASNLFNFGFFSNNSNTGRTSNNDNANTGSTTTNLASPGLLNATQFNNVNGAGQRTSVFPTNMSGDHVGSAMSSFFNTSMQQENITPHVSATALLQKAAQMGSTTSSNSPSGLLRSLGSSSTTGAKSIRPLVSTNFGSSFSNANVGESLETHMESESQLQGLMNSLANGSSSIFGNEQDNSYTGFDSSSFSKADEGNMHQGLAGSDKLTLDFLGVGGRVRNIGGGFPQRQQQNGINNI

SEQ ID NO: 1150 - protein, 499 aa, Arabidopsis thaliana
  misc_feature (1)..(499): Public GI no. 7527719
  misc_feature (1)..(499): Functional Homolog of  Ceres CLONE ID no.  9804
  misc_feature (65)..(87): Pfam Name: zf-C2H2 Pfam Description: Zinc finger, C2H2 type
MSSSYNTIALSSTPTFLLSSAAAGPGPNNFNRQEAAMTMVQQQPTSSVAPPPKKRRNQPGNPSKFLCEVCNKGFQREQNLQLHRRGHNLPWKLKQKSNKEVRRKVYLCPEPSCVHHDPARALGDLTGIKKHYYRKHGEKKWKCDKCSKRYAVQSDWKAHSKTCGTKEYRCDCGTIFSSEREKDSEGERGKIKDAKFGHIGWFHCLIDEHGGQRDIVGVVDEHFTFLGRDSYITHRAFCDALIQESARNPTVSFTAMAAGGGGGARHGFYGGASSALSHNHFGNNPNSGFTPLAAAGYNLNRSSSDKFEDFVPQATNPNPGPTNFLMQCSPNQGLLAQNNQSLMNHHGLISLGDNNNNNHNFFNLAYFQDTKNSDQTGVPSLFTNGADNNGPSALLRGLTSSSSSSVVVNDFGDCDHGNLQGLMNSLAATTDQQGRSPSLFDLHFANNLSMGGSDRLTLDFLGVNGGIVSTVNGRGGRSGGPPLDAEMKFSHPNHPYGKA

SEQ ID NO: 1151 - protein, 516 aa, Arabidopsis thaliana
  misc_feature (1)..(516): Public GI no. 45935057
  misc_feature (1)..(516): Functional Homolog of  Ceres CLONE ID no.  9804
  misc_feature (102)..(124): Pfam Name: zf-C2H2 Pfam Description: Zinc finger, C2H2 type
MMNKDMLLHQHQQPQQDENMSNLTSASGDQASVSSGNITEASGSNYFPHHQQQQEQQQQQRQQLFVPDSQPQKKRRNQPGNPDPESEVIALSPKTLMATNRFVCEICNKGFQRDQNLQLHRRGHNLPWKLKQRSNKEVIRKKVYVCPEASCVHHDPSRALGDLTGIKKHFCRKHGEKKWKCDKCSKKYAVQSDCKAHSKTCGTKEYRCDCGTLFSRRDSFITHRAFCEALAEETAREVVIPQNQNNNQPNPLLIHQSASHPHHHHQTQPTINVSSSSSSSHNHNIINSLHFDTNNGNTNNSNNSNNHLHTFPMKKEQQSNDHIMNYHHSIIPPWLAPQPHALTSSNPNPSNGGGGGGSLFSLASPAMSATALLQKAAQMGSTKTPPLPPTTAYERSTHNNNLTTTMAAMMTSPSGFISSNNNNHVLFQDYNASGFDNHGGEEAFDDTFGGFLRTNEVTAAAGSEKSTKSGGGEGLTRDFLGLRPLMSHNEILSFAGLGSCINSSASDQLHPKPWQG

SEQ ID NO: 1152 - protein, 195 aa, Zea mays
  misc_feature (1)..(195): Ceres CLONE ID no. 1167848
  misc_feature (1)..(195): Functional Homolog of  Ceres CLONE ID no.  9804
  misc_feature (84)..(106): Pfam Name: zf-C2H2 Pfam Description: Zinc finger, C2H2 type
MDMFSSHSLSYKLSSLSTEASASSGNNTLSTIQEFSGFHNVISSVCTHTETHKPKKKRGLPGNPDPDAEVIALSPKTLLATNRFVCEICNKGFQRDQNLQLHRRGHNLPWKLKQKNTKEQQKKKVYVCPETNCAHHHPSRALGDLTGIKKHFCRKHGEKKWKCEKCSKFYAVQSDWKAHTKICGTRDYRCDCGTL

SEQ ID NO: 1153 - protein, 548 aa, Oryza sativa
  misc_feature (1)..(548): Public GI no. 51965086
  misc_feature (1)..(548): Functional Homolog of  Ceres CLONE ID no.  9804
  misc_feature (70)..(92): Pfam Name: zf-C2H2 Pfam Description: Zinc finger, C2H2 type
MAAASSAHYFGLGEPQMQQQQQQPPLQNNAAAPVAATPPPKKKRNQPGNPNPDAEVVALSPHTLLATNRFVCEVCNKGFQREQNLQLHRRGHNLPWKLKQKNPKETRRRVYLCPEPSCVHHDPSRALGDLTGIKKHYSRKHGEKKWKCDKCNKRYAVQSDWKAHSKTCGTREYRCDCGTLFSRRDSFITHRAFCDALAQESGRIMPPMGAALYAAAGAGMAIGGLTGMAASHQLQPFQDHSSAITTAANAAAQFDHLMATSSAAAGSPAFRAAQPTSSSSSPFYLGGGGDDGQAHTSLLHGKPAFHGLMQLPEQQGSNGGGLLNLSYFSGGNGGHHHHHQEGRLVFPDQFNGVAAGNGARAGSGEHGNSGNNADSGSIFSGNMMGGGGGFSSLYSSSDQTVPPPQMSATALLQKAAQMGATTSSGGAGSVNSLLRGLGSGGGGGALNGKPAGAAGFIMSGESSSRSTASQTAENESQLRELMMNTLSATGGGTGAGTVFVGGGFPGVDDGKLSTRDFLGVSGGAPGLQLRHGGAAGMGMAGSLDQEMK

SEQ ID NO: 1154 - protein, 518 aa, Zea mays
  misc_feature (1)..(518): Public GI no. 55418542
  misc_feature (1)..(518): Functional Homolog of  Ceres CLONE ID no.  9804
  misc_feature (57)..(79): Pfam Name: zf-C2H2 Pfam Description: Zinc finger, C2H2 type
MQPQQGSSSSLQQNSTSAPGAAVVPPPKKKRNQPGNPNPDAEVIALSPRTLLATNRFVCEVCNKGFQREQNLQLHRRGHNLPWKLKQKNPREARRRVYLCPEPTCVHHDPSRALGDLTGIKKHYCRKHGEKKWKCDKCSKRYAVQSDWKAHSKTCGTREYRCDCGTLFSRRDSFITHRAFCDALARESAQMPPLGAGLYVGPGSMSLGLSQIHGFADQAQSSSAAAAPQFDHIMPSSSGSSSMFRSQASASSPSYFLGGSAPPAAAQDFSEDGSQGSQGPLLHGKAHFHGLMMQLPEQQHQPGSSNAAVGANGSNILNLGFFSAGNSGGTSGSLQDARIAIQDQFNLSGSGSGSAEHGNNVMVASIGSHLGRGFPSLYSSSPSAGMAQNSATALLMKAAQMGSTTSSTTHNNHNGPTTTSTLLRATGFSGATGSGQLGTTGGRAAAGEEGAASHEAHFHELIMNSLAGGGFSGTAGFGGGVDDGKLSTRDFLGVGRGAATMAPPGLHMGALDPAQQMK

SEQ ID NO: 1155 - DNA, 2040 bp, Populus balsamifera subsp. trichocarpa
  misc_feature (1)..(2040): Ceres ANNOT ID no. 1463658
atggctgcttcttcttcatcggcgcctttttttggaattagggaagaagaacaaaaccagcagatgaaacaacagcattcctcaactccaacttcatcttcagctcaggctccaccgccacagaagaaaaagagaaaccaacctggaacaccaagcaagtatcatcaattttatctaaagatcgatctacctaatccagacgcagaggtgatagcactatctcccaagaccctaatggcaacaaacaggttcatatgtgaggtatgcaacaaagggttccaaagggagcaaaatctacagctccacagaagaggacataacctgccttggaagctaaagcagaagactacaaaagaagtgaggaggaaggtttatctgtgccccgaacccacatgcgtccaccatgagccttctagagctcttggtgatcttactggaatcaaaaagcactactcaagaaaacatggtgagaagaaatggaagtgtgagaagtgctcaaaaaaatatgctgtccagtctgattggaaagcccattctaagacttgtggcactagagaatacagatgtgactgtggcactctcttctcaaggaggacggctatccctcgattcatatacgacaccaacaaaaaggttgaaagagaagaaacggaagaggcgttacgagtatatggagatggtgagagagcagaaaacatgcgctcgcacgtgaataatctattgaaactgccaccatggtcattgaggttttggcgtgacagctttatcactcacagggcattctgtgatgcgctggctcaagaaagtgcaagaaaccctcctaccaacttgaacacaattggaagccatctgtatggaagtagcaacatgaccttaggcttatctcaagtaggaactcaaatctcctcattacaagaccacaacaaccagtctactgacattttacgacttggtggcggtggtgcccggactggacaattcgatcatcttctcccttcatcaattggttcatcgtcgtttcgacctccacagcaaatgccctcacctgctttcttcatgcaagaaccaaaccagaattatcatgatgaaaaccaatctcagcaagacttgttgcaaaataagccgttccatcatggactgatgcaatttgctgatattcacaacaccacaggcaaccctccctctgctggcaatctgttcaacctcagctttctttccaatagtagcaccgcaagcagcatttccaacagcaacaatgcaaacaattccaacagcaacctaccaacttcaggattgctaatgcccagtcatttcaacaaccaaaatggtgttggtggtggtgaagggagtaatatcttctcaaataatgtaatgggtaatcaaatgacctccggtgtcccttctctctacagctcttcggttcagaatgataacatggtctctcatatgtctgctactgcgctgcttcaaaaggctgctcaaatgggttcaagttcaagcaacaacagtgcctcattacttagaagttttggtagctcttcctcaagtggtaacaaatcagataggcaacttattggtgggaactttagtggcatgttcagcgaaaacgagaataatcttcatgacctaatgaactcatttgctcctgggaattcctccatgtttggttccggacatgcacaagaaaacccctatggtggatatactgcaagcaggacaagtttggagcaagaaaagcagcaccacggcccaaattttggcaacactagtatggatgaagcaaagttgcaccaaagtctcaatgcaagcattggtgggtctgatagattgacaagagactttcttggtgttggtcctcaaatagtgagaagcatgagtggatcatcagggttttcacagagagaaaaacagcagcagccacagcgtcagcatcatggcatggatatgggtggctcctccttggattcagagagacataacactaatatttctgcggcgccgacaagccagcctttcggaggaaatgggagttttcagtga

SEQ ID NO: 1156 - protein, 679 aa, Populus balsamifera subsp. trichocarpa
  misc_feature (1)..(679): Ceres ANNOT ID no. 1463658
  misc_feature (1)..(679): Functional Homolog of  Ceres CLONE ID no.  9804
  misc_feature (84)..(106): Pfam Name: zf-C2H2 Pfam Description: Zinc finger, C2H2 type
MAASSSSAPFFGIREEEQNQQMKQQHSSTPTSSSAQAPPPQKKKRNQPGTPSKYHQFYLKIDLPNPDAEVIALSPKTLMATNRFICEVCNKGFQREQNLQLHRRGHNLPWKLKQKTTKEVRRKVYLCPEPTCVHHEPSRALGDLTGIKKHYSRKHGEKKWKCEKCSKKYAVQSDWKAHSKTCGTREYRCDCGTLFSRRTAIPRFIYDTNKKVEREETEEALRVYGDGERAENMRSHVNNLLKLPPWSLRFWRDSFITHRAFCDALAQESARNPPTNLNTIGSHLYGSSNMTLGLSQVGTQISSLQDHNNQSTDILRLGGGGARTGQFDHLLPSSIGSSSFRPPQQMPSPAFFMQEPNQNYHDENQSQQDLLQNKPFHHGLMQFADIHNTTGNPPSAGNLFNLSFLSNSSTASSISNSNNANNSNSNLPTSGLLMPSHFNNQNGVGGGEGSNIFSNNVMGNQMTSGVPSLYSSSVQNDNMVSHMSATALLQKAAQMGSSSSNNSASLLRSFGSSSSSGNKSDRQLIGGNFSGMFSENENNLHDLMNSFAPGNSSMFGSGHAQENPYGGYTASRTSLEQEKQHHGPNFGNTSMDEAKLHQSLNASIGGSDRLTRDFLGVGPQIVRSMSGSSGFSQREKQQQPQRQHHGMDMGGSSLDSERHNTNISAAPTSQPFGGNGSFQ

SEQ ID NO: 1157 - protein, 467 aa, Arabidopsis thaliana
  misc_feature (1)..(467): Public GI no. 22136762
  misc_feature (1)..(467): Functional Homolog of  Ceres CLONE ID no.  9804
  misc_feature (82)..(104): Pfam Name: zf-C2H2 Pfam Description: Zinc finger, C2H2 type
MSSSYNTIALSSTPTFLLSSAAAGPGPNNFNRQEAAMTMVQQQPTSSVAPPPKKRRNQPGNPNPDAEVIALSPKTIMATNRFLCEVCNKGFQREQNLQLHRRGHNLPWKLKQKSNKEVRRKVYLCPEPSCVHHDPARALGDLTGIKKHYYRKHGEKKWKCDKCSKRYAVQSDWKAHSKTCGTKEYRCDCGTIFSRRDSYITHRAFCDALIQESARNPTVSFTAMAAGGGGGARHGFYGGASSALSHNHFGNNPNSGFTPLAAAGYNLNRSSSDKFEDFVPQATNPNPGPTNFLMQCSPNQGLLAQNNQSLMNHHGLISLGDNNNNNHNFFNLAYFQDTKNSDQTGVPSLFTNGADNNGPSALLRGLTSSSSSSVVVNDFGDCDHGNLQGLMNSLAATTDQQGRSPSLFDLHFANNLSMGGSDRLTLDFLGVNGGIVSTVNGRGGRSGGPPLDAEMKFSHPNHPYGKA

SEQ ID NO: 1158 - DNA, 664 bp, Panicum virgatum
  misc_feature (1)..(664): Ceres CLONE ID no.1877855
ataaggaggtgctcatcataaccaaccaccactcgctactactgctagctccttcctccctctccttctacctccttctcttttgcttccgtgtgtgttccaagagggagagagaaagagaggggcgcatgctccggttgctagcttcagttcgatccgtgtagctctgctagctccttctcgatcgatcacccgactttcgggattcattatcatccagttggtgcttatatactattgatatcgatcggtcgtcggtggtgcagaagaagccggagagtcaggtaggctactgtccaagctaaggagagactatactagcagtcacgctgccgcacagttgcgtgacttggactggccagtcgcagtgtgaccggccggtagctcgctctgctagcagcagtggtggactggtggtggtggtgaccaatccaccaatcaactcgtgagctagctagctgagatcgatcgatacacatggcggccgcccacctgttcggactcggcgacgcgcagatgcagccgccgctgccgcagcaggcggcgcctcctcctccggcagccgcgccggcgcccaagaagaagaggaaccagcccggtaacccaaatccggacgctgaggtgatcgcgctgtcccccaagtcgctgctggcgacgaaccggt

SEQ ID NO: 1159 - protein, 333 aa, Panicum virgatum
  misc_feature (1)..(333): Ceres CLONE ID no. 1877855
  misc_feature (1)..(333): Functional Homolog of  Ceres CLONE ID no.  9804
  misc_feature (63)..(85): Pfam Name: zf-C2H2 Pfam Description: Zinc finger, C2H2 type
MAAAHLFGLGDAQMQPPLPQQAAPPPPAAAPAPKKKRNQPGNPNPDAEVIALSPKSLLATNRFVCEVCNKGFQREQNLQLHRRGHNLPWKLKQKNPKETRRRVYLCPEPTCVHHDPSRALGDLTGIKKHYCRKHGEKKWKCDKCNKRYAVQSDWKAHSKTCGTREYRCDCGTLFSRRDSFITHRAFCDAMAQESARAPPIGAGMYGSGGMALGLSGLAASQLHSFQDQAHSSAATAIGGNPAAQFEHLMPSSAGSPAFRGAQPASSSSSPFYLGGAEDGHQSQPGHTSLLHGKPAFHGLMQLPEQHGQPGSNGLLNLGFFSGASRGQDARLVF

SEQ ID NO: 1160 - DNA, 717 bp, Gossypium hirsutum
  misc_feature (1)..(717): Ceres CLONE ID no.1940423
ttcaataggagggtttgttcatcaagaacaaaataatacaaacccgaacaaaataatacaaaccctaaccctaaatccaatcccgttaagaagaagagaaatcttccaggaaatccagatccagatgctgaagttattgctctatctcccaaaactctcatggctaccaacagattcatatgtgaaatatgcaacaaaggcttccaacgagaccaaaacttgcagcttcatcgaaggggtcacaatcttccatggaagctgaagcaaagaaacaacaaagaaccagttaagaagaaggtatacatttgccccgagaaaacctgcgtccaccatgatccatcgagagcactcggtgacctcactgggataaagaagcatttcagcagaaaacatggagaaaagaagtggaagtgtgagaaatgttcgaagaaatacgccgttcaatccgactggaaagctcactccaaaacttgtggtactagggagtacaagtgtgactgtgggacactgttttccagaaaagacagctttatcacacatagagctttctgtgacgccttagctgaagagagtgcaagattcagttccgttgctggtgcagccacaaatctaaatttcagaaacgatgttgtgaatctgcctattggatttggtggaattcctcagtttggttccggttttacacaagatgtcagtgggatgactgtatcaagtctg

SEQ ID NO: 1161 - protein, 186 aa, Gossypium hirsutum
  misc_feature (1)..(186): Ceres CLONE ID no. 1940423
  misc_feature (1)..(186): Functional Homolog of  Ceres CLONE ID no.  9804
  misc_feature (6)..(28): Pfam Name: zf-C2H2 Pfam Description: Zinc finger, C2H2 type
MATNRFICEICNKGFQRDQNLQLHRRGHNLPWKLKQRNNKEPVKKKVYICPEKTCVHHDPSRALGDLTGIKKHFSRKHGEKKWKCEKCSKKYAVQSDWKAHSKTCGTREYKCDCGTLFSRKDSFITHRAFCDALAEESARFSSVAGAATNLNFRNDVVNLPIGFGGIPQFGSGFTQDVSGMTVSSL

SEQ ID NO: 1162 - DNA, 960 bp, Arabidopsis thaliana
  misc_feature (1)..(960): Ceres CLONE ID no.  98716
  misc_feature (1)..(960): GEMINI ID 533A2
aactgtcttagagaaagaaaaaaaaacaaaactagctcacaaaaaggaaatcatattttgatttaatttgtagtgtctctaatggcacggtttgagccatataactataataatggtcatgatcctttctttgcacacattaaccaaaatccagagctaataaatctggacttaccagcttctaccccttccagtttcatgcttttctccaatggagctttagttgatgccaatcacaataattctcacttcttcccaaatttattgcacggtaatacgagaagaaaaggaaataaagaagagagtgggtcgaagagaagaagaaagaggtcggaagaggaagaagccatgaatggagatgagactcagaagccaaaagatgttgttcatgtccgagctaagagaggtcaagctactgatagccatagtttggctgaaagggtacgaagagagaagatcaatgaaaggctgaaatgcttacaagaccttgttccaggatgctacaaggcaatgggaatggcagtgatgcttgatgtcatcatagattatgtacgatcactccagaatcaaatcgagtttttgtccatgaaactctcagcggcaagtgcatgttacgaccttaattctttggatattgagccaacggatatatttcagggagggaatattcatagtgcagcagagatggaaaggattttaagagaaagcgttggaacacagcctcctaatttcagttcaacattacccttttgatcataagaaaattatgaattttcagagaaattattctctttttctataattaaactccataaataaggacttaccatgatcagtatatataggtttatctatcttttgtgtgtgacgtcagtatacttttatcataaatgtgtaaccttatgattatgaagcttatccatatagtatgtaccatgaaaatgagtaaagctatatgtt

SEQ ID NO: 1163 - protein, 223 aa, Arabidopsis thaliana
  misc_feature (1)..(223): Ceres CLONE ID no.  98716
  misc_feature (1)..(223): GEMINI ID 533A2
  misc_feature (111)..(161): Pfam Name: HLH Pfam Description: Helix-loop-helix DNA-binding domain
MARFEPYNYNNGHDPFFAHINQNPELINLDLPASTPSSFMLFSNGALVDANHNNSHFFPNLLHGNTRRKGNKEESGSKRRRKRSEEEEAMNGDETQKPKDVVHVRAKRGQATDSHSLAERVRREKINERLKCLQDLVPGCYKAMGMAVMLDVIIDYVRSLQNQIEFLSMKLSAASACYDLNSLDIEPTDIFQGGNIHSAAEMERILRESVGTQPPNFSSTLPF

SEQ ID NO: 1164 - DNA, 1170 bp, Arabidopsis thaliana
  misc_feature (1)..(1170): Ceres CLONE ID no.  99033
  misc_feature (1)..(1170): GEMINI ID 53200
gaaagaaacatcaaactcctaaaagagaagcctttaaagtttttttttaatcaaaaacaaaaagaagaaaattttcctttttgttttagatggcatgaatcatcatcatcgctttgctttcttgattctctatttcgtttgatgggatttgtttttctgggaatttattcattcacctgctgccatggctaaattatctttcaaggattctcttaaagctcttgaagccgatattcaacacgctaatacactagctttagattatcctcgggagaaggatggagcgcgcgttcagatgagattatcatacagcccgactgctcaattttttctttttcttgtacaatggactgattgtaagcttgctggtttcctcggtttactcagagttcttatttatatgacttatgcagatgggaaaacaaccatgtcggtttacgaaagaaaagccagtattagagagttccaagctgtgatattaccatctttgtcacaactacaaaggggtgttacagacatagatgacagcaaacaaaaagaggtatgcaagatgcgatacagaaagaaggatgagagcgaaatgtcggagattgagatcgagagggaagaagaatgtggaatctgtatggagatgaacagcaaggtggtgctaccaaactgtactcattctttatgcatcaagtgttaccgcgattggcgagggagatcacagtcatgcccgttctgcagagacagccttaaaagagtagattcaggtgatctctggatgtttttggaccaaaacgatacagtgaatctcactgcaatcgctagagagaaccagaaacgattgtttatgtacattgagaagttaccactagtggttccagatcaagtgtatgcgtcttctccttacgatttccatgtgagatgaaggcggaaaaccggttctggtaaatctttatctgtatacttggggaaaaggaggacttgttttgtatatgtattagagttagtacaagtagtagtaatcagtcactttcttcaccattatcttgggaaggttccacttactacgtgctttttctgcattttgctttggtttccttctatctcgtaaagcttcaagaagctcatgtatagttagcaatttatgaacttaaacctcctcatcaagaagagtgtttcacc

SEQ ID NO: 1165 - protein, 242 aa, Arabidopsis thaliana
  misc_feature (1)..(242): Ceres CLONE ID no.  99033
  misc_feature (1)..(242): GEMINI ID 53200
  misc_feature (144)..(181): Pfam Name: zf-C3HC4 Pfam Description: Zinc finger, C3HC4 type (RING finger)
MAKLSFKDSLKALEADIQHANTLALDYPREKDGARVQMRLSYSPTAQFFLFLVQWTDCKLAGFLGLLRVLIYMTYADGKTTMSVYERKASIREFQAVILPSLSQLQRGVTDIDDSKQKEVCKMRYRKKDESEMSEIEIEREEECGICMEMNSKVVLPNCTHSLCIKCYRDWRGRSQSCPFCRDSLKRVDSGDLWMFLDQNDTVNLTAIARENQKRLFMYIEKLPLVVPDQVYASSPYDFHVR

SEQ ID NO: 1166 - protein, 227 aa, Arabidopsis thaliana
  misc_feature (1)..(227): Public GI no. 79331357
  misc_feature (1)..(227): Functional Homolog of  Ceres CLONE ID no.  99033
  misc_feature (129)..(166): Pfam Name: zf-C3HC4 Pfam Description: Zinc finger, C3HC4 type (RING finger)
MAKLSFKDSLKALEADIQHANTLALDYPREKDGARVQMRLSYSPTAQFFLFLVQWTDCKLAGFLGLLRVLIYMTYADGKTTMSVYERKASIREFQDIDDSKQKEVCKMRYRKKDESEMSEIEIEREEECGICMEMNSKVVLPNCTHSLCIKCYRDWRGRSQSCPFCRDSLKRVDSGDLWMFLDQNDTVNLTAIARENQKRLFMYIEKLPLVVPDQVYASSPYDFHVR

SEQ ID NO: 1167 - protein, 245 aa, Arabidopsis thaliana
  misc_feature (1)..(245): Public GI no. 21618121
  misc_feature (1)..(245): Functional Homolog of  Ceres CLONE ID no.  99033
MAKVSFKDSLKALEADIQHANTVALDYPREKDGARVQMRLSYTPAAQFLLFLVQWTDCHLAGTLGLLRVLIYMTYADGKTTMSVYERKTSIKDFYAVIFPSLLQLERGITDLDDRKQKEVCKIRYRNKDESEKVKLSEIDIEREEECGICMEMNNMVVLPNCTHSLCIKCYRDWHGRSESCPFCRDSLKRVNSGDLWMLMEKSDTVNMYTIERENKKRLFVYIEKLPLVVPDQVFASSPYDCHVK

SEQ ID NO: 1168 - protein, 245 aa, Arabidopsis thaliana; identical to SEQ ID NO: 1167
  misc_feature (1)..(245): Ceres CLONE ID no. 9763
  misc_feature (1)..(245): Functional Homolog of  Ceres CLONE ID no.  99033

SEQ ID NO: 1169 - protein, 245 aa, Arabidopsis thaliana
  misc_feature (1)..(245): Public GI no. 20466304
  misc_feature (1)..(245): Functional Homolog of  Ceres CLONE ID no.  99033
MAKVSFKDSLKALEADIQHANTVALDYPREKDGARVQMRLSYTPAAQFLLFLVQWTDCHLAGTLGLLRVLIYMTYADGKTTMSVYERKTSIKDFYAVIFPSLLQLERGITDLDDRKQKEVCKIRYRNKDETEKVKLSEIDIEREEECGICMEMNNMVVLPNCTHSLCIKCYRDWHGRSESCPFCRDSLKRVNSGDLWMLMEKSDTVNMYTIERENKKRLFVYIEKLPLVVPDQVFASSPYDCHVK

SEQ ID NO: 1170 - DNA, 1022 bp, Gossypium hirsutum
  misc_feature (1)..(1022): Ceres CLONE ID no.1840223
ttacgaggtttttctcgaaattacaataataccaatttgtttctctctttattttcccttttgattcggataattggggggtctagtttgaagaattttccttttgagggtttcactttagctgtctgatttgtgtgtgtttgtttgatgggaataattttccgggaaaatacccggtcatgggaaagttatcttttaaggattcactaaaagcgctcgaagctgatattcaacacgccaatactctggcttttgattatccgagggagaaagatggagcacgacttcaaatgagactgtcttacagccctgcagctcagtttttccttttccttgttcagtggaccgactgccaactagccggtgcccttggtttgctccggatacttatttatatgacctatgccgatggcaagaccaccatgtctgtgtatgagaggaaagccagcattagagagttttatgcggtaatattcccgtctttattgcaacttcaaaaaggcattaccagtttggaagataggaaacagaaagaagtgtgtaccatgaggtaccgtaagaaggatgaatccgagagggggaaactctctgaaattgacttagaaagggaagaagagtgtgggatttgcttggagatgagcagcatggttgttttgcctaactgtagccattctctgtgtttgaagtgttatcgggattggcacggccggtctcagtcatgtcccttctgtcgggacagtctcaaaagggtcaactcatgtgacctttggatttacaccgagaagagcgagatcgttgatttgtcactgatattgagagagaattctaataggctcttcatgtacattgataaattgccgcttattgttccagaccctgtatttgttccttatgatgttcatgttaggtgattgcttcagtgtagggcatcataattgcctgtatatatataaaactagcatgactgtatatcaatctatatataatcatacttgccattctaaaaaaaaaaaaaaaaaaaa

SEQ ID NO: 1171 - protein, 243 aa, Gossypium hirsutum
  misc_feature (1)..(243): Ceres CLONE ID no. 1840223
  misc_feature (1)..(243): Functional Homolog of  Ceres CLONE ID no.  99033
  misc_feature (147)..(184): Pfam Name: zf-C3HC4 Pfam Description: Zinc finger, C3HC4 type (RING finger)
MGKLSFKDSLKALEADIQHANTLAFDYPREKDGARLQMRLSYSPAAQFFLFLVQWTDCQLAGALGLLRILIYMTYADGKTTMSVYERKASIREFYAVIFPSLLQLQKGITSLEDRKQKEVCTMRYRKKDESERGKLSEIDLEREEECGICLEMSSMVVLPNCSHSLCLKCYRDWHGRSQSCPFCRDSLKRVNSCDLWIYTEKSEIVDLSLILRENSNRLFMYIDKLPLIVPDPVFVPYDVHVR

SEQ ID NO: 1172 - DNA, 732 bp, Populus balsamifera subsp. trichocarpa
  misc_feature (1)..(732): Ceres ANNOT ID no. 1514944
atgggaaagttgtctttcaaggattctctcaaagctctcgaagctgatatccagcacgccaatactcttgctttagatcatccaagggagaacgacggagctcgccttcagatgcgattatcctatagcccagcagcccaattttttctctttcttgtgcagtggactgattgtaaccttgctggtgcccttggtttgctaagaattcttatttatcttacctatgcagatgggaaaactactatgtctgttcaggaaagaaaagctagcattagagaattttatgcggtgatatttccttctttactgcaacttcaaggaggaatcacggatgtggatgacaggaaacagaaagaagtatgtactatgagatatagaagaaaggatgagttggagaaggggaaactctcagaagtcgatatagaaagagaagaagagtgtgggatttgcatggaaatgaacaacaaggttgtgttgcctacttgcagtcattctttgtgtttgaggtgctatcgggattggcgtgggcggtctcaatcatgccccttttgtcgcggtagtcttaaaagggtcaattctggcgacctttggatctatgcagagaagtctgacgttgtcgatttagccttgattacgagacagaattgcaagaggctgttcatgtacattgataagctgccccttattattccagatactgtatatatgccctatgattctcatgtgaagtag

SEQ ID NO: 1173 - protein, 243 aa, Populus balsamifera subsp. trichocarpa
  misc_feature (1)..(243): Ceres ANNOT ID no. 1514944
  misc_feature (1)..(243): Functional Homolog of  Ceres CLONE ID no.  99033
  misc_feature (147)..(184): Pfam Name: zf-C3HC4 Pfam Description: Zinc finger, C3HC4 type (RING finger)
MGKLSFKDSLKALEADIQHANTLALDHPRENDGARLQMRLSYSPAAQFFLFLVQWTDCNLAGALGLLRILIYLTYADGKTTMSVQERKASIREFYAVIFPSLLQLQGGITDVDDRKQKEVCTMRYRRKDELEKGKLSEVDIEREEECGICMEMNNKVVLPTCSHSLCLRCYRDWRGRSQSCPFCRGSLKRVNSGDLWIYAEKSDVVDLALITRQNCKRLFMYIDKLPLIIPDTVYMPYDSHVK

SEQ ID NO: 1174 - protein, 255 aa, Oryza sativa
  misc_feature (1)..(255): Public GI no. 90399248
  misc_feature (1)..(255): Functional Homolog of  Ceres CLONE ID no.  99033
  misc_feature (152)..(189): Pfam Name: zf-C3HC4 Pfam Description: Zinc finger, C3HC4 type (RING finger)
MVLCSMRKSFKDSLKVLEADIQHANTLASDFSRDYDGACLQMRMSYSPAAQFFLFLVQWTDCSLAGALGLLRILIYKVYVDGTTTLSTHERKASIREFYAVIFPSLMQLHKGISDVDDRRQKAICTERYRRRDEDESKRHVSEIDVEREEECGICMEMNNKVVLPNCSHAMCMKCYRQWRSRSQSCPFCRDSLKRVNSGDLWMLTDDRDVIDMATITRENLRRLFMYIEKLPLVAPDNIFYAYDSHRMFLVVGCG

SEQ ID NO: 1175 - DNA, 1373 bp, Panicum virgatum
  misc_feature (1)..(1373): Ceres CLONE ID no.1827510
aagcgaagcgagcggaaagccgaggcggcgagagtggagccaaaaagcgggcggcaccgcaccgcaccgcccgccaccaccgcaggaggagccgagcctttcggtgtgggggtgggggtggtggagccttgtcgcggtccagcggctagccggctaggggtggggttcctccgcgcctgctcgctactacttcattccatggcggccgggccggctgaaccctgacagcggcggcgggcggtgtggaggcgcgagaacaagccacggcgaggcggagatggtggtgtgctccatgcgcaagtcgtcgttcaaggactcgctcaaggtgctcgaggccgacatccaccacgccaacaccctggcagctgatttctccagggactacgatggggcctgcctccagatgcggatgtcctacagccccgccgcgcacttcttcctcttcctcgtgcagtggaccgattgcagcctcgccggcgcgctcgggctgctcaggatcctaatctacaaggtttatgtggatgggagtaccactatgtccacacatgagaggaaagcaagcatcagagaattttatgctgttatatttccatccctcatgcaactgcccaaggggatcagcgacctcgatgaccggaggcagaaggcggtctgcacagagagatacaggaggagagaccaggacgagagcaagaggccagtttctgagattgatgtcgagagggaggaggaatgtggcatttgcatggagatgaacagcaaggtggtgctgcccacctgcagccatgctatgtgcatcaagtgctaccgccaatggcgctccagatcccagtcctgccccttctgtcgtgacagcctcaagcgagtaaattccggtgacctgtggatgttcactgactgccgagacgtagttgacatggctacggtgagcagagagaacatcaggcgcctgtttatgtacatcgagaagctgcctctggtcatgccggaaaacatcttctacgcctatgattctcatgtaaaatagctcgagctgcacatgatgacttgctcaccattgttttctgagagtgatgacgcatggcttattgattcatgcagaggatgttcctcgtcctaggatgtggctaatcttggagcagcctgtggactctgacaagagaccttgagagctctgactgggtgtagagtcttgttcaggtttttgtaaatgtgctgtacatatttatggtgcaatgaaaaatctttagggaaaaagcgttgtgttccaagtagggaagctctggctgagatacacttggtgcatgtattgggttcgattttaagcttgaaatgctctgtagtttaaactggaaaaaaaaaaaaaaaaaaaa

SEQ ID NO: 1176 - protein, 244 aa, Panicum virgatum
  misc_feature (1)..(244): Ceres CLONE ID no. 1827510
  misc_feature (1)..(244): Functional Homolog of  Ceres CLONE ID no.  99033
  misc_feature (148)..(185): Pfam Name: zf-C3HC4 Pfam Description: Zinc finger, C3HC4 type (RING finger)
MRKSSFKDSLKVLEADIHHANTLAADFSRDYDGACLQMRMSYSPAAHFFLFLVQWTDCSLAGALGLLRILIYKVYVDGSTTMSTHERKASIREFYAVIFPSLMQLPKGISDLDDRRQKAVCTERYRRRDQDESKRPVSEIDVEREEECGICMEMNSKVVLPTCSHAMCIKCYRQWRSRSQSCPFCRDSLKRVNSGDLWMFTDCRDVVDMATVSRENIRRLFMYIEKLPLVMPENIFYAYDSHVK

SEQ ID NO: 1177 - protein, 247 aa, Glycine max
  misc_feature (1)..(247): Ceres CLONE ID no. 467336
  misc_feature (1)..(247): Functional Homolog of  Ceres CLONE ID no.  99033
  misc_feature (151)..(188): Pfam Name: zf-C3HC4 Pfam Description: Zinc finger, C3HC4 type (RING finger)
MYVASMRKSFKDSLKVLEADIQHANTLASDFPREYDGACLQMRMSYSPAAHLFLFLVQWTDCHLAGALGLLRILIYKVYVDGTTTMSTHERKASIREFYAVIYPSLLQLEKGVTDTEDKKQKAVCMERYRRRDDEEYRQSSDIDIEREDECGICMDMNSKIVLPNCNHAMCLKCYREWRTISQSCPFCRDSLKRVNSGDLWVFTDRRDVVDMATVTRENLRRLFMYIDKLPLIVPDSLFDTYDSHIR

SEQ ID NO: 1178 - protein, 247 aa, Glycine max
  misc_feature (1)..(247): Ceres CLONE ID no. 481884
  misc_feature (1)..(247): Functional Homolog of  Ceres CLONE ID no.  99033
  misc_feature (151)..(188): Pfam Name: zf-C3HC4 Pfam Description: Zinc finger, C3HC4 type (RING finger)
MYVASMRKSFKDSLKVLEADIQHANTLASDFPREYDGACLQMRMSYSPAAHLFLFLVQWTDCHLAGALGLLRILIYKVYVDGTTTMSTHERKASIREFYAVIYPSLLQLEKGVTDTEDKKQKVVCMERYRRRDDEEYRQSSDIDIEREDECGICMDMNSKIVLPNCNHAMCLKCYREWRTISQSCPFCRDSLKRVNSGDLWVFTDRRDVVDMATVTRENLRRLFMYIDKLPLIVPDSLFDTYDSHIR

SEQ ID NO: 1179 - protein, 242 aa, Oryza sativa
  misc_feature (1)..(242): Public GI no. 22165059
  misc_feature (1)..(242): Functional Homolog of  Ceres CLONE ID no.  99033
  misc_feature (146)..(183): Pfam Name: zf-C3HC4 Pfam Description: Zinc finger, C3HC4 type (RING finger)
MRKAYKDSFKVLEADIQHANTLASEFPREYDGACLQMRLSYSPAAHIFLFLVQWTDCSLAGALGLLRILVYKVYVDGTTTMSTHERKASIKEFYAVIFPSLLQLQRGITDTEDKKQKAVCMERYRRRDEDERNILSEIDAEREEECGICMEMNSKVVLPNCTHNMCLRCYQDWNSRSQSCPFCRDNLKKTDPGDLWIYVEDQDVVDLETVSRENLRRLFMYINKLPLIVPDVIFSIYDSHIK

SEQ ID NO: 1180 - protein, 242 aa, Zea mays
  misc_feature (1)..(242): Ceres CLONE ID no. 1555943
  misc_feature (1)..(242): Functional Homolog of  Ceres CLONE ID no.  99033
  misc_feature (146)..(183): Pfam Name: zf-C3HC4 Pfam Description: Zinc finger, C3HC4 type (RING finger)
MRKAYRDSIKVLEADIQHANTLASEFPRDYDGACLQMRLSYSPAAHIFLFLVQWTDCSLAGALGLLRILIYKVYVDGTTTMSTHERKASIKEFYAVIFPSLLQLQRGITDVEDKKQKAICMEKYRKKDEDGRDTLSDIDVEREEECGICMEMNSKVVLPNCTHAMCIRCYQDWSSRSQSCPFCRDNLKKTCPGDLWIYVEDQDVVDMETVSSENLRRLFMYISKLPLIVPDVIFSVYDSHIK

SEQ ID NO: 1181 - protein, 243 aa, Medicago truncatula
  misc_feature (1)..(243): Public GI no. 9294812
  misc_feature (1)..(243): Functional Homolog of  Ceres CLONE ID no.  99033
  misc_feature (147)..(184): Pfam Name: zf-C3HC4 Pfam Description: Zinc finger, C3HC4 type (RING finger)
MGKSLFQESLKALEADIQYANTLALGHPRDKEGGCFQMRLSYSPVAPLFLSLVQWTDYRLAGALGLLRILIYVTYGNGKTTISIYERKASIRQFYSIIFPALLQLQKGVTDLEERKQKEVYANRYQKKTDFKDRRESKIDIEREKECGVCLEVKAKVVLPNCCHQMCFKCYREWCLRSQSCPFCRDSLKRVNSGDLWIYTDTSDIVDVGTIFKENCKILFLYIEKLPLIIPDPRHVSYDPFFR

SEQ ID NO: 1182 - DNA, 1163 bp, Arabidopsis thaliana
  misc_feature (1)..(1163): Ceres CLONE ID no.  99612
  misc_feature (1)..(1163): GEMINI ID 532G2
aatttcataaatcatagagagagagagagagagagagagagagtttggaaacattccaaaaccagaactcgatattatttcaccaaagaatgatagaaacaagaactatctttttataaaactctttacaccccaaaagaaaatgtctcactcgttttgccttataatatttctttcaacaacaacccaaatctacaaaaaatcccaataaaaaaaaacttcagtctgtttgacattttgtcgaacacttggacggcatcacaaaaagctctaaactttctgactaccaatggcggattcgtcttccgacaaggagaagaaggaaaataataagcagcccgtgtatcgtggagtccgtatgaggagctggggaaaatgggtatcggagattcgcgaaccgaggaagaaatcgagaatctggctcgggacttttccgacggcggagatggctatgcgtgctcacgacgtggcggctatgagtatcaaaggaacttcagccattctcaatttccctgagctctctaaacttcttccccgacccgtttcgctcagccctcgtgacgtcagagctgcggcgaccaaagctgctctcatggacttcgatacgacggcgtttcgttcggatactgagactagcgaaacgacgacgtcgaataaaatgtcagagagtagtgagagtaacgaaacggtgtcgttctcatcgtcgtcttggtcctctgttacgagcattgaggaaagtacagtctccgacgatcttgacgagatcgtaaagttaccgagtctaggaacgagcctaaacgagtcgaacgagttcgtgatatttgactcgttggaggatttggtgtacatgcctcggtggttaagcggtacggaagaagaagtttttacgtataataacaatgattcttcgttgaattactcatcagttttcgaatcttggaaacattttccctgagaaaagaaagaagccatattttctctctctttttcgccatttttggttttaagttttttgatgggattctctctgtttttgctatgcgtgagatatctctctttgtggaatagataacttttctgttgaaaatctcctaagtctgtgaaatgaacgacgatggaaatgtaagtgtgtatattagcccgaaataatgactgtatacatt

SEQ ID NO: 1183 - protein, 169 aa, Arabidopsis thaliana
  misc_feature (1)..(169): Ceres CLONE ID no.  99612
  misc_feature (1)..(169): GEMINI ID 532G2
MAMRAHDVAAMSIKGTSAILNFPELSKLLPRPVSLSPRDVRAAATKAALMDFDTTAFRSDTETSETTTSNKMSESSESNETVSFSSSSWSSVTSIEESTVSDDLDEIVKLPSLGTSLNESNEFVIFDSLEDLVYMPRWLSGTEEEVFTYNNNDSSLNYSSVFESWKHFP

SEQ ID NO: 1184 - DNA, 549 bp, Arabidopsis thaliana
  misc_feature (1)..(549): Ceres CLONE ID no. 3929
  misc_feature (1)..(549): GEMINI ID 531B7
atcacttacttaacatactaagagagttattagaacttgcaaaaaatggcttccaaggctttgattctgttaggtctcttctcagttcttctcgtcgtctccgaagtgtctgccgcaaggmaatcgggcatggtgaagccagagagtgaggaaactgtgcaacctgaaggttatggcggtggccacggaggacatggtggtcacggagggggaggaggccacggacatggaggacacaacggaggagggggccacggacttgacggatacggaggaggtggaggacactatggaggaggtggaggacactacggaggaggtggaggacactacggaggaggtggaggacactacggaggaggtggccacgggctaaacgaacctgttcagactaagccgggtgtttaaaactatataatatcttcactaccatgcatgattgcatatatatatatacgcttatgtattatctatatgcctataaataaaccatggtgagtttgtaacgcagtgccttcagaaatgttcggaataaatttccataatatt

SEQ ID NO: 1185 - protein, 120 aa, Arabidopsis thaliana
  misc_feature (1)..(120): Ceres CLONE ID no. 3929
  misc_feature (1)..(120): GEMINI ID 531B7
  misc_feature (1)..(106): Pfam Name: GRP Pfam Description: Glycine rich protein family
  misc_feature (26)..(26): Xaa is any aa, unknown, or other
MASKALILLGLFSVLLVVSEVSAARXSGMVKPESEETVQPEGYGGGHGGHGGHGGGGGHGHGGHNGGGGHGLDGYGGGGGHYGGGGGHYGGGGGHYGGGGGHYGGGGHGLNEPVQTKPGV

SEQ ID NO: 1186 - protein, 120 aa, Arabidopsis thaliana; identical to SEQ ID NO: 1185
  misc_feature (1)..(120): Ceres CDNA ID  no. 23389966
  misc_feature (1)..(120): Functional Homolog of  Ceres  ID no. 3929
  misc_feature (1)..(106): Pfam Name: GRP Pfam Description: Glycine rich protein family
  misc_feature (26)..(26): Xaa is any aa, unknown, or other

SEQ ID NO: 1187 - protein, 127 aa, Arabidopsis thaliana
  misc_feature (1)..(127): Public GI no. 20197615
  misc_feature (1)..(127): Functional Homolog of  Ceres  ID no. 3929
  misc_feature (1)..(113): Pfam Name: GRP Pfam Description: Glycine rich protein family
MASKALILLGLFSVLLVVSEVSAARQSGMVKPESEETVQPEGYGGGHGGHGGHGGGGGHGHGGHNGGGGHGLDGYGGGGGHYGGGGGHYGGGGGHYGGGGGGYGGGGGHHGGGGHGLNEPVQTKPGV

SEQ ID NO: 1188 - protein, 120 aa, Arabidopsis thaliana
  misc_feature (1)..(120): Ceres CLONE ID  no. 18215
  misc_feature (1)..(120): Functional Homolog of  Ceres  ID no. 3929
  misc_feature (1)..(100): Pfam Name: GRP Pfam Description: Glycine rich protein family
MASKALILLGLFSVLLVVSEVSAARQSGMVKPESEETVQPEGYGGGHGGHGGHGGGGGHGHGGHNGGGGHGLDGYGGGGGHYGGGGGHYGGGGGGYGGGGGHHGGGGHGLNEPVQTKPGV

SEQ ID NO: 1189 - protein, 127 aa, Arabidopsis thaliana
  misc_feature (1)..(127): Public GI no. 21536606
  misc_feature (1)..(127): Functional Homolog of  Ceres  ID no. 3929
  misc_feature (1)..(113): Pfam Name: GRP Pfam Description: Glycine rich protein family
MASKALILLGLFSVLLVVSEVSSARQSGMVKPESEETVQPEGYGGGHGGHGGHGGGGGHGHGGHNGGGGHGLDGYGGGGGHYGGGGGHYGGGGGHYGGGGGGYGGGGGHHGGGGHGLNEPVQTKPGV

SEQ ID NO: 1190 - protein, 127 aa, Arabidopsis thaliana; identical to SEQ ID NO: 1189
  misc_feature (1)..(127): Ceres CLONE ID  no. 105261
  misc_feature (1)..(127): Functional Homolog of  Ceres  ID no. 3929
  misc_feature (1)..(113): Pfam Name: GRP Pfam Description: Glycine rich protein family

SEQ ID NO: 1191 - protein, 120 aa, Arabidopsis thaliana; identical to SEQ ID NO: 1188
  misc_feature (1)..(120): Ceres CLONE ID  no. 23214
  misc_feature (1)..(120): Functional Homolog of  Ceres  ID no. 3929
  misc_feature (1)..(100): Pfam Name: GRP Pfam Description: Glycine rich protein family

SEQ ID NO: 1192 - protein, 110 aa, Arabidopsis thaliana
  misc_feature (1)..(110): Ceres CLONE ID  no. 207629
  misc_feature (1)..(110): Functional Homolog of  Ceres  ID no. 3929
  misc_feature (1)..(110): GEMINI ID 83D4
  misc_feature (1)..(96): Pfam Name: GRP Pfam Description: Glycine rich protein family
MASKALILLGLFSVLLVVSEVSAARQSGMVKPESEETVQPEGYGGGHGGHGGHGGGGGHGHGGHNGGGGHGLDGYGGHYGGGGGGYGGGGGHHGGGGHGLNEPVQTKPGV

SEQ ID NO: 1193 - protein, 123 aa, Arabidopsis thaliana
  misc_feature (1)..(123): Ceres CLONE ID  no. 24667
  misc_feature (1)..(123): Functional Homolog of  Ceres  ID no. 3929
  misc_feature (1)..(90): Pfam Name: GRP Pfam Description: Glycine rich protein family
MASKALILLGLFSVLLVVSEVSAARQSGMVKPESEETVQPEGYGGGHGGHGGHGGGGGHGHGGHYGGGGGHYGGGGGHYGGGGGGHGGGGHYGGGGGGYGGGGGHHGGGGHGLNEPVQTKPGV

SEQ ID NO: 1194 - protein, 112 aa, Arabidopsis thaliana
  misc_feature (1)..(112): Ceres CLONE ID  no. 1006473
  misc_feature (1)..(112): Functional Homolog of  Ceres  ID no. 3929
  misc_feature (1)..(112): Pfam Name: GRP Pfam Description: Glycine rich protein family
MASKALILLGLFSVLLVVSEVSAARQSGMVKPESEETVQPEGYGGGHGGHGGHGGGGGHGHGGHNGGGGHGLDGYGGGGGHYGGGGGGHGGGGHYGGGGGGYGGGGGHHGGG

SEQ ID NO: 1195 - protein, 120 aa, Arabidopsis thaliana
  misc_feature (1)..(120): Ceres CLONE ID  no. 118878
  misc_feature (1)..(120): Functional Homolog of  Ceres  ID no. 3929
  misc_feature (1)..(100): Pfam Name: GRP Pfam Description: Glycine rich protein family
  misc_feature (26)..(26): Xaa is any aa, unknown, or other
  misc_feature (76)..(76): Xaa is any aa, unknown, or other
MASKALILLGLFSVLLVVSEVSAARXSGMVKPESEETVQPEGYGGGHGGHGGHGGGGGHGHGGHNGGGGHGLDGYXGGGGHYGGGGGHYGGGGGGYGGGGGHHGRAESTPLKPLSYQFLR

SEQ ID NO: 1196 - protein, 127 aa, Arabidopsis thaliana
  misc_feature (1)..(127): Ceres CLONE ID  no. 12459
  misc_feature (1)..(127): Functional Homolog of  Ceres  ID no. 3929
  misc_feature (1)..(113): Pfam Name: GRP Pfam Description: Glycine rich protein family
MASKALILLGLFAILLVVSEVSAARQSGMVKPESEETVQPEGYHGGHGGHGGGGHYGGGGHGHGGHNGGGGHGLDGYGGGHGGHYGGGGGHYGGGGGHGGGGHYGGGGHHGGGGHGLNEPVQTKPGV

SEQ ID NO: 1197 - protein, 127 aa, Arabidopsis thaliana
  misc_feature (1)..(127): Ceres CLONE ID  no. 1354021
  misc_feature (1)..(127): Functional Homolog of  Ceres  ID no. 3929
  misc_feature (1)..(113): Pfam Name: GRP Pfam Description: Glycine rich protein family
MASKALILLGLFAILLVVSEVSAARQSGMVKPESEATVQPEGYHGGHGGHGGGGHYGGGGHGHGGHNGGGGHGLDGYGGGHGGHYGGGGGHYGGGGGHGGGGHYGGGGHHGGGGHGLNEPVQTKPGV

SEQ ID NO: 1198 - protein, 127 aa, Arabidopsis thaliana; identical to SEQ ID NO: 1197
  misc_feature (1)..(127): Public GI no. 30017217
  misc_feature (1)..(127): Functional Homolog of  Ceres  ID no. 3929
  misc_feature (1)..(113): Pfam Name: GRP Pfam Description: Glycine rich protein family

SEQ ID NO: 1199 - protein, 160 aa, Arabidopsis thaliana
  misc_feature (1)..(160): Ceres CLONE ID  no. 109026
  misc_feature (1)..(160): Functional Homolog of  Ceres  ID no. 3929
  misc_feature (1)..(113): Pfam Name: GRP Pfam Description: Glycine rich protein family
  misc_feature (26)..(26): Xaa is any aa, unknown, or other
  misc_feature (27)..(27): Xaa is any aa, unknown, or other
  misc_feature (52)..(52): Xaa is any aa, unknown, or other
  misc_feature (87)..(87): Xaa is any aa, unknown, or other
  misc_feature (94)..(94): Xaa is any aa, unknown, or other
MASKALILLGLFAILLVVSEVSAARXXGMVKPESEETVQPEGYHGGHGGHGXGGHYGGGGHGHGGHNGGGGHGLDGYGGGHGGHYGXGGGHYGXGGGHGGGGHYGGGGHHGGGGHGLNEPVQTKGEEQEAGKKGFHSDTQRLLNLSLETNLTLVAMTLAM

SEQ ID NO: 1200 - protein, 160 aa, Arabidopsis thaliana; identical to SEQ ID NO: 1199
  misc_feature (1)..(160): Ceres CLONE ID  no. 109026
  misc_feature (1)..(160): Functional Homolog of  Ceres  ID no. 3929
  misc_feature (1)..(113): Pfam Name: GRP Pfam Description: Glycine rich protein family
  misc_feature (26)..(26): Xaa is any aa, unknown, or other
  misc_feature (27)..(27): Xaa is any aa, unknown, or other
  misc_feature (52)..(52): Xaa is any aa, unknown, or other
  misc_feature (87)..(87): Xaa is any aa, unknown, or other
  misc_feature (94)..(94): Xaa is any aa, unknown, or other

SEQ ID NO: 1201 - protein, 133 aa, Arabidopsis thaliana
  misc_feature (1)..(133): Ceres CLONE ID no. 118184
  misc_feature (1)..(133): Functional Homolog of  Ceres  ID no. 3929
  misc_feature (1)..(133): GEMINI ID 549H3
  misc_feature (1)..(99): Pfam Name: GRP Pfam Description: Glycine rich protein family
MASKALILLGLFSVLLVVSEVSAARQSGMVKPESEETVQPEGYGGGHGGHGGHGGGGGHGHGGHNGGGGHGLDGYGGGGGHYGGGGGHYGGGGGHYGGGGGHYGGGGGGHGGGGHYGGGGHGLNEPVQTKPGV

SEQ ID NO: 1202 - protein, 120 aa, Arabidopsis thaliana; identical to SEQ ID NO: 1195
  misc_feature (1)..(120): Ceres CLONE ID no. 118878
  misc_feature (1)..(120): Functional Homolog of  Ceres  ID no. 3929
  misc_feature (1)..(100): Pfam Name: GRP Pfam Description: Glycine rich protein family
  misc_feature (26)..(26): Xaa is any aa, unknown, or other
  misc_feature (76)..(76): Xaa is any aa, unknown, or other

SEQ ID NO: 1203 - protein, 127 aa, Arabidopsis thaliana; identical to SEQ ID NO: 1196
  misc_feature (1)..(127): Ceres CLONE ID no. 12459
  misc_feature (1)..(127): Functional Homolog of  Ceres  ID no. 3929
  misc_feature (1)..(113): Pfam Name: GRP Pfam Description: Glycine rich protein family

SEQ ID NO: 1204 - protein, 127 aa, Arabidopsis thaliana; identical to SEQ ID NO: 1197
  misc_feature (1)..(127): Ceres CLONE ID no. 1354021
  misc_feature (1)..(127): Functional Homolog of  Ceres  ID no. 3929
  misc_feature (1)..(113): Pfam Name: GRP Pfam Description: Glycine rich protein family

SEQ ID NO: 1205 - protein, 127 aa, Arabidopsis thaliana; identical to SEQ ID NO: 1197
  misc_feature (1)..(127): Public GI no. 30017217
  misc_feature (1)..(127): Functional Homolog of  Ceres  ID no. 3929
  misc_feature (1)..(113): Pfam Name: GRP Pfam Description: Glycine rich protein family

SEQ ID NO: 1206 - protein, 160 aa, Arabidopsis thaliana; identical to SEQ ID NO: 1199
  misc_feature (1)..(160): Ceres CLONE ID no. 109026
  misc_feature (1)..(160): Functional Homolog of  Ceres  ID no. 3929
  misc_feature (1)..(113): Pfam Name: GRP Pfam Description: Glycine rich protein family
  misc_feature (26)..(26): Xaa is any aa, unknown, or other
  misc_feature (27)..(27): Xaa is any aa, unknown, or other
  misc_feature (52)..(52): Xaa is any aa, unknown, or other
  misc_feature (87)..(87): Xaa is any aa, unknown, or other
  misc_feature (94)..(94): Xaa is any aa, unknown, or other

SEQ ID NO: 1207 - protein, 126 aa, Arabidopsis thaliana
  misc_feature (1)..(126): Public GI no. 1252961811
  misc_feature (1)..(126): Functional Homolog of  Ceres  ID no. 3929
  misc_feature (1)..(112): Pfam Name: GRP Pfam Description: Glycine rich protein family
MASKALILLGLFAILLWSEVSAARQSGMVKPESEATVQPEGYHGGHGGHGGGGHYGGGGHGHGGHNGGGGHGLDGYGGGHGGHYGGGGGHYGGGGGHGGGGHYGGGGHHGGGGHGLNEPVQTKPGV

SEQ ID NO: 1208 - DNA, 648 bp, Panicum virgatum
  misc_feature (1)..(648): Ceres CLONE ID no.1767187
atcataatcccacacagatcaagtgctcatcttgaaggccagggatggcttccgattccaagtctctgcttctgattggcgtcgtcctggcttccctcctcctcgtcaccaaggatgtggctgctgctagaaatcacttcatcgaggacaaggaatctgaggcaaagaacatgaagattaatggtgaggctgaactcaatgatgagaagggggctcgcggatattacggcggcgggtatggtggtggatatggtggagtgtacggcggtggctatggcggctatgttcctgggcgtggttggtatggtggcgggtatggttaccctggctttggcggtggatatggtggtggtggaggtggtggcggtggcggtggctatggtagtggatatggcgctggcggcggtggatatggtggcggcggttatcctggagtaggatattatggtggcggaggtggtggcaagcattaggagctatatacaagcattgtgcttcaacaatattacctgttactgtggttcacttgctttagacatggtttcatgttatccctttggtattaagttcgtcttggtgcaatgctgttatatcatgttgtattatgccaatatatatttcaaataaatgacagcccaattactttgg

SEQ ID NO: 1209 - protein, 142 aa, Panicum virgatum
  misc_feature (1)..(142): Ceres CLONE ID no. 1767187
  misc_feature (1)..(142): Functional Homolog of  Ceres  ID no. 3929
  misc_feature (1)..(127): Pfam Name: GRP Pfam Description: Glycine rich protein family
MASDSKSLLLIGVVLASLLLVTKDVAAARNHFIEDKESEAKNMKINGEAELNDEKGARGYYGGGYGGGYGGVYGGGYGGYVPGRGWYGGGYGYPGFGGGYGGGGGGGGGGGYGSGYGAGGGGYGGGGYPGVGYYGGGGGGKH

SEQ ID NO: 1210 - DNA, 849 bp, Arabidopsis thaliana
  misc_feature (1)..(849): Ceres CLONE ID no. 14909
  misc_feature (1)..(849): GEMINI ID 539F4
  misc_feature: Encodes the peptide sequence at SEQ ID NO. 1211
  misc_feature: Encodes the peptide sequence at SEQ ID NO. 1986
cctctcacgttcgaagaccatttcttgttctttggacgaccatcggcgacagtgttaagtctagagtcttcttcttcttcggcgtagttttttccccggcttgaaaaatgggtctatccttcggaaagttgttcagcaagctctttgcaaagaaagagatgcgtatcctcatggtgggtctcgatgcagctggtaagactacgatcttgtacaagctcaagcttggagagatcgtgactacgattccaaccattggtttcaatgtggagactgtggaatacaagaacattagctttaccgtgtgggatgtcgggggtcaagacaagattcgtccattgtggaggcactacttccagaacactcagggacttatctttgtggtggacagcaatgatcgtgaccgtgttgtggaagccagagatgagcttcacagaatgttgaacgaagatgagttgagagatgctgtgcttctcgtttttgctaacaagcaagatcttccaaatgcgatgaacgccgctgagataaccgataagcttggacttcactctctccgtcaacgacactggtacatacagagcacatgtgctacctccggagaagggctttatgagggacttgactggctctctaacaacatcgcaaacaaggcttaggagaacaacgtgtggtttggtttttaatcgaggagagtcttgtcttcttccttctatcttttgttctttcgtctcaaactcttatcatttcatactctttgtttttcgctctaataatttacaagttttttttttgttgcttttatcctataattcagactcttataaaatggggcccaatttcggcggatattcc

SEQ ID NO: 1211 - protein, 137 aa, Arabidopsis thaliana
  misc_feature (1)..(137): Ceres CLONE ID no. 14909
  misc_feature (1)..(137): GEMINI ID 539F4
  misc_feature (5)..(133): Pfam Name: Arf Pfam Description: ADP-ribosylation factor family
MGLSFGKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNCDERR

SEQ ID NO: 1212 - DNA, 546 bp, Populus balsamifera subsp. trichocarpa
  misc_feature (1)..(546): Ceres ANNOT ID no. 1497838
atggggctgtctttcaccaagttgtttagccgactgtttgctaagaaggaaatgcgtattctgatggtgggtcttgatgctgctggtaagaccaccattctctacaagctcaagctcggtgagattgtcaccaccattcctaccattggatttaatgtggagactgtggagtacaaaaacattagctttactgtttgggatgtcgggggtcaggacaagatccgccccttgtggagacattacttccagaacacacaaggacttatctttgtggttgatagcaatgacagagatcgtgtggttgaagctagggatgagctacacaggatgttgaatgaggatgagttgagggatgctgtgctgctagtgtttgcaaacaaacaggatcttccgaatgcaatgaatgccgctgagattacggataagcttggccttcactcccttcgtcagcgccactggtacatccagagcacatgcgccacctctggtgaggggctgtatgagggattggactggctctcaaacaacattgcaaacaaggtatag

SEQ ID NO: 1213 - protein, 181 aa, Populus balsamifera subsp. trichocarpa
  misc_feature (1)..(181): Ceres ANNOT ID no. 1497838
  misc_feature (1)..(181): Functional Homolog of  Ceres  ID no. 14909
  misc_feature (5)..(177): Pfam Name: Arf Pfam Description: ADP-ribosylation factor family
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKV

SEQ ID NO: 1214 - DNA, 672 bp, Populus balsamifera subsp. trichocarpa
  misc_feature (1)..(672): Ceres ANNOT ID no. 1522523
atggggctctcattcaccaaactttttagccgtctgtttgccaagaaagaaatgcgaattctcatggtgggtcttgacgctgctggtaagaccaccatcttgtacaagctcaagctcggagagattgtcaccaccattccaacaattgggtttaacgtggagactgtggaatacaagaacataagcttcactgtctgggatgtaggtggtcaggacaagatccgaccattgtggaggcattatttccaaaacactcaagggctcatctttgtggttgatagcaatgatcgtgaccgtgtggttgaagctagggatgagctgcaccggatgttgaatgaggatgaattgagggatgctgtgctacttgtgtttgcaaacaagcaagatcttccaaatgctatgaatgctgctgaaattacagataagcttggtcttcattcactccgtcaacgccactggtatatccagagcacctgtgccacttctggtgaaggtctctatgagggactggactggctctccaacaacattgctagcaaggtaagttttatgctagtggagtttttgaagaactgtgcttctttcaatgaccagccattgtttcattgcattctctcaagtaatgtagttctacgggccggtcaaatttttgagtgtacagaaggaagctga

SEQ ID NO: 1215 - protein, 223 aa, Populus balsamifera subsp. trichocarpa
  misc_feature (1)..(223): Ceres ANNOT ID no. 1522523
  misc_feature (1)..(223): Functional Homolog of  Ceres  ID no. 14909
  misc_feature (5)..(177): Pfam Name: Arf Pfam Description: ADP-ribosylation factor family
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKVSFMLVEFLKNCASFNDQPLFHCILSSNVVLRAGQIFECTEGS

SEQ ID NO: 1216 - DNA, 546 bp, Populus balsamifera subsp. trichocarpa
  misc_feature (1)..(546): Ceres ANNOT ID no. 1471525
atggggctgtctttcaccaagttgtttagcagactgtttgctaagaaggaaatgcgtattctgatggtgggtcttgatgctgctggtaagacaaccattctctacaagctcaagctcggtgagattgtcaccaccattcctactattggattcaatgtggagactgtggagtataagaacattagctttactgtttgggatgtcgggggtcaggacaagatccgccccttgtggagacattacttccagaacacacaaggacttatctttgtggttgatagcaacgacagggatcgtgtggttgaagctagggatgagctacacaggatgttgaatgaggatgagttgagggatgctgtgcttctagtgtttgcaaacaagcaagatcttccaaatgcaatgaatgctgctgagataactgataagcttggtcttcactctcttcgtcagcgccactggtatatccaaagcacatgtgccacttctggtgaagggctgtatgagggattggactggctctcaaacaacattgcaaacaaggcttag

SEQ ID NO: 1217 - protein, 181 aa, Populus balsamifera subsp. trichocarpa
  misc_feature (1)..(181): Ceres ANNOT ID no. 1471525
  misc_feature (1)..(181): Functional Homolog of  Ceres  ID no. 14909
  misc_feature (5)..(177): Pfam Name: Arf Pfam Description: ADP-ribosylation factor family
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 1218 - DNA, 546 bp, Populus balsamifera subsp. trichocarpa
  misc_feature (1)..(546): Ceres ANNOT ID no. 1511908
atggggctctctttcacgaaattacttggccggttgttctcaaagaaggaaatgcggattctgatggtaggtcttgatgctgctggtaaaaccaccattctttacaagctcaagttgggagaaattgtcaccaccatccctaccattggatttaatgtggaaactgtggaatacaagaatattagcttcactgtttgggatgttggtggtcaagataagattcgccctttgtggagacattacttccaaaacacgcaagggcttatctttgtggttgacagtaatgaccgagatcgagttggtgaggctagagacgagctgcacaggatgttgaatgaggatgagctgagggatgctgtgctccttgtgtttgcaaataagcaagatcttccaaatgcaatgaatgctgctgaaatcactgataagcttggtcttcattctctaaggcaacgccactggtatatccagagcacatgtgccacttcaggagaagggctttatgaaggattggactggctttcaaacaacattgctagcaaggcttaa

SEQ ID NO: 1219 - protein, 181 aa, Populus balsamifera subsp. trichocarpa
  misc_feature (1)..(181): Ceres ANNOT ID no. 1511908
  misc_feature (1)..(181): Functional Homolog of  Ceres  ID no. 14909
  misc_feature (1)..(177): Pfam Name: Arf Pfam Description: ADP-ribosylation factor family
MGLSFTKLLGRLFSKKEMRILMVGLDAAGKTTILYKLKLGEIVTTIPTIGFNVETVEYKNISFTVWDVGGQDKIRPLWRHYFQNTQGLIFVVDSNDRDRVGEARDELHRMLNEDELRDAVLLVFANKQDLPNAMNAAEITDKLGLHSLRQRHWYIQSTCATSGEGLYEGLDWLSNNIASKA

SEQ ID NO: 1220 - DNA, 546 bp, Populus balsamifera subsp. trichocarpa
  misc_feature (1)..(546): Ceres ANNOT ID no. 1464305
atggggctgtcattcacgaaattacttggccgattgttctcgaagaaagaaatgcgaattctgatggtaggtcttgatgctgctggtaaaaccaccattctttacaagctcaagttgggagaaattgtcactactatccctaccattggatttaatgtggaaactgtggaatataagaatattagcttcactgtttgggatgttggcggtcaagacaagattcgtcctttgtggagacattacttccaaaacacgcaagggcttatctttgtggttgacagcaatgaccgagatcgagttggtgaggccagagacgagctgcacaggatgttgaatgaggatgagctgagggatgctgtgctccttgtatttgcaaataagcaagatcttccaaatgcaatgaatgctgccgagataactgataaactcggtcttcattctctaagacaacgccactggtatatccagagcacatgtgccacttcaggagaagggctttatgaaggattggactggctttcaaacaacatttctagcaaggcttag

SEQ ID NO: 1221 - protein, 181 aa, Populus balsamifera subsp. trichocarpa
  misc_feature (1)..(181): Ceres ANNOT ID no. 1464305
  misc_feature (1)..(181): Functional Homolog of  Ceres  ID no. 14909
  misc_feature (1)..(177): Pfam Name: Arf Pfam Description: ADP-ribosylation factor family
MGLSFTKLLGRLFSKKEMRILMVGLDAAGKTTILYKLKLGEIVTTIPTIGFNVETVEYKNISFTVWDVGGQDKIRPLWRHYFQNTQGLIFVVDSNDRDRVGEARDELHRMLNEDELRDAVLLVFANKQDLPNAMNAAEITDKLGLHSLRQRHWYIQSTCATSGEGLYEGLDWLSNNISSKA

SEQ ID NO: 1222 - DNA, 564 bp, Populus balsamifera subsp. trichocarpa
  misc_feature (1)..(564): Ceres ANNOT ID no. 1451416
atgggaatggcaatatctagactcgtgaagctactctttgcaaggaaagaaatgaggatcctgatggtgggtctagatgctgcagggaaaacaactatcctctacaagttgaagcttggagagattgttactaccatacctacaatagggttcaacgtggaaactgttgaatacaaaaacgttagtttcactgtctgggatgttggaggacaggataagattcgaccattatggagacactacttccagaacacccagggccttatatttgtggtggatagcaatgacagagaaagggttacagaagccagagatgagcttcatcgaatgctgagcgaggatgaactgcgtgatgcgacactgcttatttttgccaataagcaagaccttccaaatgctatgagtgtctcagaaatcactgataagcttggtttgcactctttgcgccagcgtcgttggtacattcaggctgcttgcgccacctctggccaaggactatacgaaggtcttgactggctgtcaagcaatatctctagcaaggcaagttcatcaaagctccattaa

SEQ ID NO: 1223 - protein, 187 aa, Populus balsamifera subsp. trichocarpa
  misc_feature (1)..(187): Ceres ANNOT ID no. 1451416
  misc_feature (1)..(187): Functional Homolog of  Ceres  ID no. 14909
  misc_feature (5)..(177): Pfam Name: Arf Pfam Description: ADP-ribosylation factor family
MGMAISRLVKLLFARKEMRILMVGLDAAGKTTILYKLKLGEIVTTIPTIGFNVETVEYKNVSFTVWDVGGQDKIRPLWRHYFQNTQGLIFVVDSNDRERVTEARDELHRMLSEDELRDATLLIFANKQDLPNAMSVSEITDKLGLHSLRQRRWYIQAACATSGQGLYEGLDWLSSNISSKASSSKLH

SEQ ID NO: 1224 - DNA, 588 bp, Populus balsamifera subsp. trichocarpa
  misc_feature (1)..(588): Ceres ANNOT ID no. 1461050
atgggcgcaaccatatcccgacttgcaagaagattccttccgaagactgaaattaggattctcatggtggggcttgatgcatctgggaaaacaaccattctgtacaaactaaagctgggagaaattgttcttacagtacctacaattggttttaatgtggagacggtggtgtacaaaaatataagtttcaccgtatgggatgtaggaggacaacaaaagattcggcctctatggagatactactttcagaattcccacggactcatctttgttgtggacagcaatgatagggggagaatttcagaagctcgcaatgagctacatcgcattttatctgatatcgaactaaaggatgccatcctgcttgtctttgccaacaagcaggatgttccgaatgctatgtctgtttctgaggttgctgataagcttggactacctactcttaaacagcgtcgctggcaacatgcgtgccaacaattgctcagcttgacaggtggtaatttggattactttctgcagtgtagtatcgctgtaaagagccactgtgaagcagtattcccacagaatgtacttagctcggtgccctaa

SEQ ID NO: 1225 - protein, 195 aa, Populus balsamifera subsp. trichocarpa
  misc_feature (1)..(195): Ceres ANNOT ID no. 1461050
  misc_feature (1)..(195): Functional Homolog of  Ceres  ID no. 14909
  misc_feature (5)..(154): Pfam Name: Arf Pfam Description: ADP-ribosylation factor family
MGATISRLARRFLPKTEIRILMVGLDASGKTTILYKLKLGEIVLTVPTIGFNVETVVYKNISFTVWDVGGQQKIRPLWRYYFQNSHGLIFVVDSNDRGRISEARNELHRILSDIELKDAILLVFANKQDVPNAMSVSEVADKLGLPTLKQRRWQHACQQLLSLTGGNLDYFLQCSIAVKSHCEAVFPQNVLSSVP

SEQ ID NO: 1226 - protein, 181 aa, Zea mays
  misc_feature (1)..(181): Ceres CLONE ID no. 1561415
  misc_feature (1)..(181): Functional Homolog of  Ceres  ID no. 14909
  misc_feature (1)..(177): Pfam Name: Arf Pfam Description: ADP-ribosylation factor family
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRAPVLLVFPNNQDLPNAMNAPEITANLGLHSLRQRHWSIQSPCAPSGEGLYEGLDWLSTNISTKS

SEQ ID NO: 1227 - protein, 164 aa, Zea mays
  misc_feature (1)..(164): Ceres CLONE ID no. 380874
  misc_feature (1)..(164): Functional Homolog of  Ceres  ID no. 14909
  misc_feature (1)..(160): Pfam Name: Arf Pfam Description: ADP-ribosylation factor family
MRILMVGLDAAGKTTILYKLKLGEIVTTIPTIGFNVETVEYKNISFTVWDVGGQDKIRPLWRHYFQNTQGLIFVVDSNDRDRVVEAKDELHRMLNEDELRDAVLLVFANKQDLPNAMNAAEITDKLGLHSLRQRHWYIQSTCATTGEGLYEGLDWLSNNIANKA

SEQ ID NO: 1228 - protein, 181 aa, Zea mays
  misc_feature (1)..(181): Ceres CLONE ID no. 416460
  misc_feature (1)..(181): Functional Homolog of  Ceres  ID no. 14909
  misc_feature (5)..(177): Pfam Name: Arf Pfam Description: ADP-ribosylation factor family
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLNSLRQRHWYIQSTCATTGEGLYEGLDWLSSNIATKS

SEQ ID NO: 1229 - protein, 181 aa, Triticum aestivum
  misc_feature (1)..(181): Ceres CLONE ID no. 631823
  misc_feature (1)..(181): Functional Homolog of  Ceres  ID no. 14909
  misc_feature (5)..(177): Pfam Name: Arf Pfam Description: ADP-ribosylation factor family
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKP

SEQ ID NO: 1230 - protein, 164 aa, Zea mays
  misc_feature (1)..(164): Ceres CLONE ID no. 1535974
  misc_feature (1)..(164): Functional Homolog of  Ceres  ID no. 14909
  misc_feature (1)..(160): Pfam Name: Arf Pfam Description: ADP-ribosylation factor family
MRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKA

SEQ ID NO: 1231 - protein, 181 aa, Zea mays
  misc_feature (1)..(181): Ceres CLONE ID no. 1428788
  misc_feature (1)..(181): Functional Homolog of  Ceres  ID no. 14909
  misc_feature (5)..(177): Pfam Name: Arf Pfam Description: ADP-ribosylation factor family
MGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKA

SEQ ID NO: 1232 - protein, 181 aa, Triticum aestivum
  misc_feature (1)..(181): Ceres CLONE ID no. 738726
  misc_feature (1)..(181): Functional Homolog of  Ceres  ID no. 14909
  misc_feature (5)..(177): Pfam Name: Arf Pfam Description: ADP-ribosylation factor family
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 1233 - protein, 164 aa, Zea mays
  misc_feature (1)..(164): Ceres CLONE ID no. 276776
  misc_feature (1)..(164): Functional Homolog of  Ceres  ID no. 14909
  misc_feature (1)..(160): Pfam Name: Arf Pfam Description: ADP-ribosylation factor family
MRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKS

SEQ ID NO: 1234 - protein, 164 aa, Zea mays; identical to SEQ ID NO: 1233
  misc_feature (1)..(164): Ceres CLONE ID no. 240510
  misc_feature (1)..(164): Functional Homolog of  Ceres  ID no. 14909
  misc_feature (1)..(160): Pfam Name: Arf Pfam Description: ADP-ribosylation factor family

SEQ ID NO: 1235 - protein, 164 aa, Glycine max
  misc_feature (1)..(164): Ceres CLONE ID no. 529239
  misc_feature (1)..(164): Functional Homolog of  Ceres  ID no. 14909
  misc_feature (1)..(160): Pfam Name: Arf Pfam Description: ADP-ribosylation factor family
  misc_feature (67)..(67): Xaa is any aa, unknown, or other
  misc_feature (110)..(110): Xaa is any aa, unknown, or other
MRILMVGLDAAGKTTILYKLKLGEIVTTIPTIGFNVETVEYKNISFTVWDVGGQDKIRPLWRHYFQXTQGLIFVVDSNDRDRVVEARDELHRMLNEDELRDAVLLVFANXQDLPNAMNAAEITDKLGLHSLRQRHWYIQSTCATSGEGLYEGLDWLSNNIANKA

SEQ ID NO: 1236 - DNA, 1030 bp, Panicum virgatum
  misc_feature (1)..(1030): Ceres CLONE ID no.1724996
atcgcagcccgcctcgggccagccgctcggaccgcacgcagggccgcagccagccccaggctcccgtcgcattcgctcgctcgctcgctcgcgtcgtcgctctcgcctccgccgatccgcgcacgcagatcgccgaagcccggcggcgcaggggcgaaggggagcgagggagctcgcgcggcggcggaggaggaaggcgttcgccaccgtctcgaggaagagatggggctctcgttcgggaagctgttcagccgcctcttcgccaagaaggagatgaggatcctcatggtcggccttgatgccgccggtaagaccaccatcctctacaagctcaagctcggcgagatcgtcaccaccatccccaccatcggattcaatgttgaaactgtagagtacaagaacattagcttcactgtttgggatgttggtggccaggacaagatcaggcccctgtggaggcactacttccagaacacgcagggtctcatttttgttgtggacagcaatgacagggagcgtgttgttgaggctagggatgagctccacaggatgctgaatgaggatgagctgcgtgatgctgtgctgcttgtgtttgcaaacaaacaagatcttcctaatgctatgaatgctgctgaaattactgacaagcttggcctgcattccctgcgccagcggcactggtacatccagagcacttgtgctacatctggtgaagggttgtacgaggggcttgattggctttccaacaacatcgccaacaaggcttgaagcttttcggcagggctcccaggaagaggaagatgtctgaacaacttattgctgccttattacatattataagattatacaatctacaatagatagtgtgggtgtttgtgaagaaaaagaaactagttctcttttgaggtgctagtgccagatttggttatgtttttgcttttggctcggtattatcgcctgtccagtttcacaaaactgactctgtcaatcatgtgtacttatgctcggagatgtgtggtaaattaaattt

SEQ ID NO: 1237 - protein, 181 aa, Panicum virgatum
  misc_feature (1)..(181): Ceres CLONE ID no. 1724996
  misc_feature (1)..(181): Functional Homolog of  Ceres  ID no. 14909
  misc_feature (1)..(177): Pfam Name: Arf Pfam Description: ADP-ribosylation factor family
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 1238 - DNA, 1569 bp, Arabidopsis thaliana
  misc_feature (1)..(1569): Ceres CLONE ID no. 19340
  misc_feature (1)..(1569): GEMINI ID 552A11
gattgactaaaagtcattaaattacaaatctaaagttaaaagtgtttcgtctgaaatttcttgttagctccaaaagaggaaaacgaatccaagaaggagaaaaagtctcattcctcaagctccgcatcattcctccttcatggggtctctgcatcttacaatttagcactctcatattattattccttaaaccccttgttttgattttgtttccagatttaaagaaaccctaagacctcttcgaaatttccccagaaacacttatttcatttcttccttggccttgactacgcgtctttccttttactccggaaggaagatccagaaaggttttctttcgatcgttgcttttgactatgcatagatctggtacaacaatggcgtggaacgtattcaagttctgtactgccttacgaggtcttggatcgatcatgatccttttggttcttggtgttgtcggtgttacttattacgctgtcgttttgactaattatggtcctccactctctcaaggtggccttgattctcttgctgctctcactatcttaatcctcttccatttcctcctggcaatgcttttgtggagctatttctcagtggtttttactgatcctggtgttgtgcctcctaattggagaccatctactgatgaagaaagaggtgaatctgatccgttaaatagtttggactttgttggtttacaatccgattcttcttcttcaaacccaagagttcggttttgtcggaagtgcaatcaactaaaaccttctcgttgtcatcattgttctgtttgtggtcggtgtgtgttgaagatggatcaccattgtgtttgggttgttaactgtgtaggagcactgaactataagtattttcttcttttcttgttctacacatttttagagacgacccttgtgactttggttcttatgccgcacttcattgcattctttagtgatgaagaaatacctggaaccccaggcactcttgctactacttttcttgcatttgttttgaacttggcatttgcgttgagcgtgatgggtttcttaattatgcatatttccttggtagctggcaataccacaactatagaggcatatgagaagaaaaccactacaaaatggcggtatgacctcggtaaaaagaaaaactttgaacaggtatttggaatggataagagatactggttaatcccaggatacacagaagaagatctaaggcgaatgccggagctgcagggacttgaatacccttcgaaaccagactttgattcccagtgatgctcaagaagactttgatcatcatcatcatcccatgtaaaacagcaatacgtagaaaaacagagcaagtggcatgtcaaggagaaatctactaacatgaagatggatgcttcactttaggcagtgtagatgtcttcccatggaaggctaagtcatcatcaaatttgtgggttttgaaaagaggatgattacaatttagctttgttggccacatatatgttcatcatcttcaatagttcatatatagatatgatcttattataaatgtagaacacacatgatttgccct

SEQ ID NO: 1239 - protein, 307 aa, Arabidopsis thaliana
  misc_feature (1)..(307): Ceres CLONE ID no. 19340
  misc_feature (1)..(307): GEMINI ID 552A11
  misc_feature (119)..(182): Pfam Name: zf-DHHC Pfam Description: DHHC zinc finger domain
MHRSGTTMAWNVFKFCTALRGLGSIMILLVLGVVGVTYYAVVLTNYGPPLSQGGLDSLAALTILILFHFLLAMLLWSYFSVVFTDPGVVPPNWRPSTDEERGESDPLNSLDFVGLQSDSSSSNPRVRFCRKCNQLKPSRCHHCSVCGRCVLKMDHHCVWVVNCVGALNYKYFLLFLFYTFLETTLVTLVLMPHFIAFFSDEEIPGTPGTLATTFLAFVLNLAFALSVMGFLIMHISLVAGNTTTIEAYEKKTTTKWRYDLGKKKNFEQVFGMDKRYWLIPGYTEEDLRRMPELQGLEYPSKPDFDSQ

SEQ ID NO: 1240 - DNA, 915 bp, Populus balsamifera subsp. trichocarpa; identical to SEQ ID NO: 821
  misc_feature (1)..(915): Ceres ANNOT ID no. 1524357

SEQ ID NO: 1241 - protein, 304 aa, Populus balsamifera subsp. trichocarpa; identical to SEQ ID NO: 822
  misc_feature (1)..(304): Ceres ANNOT ID no. 1524357
  misc_feature (1)..(304): Functional Homolog of  Ceres  ID no. 19340
  misc_feature (117)..(180): Pfam Name: zf-DHHC Pfam Description: DHHC zinc finger domain

SEQ ID NO: 1242 - DNA, 1218 bp, Populus balsamifera subsp. trichocarpa
  misc_feature (1)..(1218): Ceres ANNOT ID no. 1497053
atgcatagatctagagctgttatggcttggaatgtgttcaagttttgtacggccttaaggggtttaggctcgatcatgatcttgttggtgctcggtgttgttgtcgtcacatattatgctgttgttttgaataattatggccctgctttatatgatggtgacattgattctctcgtttctcttgctgtcttgatcacattccattctttgctagtgatgctattatggagctacttctctgttgttttaactgatcctggtagtgtgcctcctaattggaggcctgctattgatgaggaaagaggggaggccgatccattgaatgggtcggaatgtagtggagtgcagtctgaccaattaaatcaaagaatccggtattgcaggaagtgcaaccagctgaaaccacctcgttgccatcattgttctgtctgtgggaggtgtgtgctaaagatggaccatcattgtgtatgggttgtaaattgtgttggggccttaaattataagtatttccttctatttttgttctatacatttcttgagacaagtcttgtaactttatctcttctaccacactttatagcattctttagtgatggagaaattcctggcactccaggcactcttgcaaccacatttcttgcctttgtcttaaatctggcatttgcattgagtgttctgggatttctgatcatgcacatatctctggtatctgccaatacaacaactattgagattatgtgtgaaaggtgtgagaatcctcatggcaggatggctataaaatacaatactcgtttcatactcaacaatctcactacattgtcaaagtgcaatatcatagcactctttcactgtaaatcagaaaaacatcatattagcatgccaatgttatgtagccatgataaatgcctattagctttaaggaatgcgttcaagcggcagaggcaaggtttccttgcctctgtcacctgggttcgagcctcagcgtgcacgcctgtcacccccgcggtgtcttacctgcctactgggcttgcagggtgttcagtgggtccggggattagttgtggtgcgcgtaagctgacccggacaccccgggtgtttggagcagataagcgatactggttcattccagcttattcagatgaagatacaaggcgaatgcctgcacttcagggtcttgaatatccatcaaaacctgattttgattcccaagaattctag

SEQ ID NO: 1243 - protein, 405 aa, Populus balsamifera subsp. trichocarpa
  misc_feature (1)..(405): Ceres ANNOT ID no. 1497053
  misc_feature (1)..(405): Functional Homolog of  Ceres  ID no. 19340
  misc_feature (116)..(180): Pfam Name: zf-DHHC Pfam Description: DHHC zinc finger domain
MHRSRAVMAWNVFKFCTALRGLGSIMILLVLGVVVVTYYAVVLNNYGPALYDGDIDSLVSLAVLITFHSLLVMLLWSYFSVVLTDPGSVPPNWRPAIDEERGEADPLNGSECSGVQSDQLNQRIRYCRKCNQLKPPRCHHCSVCGRCVLKMDHHCVWVVNCVGALNYKYFLLFLFYTFLETSLVTLSLLPHFIAFFSDGEIPGTPGTLATTFLAFVLNLAFALSVLGFLIMHISLVSANTTTIEIMCERCENPHGRMAIKYNTRFILNNLTTLSKCNIIALFHCKSEKHHISMPMLCSHDKCLLALRNAFKRQRQGFLASVTWVRASACTPVTPAVSYLPTGLAGCSVGPGISCGARKLTRTPRVFGADKRYWFIPAYSDEDTRRMPALQGLEYPSKPDFDSQEF

SEQ ID NO: 1244 - DNA, 957 bp, Populus balsamifera subsp. trichocarpa
  misc_feature (1)..(957): Ceres ANNOT ID no. 1500296
atgcagaaatcaggaaagtcggtaatggcatggaacgtgttcaagttttgtacagcactgcgtgctcttggttccatcatgatagtattagtgcttggcataattggggttacatattatgttattgttgtagctaattatggtccagctctttttcacggtggcctggattcttttgtcgctttccttgtcttggttttgttccattccttgctggtgatgctattatggagctacttcactactgttctaactgatcctggtggtgtcccaccaaattggaggccatcaatagacgaggagagtggtgatgctgatccattggtgggattaggatatgaaggcacggatttaggtttaaatcaaccggctacattcggtgagccagctaatccacaactacgagtctgtcgaaaatgcaaccagtgtaaacctccccgttgccatcactgttctgtttgtggaaggtgtatattgaaaatggaccatcattgcgtatgggtcgtgaattgtgttggggcattgaactacaagtatttccttcttttcttgttttacacgtttctcttgacaactcttgtcactttatccttattgaggctgtttatagcatttttcactgatggtgtaataaatggaacaccgggaacccttgttgccacttttgtcacatttgttttgaacttatcatttgcattgagtattatgggcttcctggttatgcacatatcgttggtgttaggcaataccaccaccattgaggcattcgagaagaaaaccaatcctaaatggcgttatgaccttggtcgaaggaaaaactttgaacaggtgtttggggtggataagagatgctggttcatccctgcttattcagaagaggatttggaatgcatgccagtgcttcgaggttttgaatatccaacaagacccgacttggatgagctccagcagctctaa

SEQ ID NO: 1245 - protein, 318 aa, Populus balsamifera subsp. trichocarpa
  misc_feature (1)..(318): Ceres ANNOT ID no. 1500296
  misc_feature (1)..(318): Functional Homolog of  Ceres  ID no. 19340
  misc_feature (126)..(190): Pfam Name: zf-DHHC Pfam Description: DHHC zinc finger domain
MQKSGKSVMAWNVFKFCTALRALGSIMIVLVLGIIGVTYYVIVVANYGPALFHGGLDSFVAFLVLVLFHSLLVMLLWSYFTTVLTDPGGVPPNWRPSIDEESGDADPLVGLGYEGTDLGLNQPATFGEPANPQLRVCRKCNQCKPPRCHHCSVCGRCILKMDHHCVWVVNCVGALNYKYFLLFLFYTFLLTTLVTLSLLRLFIAFFTDGVINGTPGTLVATFVTFVLNLSFALSIMGFLVMHISLVLGNTTTIEAFEKKTNPKWRYDLGRRKNFEQVFGVDKRCWFIPAYSEEDLECMPVLRGFEYPTRPDLDELQQL

SEQ ID NO: 1246 - DNA, 1481 bp, Panicum virgatum; identical to SEQ ID NO: 823
  misc_feature (1)..(1481): Ceres CLONE ID no.1819666

SEQ ID NO: 1247 - protein, 298 aa, Panicum virgatum; identical to SEQ ID NO: 824
  misc_feature (1)..(298): Ceres CLONE ID no. 1819666
  misc_feature (1)..(298): Functional Homolog of  Ceres  ID no. 19340
  misc_feature (107)..(171): Pfam Name: zf-DHHC Pfam Description: DHHC zinc finger domain

SEQ ID NO: 1248 - DNA, 947 bp, Arabidopsis thaliana
  misc_feature (1)..(947): Ceres CLONE ID no. 21604
  misc_feature (1)..(947): GEMINI ID 533F7
acgacctttttgatccaaaaatcaaaatccaaaaccgaccaatggataccaacaaccagcaaccacctccctccgccgccggaatccctcctccaccacctggaaccaccatctccgccgcaggaggaggagcttcttaccaccaccttctccaacaacaacaacaacagctccaactattctggacctaccaacgccaagagatcgaacaagttaacgatttcaaaaaccatcagcttccactagctaggataaaaaagatcatgaaagccgatgaagatgttcgtatgatctccgcagaagcaccgattctcttcgcgaaagcttgtgagcttttcattctcgagctcacgatcagatcttggcttcacgctgaggagaataaacgtcgtacgcttcagaaaaacgatatcgctgctgcgattactaggactgatatcttcgatttccttgttgatattgttcctagagatgagattaaggacgaagccgcagtcctcggtggtggaatggtggtggctcctaccgcgagcggcgtgccttactattatccgccgatgggacaaccagctggtcctggagggatgatgattgggagaccagctatggatccgaatggtgtttatgtccagcctccgtctcaggcgtggcagagtgtctggcagacttcgacggggacgggagatgatgtctcttatggtagtggtggaagttccggtcaagggaatctcgacggccaaggttaagctcagagtattccagatgatgcttgacctgcttgaagatagcagatattagtcgacctcgccttgaattttggatgtgtttgatagattatgcctaaattcaatgaaaaggcttcgttaaagaagagtaaaaaaaactcttgtttctctctgttaacgtatatgttattgtagcaaaaccatcattgctgcgacttagcc

SEQ ID NO: 1249 - protein, 160 aa, Arabidopsis thaliana
  misc_feature (1)..(160): Ceres CLONE ID no. 21604
  misc_feature: Bit Score of 602.6 for HMM based on sequences of FIGURE 74
  misc_feature (1)..(160): GEMINI ID 533F7
  misc_feature (1)..(54): Pfam Name: CBFD_NFYB_HMF Pfam Description: Histone-like transcription factor (CBF/NF-Y) and archaeal histone
MKADEDVRMISAEAPILFAKACELFILELTIRSWLHAEENKRRTLQKNDIAAAITRTDIFDFLVDIVPRDEIKDEAAVLGGGMVVAPTASGVPYYYPPMGQPAGPGGMMIGRPAMDPNGVYVQPPSQAWQSVWQTSTGTGDDVSYGSGGSSGQGNLDGQG

SEQ ID NO: 1250 - DNA, 858 bp, Populus balsamifera subsp. trichocarpa
  misc_feature (1)..(858): Ceres ANNOT ID no. 1473854
atggacaacaccaccaccaatcaccagcctcagcccacggcatacccaacgcaatccatcaccaccactccaccactacctccagcaggtggagcaccatcctcaaccccattccaccacctcctccaacaacaacagcaacaacttcaaatgttttggtcttaccaacgtcaagaaattgaacaagttaatgatttcaagaaccatcaactccctttagcaagaatcaagaaaatcatgaaagctgacgaggatgtgcgcatgatctctgctgaagcacctattctctttgctaaagcatgtgagcttttcattttagaactgacaattcgttcttggcttcacgctgaggaaaacaagagaaggactttacagaagaatgacattgctgctgctattacaagaactgacatttttgatttcttggttgatattgtacctagagatgagatcaaagaggaagctgctggtcttggtggaattgtcggtgctacggctagtggggtgccatattattaccctccgatgggacagcctgccgctgccactggagggatgatgatcggaaggccagccatggatcctgccactggggtgtatgttcaaccaccatctcaggcttggcagtctgtttggcagacagctgccaccgaagatggttcttatgggagtggtggtgcgagtggtggacaagggaatcttgatggacaagatggtttaatggctgttagatatcactttaatgaggatttcttttgcatgcccatgcttaaaggtgttagccacttgttggcaccttggtgggttttgtacgcttatgttggttggttcaagcacgcgacaatgaagaacttttga

SEQ ID NO: 1251 - protein, 285 aa, Populus balsamifera subsp. trichocarpa
  misc_feature (1)..(285): Ceres ANNOT ID no. 1473854
  misc_feature: Bit Score of 526.9 for HMM based on sequences of FIGURE 74
  misc_feature (1)..(285): Functional Homolog of  Ceres  ID no. 21604
  misc_feature (69)..(133): Pfam Name: CBFD_NFYB_HMF Pfam Description: Histone-like transcription factor (CBF/NF-Y) and archaeal histone
MDNTTTNHQPQPTAYPTQSITTTPPLPPAGGAPSSTPFHHLLQQQQQQLQMFWSYQRQEIEQVNDFKNHQLPLARIKKIMKADEDVRMISAEAPILFAKACELFILELTIRSWLHAEENKRRTLQKNDIAAAITRTDIFDFLVDIVPRDEIKEEAAGLGGIVGATASGVPYYYPPMGQPAAATGGMMIGRPAMDPATGVYVQPPSQAWQSVWQTAATEDGSYGSGGASGGQGNLDGQDGLMAVRYHFNEDFFCMPMLKGVSHLLAPWWVLYAYVGWFKHATMKNF

SEQ ID NO: 1252 - DNA, 717 bp, Populus balsamifera subsp. trichocarpa
  misc_feature (1)..(717): Ceres ANNOT ID no. 1521997
atggacaacaccaacaccaacaccaatcaccagcctcaatccaccgcatacccgccacactccaccaccaccactccaccaccaccaccaccaggggcaccatcctcagccccattccaccacctccttcaacaacaacagcagcaacttcaaatgttttggtcttaccagcgtcaggaaattgaacaagttaatgatttcaagaaccatcaactccctctagcaagaatcaagaaaatcatgaaagctgatgaagatgtgcgcatgatctctgctgaagcacctattttgtttgctaaagcatgtgagcttttcattttagaactgacaattcgttcttggcttcatgctgaggaaaacaagagaaggactttacagaagaatgacattgctgctgctattaccagaactgacatttttgatttcttggttgatattgtacctagagatgagatcaaagaggaagctgctggtcttggtggaattgtcggcgctacggctagtggggtaccttattattaccctccgatgggacagcctgccgctgccgctgcgctagggatgatgattggaaggccagctgtggatcctgccactggggtttatgttcagccaccttctcaggcatggcaatctgtttggcagacagctgccgccgaggatggttcttatgggagtggtggtgccagtggtggacaaggcgaggttgttgtgtga

SEQ ID NO: 1253 - protein, 158 aa, Populus balsamifera subsp. trichocarpa
  misc_feature (1)..(158): Ceres ANNOT ID no. 1521997
  misc_feature: Bit Score of 227.0 for HMM based on sequences of FIGURE 74
  misc_feature (1)..(158): Functional Homolog of  Ceres  ID no. 21604
  misc_feature (1)..(54): Pfam Name: CBFD_NFYB_HMF Pfam Description: Histone-like transcription factor (CBF/NF-Y) and archaeal histone
MKADEDVRMISAEAPILFAKACELFILELTIRSWLHAEENKRRTLQKNDIAAAITRTDIFDFLVDIVPRDEIKEEAAGLGGIVGATASGVPYYYPPMGQPAAAAALGMMIGRPAVDPATGVYVQPPSQAWQSVWQTAAAEDGSYGSGGASGGQGEVVV

SEQ ID NO: 1254 - DNA, 747 bp, Populus balsamifera subsp. trichocarpa
  misc_feature (1)..(747): Ceres ANNOT ID no. 1468633
atggacaacaccaacaccaacaccaatcaccagcctcaatccaccgcatacccgccacactccaccaccaccactccaccaccaccaccaccaggggcaccatcctcagccccattccaccacctccttcaacaacaacagcagcaacttcaaatgttttggtcttaccagcgtcaggaaattgaacaagttaatgatttcaagaaccatcaactccctctagcaagaatcaagaaaatcatgaaagctgatgaagatgtgcgcatgatctctgctgaagcacctattttgtttgctaaagcatgtgagcttttcattttagaactgacaattcgttcttggcttcatgctgaggaaaacaagagaaggactttacagaagaatgacattgctgctgctattaccagaactgacatttttgatttcttggttgatattgtacctagagatgagatcaaagaggaagctgctggtcttggtggaattgtcggcgctacggctagtggggtaccttattattaccctccgatgggacagcctgccgctgccgctgcgctagggatgatgattggaaggccagctgtggatcctgccactggggtttatgttcagccaccttctcaggcatggcaatctgtttggcagacagctgccgccgaggatggttcttatgggagtggtggtgccagtggtggacaagggtttctcattttttttttgtacttattttttcgatttggagcgtga

SEQ ID NO: 1255 - protein, 248 aa, Populus balsamifera subsp. trichocarpa
  misc_feature (1)..(248): Ceres ANNOT ID no. 1468633
  misc_feature: Bit Score of 510.1 for HMM based on sequences of FIGURE 74
  misc_feature (1)..(248): Functional Homolog of  Ceres  ID no. 21604
  misc_feature (70)..(134): Pfam Name: CBFD_NFYB_HMF Pfam Description: Histone-like transcription factor (CBF/NF-Y) and archaeal histone
MDNTNTNTNHQPQSTAYPPHSTTTTPPPPPPGAPSSAPFHHLLQQQQQQLQMFWSYQRQEIEQVNDFKNHQLPLARIKKIMKADEDVRMISAEAPILFAKACELFILELTIRSWLHAEENKRRTLQKNDIAAAITRTDIFDFLVDIVPRDEIKEEAAGLGGIVGATASGVPYYYPPMGQPAAAAALGMMIGRPAVDPATGVYVQPPSQAWQSVWQTAAAEDGSYGSGGASGGQGFLIFFLYLFFRFGA

SEQ ID NO: 1256 - DNA, 1101 bp, Panicum virgatum
  misc_feature (1)..(1101): Ceres CLONE ID no.1784110
agagagcttgagccggcagtagctacctcgagttcaggcgcaaagctcgcaagcagatagataccaggcgagaagaagctagcatcggtacggtcacaaaggtagcaagcaattcatcagcccatggacaaccagccgctgccctactccaccggccagcccccggcgaccggcggggccccggtgcccggcgtgcctggcgctgccgggcccccgccggtcccgcaccaccacctgctccagcagcagcaggcccagctgcaggcgttctgggcgtaccagcggcaggaggcggagcgcgcgtcggcgtcggacttcaagaaccaccagctgccgctggcccggatcaagaagatcatgaaggccgacgaggacgtgcgcatgatctccgccgaggcgcccgtgctgttcgccaaggcctgcgagctcttcatcctcgagctcaccatccgctcctggctgcacgccgaggagaacaagcgccgcaccctgcagcgcaacgacgtcgccgccgccatcgcgcgcaccgacgtcttcgacttcctcgtggacatcgtgccgcgcgaggaggccaaggaggagccggggagcgccctggggttcgctgcggcggcaggggccggcgcggtcgggagcggcgcggcgggcggcgccccggccgccgggatgccgtactactacccgccgatggggcagccggcgccgatgatgccggcctggcacgttcccgcctgggacccggcctggcagcaaggggcggcggcggatgtcgatcagagcggcagcttcggcgaggaagggcaagggtttgcagcaggccatggcggcggtgccgctagcttccctcctgctgcacctccgagctccgagtgatctgcgcgctcctacgcgatggcttagctaaatgtgcaatgcacttgcagtgaaagtcgattgttcaatgcgtcgggcacggtgtctatagcaagcatggtaattagtcgaacaacatacagaacgaataagtgggagagctgactggagtaagttgtacatgcacgtgatgtgctgattaatcaaagattaacatgcagttttaattaaaaaaaaaaaaaaaaaaaa

SEQ ID NO: 1257 - protein, 249 aa, Panicum virgatum
  misc_feature (1)..(249): Ceres CLONE ID no. 1784110
  misc_feature: Bit Score of 538.0 for HMM based on sequences of FIGURE 74
  misc_feature (1)..(249): Functional Homolog of  Ceres  ID no. 21604
  misc_feature (68)..(132): Pfam Name: CBFD_NFYB_HMF Pfam Description: Histone-like transcription factor (CBF/NF-Y) and archaeal histone
MDNQPLPYSTGQPPATGGAPVPGVPGAAGPPPVPHHHLLQQQQAQLQAFWAYQRQEAERASASDFKNHQLPLARIKKIMKADEDVRMISAEAPVLFAKACELFILELTIRSWLHAEENKRRTLQRNDVAAAIARTDVFDFLVDIVPREEAKEEPGSALGFAAAAGAGAVGSGAAGGAPAAGMPYYYPPMGQPAPMMPAWHVPAWDPAWQQGAAADVDQSGSFGEEGQGFAAGHGGGAASFPPAAPPSSE

SEQ ID NO: 1258 - DNA, 712 bp, Arabidopsis thaliana
  misc_feature (1)..(712): Ceres CLONE ID no. 29637
  misc_feature (1)..(712): GEMINI ID 553C3
aacaatggcggcagttcaacagcaacaagcgatgcagaagaacactttatacgtaggaggtttagctgatgaagttaacgaatcgatccttcacgccgcgtttatacctttcggcgatatcaaagacgtgaagacgccgttggaccaagcgaatcagaagcatagatccttcggattcgttacttttcttgagagagaagacgcttctgctgctatggataatatggacggtgctgagctttatggtcgtgtcctcactgttaattatgctctccctgagaaaattaagggtggtgaacagggttgggctgctcatccactttgggcagatgcagacacatggtttgagaggcagcaacaggagaaggagattctgaagatgcaagctgagaacaaggctgccatggagactgctgaggagcttcacaggaagaaattggcggaagatcgacaaggagagatggaggaagatacagataccaaagatgatcctatggccagagcagaggctgatgctctaagtcacggcgatgcctaatgaaagtaagcgttaccggattctcttatgcaccttgtcctgtaggataacaagtatgttttcgcctgagtgtgtaacactgtcactatcacctcatagagtttttgaggttagattgtttcttgaggttgattaccatgttattgctatagttaatagattaggtagtttggc

SEQ ID NO: 1259 - protein, 177 aa, Arabidopsis thaliana
  misc_feature (1)..(177): Ceres CLONE ID no. 29637
  misc_feature (1)..(177): GEMINI ID 553C3
  misc_feature (15)..(86): Pfam Name: RRM_1 Pfam Description: RNA recognition motif. (a.k.a. RRM, RBD, or RNP domain)
MAAVQQQQAMQKNTLYVGGLADEVNESILHAAFIPFGDIKDVKTPLDQANQKHRSFGFVTFLEREDASAAMDNMDGAELYGRVLTVNYALPEKIKGGEQGWAAHPLWADADTWFERQQQEKEILKMQAENKAAMETAEELHRKKLAEDRQGEMEEDTDTKDDPMARAEADALSHGDA

SEQ ID NO: 1260 - DNA, 525 bp, Populus balsamifera subsp. trichocarpa
  misc_feature (1)..(525): Ceres ANNOT ID no. 1458617
atggcagcacagcagcaagtgcaaaagaacacgctatacgtaggaggattagctgaggaagtaaacgaagcaatactccacgctactttcattccttttggtgacattaaggatgtcaaaacccccttagatcaagccacacagaaacaccgctcttttggcttcgttactttcctcgaaagagaggacgccgcctccgccatggacaatatggatggcgctgagctctatggtcgtgtcctcaccgttaattacgctttgcctgagaagattaagggtggtgaacaaggttgggctgcccagccaatctgggctgatgcggacacatggttcgaaaggcagcagcaagaggaggaaatgcagcgtatgcaggcagagaacagggctgcaatggaagctgcagaagagttgcacagaaagaagatggcagaggagcgagaaggggagaaggaagatgaagggcaggtcaaggatgatccaatggcaagggctgaagcggaggttttgaaacagaacatatcttag

SEQ ID NO: 1261 - protein, 174 aa, Populus balsamifera subsp. trichocarpa
  misc_feature (1)..(174): Ceres ANNOT ID no. 1458617
  misc_feature (1)..(174): Functional Homolog of  Ceres  ID no. 29637
  misc_feature (12)..(83): Pfam Name: RRM_1 Pfam Description: RNA recognition motif. (a.k.a. RRM, RBD, or RNP domain)
MAAQQQVQKNTLYVGGLAEEVNEAILHATFIPFGDIKDVKTPLDQATQKHRSFGFVTFLEREDAASAMDNMDGAELYGRVLTVNYALPEKIKGGEQGWAAQPIWADADTWFERQQQEEEMQRMQAENRAAMEAAEELHRKKMAEEREGEKEDEGQVKDDPMARAEAEVLKQNIS

SEQ ID NO: 1262 - DNA, 516 bp, Populus balsamifera subsp. trichocarpa
  misc_feature (1)..(516): Ceres ANNOT ID no. 1464333
atggcggcacagcagcaagtacagaagaacaccctatacgtaggaggattagctgaggaagcaaacgaatcaatactccacgccgctttcattccttttggtgacattaaagatgtcaaaacccctttagatcaagctaaacagaaacaccgctcttttggcttcgttactctcctcgaaagagaggtcgctgttgctgccatgggcaatatggacggcgctgagctctatggtcgtgtcctcaccgttaattacgccttgcccgagaagattaagggtggtgaacagggttgggctgcccaaccaagcaagtatttctctttgattctttcttttttgttggacgttgctacattatgttggcgctggcttcagtttttaggcgttcgatttgaggggcagcagcaagaggaggaaatgcagcgtatgcaggcagagaacagggctgcaatgcaacctgcagagaacttgcacgtgaagaaaatggcggaggagcgagaaggggaaaaggaatga

SEQ ID NO: 1263 - protein, 171 aa, Populus balsamifera subsp. trichocarpa
  misc_feature (1)..(171): Ceres ANNOT ID no. 1464333
  misc_feature (1)..(171): Functional Homolog of  Ceres  ID no. 29637
  misc_feature (12)..(83): Pfam Name: RRM_1 Pfam Description: RNA recognition motif. (a.k.a. RRM, RBD, or RNP domain)
MAAQQQVQKNTLYVGGLAEEANESILHAAFIPFGDIKDVKTPLDQAKQKHRSFGFVTLLEREVAVAAMGNMDGAELYGRVLTVNYALPEKIKGGEQGWAAQPSKYFSLILSFLLDVATLCWRWLQFLGVRFEGQQQEEEMQRMQAENRAAMQPAENLHVKKMAEEREGEKE

SEQ ID NO: 1264 - DNA, 867 bp, Panicum virgatum
  misc_feature (1)..(867): Ceres CLONE ID no.1787181
gttcgagttcagcccgttgaggccgtagctaagcaaacagagaaggcggagccaaaggtcccaaacaacccccgtcttgctgtctctgcccccctgcgcatcagcagttcagcaccccactcgccgccgccggagacatgaaccagccggtgcagaagaacaccctctatgtcggtggcctggcggaggaggtggacgagaagatcctgcacgcggcgttcgtgcccttcggcgaggtcaaggacgtcaagacgccgctcgaccagtccacgcagaagcaccgctccttcgggttcgtcaccttcctcgagcgcgaggacgccgccgccgccatggacaacatggacggcgccgagctcttcggacgtgtcctcaccgtcaactacgccttccccgagcgcatcaagggaggggagcagggatgggccgcgcagccgatttgggctgatgcggacacttggttcgagaggcagcagcaggaagaggagatgcagcgtctgcaggcagagcagcgcgcggcaatgcaagtagcagagaagctgcacagagagaaacttgctgccgaaagagaaggtgagaaagaagaggaggcggatcccatggctgcagcagaagctcaggccttgaagcagagttcttaagaactggatatagacttaagaacatctgccgctttcctgtccatttgtcaaatacacatgcttttctcggccgtggttaaggtgttgctaacatgctagacttgggagtgatgtttgtttagtttgaaagaatcctatttgtcttaacgtgggatgctttgtgttttgtttggccttctgatagactaatatgtactgcacgctcgaaaaaaaaaaaaaaaaaaaa

SEQ ID NO: 1265 - protein, 167 aa, Panicum virgatum
  misc_feature (1)..(167): Ceres CLONE ID no. 1787181
  misc_feature (1)..(167): Functional Homolog of  Ceres  ID no. 29637
  misc_feature (10)..(81): Pfam Name: RRM_1 Pfam Description: RNA recognition motif. (a.k.a. RRM, RBD, or RNP domain)
MNQPVQKNTLYVGGLAEEVDEKILHAAFVPFGEVKDVKTPLDQSTQKHRSFGFVTFLEREDAAAAMDNMDGAELFGRVLTVNYAFPERIKGGEQGWAAQPIWADADTWFERQQQEEEMQRLQAEQRAAMQVAEKLHREKLAAEREGEKEEEADPMAAAEAQALKQSS

SEQ ID NO: 1266 - DNA, 996 bp, Arabidopsis thaliana
  misc_feature (1)..(996): Ceres CLONE ID no. 34414
  misc_feature (1)..(996): GEMINI ID 554B7
atttttaacgctcactggatttataagtagagattttttgtgtctcacaaaaacaaaaaaatcatcgtgaaacgtttcgaaggccattttctttggacgaccatcggcgttaaggagagagcttagatctcgtgccgtcgtgcgacgttgttttccggcttgatcaaaatggggttgtcattcggaaagttgttcagcaggctctttgcgaagaaagagatgcgtattctgatggttggtctcgatgctgctggtaagacgactatcctctacaagctcaaacttggagagatcgtcaccactattccaaccattgggttcaacgttgagactgttgaatacaagaacatcagcttcaccgtgtgggatgttgggggtcaagacaagatccgtccattgtggagacattacttccagaacacacagggacttatctttgttgtggacagcaatgatcgtgaccgtgttgttgaagccagggacgagcttcacaggatgctgaatgaggatgaattgagggatgcagttctgcttgtatttgctaacaagcaagatcttcccaacgcgatgaacgctgctgagataactgacaagcttgggcttcattctcttcgtcaacgacactggtacattcagagcacatgtgccacctctggagaaggactctatgagggacttgactggctctccaacaacatcgcaagcaaggcatagatggaatgttagccagattcctcttctgcttgtttggtttacaaatcaaagacagaggtctgtttctctagtactaaaagatttattattatattcttcttcgtcacttatctcaaacgcagatcattttacactttgtacttccccttcaataacttgttacttctctcgtttgcttccgaatttgagtatatcatttttacatctgcttttcatcaaagcataaagcatctttcgaaacaaaaattgaaccgaatttttctgtaaactgatcaaatgtgc

SEQ ID NO: 1267 - protein, 181 aa, Arabidopsis thaliana
  misc_feature (1)..(181): Ceres CLONE ID no. 34414
  misc_feature (1)..(181): GEMINI ID 554B7
  misc_feature (1)..(177): Pfam Name: Arf Pfam Description: ADP-ribosylation factor family
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 1268 - DNA, 546 bp, Populus balsamifera subsp. trichocarpa; identical to SEQ ID NO: 1216
  misc_feature (1)..(546): Ceres ANNOT ID no. 1471525

SEQ ID NO: 1269 - protein, 181 aa, Populus balsamifera subsp. trichocarpa; identical to SEQ ID NO: 1217
  misc_feature (1)..(181): Ceres ANNOT ID no. 1471525
  misc_feature (1)..(181): Functional Homolog of  Ceres  ID no. 34414
  misc_feature (5)..(177): Pfam Name: Arf Pfam Description: ADP-ribosylation factor family

SEQ ID NO: 1270 - DNA, 546 bp, Populus balsamifera subsp. trichocarpa; identical to SEQ ID NO: 1212
  misc_feature (1)..(546): Ceres ANNOT ID no. 1497838

SEQ ID NO: 1271 - protein, 181 aa, Populus balsamifera subsp. trichocarpa; identical to SEQ ID NO: 1213
  misc_feature (1)..(181): Ceres ANNOT ID no. 1497838
  misc_feature (1)..(181): Functional Homolog of  Ceres  ID no. 34414
  misc_feature (5)..(177): Pfam Name: Arf Pfam Description: ADP-ribosylation factor family

SEQ ID NO: 1272 - DNA, 546 bp, Populus balsamifera subsp. trichocarpa; identical to SEQ ID NO: 1218
  misc_feature (1)..(546): Ceres ANNOT ID no. 1511908

SEQ ID NO: 1273 - protein, 181 aa, Populus balsamifera subsp. trichocarpa; identical to SEQ ID NO: 1219
  misc_feature (1)..(181): Ceres ANNOT ID no. 1511908
  misc_feature (1)..(181): Functional Homolog of  Ceres  ID no. 34414
  misc_feature (1)..(177): Pfam Name: Arf Pfam Description: ADP-ribosylation factor family

SEQ ID NO: 1274 - DNA, 546 bp, Populus balsamifera subsp. trichocarpa; identical to SEQ ID NO: 1220
  misc_feature (1)..(546): Ceres ANNOT ID no. 1464305

SEQ ID NO: 1275 - protein, 181 aa, Populus balsamifera subsp. trichocarpa; identical to SEQ ID NO: 1221
  misc_feature (1)..(181): Ceres ANNOT ID no. 1464305
  misc_feature (1)..(181): Functional Homolog of  Ceres  ID no. 34414
  misc_feature (1)..(177): Pfam Name: Arf Pfam Description: ADP-ribosylation factor family

SEQ ID NO: 1276 - DNA, 564 bp, Populus balsamifera subsp. trichocarpa; identical to SEQ ID NO: 1222
  misc_feature (1)..(564): Ceres ANNOT ID no. 1451416

SEQ ID NO: 1277 - protein, 187 aa, Populus balsamifera subsp. trichocarpa; identical to SEQ ID NO: 1223
  misc_feature (1)..(187): Ceres ANNOT ID no. 1451416
  misc_feature (1)..(187): Functional Homolog of  Ceres  ID no. 34414
  misc_feature (5)..(177): Pfam Name: Arf Pfam Description: ADP-ribosylation factor family

SEQ ID NO: 1278 - DNA, 549 bp, Populus balsamifera subsp. trichocarpa
  misc_feature (1)..(549): Ceres ANNOT ID no. 1514324
atgggcgcaaccatatcccgacttgcaagaagattccttccgaagactgaaattaggattctcatggtggggcttgatgcatctgggaaaacaaccattctgtacaaactaaagctgggagaaattgttcttacagtacctacaattggttttaatgtggagacggtggtgtacaaaaatataagtttcaccgtatgggatgtaggaggacaacaaaagattcggcctctatggagatactactttcagaattcccacggactcatctttgttgtggacagcaatgatagggggagaatttcagaagctcgcaatgagctacatcgcattttatctgatatcgaactaaaggatgccatcctgcttgtctttgccaacaagcaggatgttccgaatgctatgtctgtttctgaggttgctgataagcttggactacctactcttaaacagcgtcgctggtacattcaaagctcttctgccacttcaggacgtggactatacgaaggtctggactggctatctaactatatctctaacaaggcagcataa

SEQ ID NO: 1279 - protein, 182 aa, Populus balsamifera subsp. trichocarpa
  misc_feature (1)..(182): Ceres ANNOT ID no. 1514324
  misc_feature (1)..(182): Functional Homolog of  Ceres  ID no. 34414
  misc_feature (5)..(177): Pfam Name: Arf Pfam Description: ADP-ribosylation factor family
MGATISRLARRFLPKTEIRILMVGLDASGKTTILYKLKLGEIVLTVPTIGFNVETVVYKNISFTVWDVGGQQKIRPLWRYYFQNSHGLIFVVDSNDRGRISEARNELHRILSDIELKDAILLVFANKQDVPNAMSVSEVADKLGLPTLKQRRWYIQSSSATSGRGLYEGLDWLSNYISNKAA

SEQ ID NO: 1280 - DNA, 588 bp, Populus balsamifera subsp. trichocarpa; identical to SEQ ID NO: 1224
  misc_feature (1)..(588): Ceres ANNOT ID no. 1461050

SEQ ID NO: 1281 - protein, 195 aa, Populus balsamifera subsp. trichocarpa; identical to SEQ ID NO: 1225
  misc_feature (1)..(195): Ceres ANNOT ID no. 1461050
  misc_feature (1)..(195): Functional Homolog of  Ceres  ID no. 34414
  misc_feature (5)..(154): Pfam Name: Arf Pfam Description: ADP-ribosylation factor family

SEQ ID NO: 1282 - DNA, 1030 bp, Panicum virgatum; identical to SEQ ID NO: 1236
  misc_feature (1)..(1030): Ceres CLONE ID no.1724996

SEQ ID NO: 1283 - protein, 181 aa, Panicum virgatum; identical to SEQ ID NO: 1237
  misc_feature (1)..(181): Ceres CLONE ID no. 1724996
  misc_feature (1)..(181): Functional Homolog of  Ceres  ID no. 34414
  misc_feature (1)..(177): Pfam Name: Arf Pfam Description: ADP-ribosylation factor family

SEQ ID NO: 1284 - DNA, 1261 bp, Arabidopsis thaliana
  misc_feature (1)..(1261): Ceres CLONE ID no. 38311
  misc_feature (1)..(1261): GEMINI ID 531C6
  misc_feature (1)..(1261): GEMINI ID 87B9
aagcaacaaaaacttaacccatttcttcttctttttttgtttctctctcacaaacacaacaaatatggaatacagctgtgtagacgacagtagtactacgtcagaatctctctccatctctactactccaaagccgacaacgacaacggagaagaaactctcttctccaccggcgacttcgatgcgtctctacagaatgggaagcggcggaagcagcgttgttttggattcagagaacggcgtcgagaccgagtcacgaaagcttccgtcgtcgaaatacaaaggcgttgtgcctcagcctaacggaagatggggagctcagatttacgagaagcatcagcgagtttggctcggtactttcaacgaggaagaagaagctgcgtcttcttacgacatcgccgtgaggaggttccgaggccgcgacgccgtcactaacttcaaatctcaagttgatggaaacgacgccgaatcggcttttcttgacgctcattctaaagctgagatcgtggatatgttgaggaaacacacttacgccgatgagtttgagcagagtagacggaagtttgttaacggcgacggaaaacgctctgggttggagacggcgacgtacggaaacgacgctgttttgagagcgcgtgaggttttgttcgagaagactgttacgccgagcgacgtcgggaagctgaaccgtttagtgataccgaaacaacacgcggagaagcattttccgttatcggcgatgacgacggcgatggggatgaatccgtctccgacgaaaggcgttttgattaacttggaagatagaacagggaaagtgtggcggttccgttacagttactggaacagcagtcaaagttacgtgttgaccaagggctggagccggttcgttaaagagaagaatcttcgagccggtgatgtggtttgtttcgagagatcaaccggaccagaccggcaattgtatatccactggaaagtccggtctagtccggttcagactgtggttaggctattcggagtcaacattttcaatgtgagtaacgagaaaccaaacgacgtcgcagtagagtgtgttggcaagaagagatctcgggaagatgatttgttttcgttagggtgttccaagaagcaggcgattatcaacatcttgtgacaaattctttttttttggttttttttcttcaatttgtttctcctttttcaatattttgtattgaaatgacaagttgtaaattaggacaatacaagaaaaaatgacaactag

SEQ ID NO: 1285 - protein, 361 aa, Arabidopsis thaliana
  misc_feature (1)..(361): Ceres CLONE ID no. 38311
  misc_feature (1)..(361): GEMINI ID 531C6
  misc_feature (1)..(361): GEMINI ID 87B9
  misc_feature (194)..(308): Pfam Name: B3 Pfam Description: B3 DNA binding domain
  misc_feature (70)..(119): Pfam Name: AP2 Pfam Description: AP2 domain
MEYSCVDDSSTTSESLSISTTPKPTTTTEKKLSSPPATSMRLYRMGSGGGSVVLDSENGVETESRKLPSSKYKGVVPQPNGRWGAQIYEKHQRVWLGTFNEEEEAASSYDIAVRRFRGRDAVTNFKSQVDGNDAESAFLDAHSKAEIVDMLRKHTYADEFEQSRRKFVNGDGKRSGLETATYGNDAVLRAREVLFEKTVTPSDVGKLNRLVIPKQHAEKHFPLSAMTTAMGMNPSPTKGVLINLEDRTGKVWRFRYSYWNSSQSYVLTKGWSRFVKEKNLRAGDVVCFERSTGPDRQLYIHWKVRSSPVQTVVRLFGVNIFNVSNEKPNDVAVECVGKKRSREDDLFSLGCSKKQAIINIL

SEQ ID NO: 1286 - protein, 315 aa, Arabidopsis thaliana
  misc_feature (1)..(315): Ceres CLONE ID no. 19561
  misc_feature (1)..(315): Functional Homolog of  Ceres  ID no. 38311
  misc_feature (1)..(315): GEMINI ID 534G10
  misc_feature (150)..(258): Pfam Name: B3 Pfam Description: B3 DNA binding domain
  misc_feature (26)..(75): Pfam Name: AP2 Pfam Description: AP2 domain
MGSGGSSVVLDPENGLETESRKLPSSKYKGVVPQPNGRWGAQIYEKHQRVWLGTFNEQEEAARSYDIAACRFRGRDAVVNFKNVLEDGDLAFLEAHSKAEIVDMLRKHTYADELEQNNKRQLFLSVDANGKRNGSSTTQNDKVLKTREVLFEKAVTPSDVGKLNRLVIPKQHAEKHFPLPSPSPAVTKGVLINFEDVNGKVWRFRYSYWNSSQSYVLTKGWSRFVKEKNLRAGDVVTFERSTGLERQLYIDWKVRSGPRENPVQVVVRLFGVDIFNVTTVKPNDVVAVCGGKRSRDVDDMFALRCSNKQAIINAL

SEQ ID NO: 1287 - protein, 351 aa, Glycine max
  misc_feature (1)..(351): Public GI no. 72140114
  misc_feature (1)..(351): Functional Homolog of  Ceres  ID no. 38311
  misc_feature (171)..(268): Pfam Name: B3 Pfam Description: B3 DNA binding domain
  misc_feature (52)..(101): Pfam Name: AP2 Pfam Description: AP2 domain
MDGGCVTDETTTSSDSLSVPPPSRVGSVASAVVDPDGCCVSGEAESRKLPSSKYKGVVPQPNGRWGAQIYEKHQRVWLGTFNEEDEAARAYDIAALRFRGPDAVTNFKPPAASDDAESEFLNSHSKFEIVDMLRKHTYDDELQQSTRGGRRRLDADTASSGVFDAKAREQLFEKTVTPSDVGKLNRLVIPKQHAEKHFPLSGSGDESSPCVAGASAAKGMLLNFEDVGGKVWRFRYSYWNSSQSYVLTKGWSRFVKEKNLRAGDAVQFFKSTGPDRQLYIDCKARSGEVNNNAGGLFVPIGPVVEPVQMVRLFGVNLLKLPVPGSDGVGKRKEMELFAFECCKKLKVIGAL

SEQ ID NO: 1288 - protein, 386 aa, Capsicum annuum
  misc_feature (1)..(386): Public GI no. 33320073
  misc_feature (1)..(386): Functional Homolog of  Ceres  ID no. 38311
  misc_feature (199)..(305): Pfam Name: B3 Pfam Description: B3 DNA binding domain
  misc_feature (59)..(108): Pfam Name: AP2 Pfam Description: AP2 domain
MEGTSSIDQESTTSDSLSIAPMTTTKPPESLCRMGSGTSSVIIDGENGVEAESRKLPSSKYKGVVPQPNGRWGAQIYEKHQRVWLGTFNEENEAARAYDVAAQRFRGRDAVTNFKPLLENQESDDDVEIAFLNSHSKAEIVDMLRKHTYIDELEQSKKLFGYTKDGTMAKNKDGLIDISSFFGGGGTIDKVNNKVREQLFEKAVTPSDVGKLNRLVIPKQHAEKHFPLQNGNNSKGVLLNFEDLNGKVWRFRYSYWNSSQSYVLTKGWSRFVKEKNLKAGDIVSFQRSTSGDKQLYIDFKARNMAPTNPVVTNQVQAQVQVPRVQMMRLFGVNICKIPATINNVVDNNNNNNNNMANCSGGKRMMEMELLTFESCRKKQRVIIDAL

SEQ ID NO: 1289 - protein, 357 aa, Glycine max
  misc_feature (1)..(357): Ceres CLONE ID no. 597624
  misc_feature (1)..(357): Functional Homolog of  Ceres  ID no. 38311
  misc_feature (1)..(357): GEMINI ID 531B11
  misc_feature (177)..(291): Pfam Name: B3 Pfam Description: B3 DNA binding domain
  misc_feature (48)..(97): Pfam Name: AP2 Pfam Description: AP2 domain
MSSEKASPSPPPPNRLCRVGSGASAVVDSDGGGGGGSTEVESRKLPSSKYKGVVPQPNGRWGSQIYEKHQRVWLGTFNEEDEAARAYDVAVQRFRGKDAVTNFKPLSGTDDDDGESEFLNSHSKSEIVDMLRKHTYNDELEQSKRSRGFVRRRGSAAGAGNGNSISGACVMKAREQLFQKAVTPSDVGKLNRLVIPKQHAEKHFPLQSAANGVSATAAAAKGVLLNFEDVGGKVWRFRYSYWNSSQSYVLTKGWSRFVKEKNLKAGDTVCFQRSTGPDRQLYIDWKTRNVVNEVALFGPVVEPIQMVRLFGVNILKLPGSDSIANNNNASGCCNGKRREMELFSLECSKKPKIIGAL

SEQ ID NO: 1290 - protein, 365 aa, Oryza sativa
  misc_feature (1)..(365): Public GI no. 34895690
  misc_feature (1)..(365): Functional Homolog of  Ceres  ID no. 38311
  misc_feature (181)..(294): Pfam Name: B3 Pfam Description: B3 DNA binding domain
  misc_feature (67)..(116): Pfam Name: AP2 Pfam Description: AP2 domain
MGVVSFSSTSSGASTATTESGGAVRMSPEPVVAVAAAAQQLPVVKGVDSADEVVTSRPAAAAAQQSSRYKGVVPQPNGRWGAQIYERHARVWLGTFPDEEAAARAYDVAALRYRGRDAATNFPGAAASAAELAFLAAHSKAEIVDMLRKHTYADELRQGLRRGRGMGARAQPTPSWAREPLFEKAVTPSDVGKLNRLVVPKQHAEKHFPLRRAASSDSASAAATGKGVLLNFEDGEGKVWRFRYSYWNSSQSYVLTKGWSRFVREKGLRAGDTIVFSRSAYGPDKLLFIDCKKNNAAAATTTCAGDERPTTSGAEPRVVRLFGVDIAGGDCRKRERAVEMGQEVFLLKRQCVVHQRTPALGALLL

SEQ ID NO: 1291 - DNA, 1486 bp, Panicum virgatum
  misc_feature (1)..(1486): Ceres CLONE ID no.1781615
aactatatcctacgcacacagcaacatctcccagtccgcagcagaagcgagcataggcggtgcaggaaatggacagcgcgagcagcctcgtggtggacgacaccagcggcggcggcgcgtgcagggacaagctcagggcgctggccgccgcggccgccgagggggcgacgctggagcgcatgggcagcggcgccagcgcggtcgtggacgcggccgagccgggcgccgaggcggactcgggctccgcgggccacgccggcgcgggcgggaagctgccgtcgtccaggtacaagggcgtggtgccgcagcccaacgggcggtggggcgcgcagatctacgagcgccaccagcgcgtgtggctcggcaccttcgcgggggaggccgaggccgcgcgcgcctacgacgtcgccgcgcagcgcttccgcggccgcgacgccgtcaccaacttccgcccgctcgcggacgccgacccggacgccgccgccgagctccgcttcctcgcgtcgcgctccaaggccgaggtcgtcgacatgctccgcaagcacacctacttcgacgagctcgcccagaacaagcgcgccttcgccgccgcgacctcgtcgctcgccggcgcccactccccctctttcgcgcccccctctcccacgcgggcgcgggagcacctgttcgacaagacggtcactcccagcgacgtgggcaagctcaaccggctggtgatcccgaagcagcacgccgagaagcacttcccgctgcagctcccgtccgccggcggcgagagcaagggcgtgctcctcaacttcgaggacgccgcggcgggcaaggtctggcggttccgctactcgtactggaacagcagccagagctacgtgctcaccaagggctggagccgcttcgtcaaggagaagggcctccaggccggcgacgtcgtcggcttctaccgctccgcggccgccgccggcgccgacagcaagctcttcatcgcctgcaggctgcggcccagcggcgtcaccgcctcgacagcccccgtagcggagccatcgtcggcgccggtggcgaaggccgtgcggctcttcggcgtcgacctgctgacggcgccagcgccggccatggccgggtgcaagagggccagggacctggcggcgcccccgcaggcggcgttcaagaagcagctcgtggagctcgcgctagtgtagattaatgccttgctcccgggcgaccgatcactcttctctctagctagtcccttttttcttttgctcgatcgccaaaaactcaagatggtagcatcaccgagctgaattagtcccctcgcggcggcgtctcacctagttggttcgtttgttaatttccttttcatcgtcttgctcttttgctgccgatgtaaatcttctcatctgtatactactaatggagaaaaaaaacagccctagaactagaaggctagaagatgatcaactgacacaaccaaaaaaaaaaaaaaaaaaaa

SEQ ID NO: 1292 - protein, 374 aa, Panicum virgatum
  misc_feature (1)..(374): Ceres CLONE ID no. 1781615
  misc_feature (1)..(374): Functional Homolog of  Ceres  ID no. 38311
  misc_feature (199)..(312): Pfam Name: B3 Pfam Description: B3 DNA binding domain
  misc_feature (72)..(121): Pfam Name: AP2 Pfam Description: AP2 domain
MDSASSLVVDDTSGGGACRDKLRALAAAAAEGATLERMGSGASAVVDAAEPGAEADSGSAGHAGAGGKLPSSRYKGVVPQPNGRWGAQIYERHQRVWLGTFAGEAEAARAYDVAAQRFRGRDAVTNFRPLADADPDAAAELRFLASRSKAEVVDMLRKHTYFDELAQNKRAFAAATSSLAGAHSPSFAPPSPTRAREHLFDKTVTPSDVGKLNRLVIPKQHAEKHFPLQLPSAGGESKGVLLNFEDAAAGKVWRFRYSYWNSSQSYVLTKGWSRFVKEKGLQAGDVVGFYRSAAAAGADSKLFIACRLRPSGVTASTAPVAEPSSAPVAKAVRLFGVDLLTAPAPAMAGCKRARDLAAPPQAAFKKQLVELALV

SEQ ID NO: 1293 - DNA, 2151 bp, Arabidopsis thaliana
  misc_feature (1)..(2151): Ceres CLONE ID no. 109490
  misc_feature (1)..(2151): GEMINI ID 552G11
aaagcgtttttatcatttctgtcttcttctgtgtaaacagtaagaccccaaaggtcaaacctttaggctttgtttcttcctttaaggcttttttccgacgtttatatcagatttcttcttgtcaatttcttcatttggacaacctccataatccaagaccgacccttttcctctaatctctcctgttgcagctgaatggtggaacaaactgtggttagagaacatatcaaagcgagagtcatgtcattagtgaggtctgcagagccatcctcatataggaacccgaagctttacacgttgaatgagaatggtaataacaatggtgtcagttctgctcaaatctttgatccagataggtcaaagaatccttgtctgactgatgattcttacccaagccaaagttatgagaagtactttcttgattcgccaactgatgagtttgttcaacatcctattggctctggtgcctcggttagctcatttggctctttagactcatttccttatcagtcaagaccagttcttggatgttccatggaatttcagttaccgttggattcaacctctacttcatctacaaggcttttgggagattaccaagcggtttcttacagtccaagcatggatgtagtggaggagtttgatgatgagcaaatgagatcaaagattcaagagcttgaaagagcgcttctcggcgatgaagatgataaaatggttggaatagataacctcatggagattgacagcgaatggtcgtaccaaaacgaaagcgaacagcatcaagactcacccaaagaatcatcgtctgcagattccaactctcatgtaagtagcaaagaagtggtgtctcaagccactccaaagcaaatcttgatatcttgtgctcgtgcgctatctgaaggaaaattagaagaagctttgtcaatggtaaatgagctgaggcagatagtttctatccaaggagacccttctcagagaatcgcagcttacatggtggaaggtctagctgcaagaatggccgcttcaggaaaattcatctacagagcattgaaatgcaaagagcctccttcggatgagaggcttgcagctatgcaagtcctgtttgaagtctgcccttgtttcaagttcgggtttttagcagctaatggtgcgatacttgaagcaatcaaaggtgaagaagaagttcacataatcgatttcgatataaaccaagggaaccaatacatgacactgatacgaagcattgctgagttgcctggtaaacgacctcgcctgaggttaacaggaattgatgaccctgaatcagtccaacgctccattggagggctaagaatcatcggtctaagactcgagcaactcgcagaggataatggagtatccttcaaattcaaagcaatgccttcaaagacttcgattgtctctccatcaacactcggttgcaaaccaggagaaaccttaatagtgaactttgcattccaacttcaccacatgcctgacgagagtgtcacaacagtaaaccagcgggacgagctacttcacatggtcaaaagcttaaacccaaagcttgtcacggtcgttgaacaagacgtgaacacaaacacttcaccgttctttcccagattcatagaggcttacgaatactactcagcagttttcgagtctctagacatgacacttccaagagaaagccaagagaggatgaatgtagaaagacagtgtctcgctagagacatagtcaacattgttgcttgcgaaggagaagaacggatagagagatacgaggctgcgggaaaatggagagcaaggatgatgatggctggattcaatccaaaaccaatgagtgctaaagtaaccaacaatatacaaaacctgataaagcaacaatattgcaataagtacaagcttaaagaagaaatgggtgagctccatttttgctgggaggagaaaagcttaatcgttgcttcagcttggaggtaagataagtgacaagagcatatagtctttatgtttcataaaacataattatgtttttactgtaatcttgggttattgtgtaactggttaaatcatctccatgtattattaccagaggttaggggtgatcacaggtactaaaagctaatctaacacttatggaagaatttttctttc

SEQ ID NO: 1294 - protein, 593 aa, Arabidopsis thaliana
  misc_feature (1)..(593): Ceres CLONE ID no. 109490
  misc_feature (1)..(593): GEMINI ID 552G11
  misc_feature (196)..(502): Pfam Name: GRAS Pfam Description: GRAS family transcription factor
  misc_feature (196)..(502): Pfam Name: GRAS Pfam Description: GRAS family transcription factor
MVEQTVVREHIKARVMSLVRSAEPSSYRNPKLYTLNENGNNNGVSSAQIFDPDRSKNPCLTDDSYPSQSYEKYFLDSPTDEFVQHPIGSGASVSSFGSLDSFPYQSRPVLGCSMEFQLPLDSTSTSSTRLLGDYQAVSYSPSMDVVEEFDDEQMRSKIQELERALLGDEDDKMVGIDNLMEIDSEWSYQNESEQHQDSPKESSSADSNSHVSSKEVVSQATPKQILISCARALSEGKLEEALSMVNELRQIVSIQGDPSQRIAAYMVEGLAARMAASGKFIYRALKCKEPPSDERLAAMQVLFEVCPCFKFGFLAANGAILEAIKGEEEVHIIDFDINQGNQYMTLIRSIAELPGKRPRLRLTGIDDPESVQRSIGGLRIIGLRLEQLAEDNGVSFKFKAMPSKTSIVSPSTLGCKPGETLIVNFAFQLHHMPDESVTTVNQRDELLHMVKSLNPKLVTVVEQDVNTNTSPFFPRFIEAYEYYSAVFESLDMTLPRESQERMNVERQCLARDIVNIVACEGEERIERYEAAGKWRARMMMAGFNPKPMSAKVTNNIQNLIKQQYCNKYKLKEEMGELHFCWEEKSLIVASAWR

SEQ ID NO: 1295 - DNA, 1758 bp, Populus balsamifera subsp. trichocarpa
  misc_feature (1)..(1758): Ceres ANNOT ID no. 1443194
atgtctttagttggacctgcagaactttctgcaacaccatacggaaatcataagctgtactcactgaaggggagcaatgacaactctggcttgtctgcccaaatattctgccctgataaacgtcagaacatgtatatgaccgattcttactccagtgagagttatgagaagtacttccttgattccccaacagaagagctaatacaaccatcaagttctggcatttcagggaattcagctccacctcaaggcacatcttcctaccagctaagaaagaatttaggtccatccatgtcccctcaagatgatccatacgacgcttgtttcacattgacgacaccctgtgatggctatcaattcaattccgagtcagattacttggacatcgagagcccagatccactaaactatgatgaatataagatgaaattaaagtttcaggaacttgagagagcgcttctaaatgataatgatgaggatggcatgtttggaaatagtcagagcatggaaatggatggagagtggtctgatccaatccagaatgggatgctccatgattctcccaaggagtcatcatcttctgattctagcctaagtagcatcagcagtaataaagaagtatcacagttatctcctcgaactcccaggcgattgctttttgaatgtgctaatgcaatctcagagggaaacattgagaaagcatcaactttaataaacgagctccgtcaattggtgtcaattcaaggagatcctccgcagaggattgcagcctacatggtggaaggtcttgcagctcgtatggctgaatctggaaaatatctctataaagctctgaaatgcaaggaacctccttcttctgataggcttgcagctatgcagatcctttttgagatttgcccttgttttaaatttggatttatggcagcaaatggtgcaatgatcgaggcatttaaaggtgaaaggagagttcatataatagattttgacataaaccaagggagtcaatacataacactgatacaaacactcgccaaccatcaaggtaagctaccacacttgaggttaacaggggtcgatgaccctgagtcagttcaacgacctgttggtggcctgaggatcattgggcaaaggcttgaaaagctagcagaagcatataaggtctcgttcgagtttcatgcagtggcctccaagacttcacttgtcaatccatcaatgctgaactgcaagcctggggaagcacttatagttaattttgctttccaactccaccacatgcctgatgagagtgtttcaacggtaaacgagagagaccagcttcttcggatggctaagagcttgaatccaaaactagtaactgttgttgagcaagatgtgaatactaacactgccccttttttcccgagattcaccgaagcttacaactattactctgctgtgtttgactctcttgatgcaactctcccacgggagagccaggatagactgaatgttgagaaacagtgcctggcaagggacatagtgaacatagtcgcatgtgagggagaggaaaggattgagcggtatgaagttgcagggaaatggagagcaaggatgatgatggctggcttcacttcatgttcaatcactcctaatgtggttgatatgatccggaaactcatcaaggagtactgcgatagatacatgttgaagcaggaagtaggtgcgcttcattttgggtgggaggacaaaagtttgattgttgcttcagcatggaagtaa

SEQ ID NO: 1296 - protein, 585 aa, Populus balsamifera subsp. trichocarpa
  misc_feature (1)..(585): Ceres ANNOT ID no. 1443194
  misc_feature (1)..(585): Functional Homolog of  Ceres  ID no. 109490
  misc_feature (189)..(495): Pfam Name: GRAS Pfam Description: GRAS family transcription factor
  misc_feature (189)..(495): Pfam Name: GRAS Pfam Description: GRAS family transcription factor
MSLVGPAELSATPYGNHKLYSLKGSNDNSGLSAQIFCPDKRQNMYMTDSYSSESYEKYFLDSPTEELIQPSSSGISGNSAPPQGTSSYQLRKNLGPSMSPQDDPYDACFTLTTPCDGYQFNSESDYLDIESPDPLNYDEYKMKLKFQELERALLNDNDEDGMFGNSQSMEMDGEWSDPIQNGMLHDSPKESSSSDSSLSSISSNKEVSQLSPRTPRRLLFECANAISEGNIEKASTLINELRQLVSIQGDPPQRIAAYMVEGLAARMAESGKYLYKALKCKEPPSSDRLAAMQILFEICPCFKFGFMAANGAMIEAFKGERRVHIIDFDINQGSQYITLIQTLANHQGKLPHLRLTGVDDPESVQRPVGGLRIIGQRLEKLAEAYKVSFEFHAVASKTSLVNPSMLNCKPGEALIVNFAFQLHHMPDESVSTVNERDQLLRMAKSLNPKLVTVVEQDVNTNTAPFFPRFTEAYNYYSAVFDSLDATLPRESQDRLNVEKQCLARDIVNIVACEGEERIERYEVAGKWRARMMMAGFTSCSITPNVVDMIRKLIKEYCDRYMLKQEVGALHFGWEDKSLIVASAWK

SEQ ID NO: 1297 - DNA, 1755 bp, Populus balsamifera subsp. trichocarpa
  misc_feature (1)..(1755): Ceres ANNOT ID no. 1505312
atgtctttagttggatccgcagaactctctgccagagcatacggaaataataagctgtactcactgaaggggagcaatgacaactctggtttgtctgccaaaatattcgggcctgataaacggcagaacatgtatatgaccgattcttactcttgtgagagttatgagaagttcttccttgattccccaacagaagaaataatacaaccatcaagttctgacatttcagggaactcagctcatccacaaggggcatcttcctaccagccaagaaagagttcaggttcaaccatgttccctcaagatccctataatgcttctttcaatttgaccacaccctgcgatggctatccattcatttccgagtcagattacttggacattgagagcccatatcaactagattatgatgaatataagatgaagttaaagcttcaggaactagagagagcacttctagaggacaatgaagaggatggcatgtttggaaatagtcaaagcatggaaatggatgtagagtggtctgatccaatccagaatgggatgctccatgattctcccaaggagtcatcatcttcagattctaacctaagtagcttcagcagtaataaagaagtatcacagttatcacctcggactcccaggcgactgctttttgaatgtgctaatgcaatctcggagggaaacattgagaaagcatcggcattaataaatgagctccgtcaattggtctcgattcaaggagatcctccccagaggattgcagcctacatggtggaaggacttgcagctcatatggctgaatctggaatatatctctataaagctctgaaatgcaaggagcctccttctgatgataggcttgcagctatgcagatcctttttgagatttgcccttgttttaaatttggatttatggcagcaaatggtgcaatgatcgaagcatttaaaggtgaaaggagagttcatataatagattttgacataaaccaagggagtcaatacataacactgatacaaacactcgccaaccagccaggtaagctgccaaacttgaggttaaccggggttgatgaccccgagtcagttcaacgacctgttggtggcctgaggaacattgggcgaaggcttgaaaagctagcagaagcacttaaggtcccatttgagtttcatgcggtggcctccaagacttcagttgtcagtccatccatgctgaactgcaagcctggggaagcacttgtagtgaattttgctttccaactccatcacatgcctgatgagagtgtttcaacagtaaatgagcgagaccagcttcttcggatggctaagagcttgaatccaaaactggtaactgttgtcgagcaagatgtgaatactaatactgccccctttttcccgagatttactgaagcttacaactattactctgccgtgttcgattctcttgatgcaactctccctcgagaaagccaggacaggctgaatgttgagaaacagtgtctggcacgggacatagtaaacattgtagcatgtgagggagaggaaaggattgagaggtatgaggttgctgggaaatggagggcaagaatgaagatggcaggcttcactccgtgttcaatcagtcatagcgtggttgatttgattcgtaaactcataaagcagtatagcgatagatacatgttgaaggaggaagtgggtgcacttcattttgggtgggaagacaaaagtttggtttttgcttcagcatggaagtaa

SEQ ID NO: 1298 - protein, 584 aa, Populus balsamifera subsp. trichocarpa
  misc_feature (1)..(584): Ceres ANNOT ID no. 1505312
  misc_feature (1)..(584): Functional Homolog of  Ceres  ID no. 109490
  misc_feature (189)..(494): Pfam Name: GRAS Pfam Description: GRAS family transcription factor
  misc_feature (189)..(494): Pfam Name: GRAS Pfam Description: GRAS family transcription factor
MSLVGSAELSARAYGNNKLYSLKGSNDNSGLSAKIFGPDKRQNMYMTDSYSCESYEKFFLDSPTEEIIQPSSSDISGNSAHPQGASSYQPRKSSGSTMFPQDPYNASFNLTTPCDGYPFISESDYLDIESPYQLDYDEYKMKLKLQELERALLEDNEEDGMFGNSQSMEMDVEWSDPIQNGMLHDSPKESSSSDSNLSSFSSNKEVSQLSPRTPRRLLFECANAISEGNIEKASALINELRQLVSIQGDPPQRIAAYMVEGLAAHMAESGIYLYKALKCKEPPSDDRLAAMQILFEICPCFKFGFMAANGAMIEAFKGERRVHIIDFDINQGSQYITLIQTLANQPGKLPNLRLTGVDDPESVQRPVGGLRNIGRRLEKLAEALKVPFEFHAVASKTSVVSPSMLNCKPGEALVVNFAFQLHHMPDESVSTVNERDQLLRMAKSLNPKLVTVVEQDVNTNTAPFFPRFTEAYNYYSAVFDSLDATLPRESQDRLNVEKQCLARDIVNIVACEGEERIERYEVAGKWRARMKMAGFTPCSISHSVVDLIRKLIKQYSDRYMLKEEVGALHFGWEDKSLVFASAWK

SEQ ID NO: 1299 - DNA, 1507 bp, Panicum virgatum
  misc_feature (1)..(1507): Ceres CLONE ID no.1810690
acgagccggcgcccaccgtttcctcccctcctcagctcctcttgtgtcacgcccccgctcgtctcctccccccccccccgcgccgctcccgctcccgctccgcgctcccgtctcaccccgccgccgcgcaggcagtttccctcgttcgccgcgcccggctccgccgtcctgcaccggccagtctcgtggaggtgttaggaattgttcgtgctgaattgagaattgatcggtggaagctgcacattcactgttttatacctcagatctcaaaagtgataaattgacctggctggctgagaattgtgagataaataatgtctttcattaggcaagcagacccatcagcatcctgtgcagaaactccttacattcacaaatttgacccaccaggctcagttttccctgcacaaagatttgcctctggcaaagaattgcttcatcatggacctcaaccatataaatctgagggctatagacagtctggtttcaacgggacagcagctcatgtatttcagaactcgttttacaatactgatagccatgtggagtgtcacttcaatgaagcaacatgttctccaacaatctccaatgtatctcagcagaactcccaatctttatcagacaaccagacctccgatcttgaagtagagtttgatggagatgagatgaagctaaagcttcaggagcttgagcatgctttactcgatgatggtgatgagatcttttctgatttgttggggatcattgatgatgagtggaatgataacatgaagaacaatgactggactaataccatgaagaatatcatgagtccagactctccaaaagagtcatcaccagaatcaagcctctgttgtcctgacagcaataatggagaagcacgggccccaaaacagttgctctttgactgcgctgaagcaatatctgaatataatgtcgacgaagcacaatcaatcatagcagaactacgacagaaggttgcgattcagggagacccttctcagagaattgcagcctatcttgtggagggccttgctgccacaatacagtcttcaggaaaagggatctacagggctctgaggtgcaaggaggctcctactctgtaccagctttcagctatgcagatcctcttcgagatctgcccatgcttcaggctaggcttcatggctgctaactatgctattcttgaagcctgcaaaggtgaagaggttgtgcacattattgacttcgatatcaaccagggtagccaatatataacgctgatccagttcctacggaataacagtaacaagccacgtcttttgaggataactggtgtcgatgacccagagtcagttaacagggctgttggaggactaaaggttgttgggcagcgacttgagaagcttgcagaggactgtggggtcccatttgagttcagggcagtggcttctaacattgaggatgtgacacctggaatgctagattgccgtcctggagagaccctcattgttaactttgcatttct

SEQ ID NO: 1300 - protein, 562 aa, Panicum virgatum
  misc_feature (1)..(562): Ceres CLONE ID no. 1810690
  misc_feature (1)..(562): Functional Homolog of  Ceres  ID no. 109490
  misc_feature (167)..(472): Pfam Name: GRAS Pfam Description: GRAS family transcription factor
  misc_feature (167)..(472): Pfam Name: GRAS Pfam Description: GRAS family transcription factor
MSFIRQADPSASCAETPYIHKFDPPGSVFPAQRFASGKELLHHGPQPYKSEGYRQSGFNGTAAHVFQNSFYNTDSHVECHFNEATCSPTISNVSQQNSQSLSDNQTSDLEVEFDGDEMKLKLQELEHALLDDGDEIFSDLLGIIDDEWNDNMKNNDWTNTMKNIMSPDSPKESSPESSLCCPDSNNGEARAPKQLLFDCAEAISEYNVDEAQSIIAELRQKVAIQGDPSQRIAAYLVEGLAATIQSSGKGIYRALRCKEAPTLYQLSAMQILFEICPCFRLGFMAANYAILEACKGEEVVHIIDFDINQGSQYITLIQFLRNNSNKPRLLRITGVDDPESVNRAVGGLKVVGQRLEKLAEDCGVPFEFRAVASNIEDVTPGMLDCRPGETLIVNFAFLLHHLPDESVSMVNERDQLLRMVKGLRPKLVTLVEQDANTNTTPFLARFREVYDYYSALFDSLDATLPRESPDRMNVERQCLAREIVNILACEGPDRVERYEVAGKWRARLTMAGFVPSPFNTNVIDGIKSLLKSYCDKYRFEKVHDGLHFGWGDKTLVVSSAWQ

SEQ ID NO: 1301 - DNA, 1125 bp, Arabidopsis thaliana
  misc_feature (1)..(1125): Ceres CLONE ID no. 124720
  misc_feature (1)..(1125): GEMINI ID 216B4
  misc_feature (1)..(1125): GEMINI ID 554A1
attttcttctcttcttcacacaaacacacacagatctcttcttcatcacattacttctggctttacatcttttttcttctccatgaggaaagggagaggctcttccgtcgttggacccgcccttccagtaaccgccggtggatctgtgaaggagccgaggtatagaggcgttaggaagagaccttggggtcgattcgcagctgagatccgtgatccattaaaaaaatctcgtgtctggctcggtactttcgattccgccgtagatgctgcacgcgcttacgataccgccgctcgtaacctccgtggtccaaaggccaagaccaatttcccgatcgattgttctccttcttctcctctccaacctctcacctacctccacaatcaaaacctctgttctcctccggtgattcagaaccagatcgatccgtttatggaccatcggttatacggcggaggtaatttccaggagcagcagcagcagcagattattagtcggccggcgagtagcagcatgagcagcaccgttaaatcttgtagcggaccgagaccgatggaagccgcggcggcgtcttcgtcggtggcgaaaccgttacatgcgattaagagatatccgagaactccaccggtagctccggaggattgtcatagcgactgcgattcttcgtcgtctgttattgacgacggagatgatatcgcatcttcgtcttcccgccggaaaacgccgtttcagtttgatcttaatttcccgccgttggatggcgttgacttattcgctggcgggatagatgatctccactgtaccgatctacgtctctgatttgctgctttacaaaaaaaatccgttgattacacacaaaaaaaattctcaaattttacaaaatgataactttatgctcttttgtttttccattttcctttgatatcatattgaaagagaaaaaaaggaagaacaaaaaaaaaagattgagcgtgatgattttatcatcaacgaagatgatgacgattaaaaagagagagagattgtgttaagatctgttactgtaagaaccagatctgggtttcatttttatctgtttcttcttataaaagatccaacaaccctttgttacatatatataacattcc

SEQ ID NO: 1302 - protein, 244 aa, Arabidopsis thaliana
  misc_feature (1)..(244): Ceres CLONE ID no. 124720
  misc_feature (1)..(244): GEMINI ID 216B4
  misc_feature (1)..(244): GEMINI ID 554A1
  misc_feature (25)..(76): Pfam Name: AP2 Pfam Description: AP2 domain
MRKGRGSSVVGPALPVTAGGSVKEPRYRGVRKRPWGRFAAEIRDPLKKSRVWLGTFDSAVDAARAYDTAARNLRGPKAKTNFPIDCSPSSPLQPLTYLHNQNLCSPPVIQNQIDPFMDHRLYGGGNFQEQQQQQIISRPASSSMSSTVKSCSGPRPMEAAAASSSVAKPLHAIKRYPRTPPVAPEDCHSDCDSSSSVIDDGDDIASSSSRRKTPFQFDLNFPPLDGVDLFAGGIDDLHCTDLRL

SEQ ID NO: 1303 - protein, 235 aa, Brassica napus
  misc_feature (1)..(235): Ceres CLONE ID no. 975672
  misc_feature (1)..(235): Functional Homolog of  Ceres  ID no. 124720
  misc_feature (41)..(92): Pfam Name: AP2 Pfam Description: AP2 domain
  misc_feature (194)..(194): Xaa is any aa, unknown, or other
  misc_feature (214)..(214): Xaa is any aa, unknown, or other
  misc_feature (228)..(228): Xaa is any aa, unknown, or other
  misc_feature (229)..(229): Xaa is any aa, unknown, or other
  misc_feature (234)..(234): Xaa is any aa, unknown, or other
FHQLQTHRSLLNHITSGSPTMRKGRGSSAVPPALPGSVKEPRYRGVRKRPWGRFAAEIRDPLKKSRVWLGTFDSAEEAARAYDAAARNLRGPKAKTNFQIDCSPSSPLQPLHHRNQIDPFMDHRLYGGEQEVVIISRPASSSMSSTVKSCSGVRPASSSVAKAATKRYPRTPPVAPEDCRSDCDSSSSVVEDGXDIASSSSRRKPPFEFDLNFXPLDGVDLFVGADDXXCTDLXL

SEQ ID NO: 1304 - protein, 208 aa, Glycine max
  misc_feature (1)..(208): Ceres CLONE ID no. 1044385
  misc_feature (1)..(208): Functional Homolog of  Ceres  ID no. 124720
  misc_feature (22)..(73): Pfam Name: AP2 Pfam Description: AP2 domain
MVKEKKNVVVKNKKPNNNADELHFRGVRKRPWGRYAAEIRDPGKKTRVWLGTFDTAEDAARAYDAAARNFRGPKAKTNFPVPPDDNNNNNVNVNKNKSVNVKSHSPSQSSTVESATPEREATRRSTSAAIDRFPFLPIQQQILMTHPVAAPMRPVFFLDRAHFMTQSFPLRFEPGPVQSDSDSSSVVVDCQPKREINLDLNLAPPNEY

SEQ ID NO: 1305 - protein, 176 aa, Glycine max
  misc_feature (1)..(176): Public GI no. 55419650
  misc_feature (1)..(176): Functional Homolog of  Ceres  ID no. 124720
  misc_feature (21)..(72): Pfam Name: AP2 Pfam Description: AP2 domain
MAPRSKPSPISPNPDPNSKEIRYRGVRKRPWGRYAAEIRDPRKKTRVWLGTFDTAEEAARAYDAKAREFRGAKAKTNFADNNANDFTRSPSQSSTVESSSPPPLDLTLASPCSSLPVTAQRPVYFFDAFATGGSGCPASGFAQSDSDSSSSVVDFEGGVRRRVFDLDLNQLPAEMD

SEQ ID NO: 1306 - protein, 218 aa, Glycine max
  misc_feature (1)..(218): Public GI no. 56384582
  misc_feature (1)..(218): Functional Homolog of  Ceres  ID no. 124720
  misc_feature (21)..(72): Pfam Name: AP2 Pfam Description: AP2 domain
MGRGGATTAAAAVEPVFFKEPRYRGVRKRPWGRFAAEIRDPLKKARVWLGTFDTAEEAARAYDTAARNLRGPKAKTNFPLAQPFYQNPEAGNPFGELRFYAGGAGEGFQDHRRPTSSGMSSTVESFGGPRPVRPPMPPSAVTGRRYPRTPPVAPGDCRSDCDSSSSVVDDADNDNAASSTMLSFKRQPLPFDLNAPPLEEGDVANGLGEDLHCTLLCL

SEQ ID NO: 1307 - protein, 225 aa, Glycine max
  misc_feature (1)..(225): Public GI no. 57012880
  misc_feature (1)..(225): Functional Homolog of  Ceres  ID no. 124720
  misc_feature (26)..(77): Pfam Name: AP2 Pfam Description: AP2 domain
MRRGRAAAAPAPVTGEPNGSGGSKEIRFRGVRKRPWGRFAAEIRDPWKKTRVWLGTFDSAEDAARAYDAAARALRGPKAKTNFPLPYAHHHQFNQGHNPNNDPFVDSRFYPQDNPIISQRPTSSSMSSTVESFSGPRPPPAPRQQTTASSRKYTRSPPVVPDDCHSDCDSSSSVVDHGDCEKENDNDNDNIASSSFRKPLLFDLNLPPPMDDAGADDLHCTALCL

SEQ ID NO: 1308 - protein, 190 aa, Glycine max
  misc_feature (1)..(190): Public GI no. 50929507
  misc_feature (1)..(190): Functional Homolog of  Ceres  ID no. 124720
  misc_feature (13)..(64): Pfam Name: AP2 Pfam Description: AP2 domain
MVGGEVMCEAAAPRYRGVRKRPWGRFAAEIRDPAKRARVWLGTYDSAEAAARAYDVAARNLRGPLARTNFPLVSSLPLPSPHYHLPGKAAAAAPPVAGPACSASSTVESSSGPRGPRPAATAAAVPRRRVPRPAPPAPDAGCHSDCASSASVVDDADDASTVRSRVAAFDLNLPPPLDRDHVDLCTDLRL

SEQ ID NO: 1309 - protein, 211 aa, Zea mays
  misc_feature (1)..(211): Ceres CLONE ID no. 273307
  misc_feature (1)..(211): Functional Homolog of  Ceres  ID no. 124720
  misc_feature (17)..(68): Pfam Name: AP2 Pfam Description: AP2 domain
MRRRGVAAADADGDVELRFRGVRKRPWGRYAAEIRDPAKKARVWLGTFDSAEDAARAYDAAARMLRGPKARTNFPLPAAAALHHPHMPAAAAAAAPPYTTYPTATGVVSTPPVARPACSSLSSTVESFSGARPRPVLPPRFPPPSIPDGDCRSDCGSSASVVDDDCTDAAASASCPFPLPFDLNLPPGGGGAGVGFYADEEDELRLTALRL

SEQ ID NO: 1310 - DNA, 660 bp, Populus balsamifera subsp. trichocarpa
  misc_feature (1)..(660): Ceres ANNOT ID no. 1441430
atggggagaacaagaacaacaacaaaacaggctgttgacccaaatggatctgcaacccaaaatatgttagtaattgcaaaagagcccagatacagaggagtacgaaagagaccatggggaagattcgctgcggagattagagatccctggaaaaagaccagagtttggctgggcaccttcgactctgcagaggatgcagcgcgtgcctacgatgcggctgctcgcaccctccgcggagcaaaggccaagacaaactttcctatctccacaacgaaccagttattcaatcatcaaaatcaaaaccaaagcccaaccgatcccttcttggatcaccacagtataaatccccaaagacccacatctagcagtttgagcagtacagtggagtctttcagcggtcctaggcctccgcagccaacaacaacaacaaaatcgggaaatgggccgaggagatctcatccacggatcccaccggttgttccagaagattgtcatagcgattgcgattcatcttcttcggtggttgatgacagagatgtcgcatccgctgcttcttctttgtgccgcaagcctttgcctttcgatctaaatttcccaccgttggaccaggttgacttgggctctggtgatgatctccactgcactgctttatgcctttga

SEQ ID NO: 1311 - protein, 219 aa, Populus balsamifera subsp. trichocarpa
  misc_feature (1)..(219): Ceres ANNOT ID no. 1441430
  misc_feature (1)..(219): Functional Homolog of  Ceres  ID no. 124720
  misc_feature (29)..(80): Pfam Name: AP2 Pfam Description: AP2 domain
MGRTRTTTKQAVDPNGSATQNMLVIAKEPRYRGVRKRPWGRFAAEIRDPWKKTRVWLGTFDSAEDAARAYDAAARTLRGAKAKTNFPISTTNQLFNHQNQNQSPTDPFLDHHSINPQRPTSSSLSSTVESFSGPRPPQPTTTTKSGNGPRRSHPRIPPVVPEDCHSDCDSSSSVVDDRDVASAASSLCRKPLPFDLNFPPLDQVDLGSGDDLHCTALCL

SEQ ID NO: 1312 - DNA, 983 bp, Panicum virgatum
  misc_feature (1)..(983): Ceres CLONE ID no.1761125
accagaccacaccacaccacaccgcgtccacatcctcccgcgcttctccgctcagcccgcgcgtttccgctgaggagggatagccgcgcggcgcgtcgaggggtttgtctttgatcgggtagctgaggctgagcgggcggggcaggatgatgcgcgacacggcggccgtggccgtggcggcgccgcggtacaggggcgtgcggaagcggccgtggggccggttcgcggcggagatccgcgacccggcgaagcgcgcgcgcgtctggctcggcaccttcgactccgccgaggccgcggcgcgcgcctacgacgtcgccgcgcggaccctgcgcggcccgctcgccaggaccaacttcccctgcgcctcctcccgcctcccgctgccctcccgccaccaaggcggctgtggcggcggcctcgtcgcgccgccgcccgccgcgccgacgtgcagctccagctccaccgtcgagtcctccagcggaccccgaggggcgcccagggctgctgcggcggcggcgcctcgaattcggaggcggtcggtgaaaaagccgcggccggcagcgcccgacatcgactgccacagcgactgcgcctcgtcggcctccgtcgtggacgacggcgacgacgcctccacggtccggtcgcgcgcgccgttcgacctcaacgtcccggctccggtggacggtgaccacgccctcgacctctgcacggagctgcggctctgagcaatatgatcctcgaacaacaacaacagcaaaacattgaaggcgatttttccccggtcttcttttcctgactaaattctgatatgatcaatatgctcgagagttctcgttttctttaacgcctcttgtatttggatctgctaccatcttctctgcccattctatttgtacaccagataacatgtaagatgttcacgaattaacacatatcttttcttaaaaaaatgaattaacacggaaaaaaaaaaaaaaaaaaaa

SEQ ID NO: 1313 - protein, 192 aa, Panicum virgatum
  misc_feature (1)..(192): Ceres CLONE ID no. 1761125
  misc_feature (1)..(192): Functional Homolog of  Ceres  ID no. 124720
  misc_feature (13)..(64): Pfam Name: AP2 Pfam Description: AP2 domain
MMRDTAAVAVAAPRYRGVRKRPWGRFAAEIRDPAKRARVWLGTFDSAEAAARAYDVAARTLRGPLARTNFPCASSRLPLPSRHQGGCGGGLVAPPPAAPTCSSSSTVESSSGPRGAPRAAAAAAPRIRRRSVKKPRPAAPDIDCHSDCASSASVVDDGDDASTVRSRAPFDLNVPAPVDGDHALDLCTELRL

SEQ ID NO: 1314 - DNA, 871 bp, Zea mays
  misc_feature (1)..(871): Ceres CLONE ID no. 208429
  misc_feature (1)..(871): GEMINI ID 538B5
aatccatcaatcctcatcgccacccaacccgccaagtccccaagcaagttgagcatccatccatccatggcgggaggcaagtccaccggcaatgccgcgcgcagcaggaagcgcgtcgaggcaaccgtcctcaagcgctccagggacgggagcgccttcaccagatgcgaggcctgcaacaaggacgtccccgtcgtcctcatcgacatgcacagctgcagcctcgacgagaagatcaggatgacgctcgaggcgcaggtcgtcgagaagaccgtcgaggtcgccagtgcggaccgcaagaagtcctccgccaagggaggtggtaacaaggacgccaagcgcaagcgctcgcccaccgccttcttcctcttcatggacgacttcaggaaggagttcaaggccacccatcctgacaacaagagtgtcgctaccgttgcaaaggaaggaggggagaggtggaagtccatgacagacgaggagaagaagccttacattgaaaaggccgcggagctcaaggctgaggccgagaatggcgagggcagtggtgagaacaatgttgccactaagaaagccaagacagatgaccaggaggtggatcagccagcaaagaagctcagaaagtgcaaggctcttcacgaggacgaggatgacgatggtgaccaggaagacgaggatgagaagaacgagttggatgacgacatgtagatggcagaggccactctcccatctctgtaaatggatggcagatgtgagcgtcttgttagaaatgtcacttgtttcaagctagagggaagagggagagtagtcagtagtgaatatcccccgttatcgttgctacatgaatgaactattctatgatgcagttctgtcc

SEQ ID NO: 1315 - protein, 212 aa, Zea mays
  misc_feature (1)..(212): Ceres CLONE ID no. 208429
  misc_feature (1)..(212): GEMINI ID 538B5
  misc_feature (93)..(152): Pfam Name: HMG_box Pfam Description: HMG (high mobility group) box
MAGGKSTGNAARSRKRVEATVLKRSRDGSAFTRCEACNKDVPVVLIDMHSCSLDEKIRMTLEAQVVEKTVEVASADRKKSSAKGGGNKDAKRKRSPTAFFLFMDDFRKEFKATHPDNKSVATVAKEGGERWKSMTDEEKKPYIEKAAELKAEAENGEGSGENNVATKKAKTDDQEVDQPAKKLRKCKALHEDEDDDGDQEDEDEKNELDDDM

SEQ ID NO: 1316 - DNA, 606 bp, Populus balsamifera subsp. trichocarpa
  misc_feature (1)..(606): Ceres ANNOT ID no. 1457538
atggcaaggaagagagtggaggctgagtctacagatgggtctgttgatgccaatactaccacttcacttgttcgtgcgaaagatggcagtgcttttactaagtgtgaggagtgcaagaaggatgtgccagtggctcttataagtttccacagctgtagccttgatgctaagatcaagatgaatttggaggctcaagttgttgaaaagccaactgaagctaagcagaaaccagctgagaggaagaaaggaagttcaactgagccaaaattgaagaaagctaaaaaagaaaagaagggcagggatccaaatgcaccgaaacgccctcccactgcattctttctctttatggatgactttaggaaggaatacaaggaagcgaacccggactctaaggatgttaagaaggttgcgaaggaaggtggtgtgagatggaagtcaatgaccgatgaagagaagaagcaatatgtggataaggctgctgagctcaaggcagagaatgacaaggcattggagagtgacaacgctgaaaatgaagatgacgaaggggtttcttcagagaaggaagtagccgatcttgaactgcgagataaagaggaggaaatttga

SEQ ID NO: 1317 - protein, 201 aa, Populus balsamifera subsp. trichocarpa
  misc_feature (1)..(201): Ceres ANNOT ID no. 1457538
  misc_feature (1)..(201): Functional Homolog of  Ceres  ID no. 208429
  misc_feature (105)..(165): Pfam Name: HMG_box Pfam Description: HMG (high mobility group) box
MARKRVEAESTDGSVDANTTTSLVRAKDGSAFTKCEECKKDVPVALISFHSCSLDAKIKMNLEAQVVEKPTEAKQKPAERKKGSSTEPKLKKAKKEKKGRDPNAPKRPPTAFFLFMDDFRKEYKEANPDSKDVKKVAKEGGVRWKSMTDEEKKQYVDKAAELKAENDKALESDNAENEDDEGVSSEKEVADLELRDKEEEI

SEQ ID NO: 1318 - DNA, 549 bp, Populus balsamifera subsp. trichocarpa
  misc_feature (1)..(549): Ceres ANNOT ID no. 1510743
atggcaaggaagagagtggaggctgagtctacagatgggtctgttgatgccaatactaccacttcacttgttcgtgcgaaagatggcagtgcttttactaagtgtgaggagtgcaagaaggatgtgccagtggctcttataagtttccacagctgtagccttgatgctaagatcaagatgaatttggaggctcaagttgttgaaaagccaactgaagctaagcagaaaccagctgagaggaagaaaggaagttcaactgagccaaaattgaagaaagctaaaaaagaaaagaagggcagggatccaaatgcaccgaaacgccctcccactgcattctttctctttatggatgactttaggaaggaatacaaggaagcgaacccggactctaaggatgttaagaaggttgcgaaggaaggtggtgtgagatggaagtcaatgaccgatgaagagaagaagcaatatgtggataaggctgctgagctcaaggcagagaatgacaaggcattggagagtgacaacgctgaaaatgaagatagaaggaagtag

SEQ ID NO: 1319 - protein, 182 aa, Populus balsamifera subsp. trichocarpa
  misc_feature (1)..(182): Ceres ANNOT ID no. 1510743
  misc_feature (1)..(182): Functional Homolog of  Ceres  ID no. 208429
  misc_feature (105)..(165): Pfam Name: HMG_box Pfam Description: HMG (high mobility group) box
MARKRVEAESTDGSVDANTTTSLVRAKDGSAFTKCEECKKDVPVALISFHSCSLDAKIKMNLEAQVVEKPTEAKQKPAERKKGSSTEPKLKKAKKEKKGRDPNAPKRPPTAFFLFMDDFRKEYKEANPDSKDVKKVAKEGGVRWKSMTDEEKKQYVDKAAELKAENDKALESDNAENEDRRK

SEQ ID NO: 1320 - DNA, 665 bp, Panicum virgatum
  misc_feature (1)..(665): Ceres CLONE ID no.1963116
acagacctctcctctctccatcctccaatctccaagcagcagcagcagcagatcccatccatggcggggggcaagtccaccggcaacgccgcgcgcaccaggaagcgcgtcgaggccaccgtcctcaagcgctccagggacggcagcgcattcaccagatgcgaggcctgcaacaaggacgtccccgtcgtcctcatcgacatgcacagctgcagcctcgacgccaagatcaggatgacgctcgaggcgcaggtggtcgagaggaccgtcgaggtcaccaagcccgaccgcaagaagccctccaagaccgccaaggaccccaagcgcaagcgcacgcccaccgccttcttcctcttcatggccgacttcaggaaggagttcaaggccgcccatcctgacaacaagaatgtcgccaccgttgcaaaggaaggaggggagaagtggaactccatgaccgaccaagagaagaagccctacatggacaaggctgccgagctcaaggctcttgctgagaatggcgagggcagtggtgagaacaatgtcgctggtgccgagaacgagaaagccaaggcagatgaggagggggaccaggaggtggatcagccaccgcccaagaggcgccgccgccgcaaggtcgctgatgatgaggatgaggaggacgaggc

SEQ ID NO: 1321 - protein, 201 aa, Panicum virgatum
  misc_feature (1)..(201): Ceres CLONE ID no. 1963116
  misc_feature (1)..(201): Functional Homolog of  Ceres  ID no. 208429
  misc_feature (90)..(148): Pfam Name: HMG_box Pfam Description: HMG (high mobility group) box
MAGGKSTGNAARTRKRVEATVLKRSRDGSAFTRCEACNKDVPVVLIDMHSCSLDAKIRMTLEAQVVERTVEVTKPDRKKPSKTAKDPKRKRTPTAFFLFMADFRKEFKAAHPDNKNVATVAKEGGEKWNSMTDQEKKPYMDKAAELKALAENGEGSGENNVAGAENEKAKADEEGDQEVDQPPPKRRRRRKVADDEDEEDE

SEQ ID NO: 1322 - DNA, 782 bp, Zea mays
  misc_feature (1)..(782): Ceres CLONE ID no. 225321
  misc_feature (1)..(782): GEMINI ID 552C9
agcgagagtagcggtcgtggatgattctgccttttcttctccttccctcacctgctctctctctctctccctttctttcccgcggcgacggtgacgacgaccgcgcgagcgccgccgactccctactgcatcaggtgcctcggccttcgtcgtgctctccgccggcaacgagtatagacgggcgcgcatggccaccttcgagctgtaccggaggtccaccatcggcatgtgcctcaccgagacgctcgacgagatggtctccaacggcaccytcagcccggagctcgctatccaggtcctcgtccagttcgacaagtccatgacggatgctctggagaaccaagtgaagagcaaggttactgtcaagggtcacctgcacacctacaggttctgtgacaacgtgtggaccttcatcttgacagacgcaagcttcaagaatgaggaggccacggagcaggtgggcaaggtgaagattgtggcatgtgattccaaattgctcggacaataggcctgtgtaccctcgaggtcaaggaaggaagcttttaagtgcggcgaggcggggtctgtctgcgcgtcagctgtacacgcctaggctaccgcgaggcggggtctgtctgcgtcagctgtacacgcctaggctaccgcccgaacggcatttcatttgccttcttcgtactgtatgtgtatcttcttttttccccttgtatacaatctgctgcagctataccggccaagagtatggcatggtatggcggcaggcagccgcaaacttgtttttacct

SEQ ID NO: 1323 - protein, 106 aa, Zea mays
  misc_feature (1)..(106): Ceres CLONE ID no. 225321
  misc_feature: Bit Score of 293.5 for HMM based on sequences of FIGURE 81
  misc_feature (1)..(106): GEMINI ID 552C9
  misc_feature (2)..(50): Pfam Name: TFIIA_gamma_N Pfam Description: Transcription initiation factor IIA, gamma subunit, helical domain
  misc_feature (52)..(101): Pfam Name: TFIIA_gamma_C Pfam Description: Transcription initiation factor IIA, gamma subunit, beta-barrel domain
MATFELYRRSTIGMCLTETLDEMVSNGTLSPELAIQVLVQFDKSMTDALENQVKSKVTVKGHLHTYRFCDNVWTFILTDASFKNEEATEQVGKVKIVACDSKLLGQ

SEQ ID NO: 1324 - DNA, 321 bp, Populus balsamifera subsp. trichocarpa
  misc_feature (1)..(321): Ceres ANNOT ID no. 1504670
atggcgacgtttgagctgtatagaagatcgacgatcgggatgtgcttgacggagactcttgatgacatggttcaaaacggtactctcagtcctgagctagccttccaggttcttgttcagtttgataagtccatgactgaagctttggaaacaaaagtgaagagcaaagtctcaattaagggacatctgcatacctacagattctgcgacaatgtttggaccttcattttacaggatgctatgtttaagaatgaggacacgcaggagaatgttgggcgggttaaaatagtggcatgcgactcaaagctgcttacgcaatga

SEQ ID NO: 1325 - protein, 106 aa, Populus balsamifera subsp. trichocarpa
  misc_feature (1)..(106): Ceres ANNOT ID no. 1504670
  misc_feature: Bit Score of 288.8 for HMM based on sequences of FIGURE 81
  misc_feature (1)..(106): Functional Homolog of  Ceres  ID no. 225321
  misc_feature (2)..(50): Pfam Name: TFIIA_gamma_N Pfam Description: Transcription initiation factor IIA, gamma subunit, helical domain
  misc_feature (52)..(101): Pfam Name: TFIIA_gamma_C Pfam Description: Transcription initiation factor IIA, gamma subunit, beta-barrel domain
MATFELYRRSTIGMCLTETLDDMVQNGTLSPELAFQVLVQFDKSMTEALETKVKSKVSIKGHLHTYRFCDNVWTFILQDAMFKNEDTQENVGRVKIVACDSKLLTQ

SEQ ID NO: 1326 - DNA, 354 bp, Populus balsamifera subsp. trichocarpa
  misc_feature (1)..(354): Ceres ANNOT ID no. 1451585
atggcgacgtttgagctgtatagaagatcgacgatcgggatgtgcttgacggagactcttgatgacatggttcaaaacggtactctcagtcctgagctagccttccaggttcttgttcagtttgataagtccatgactgaagctttggaaacaaaagtgaagagcaaagtctcaattaagggacatctgcatacctacagattctgcgacaatgtttggaccttcattttacaggatgctatgtttaagaatgaggacacgcaggagaatgttgggcggtttaacgtgggtgtccgggccagcttgcgcgcacctcgactaatcccacgggctctaaagttaacgaccatgtaa

SEQ ID NO: 1327 - protein, 117 aa, Populus balsamifera subsp. trichocarpa
  misc_feature (1)..(117): Ceres ANNOT ID no. 1451585
  misc_feature: Bit Score of 246.1 for HMM based on sequences of FIGURE 81
  misc_feature (1)..(117): Functional Homolog of  Ceres  ID no. 225321
  misc_feature (2)..(50): Pfam Name: TFIIA_gamma_N Pfam Description: Transcription initiation factor IIA, gamma subunit, helical domain
  misc_feature (52)..(90): Pfam Name: TFIIA_gamma_C Pfam Description: Transcription initiation factor IIA, gamma subunit, beta-barrel domain
MATFELYRRSTIGMCLTETLDDMVQNGTLSPELAFQVLVQFDKSMTEALETKVKSKVSIKGHLHTYRFCDNVWTFILQDAMFKNEDTQENVGRFNVGVRASLRAPRLIPRALKLTTM

SEQ ID NO: 1328 - DNA, 686 bp, Panicum virgatum
  misc_feature (1)..(686): Ceres CLONE ID no.1785734
ggttgaagtggaacctttcccttctctcggactgtctcctcccttctctttcttccctcgcggcggcgacgactgggcgagcggcggcgccatttgtcacgtcttcgtccagaccctttgccggcgacgagcatcctccaggcggcggccatggccaccttcgagctctaccggaggtccaccatcggcatgtgcctcaccgagacgctcgacgagatggtctccagcggcaccctcagcccggagctcgccatccaggtcctcgtccagtttgacaagtctatgacggatgctctggagaaccaagtgaagagcaaggttaacatcaagggccatctgcacacctacaggttctgcgacaatgtgtggaccttcatcttgacggatgcacagttcaagaatgaggagacaaccgagcaggtgggcaaggtgaaaattgtggcctgcgactccaaattgctgagccaaagccagtagaggccctatgctcgtggtggggtgtgtcttgtctgggcaccagagtagcagtgctctgttcagctgcttctttacctggctcctgcctgcatttgcgttgctgttagtgatatatcttgtatacaatctgctggtgttatatataccaccaaccaaccagagtatgtcatggtgtggtatgacagcaagcagatctaaacccttttatt

SEQ ID NO: 1329 - protein, 108 aa, Panicum virgatum
  misc_feature (1)..(108): Ceres CLONE ID no. 1785734
  misc_feature: Bit Score of 292.6 for HMM based on sequences of FIGURE 81
  misc_feature (1)..(108): Functional Homolog of  Ceres  ID no. 225321
  misc_feature (2)..(50): Pfam Name: TFIIA_gamma_N Pfam Description: Transcription initiation factor IIA, gamma subunit, helical domain
  misc_feature (52)..(101): Pfam Name: TFIIA_gamma_C Pfam Description: Transcription initiation factor IIA, gamma subunit, beta-barrel domain
MATFELYRRSTIGMCLTETLDEMVSSGTLSPELAIQVLVQFDKSMTDALENQVKSKVNIKGHLHTYRFCDNVWTFILTDAQFKNEETTEQVGKVKIVACDSKLLSQSQ

SEQ ID NO: 1330 - DNA, 644 bp, Panicum virgatum
  misc_feature (1)..(644): Ceres CLONE ID no.1886324
gcgtctccgtatataagaacccagatttcgaattcctcctcccctctcccaaggctccgcgctcctcgtcgacgccgctgttccagcagatcccaagggagtcttcctcctccgatccgtccccgtcccgatcctcgctggggatggccaccttcgagctgtaccggaggtccaccatcggcacctgcctcaccgagacgcttgacgagctcgtgtccagcggggccgtcagccccgagctcgccattcaagtccttgtgcagtttgacaagtccatgactgacgcgctggagagtcaggtcaagagcaaggttaacatcaagggccatctgcacacctacaggttctgcgacaatgtctggaccttcattctaacagatgcaaccttcaagagcgaggagatttcagaaacattgggcaaggtgaagatcgtggcctgcgattctaagttgctgcagcctcatcaaccataaattgacagccacctgctccatgtcgattgatcaccatccagtttagctcagttgatgctattcctggcgccacccaaactttcctagtttatgtgaatttgccctctctgaatgttgtttctgtgaatctaaactatcaccgtggcactagagtaccagggctgacaactt

SEQ ID NO: 1331 - protein, 109 aa, Panicum virgatum
  misc_feature (1)..(109): Ceres CLONE ID no. 1886324
  misc_feature: Bit Score of 270.4 for HMM based on sequences of FIGURE 81
  misc_feature (1)..(109): Functional Homolog of  Ceres  ID no. 225321
  misc_feature (2)..(50): Pfam Name: TFIIA_gamma_N Pfam Description: Transcription initiation factor IIA, gamma subunit, helical domain
  misc_feature (52)..(101): Pfam Name: TFIIA_gamma_C Pfam Description: Transcription initiation factor IIA, gamma subunit, beta-barrel domain
MATFELYRRSTIGTCLTETLDELVSSGAVSPELAIQVLVQFDKSMTDALESQVKSKVNIKGHLHTYRFCDNVWTFILTDATFKSEEISETLGKVKIVACDSKLLQPHQP

SEQ ID NO: 1332 - DNA, 780 bp, Zea mays
  misc_feature (1)..(780): Ceres CLONE ID no. 333753
  misc_feature (1)..(780): GEMINI ID 538C6
  misc_feature: Encodes the peptide sequence at SEQ ID NO. 1333
tccactcgcacgctaaccctacacactcccgtttacgggcacacctccaaaccctcatcacgatccggctccaaggtctcgagatgaagtcgagggcgaggtccggcggtggcgactccaggctctcggtgaggaagaccaaggttgagaaggacccaaacaagcccaagaggcctccgaccacgttcttcgtcttcatggaggagttcaggaaggactacaaggagaagcaccccaatgtgaagcaagtctcagtcattggcaaggctggtggtgacatgtggaagtccttgtctgatgccgagaaggctccctacgtatctaaggccgagaagctgaaggttgagtacacaaagaagatggacgcctataacaacaagcagtctggaggaggacccacattgtctggtgattctgacaagtccaagtccgaggtcaacgacggggacgaggagggtgatgagtgatggatgacgggtgaaactctgggctgcccaagtgcttgcagtcagcagggaaatctcatcgtcgttgggcctaaccgggctttgctgctccgtagcgtctggaagctgtctgtcttttgagatgctgtagactagtagtgcctgctctgagttagtaattgaaagtgttgtccctgaagtgatgctgtttagttggtagtgtgttcgcttcttcggcacttatacttacccccaagcatcaacgctgcctgttttaaatctcaataggtgctgttttaaatctcagatctcaatatatgactactgatcgctg

SEQ ID NO: 1333 - protein, 127 aa, Zea mays
  misc_feature (1)..(127): Ceres CLONE ID no. 333753
  misc_feature (1)..(127): GEMINI ID 538C6
  misc_feature (28)..(97): Pfam Name: HMG_box Pfam Description: HMG (high mobility group) box
MKSRARSGGGDSRLSVRKTKVEKDPNKPKRPPTTFFVFMEEFRKDYKEKHPNVKQVSVIGKAGGDMWKSLSDAEKAPYVSKAEKLKVEYTKKMDAYNNKQSGGGPTLSGDSDKSKSEVNDGDEEGDE

SEQ ID NO: 1334 - DNA, 531 bp, Populus balsamifera subsp. trichocarpa
  misc_feature (1)..(531): Ceres ANNOT ID no. 1442401
atgattacttatgtgagagcaaagaagcacaaagagaagcacaaagaggaaagccaaatatcaaagggtttctccatgaaaggaggtagatcaaagtcagataccaagagcgctaagctctctgtgaacaagaaaccaaccaaaggagcagcagcagcagcagcaaagaaatcaggaaaggcagctaaggatccaaacaagcctaagaggcctgcgagcgcatttttcgtcttcatggaggagtttagagagcagtacaagaaggaacaccctaaaaacaaatcagttgctgctgttggaaaagctggaggagataaatggaagtcactgtcagcggctgagaaagcaccctatgttgccaaggctgataaaaggaaagtcgagtatgagaagaagatgaaggcctacaacaaggagcaggctgaagggcccaaggaagaagaggaatccgagaagtcagtgtcggaagtcaatgatgaagatgaagatgacgaggagggcagtgcagaggaggatgacgacgacgagtag

SEQ ID NO: 1335 - protein, 176 aa, Populus balsamifera subsp. trichocarpa
  misc_feature (1)..(176): Ceres ANNOT ID no. 1442401
  misc_feature (1)..(176): Functional Homolog of  Ceres  ID no. 333753
  misc_feature (68)..(137): Pfam Name: HMG_box Pfam Description: HMG (high mobility group) box
MITYVRAKKHKEKHKEESQISKGFSMKGGRSKSDTKSAKLSVNKKPTKGAAAAAAKKSGKAAKDPNKPKRPASAFFVFMEEFREQYKKEHPKNKSVAAVGKAGGDKWKSLSAAEKAPYVAKADKRKVEYEKKMKAYNKEQAEGPKEEEESEKSVSEVNDEDEDDEEGSAEEDDDDE

SEQ ID NO: 1336 - DNA, 426 bp, Populus balsamifera subsp. trichocarpa
  misc_feature (1)..(426): Ceres ANNOT ID no. 1506142
atgaaaggaggtagatcaaagtcagatactaagagcgccaagctctctgtgaccaagaaaccaaccaaaggaggaggaggaggagctgcagcccggaaatcaggaaaggcagctaaggatccaaacaagcccaagagggaggagttcagagagcagtacaagagggaacaccctaaaaacaaatccgttgcagctgttggaaaagctggaggagataaatggaagtcactgtcagaggctgagaaagcaccctttgttgccaaagcggacaagaggaaggttgaatatgagaagaagatgaaagcttacaacaaggagcaggctgaagggcccaaggaagaagaggagtctgagaagtcaatgtcagaggtcaatgatgacgatgaagatgatgaagagggaagtggggaggttagtattgcttaa

SEQ ID NO: 1337 - protein, 141 aa, Populus balsamifera subsp. trichocarpa
  misc_feature (1)..(141): Ceres ANNOT ID no. 1506142
  misc_feature (1)..(141): Functional Homolog of  Ceres  ID no. 333753
  misc_feature (46)..(104): Pfam Name: HMG_box Pfam Description: HMG (high mobility group) box
MKGGRSKSDTKSAKLSVTKKPTKGGGGGAAARKSGKAAKDPNKPKREEFREQYKREHPKNKSVAAVGKAGGDKWKSLSEAEKAPFVAKADKRKVEYEKKMKAYNKEQAEGPKEEEESEKSMSEVNDDDEDDEEGSGEVSIA

SEQ ID NO: 1338 - DNA, 996 bp, Panicum virgatum
  misc_feature (1)..(996): Ceres CLONE ID no.1802372
acttcgcatcacgcaacgcccccaggcactcgtcacgcacatccaaacccacttcccgatccgacccggaggttcggagcggagatgaagtcgagggcgaggtccagcggagccgactccaggctctccgtgaggaagtccaaggccgagaaggacccgaacaagcccaaaaggcctccgagcgccttcttcgtcttcatggaggagttcaggaaggactacaaggagaagcaccccaatgtcaagcaagtctccgtgattggcaaggctggtggcgacaagtggaagtccctgtccgatgctgagaaagctcccttcgtgtccaaggctgagaagctcaaagctgagtacaccaagaagatggatgcctacaataacaagacggctggaggccctacagcttctggtgactctgacaagtccaagtccgaggtgaacgacgaggatgaggagggtgacgagtgatgcatccatgtctccagccaagtcgtcgcagtcagtagtagggaagtcttcgtcgtcggcctaaccgggcattgctgctccttagcctctggatgctgtcggtctctctagatgtagcagtagtagcttggtagttgcaagtgtcgtccctgaagtgaagcagtttagtggtagtgtgttcgcttcttcggcacttaaccgttgttggaatttatgtcgccctgcagtctgtacttaccccaagcatcagttcctgtttaaatctcagatctgaatagatgagttattttgctgaactgaattctctgtttctcttgtttgcatttctgcttgatgtctactgttcgatgacagcgattctggcctctgggctgttcttggccgtgatgtgagatcgtgaagattaggttgtccatctgaatattttgcagtcatcagtctgattggctgttgttatctggtctcaattgtttcttcctgcaactggatgttggaatgacctgagatgaccaaaaaaaaaaaaaaaaaaaa

SEQ ID NO: 1339 - protein, 126 aa, Panicum virgatum
  misc_feature (1)..(126): Ceres CLONE ID no. 1802372
  misc_feature (1)..(126): Functional Homolog of  Ceres  ID no. 333753
  misc_feature (28)..(97): Pfam Name: HMG_box Pfam Description: HMG (high mobility group) box
MKSRARSSGADSRLSVRKSKAEKDPNKPKRPPSAFFVFMEEFRKDYKEKHPNVKQVSVIGKAGGDKWKSLSDAEKAPFVSKAEKLKAEYTKKMDAYNNKTAGGPTASGDSDKSKSEVNDEDEEGDE

SEQ ID NO: 1340 - DNA, 665 bp, Panicum virgatum
  misc_feature (1)..(665): Ceres CLONE ID no.1891458
ccgccacttcgcatcacgcaacgcccccaggcactcgtcacgcacacatccaaacccacttcccgatccgacccggaggcactgcgagttcggagcggagatgaagtcgagggcgaggtccagcggagccgactccaggctctccgtgaggaagtccaaggccgagaaggacccgaacaagcccaaaaggcctccgagcgccttcttcgtcttcatggaggagttcaggaaggactacaaggagaagcaccccaatgtcaagcaagtctccgtgattggcaaggctggtggtgacaagtggaagtccctgtccgatgctgagaaagctcccttcgtgtccaaggccgagaagctcaaagctgagtacaccaagaagatggacgcctacagtaacaagacggctggaggccctacagcttctggtgactctgacaagtccaagtccgaggtgaacgacgaggatgaggagggtgacgagtgatgcatccatgtctctccagccaagtcgtcgcagtcagtagtagggaagtcttcgtcgtcggcctaaccgggcattgctgctccttatcctctggatgctgtcggtctctctagatgtagcagtagtagctgtccactctcgagttggtagttgcaagtgtcgtccctgaagtgaagcagtttag

SEQ ID NO: 1341 - protein, 126 aa, Panicum virgatum
  misc_feature (1)..(126): Ceres CLONE ID no. 1891458
  misc_feature (1)..(126): Functional Homolog of  Ceres  ID no. 333753
  misc_feature (28)..(97): Pfam Name: HMG_box Pfam Description: HMG (high mobility group) box
MKSRARSSGADSRLSVRKSKAEKDPNKPKRPPSAFFVFMEEFRKDYKEKHPNVKQVSVIGKAGGDKWKSLSDAEKAPFVSKAEKLKAEYTKKMDAYSNKTAGGPTASGDSDKSKSEVNDEDEEGDE

SEQ ID NO: 1342 - DNA, 780 bp, Panicum virgatum
  misc_feature (1)..(780): Ceres CLONE ID no.1762738
cctccacttcgcatcacgcccaccacgcacacaggcgctcgtcccgcagcgcacgagcacacatccaaacccacttcccgatccgacccggaggttcggagatgaagtcgagggcgaggtccagcggagccgactccaggctctccgtgaggaagtccaaggccgagaaggaccccaacaagcccaagaggcctccgagcgccttcttcgtcttcatggaggagttcaggaaggactacaaggagaagcaccccaatgtcaagcaagtctccgtgattggcaaggctggtggggacaagtggaagtccctgtccgatgctgaaaaatctcccttcgtgtccaaggccgagaagctcaaggctgagtacaacaagaagatggacgcctacaataacaagacggctggaggccctacagcttctggtgactctgacaagtccaagtccgaggtgaacgatgaggatgaggagggtgacgagtgatgcatccagctctcagtagtcgcagtcagtagtagggaagtcttcgtcgtcggcctaaccgggcattgctgccccttagcctttggatgctgtctgtctctctagatgtagcagtagtagctgtcccctctcgagttggtagttgcaagtgtcgtccctgaagtgaggcagtttagtgttagtgtgttcgcttcttcgtcacttgaccgtcgttggaatgtcaacctgcagtctgtacttaccccgagcatccgttcctgttttaaatctaagatctcaaaagacgagttaatttgct

SEQ ID NO: 1343 - protein, 126 aa, Panicum virgatum
  misc_feature (1)..(126): Ceres CLONE ID no. 1762738
  misc_feature (1)..(126): Functional Homolog of  Ceres  ID no. 333753
  misc_feature (28)..(97): Pfam Name: HMG_box Pfam Description: HMG (high mobility group) box
MKSRARSSGADSRLSVRKSKAEKDPNKPKRPPSAFFVFMEEFRKDYKEKHPNVKQVSVIGKAGGDKWKSLSDAEKSPFVSKAEKLKAEYNKKMDAYNNKTAGGPTASGDSDKSKSEVNDEDEEGDE

SEQ ID NO: 1344 - DNA, 1433 bp, Glycine max
  misc_feature (1)..(1433): Ceres CLONE ID no. 475689
  misc_feature (1)..(1433): GEMINI ID 540H1
acaacacttccagtgatcatcttctccatccagaacgaacaaaaatggagaattcgacccaagaatcccacctccgatccgaaaactccgtgagctacgaatccccctacccaatctacggcatgtcgttctccccttcccacccccaccgcctggccctcggcagcttcattgaagaatacaccaaccgcgttgacatcctctccttccaccccgacaccctctccctcacccccaacccttctctctcctttgaccacccttaccctcccaccaaactcatgttccacccccgcaaacccccctcctcctcctccgacctcctcgccacctccggcgactacctccgcctctgggaggtccgcgacaactccgtggaggccgtctcccttttcaacaacagcaagaccagcgagttctgcgcccccttaacctccttcgactggaacgatatcgaccccaaccgcatcgccacctccagcatcgacaccacctgcaccatctgggacatcgaacgcaccctcgtcgaaacccaactcatcgcgcacgacaaagaggtctacgacatcgcatggggagaggccagagtcttcgcctccgtctccgccgacggctccgttagaatcttcgacctacgcgacaaggagcactccaccatcatctacgagagcccccaccctgacacccctctgctccgtttggcttggaacaaacaggacctgaggtacatggctactattttaatggacagtaataaagttgtgattttggatattaggtctcccactacccctgttgcggagttagagaggcaccgtgggagtgtgaacgctattgcttgggctcctcatagttccacgcatatttgttctgctggggatgatactcaggctcttatttgggatttgcccactctggcttctcccactgggattgatcccgtgtgtatgtattctgctggctgtgaaattaaccagctgcagtggtctgccgtgcagcccgaatggattgccattgcttttgccaacaagatgcagcttttgaaggtttgaggtgagtcgagggagaataaacacaattctagttactcaaacttgattgtgggatagataggactcctttcgcggatgctgcaacttcttagttctcgtggcttgtgtataagagtgagcgagttagtactatatataatactattgtagttgttgactgtaaaatagtttgccctcctcatgttttacttgtagcgaaattgatgatcaatttgtctgttgaggacagcttttagatacatgtatgtcctgttcaggatttaagattccatgtctgttgatgtggaagccataactattagtttcttagtaaacatgaaaaatcacatgtccagatgatagttgtaaaatgttcagtgtatgtattagcatttgattgtc

SEQ ID NO: 1345 - protein, 335 aa, Glycine max
  misc_feature (1)..(335): Ceres CLONE ID no. 475689
  misc_feature (1)..(335): GEMINI ID 540H1
  misc_feature (248)..(287): Pfam Name: WD40 Pfam Description: WD domain, G-beta repeat
MENSTQESHLRSENSVSYESPYPIYGMSFSPSHPHRLALGSFIEEYTNRVDILSFHPDTLSLTPNPSLSFDHPYPPTKLMFHPRKPPSSSSDLLATSGDYLRLWEVRDNSVEAVSLFNNSKTSEFCAPLTSFDWNDIDPNRIATSSIDTTCTIWDIERTLVETQLIAHDKEVYDIAWGEARVFASVSADGSVRIFDLRDKEHSTIIYESPHPDTPLLRLAWNKQDLRYMATILMDSNKVVILDIRSPTTPVAELERHRGSVNAIAWAPHSSTHICSAGDDTQALIWDLPTLASPTGIDPVCMYSAGCEINQLQWSAVQPEWIAIAFANKMQLLKV

SEQ ID NO: 1346 - DNA, 1023 bp, Populus balsamifera subsp. trichocarpa
  misc_feature (1)..(1023): Ceres ANNOT ID no. 1472897
atggagagctcaacccaagaatcccacctaagatcggaaaacaccataacctatgaatctccataccctctctatgccatggcaatctcttcgaccccatctcgcacaaaccaataccaacgcattgccttgggcagcttcactgaagactacaacaaccgcatagacattgtctcttttgaccctgaaaccctctctgtcaaaacccatcaaaatctctctcttgaacacccttatccacccaccaagctcatgttcagcccttcctctcttcacaagtccaatgaccttttagcctcttctggtgactatcttcgcttatgggaagttagagactctgcttctattgagcctgtttttgtgcttaacaatagtaagacaggtgagttttgtgctcctttaacttcttttgattggaatgatattgaacctaaaagaattggtacttgtagtgttgatacaacctgtacgatttgggatattgaaaagggtgctgttgaaacacaacttatagctcatgataaggaagtttatgatattgcttggggtgaagcaagggtttttgcttcagtttcagctgatgggtcagttaggatttttgatttaagagataaggaacattctactattatatatgagagtcctagacctgatacacccttgttgagattggcttggaacaagcaggatttgaggtatatggccaccacgttgatggatagcaataaagttgtgatcttggatattaggtccccaacaatacctgttgcggagttggagaggcatcgttcgagtgtgaatgctattgcttgggctccgcagagttgttgtcatatttgttctgctggtgatgattcacaggctcttatttgggagttgcctactgtggctggacctaatgggattgatccaatgtccatgtgctctgctgcttctgaaattaaccagcttcaatggtctgctgcactgcctgattggattgctatcgcgttttcaaataaaatgcagcttttaaaagtttga

SEQ ID NO: 1347 - protein, 340 aa, Populus balsamifera subsp. trichocarpa
  misc_feature (1)..(340): Ceres ANNOT ID no. 1472897
  misc_feature (1)..(340): Functional Homolog of  Ceres  ID no. 475689
  misc_feature (253)..(292): Pfam Name: WD40 Pfam Description: WD domain, G-beta repeat
MESSTQESHLRSENTITYESPYPLYAMAISSTPSRTNQYQRIALGSFTEDYNNRIDIVSFDPETLSVKTHQNLSLEHPYPPTKLMFSPSSLHKSNDLLASSGDYLRLWEVRDSASIEPVFVLNNSKTGEFCAPLTSFDWNDIEPKRIGTCSVDTTCTIWDIEKGAVETQLIAHDKEVYDIAWGEARVFASVSADGSVRIFDLRDKEHSTIIYESPRPDTPLLRLAWNKQDLRYMATTLMDSNKVVILDIRSPTIPVAELERHRSSVNAIAWAPQSCCHICSAGDDSQALIWELPTVAGPNGIDPMSMCSAASEINQLQWSAALPDWIAIAFSNKMQLLKV

SEQ ID NO: 1348 - DNA, 1023 bp, Populus balsamifera subsp. trichocarpa
  misc_feature (1)..(1023): Ceres ANNOT ID no. 1467673
atggagaattcaacccaagaatcccacctaagatcagaaaacactgtaacatatgaatccccataccctctctatgccatggcaatctcttcaaccgcatctcgtgcgaaccaataccagcggattgccttaggtagcttcattgaagactacaacaaccgtatagacatcgtctcttttgaccctgaaaccctctctatcaaaacccaccaaaatctctctgttgagcacccttatccacccacaaagctcatgtttagcccttcatctcttcacaagtccaatgacctcttagcctcttctggtgactatcttcgattgtgggaagttagagactctgcttctgttgagcctcttttggtgcttaacaatagtaagacaagtgagttttgtgcccctttaacttcttttgactggaatgatattgaacctaagagaattggtacttgtagtattgatacaacttgtactatttgggatattgaaaagggtgttgttgaaacacaacttatagctcatgataaagaggttcatgatattgcttggggagaagcaagggtttttgcttcagtttctgctgatgggtcagttaggatttttgatttaagagataaggaacattctactattatatatgagagtcctagacctgatacacccttgttgagattggcttggaacaaacaggatttgaggtatatggctacaatattgatggatagtaataaagttgtgatcttggatattaggtctccaacaatccctgttgctgagttggagaggcatatggcgagtgtcaatgctattgcttgggctccgcagagttgtaggcatatttgctctgctggtgatgattcacaggcacttatttgggagttacctactgtggctgggcctaatgggattgatccaatgtcaatgtgctctgctacttctgaaattaaccagcttcgatggtctgctgcactgcctgattggattgctatcgcgttttcaaacaaaatgcagcttttaaaagtttga

SEQ ID NO: 1349 - protein, 340 aa, Populus balsamifera subsp. trichocarpa
  misc_feature (1)..(340): Ceres ANNOT ID no. 1467673
  misc_feature (1)..(340): Functional Homolog of  Ceres  ID no. 475689
  misc_feature (253)..(292): Pfam Name: WD40 Pfam Description: WD domain, G-beta repeat
MENSTQESHLRSENTVTYESPYPLYAMAISSTASRANQYQRIALGSFIEDYNNRIDIVSFDPETLSIKTHQNLSVEHPYPPTKLMFSPSSLHKSNDLLASSGDYLRLWEVRDSASVEPLLVLNNSKTSEFCAPLTSFDWNDIEPKRIGTCSIDTTCTIWDIEKGVVETQLIAHDKEVHDIAWGEARVFASVSADGSVRIFDLRDKEHSTIIYESPRPDTPLLRLAWNKQDLRYMATILMDSNKVVILDIRSPTIPVAELERHMASVNAIAWAPQSCRHICSAGDDSQALIWELPTVAGPNGIDPMSMCSATSEINQLRWSAALPDWIAIAFSNKMQLLKV

SEQ ID NO: 1350 - DNA, 1041 bp, Populus balsamifera subsp. trichocarpa
  misc_feature (1)..(1041): Ceres ANNOT ID no. 1445014
atgggaggtagcagcgacccaaatcaagacgggtcggacgagcaacagaaacgatcagagatctacacatatgaggcaccatggcacatctacgccatgaactggagcgtccgtcgtgacaagaagtaccgtctcgccatcgccagcctcctagaacagtacccaaaccgggtcgagattgtacagctggacgaatccaatggagagatccgatccgacccgaatctgtccttcgagcacccttatccacctaccaaaaccatattcatcccggacaaggagtgccaaaagcctgacctcctcgcgacctccagcgacttcctgcgcgtgtggcgcataaacgatgagcagccgcgcgtggagctcaaaagcctgttaaatggcaacaagaacagcgaattttgcgggcctttgacttcctttgactggaacgaagcagagccaaggcgaattgggacatccagcattgacacgacttgcaccatctgggatatcgagagggagactgttgatacacagttaatcgcccacgacaaggaggtatacgacatcgcatggggcggtgttggggttttcgcttctgtttcagccgacgggtcggttagggttttcgatttacgggataaggagcattcaacgataatctacgagagttcggagcccgacacgcctttggttaggctggggtggaacaagcaggatccgaggtacatggccacgataatcatggacagtgctaaggttgtggtgttggatattcgcttcccaactcttccagtggtggaattgcagaggcatcatgctagtgttaatgccgttgcttgggccccgcatagttcatgccatatttgtactgctggggatgattcacaggcgttaatttgggacctctcttccatgggtcagcctgttgagggtggattggaccccattcttgcttatactgctggtgctgaaatcgagcagttgcagtggtcgtcttctcagcctgattgggttgccattgctttctctaccaagctgcagattctcagggtttga

SEQ ID NO: 1351 - protein, 346 aa, Populus balsamifera subsp. trichocarpa
  misc_feature (1)..(346): Ceres ANNOT ID no. 1445014
  misc_feature (1)..(346): Functional Homolog of  Ceres  ID no. 475689
  misc_feature (257)..(296): Pfam Name: WD40 Pfam Description: WD domain, G-beta repeat
MGGSSDPNQDGSDEQQKRSEIYTYEAPWHIYAMNWSVRRDKKYRLAIASLLEQYPNRVEIVQLDESNGEIRSDPNLSFEHPYPPTKTIFIPDKECQKPDLLATSSDFLRVWRINDEQPRVELKSLLNGNKNSEFCGPLTSFDWNEAEPRRIGTSSIDTTCTIWDIERETVDTQLIAHDKEVYDIAWGGVGVFASVSADGSVRVFDLRDKEHSTIIYESSEPDTPLVRLGWNKQDPRYMATIIMDSAKVVVLDIRFPTLPVVELQRHHASVNAVAWAPHSSCHICTAGDDSQALIWDLSSMGQPVEGGLDPILAYTAGAEIEQLQWSSSQPDWVAIAFSTKLQILRV

SEQ ID NO: 1352 - DNA, 1041 bp, Populus balsamifera subsp. trichocarpa
  misc_feature (1)..(1041): Ceres ANNOT ID no. 1471808
atgggagctagcagcgacccgaatcaagacgggtcggacgagcaacaaaaacgatctgagatctacacatacgaggcaccatggcacatctacgctatgaactggagcgtccgccgtgacaagaagtaccgccttgccatcgccagcctcctagaacagtacccaaaccgggtcgagattgttcagctggatgactccaacggagagatccgatccgacccgaacctgtccttcgagcacccttatccacctacgaagaccattttcattccagacaaggagtgccaaaaacctgacctcctcgcaacgtccagcgacttcctgcgcgtgtggcgcataaacgatgaacagccgcgcgtggagctcaaaagcctgttaaacggcaacaagaacagcgagttttgcgggcctttgacttcctttgactggaacgaggcggagcctaggcgaattgggacatccagcatcgacacgacatgcaccatctgggatatcgagaaggagactgttgatacacagttaatcgctcacgacaaggaggtatacgacatcgcatggggtggtgttggggttttcgcttcggtttcagcagacgggtcggttagggttttcgatttacgggataaggagcattcgacgataatctacgagagttcggagcccgacacgcctttggtgagactaggttggaacaagcaggatccgaggtacatggcgacgatcatcatggacagtgctaaggttgtggtgttggatattcgcttcccaactcttccagtggtggaattgcagaggcatcatgctagtgttaatgctgttgcttgggcccctcatagttcttgccacatttgtactgctggggatgattcacaggcattgatttgggatctttcttcgatgggtcagcctgttgagggtggattggaccccattcttgcttacactgctggtgctgaaatcgagcagctgcagtggtcgtcttcgcagcctgattgggttgctattgctttctctaccaagcttcaaattctcagggtttga

SEQ ID NO: 1353 - protein, 346 aa, Populus balsamifera subsp. trichocarpa
  misc_feature (1)..(346): Ceres ANNOT ID no. 1471808
  misc_feature (1)..(346): Functional Homolog of  Ceres  ID no. 475689
  misc_feature (257)..(296): Pfam Name: WD40 Pfam Description: WD domain, G-beta repeat
MGASSDPNQDGSDEQQKRSEIYTYEAPWHIYAMNWSVRRDKKYRLAIASLLEQYPNRVEIVQLDDSNGEIRSDPNLSFEHPYPPTKTIFIPDKECQKPDLLATSSDFLRVWRINDEQPRVELKSLLNGNKNSEFCGPLTSFDWNEAEPRRIGTSSIDTTCTIWDIEKETVDTQLIAHDKEVYDIAWGGVGVFASVSADGSVRVFDLRDKEHSTIIYESSEPDTPLVRLGWNKQDPRYMATIIMDSAKVVVLDIRFPTLPVVELQRHHASVNAVAWAPHSSCHICTAGDDSQALIWDLSSMGQPVEGGLDPILAYTAGAEIEQLQWSSSQPDWVAIAFSTKLQILRV

SEQ ID NO: 1354 - DNA, 1029 bp, Populus balsamifera subsp. trichocarpa
  misc_feature (1)..(1029): Ceres ANNOT ID no. 1454998
atgcaaagctcttcagagaaaagaccaggcatctacacttacatagctcagtggcctatatattcactagcctggtcggttcgacaggacaaaaaatcacgtcttgccataggaagtttccttgaagactatagcaacaaggtggaaattgttcaattcaaccgcgacacttctgatttcaccactgatagccgcctaatcttcgaccacccttattcacctacaaacctcatgttcttcccctccgaggatgctgcaaatcctgatatcatcgctacctccggagactacttgcgcatatggcaaattcatgatgaccgaatcgagttgaagtctctccttaatggcaataagagtagtgaattcagttctgccataacttcatttgactgggctgatttcgatgttcatcgtgtggccacttctagtgtcgataccacttgtgtgatttgggacatagagaaggaagttatagacgctcaattagttgcacatgataaagaagtgtttgatatttcatggggttcattcaatattttcgcatcagtgtcgggtgatggctcggttagagttttcgatctaaggaacaaagacagatcaacaataatttatgaaaatacaatgcaagactgtcctttgctaaggctagagtggaacaaaagagacccgagatttatagccacagttggcatggacagtaataaggttgttattctggacattcgctttcctacaactcctttaatggagctatgtaagcataaggcaagtgtgaatgctatatcttggtctccatgcaccggaaggcagatatgctcggtaggtgatgattcaagggctttgttatgggaagtggttagcaaggccggagtgcgaccagaatacagcggtgctggcgctaatagccaagtggaacctgaaatgtggtatggatcaatggcggcgatcaataatgtgaggtggtcacctgtggagttggattggattgctattgctttttttagcaagttacaactcctgaaggtctaa

SEQ ID NO: 1355 - protein, 342 aa, Populus balsamifera subsp. trichocarpa
  misc_feature (1)..(342): Ceres ANNOT ID no. 1454998
  misc_feature (1)..(342): Functional Homolog of  Ceres  ID no. 475689
  misc_feature (245)..(284): Pfam Name: WD40 Pfam Description: WD domain, G-beta repeat
MQSSSEKRPGIYTYIAQWPIYSLAWSVRQDKKSRLAIGSFLEDYSNKVEIVQFNRDTSDFTTDSRLIFDHPYSPTNLMFFPSEDAANPDIIATSGDYLRIWQIHDDRIELKSLLNGNKSSEFSSAITSFDWADFDVHRVATSSVDTTCVIWDIEKEVIDAQLVAHDKEVFDISWGSFNIFASVSGDGSVRVFDLRNKDRSTIIYENTMQDCPLLRLEWNKRDPRFIATVGMDSNKVVILDIRFPTTPLMELCKHKASVNAISWSPCTGRQICSVGDDSRALLWEVVSKAGVRPEYSGAGANSQVEPEMWYGSMAAINNVRWSPVELDWIAIAFFSKLQLLKV

SEQ ID NO: 1356 - DNA, 1017 bp, Populus balsamifera subsp. trichocarpa
  misc_feature (1)..(1017): Ceres ANNOT ID no. 1475212
atggaaagctcttcacagaaaggaccagtcatctgcacttacgtagctcaatggcctatatattcactagcctggtctgcccgacgtgacaaaaaaacacgtcttgccataggaagtttccttgaagactatagcaacaaggtggaaattgttcaattcaacagcgacacttctgatttcaccaccgatagccgcctaatattcgatcacccttattcacccacaaacctgatgttcttcccctccgaggatgttgcaaatcctgatatcatcatcacctccggggactacatgcgtatatggcaaatttacgatgaccgaattgagttgaagtctctcctaaatggcaataagtgtagtgaattcaactctgccataacatcttttgattgggctgattttgatgttcatcgtgtggtcagttcgagtgttgactccaccattgttgtttgggatatagagaaggaaactatatatgctcaattagttgcacatgataaagaagtgaatgatatttcatggggttggttcaatattttcgcatcagtatcaggtgatggttcagttagggtttgcgatttaagaaaaaaagagagatcaacaataatttatgaaaatccaatgcaggattgttctttgttaaggctagagtggaacaaaagtgacccgagatttatagccacagtcggcatgaacagtaacaaggttgtaattttggacattcgctttccttcaactcctttaatggagcttagcaagcatagggcaagtgtgaattctatatcctgggctccatgtacaggacgaaagatatgctcggtaggtgatgattcaagggctttgatatgggatgtggccagtaaggctggaaacggaccagaaaacattacaggccaggtggaacctgaaatgtggtatggatcagtgggtgggatcaataatatgcgttggtctccggtggagatggattggattgctattgcttttctgaccaagttacaactcttgaaggtttag

SEQ ID NO: 1357 - protein, 338 aa, Populus balsamifera subsp. trichocarpa
  misc_feature (1)..(338): Ceres ANNOT ID no. 1475212
  misc_feature (1)..(338): Functional Homolog of  Ceres  ID no. 475689
  misc_feature (245)..(284): Pfam Name: WD40 Pfam Description: WD domain, G-beta repeat
MESSSQKGPVICTYVAQWPIYSLAWSARRDKKTRLAIGSFLEDYSNKVEIVQFNSDTSDFTTDSRLIFDHPYSPTNLMFFPSEDVANPDIIITSGDYMRIWQIYDDRIELKSLLNGNKCSEFNSAITSFDWADFDVHRVVSSSVDSTIVVWDIEKETIYAQLVAHDKEVNDISWGWFNIFASVSGDGSVRVCDLRKKERSTIIYENPMQDCSLLRLEWNKSDPRFIATVGMNSNKVVILDIRFPSTPLMELSKHRASVNSISWAPCTGRKICSVGDDSRALIWDVASKAGNGPENITGQVEPEMWYGSVGGINNMRWSPVEMDWIAIAFLTKLQLLKV

SEQ ID NO: 1358 - DNA, 1665 bp, Panicum virgatum
  misc_feature (1)..(1665): Ceres CLONE ID no.1821171
gaactgaaacccccccaaatccgcagcgcttgccctatccacctcgattccgatcctcccgtggcggcggcggcgtcgaaggcgaaggcggcggggccatgggcgggggcggtgacggagacgcgtgggcggatcaggagcagggcaacggcgggggcagccgcggtgggggcggcggcggcggggaggccaagcggtcggagatctacacctacgaggccggctggcacatctacgccatgaactggagcgtgcgccgcgacaagaagtaccgcctcgccatcggcagcctcctcgagcaggtccccaaccgcgtcgaggtcgtccagctcgacgaggcctcgggcgacatcgcccccgtcctcgccttcgaccaccagtacccgcccaccaagaccatgttcatcccggacccgcacgcgctccgccccgacctgctcgccacctccgccgaccacctccgcatctggcgcatcccctccgccgacgacgccgacggcgacgccccctccgccaacaactccggctccgtccgctgcaacggcgccccgcagccgggcgtcgagctccgctgcgagctcaacggcaaccgcaacagcgactactgcggcccgctcacctccttcgactggaacgacgccgacccgcgccgcatcggcacctcctccatcgacaccacctgcaccatctgggacgtcgagcgcgaggccgtcgacacccagctcatcgcccacgacaaggaggtctatgacatcgcctggggcggcgcgggggtcttcgcctccgtctccgctgacggctctgtccgtgtctttgatctccgggacaaggagcattccacaatcatctacgagtctggttcaggtggcggcggtggcggctccaattctggtgctggagatggcggcgctgcatcgccaacaccgctcgtcaggctgggctggaacaagcaggaccctaggtacatggccaccatcatcctggatagccctaaggtggtagtgcttgatatccgctacccgacactgccagtggtagagctgcatcgtcaccatgcccctgtcaatgccatcgcgtgggcacctcactcttcatgccacatctgcacagccggtgatgacatgcaggccctgatatgggacctatcatccatgggcactgggagcaacggtggcaacaatggaaatggtaatgctgccgcagctgctgcagcagagggtggtctggatcccattctggcatatacggcaggagcagagattgagcagctgcagtggtcggcgacccagcctgactgggttgctattgcatttgccaataaacttcagattctcagggtctgattgcctaatcccatctggttcactgagaagagttaaagacaaatggcaaacttaggataatcttgcaattgctttggtgttgcttatctatgctgtgcacaactgatgtccaatgattggttgtttctagtggtagaacagaagatttgctagttagaagctggaattggcaaacatggtttgtagattaaagtagctgctatggtaatagtgttggtgataatgggaactgaagttagctatctctttctgatagtatgttctgcatctgctcattagcatgtagattgacagcttaaattaaaaaaaaaaaaaaaaaaaa

SEQ ID NO: 1359 - protein, 414 aa, Panicum virgatum
  misc_feature (1)..(414): Ceres CLONE ID no. 1821171
  misc_feature (1)..(414): Functional Homolog of  Ceres  ID no. 475689
  misc_feature (309)..(348): Pfam Name: WD40 Pfam Description: WD domain, G-beta repeat
MGGGGDGDAWADQEQGNGGGSRGGGGGGGEAKRSEIYTYEAGWHIYAMNWSVRRDKKYRLAIGSLLEQVPNRVEVVQLDEASGDIAPVLAFDHQYPPTKTMFIPDPHALRPDLLATSADHLRIWRIPSADDADGDAPSANNSGSVRCNGAPQPGVELRCELNGNRNSDYCGPLTSFDWNDADPRRIGTSSIDTTCTIWDVEREAVDTQLIAHDKEVYDIAWGGAGVFASVSADGSVRVFDLRDKEHSTIIYESGSGGGGGGSNSGAGDGGAASPTPLVRLGWNKQDPRYMATIILDSPKVVVLDIRYPTLPVVELHRHHAPVNAIAWAPHSSCHICTAGDDMQALIWDLSSMGTGSNGGNNGNGNAAAAAAAEGGLDPILAYTAGAEIEQLQWSATQPDWVAIAFANKLQILRV

SEQ ID NO: 1360 - DNA, 697 bp, Glycine max
  misc_feature (1)..(697): Ceres CLONE ID no. 560948
  misc_feature (1)..(697): GEMINI ID 537A3
  misc_feature: Encodes the peptide sequence at SEQ ID NO. 1361
  misc_feature: Encodes the peptide sequence at SEQ ID NO. 1790
  misc_feature: Encodes the peptide sequence at SEQ ID NO. 1817
atgtgttttatttcctacttcccaacccataaccattaattcttaattagtttcctcttgctttcttctccttctatattattactagtacaacttatcatacacatatacctctggttatagcagcaaactaggctatagcttgcactttgaagatatttatacacagaccaagtacaacaccaagctctagctagctagggacatgtctagccgaagatccagacaacattcagggtctacaaggatctccgatgaccaaatcatcgaacttgtttccaaattgcgccaacttgttcctgagattcgcaataggcgatctgataaggtttcagcgtcaaaggtcctacaagagacctgcaactacatcagaggcttgcacagagaggtgagtgacttgagcgagcgactgtctcagttgttgaccacaattgatgctgatagtgctgaggctggaatcattaggagcctacttaatcaatgagagagtgttatgattttttatttattcaaagagagtgttaattaaattataattatgattattataagagtattgtacttcattctaggtgtgctgagagcctgggagagttcagtttttgaggctgtacctcccatatggcaggtagggcattttcataactagttgtttttctcttttttccaataaaaattcaagtgcttgtaccagctg

SEQ ID NO: 1361 - protein, 92 aa, Glycine max
  misc_feature (1)..(92): Ceres CLONE ID no. 560948
  misc_feature (1)..(92): GEMINI ID 537A3
  misc_feature (25)..(59): Pfam Name: HLH Pfam Description: Helix-loop-helix DNA-binding domain
MSSRRSRQHSGSTRISDDQIIELVSKLRQLVPEIRNRRSDKVSASKVLQETCNYIRGLHREVSDLSERLSQLLTTIDADSAEAGIIRSLLNQ

SEQ ID NO: 1362 - protein, 86 aa, Brassica napus
  misc_feature (1)..(86): Ceres CLONE ID no. 945972
  misc_feature (1)..(86): Functional Homolog of  Ceres  ID no. 560948
  misc_feature (43)..(43): Xaa is any aa, unknown, or other
  misc_feature (85)..(85): Xaa is any aa, unknown, or other
MSSRRSSCSRQSGSSRISDDQISDLVTKLQHLIPELRRRRSDXVSASKVLQETCNYIRNLHREVDDLSDRLSEFLASTDDNSAEXA

SEQ ID NO: 1363 - protein, 92 aa, Arabidopsis thaliana
  misc_feature (1)..(92): Public GI no. 22331645
  misc_feature (1)..(92): Functional Homolog of  Ceres  ID no. 560948
MSSRKSRSRQTGASMITDEQINDLVLQLHRLLPELANNRRSGKVSASRVLQETCSYIRNLSKEVDDLSERLSQLLESTDSAQAALIRSLLMQ

SEQ ID NO: 1364 - protein, 88 aa, Oryza sativa
  misc_feature (1)..(88): Public GI no. 31431968
  misc_feature (1)..(88): Functional Homolog of  Ceres  ID no. 560948
MSGRRASGRITDDEINELISKLQSLLPESSRRRGATSRSPATKLLKEMCSYIKSLHREVDDLSERLSELMATMDSNSPQADIIRSLLR

SEQ ID NO: 1365 - protein, 88 aa, Oryza sativa
  misc_feature (1)..(88): Public GI no. 50912765
  misc_feature (1)..(88): Functional Homolog of  Ceres  ID no. 560948
  misc_feature (14)..(55): Pfam Name: HLH Pfam Description: Helix-loop-helix DNA-binding domain
MSSRRSSRGSISEEEINELISKLQSLLPNSRRRGSSQASTTKLLKETCNYIKSLHREVDDLSDRLSDLMATMDHNSPGAEIIRSILRS

SEQ ID NO: 1366 - protein, 90 aa, Zea mays
  misc_feature (1)..(90): Ceres CLONE ID no. 486120
  misc_feature (1)..(90): Functional Homolog of  Ceres  ID no. 560948
  misc_feature (15)..(57): Pfam Name: HLH Pfam Description: Helix-loop-helix DNA-binding domain
MSSRRSSSHGNISEDEMNELVSKLQALLPSSRRRRGSGQASTAKLLKETCSYIKSLQREVDDLSDRLSDLLSTMDHNSPAAEIIRSILRS

SEQ ID NO: 1367 - protein, 89 aa, Zea mays
  misc_feature (1)..(89): Ceres CLONE ID no. 503296
  misc_feature (1)..(89): Functional Homolog of  Ceres  ID no. 560948
  misc_feature (15)..(56): Pfam Name: HLH Pfam Description: Helix-loop-helix DNA-binding domain
MSSRRPSSRGNISEDEINELISKLQALLPSSRRRGSGQASTTKLLKETCSYIKSLHREVDDLSDRLSDLMATMDHNSPGAEIIRSILRS

SEQ ID NO: 1368 - DNA, 841 bp, Panicum virgatum
  misc_feature (1)..(841): Ceres CLONE ID no.1759397
acgcaagttccgcgagagaggccgaggcagagacgacgaccaggaagaatccgccaggtgctgtagcatcatccaagcaaagcaagtactctctgagctaggtaggataggacacggtcgccggccggagatgtcggaccgccgcgacaggatcagcgacgacgagatcaacgagctcatctccaagctccaggcgctcctcccggagtcctcacgccgccggaacgcgagccggtcgtcggcgtcgaagctcctgaaggagacgtgcagctacattaagagcctgcaccgggaggtggacgacctctcggagcggctgtcggggctcatgtcgaccatggacaacgacagcccccaggcggagataatccggagcctgctccggtgaccggccggcagcagggccttctcctgccagctagctgcagcggcccgcgccgcagctgaattatattaattagtgaagaagacgatggagctgctcgcttggcgcttgctacgaccaggagcttatgttcattcgtttttttctctctcttgttcttctacttcttcttcttcctcctcctcctccgatccgatgtgcgtgtgtttgtttccgtacctgctatcttccaaggaccctcgttcagaagacaacgaacgaagggctagctcttggtgtaccagaggggttagtagagataaatatatggacttctattaaccgaccaagcaaggtactgccggtaggcggtagcttgtagtagctcgtcatctgtagtagactgtagctgttcagagttgcagatgcatcctagctaagagtttattttttgcttaaaaaaaaaaaaaaaaaaaa

SEQ ID NO: 1369 - protein, 85 aa, Panicum virgatum
  misc_feature (1)..(85): Ceres CLONE ID no. 1759397
  misc_feature (1)..(85): Functional Homolog of  Ceres  ID no. 560948
  misc_feature (11)..(53): Pfam Name: HLH Pfam Description: Helix-loop-helix DNA-binding domain
MSDRRDRISDDEINELISKLQALLPESSRRRNASRSSASKLLKETCSYIKSLHREVDDLSERLSGLMSTMDNDSPQAEIIRSLLR

SEQ ID NO: 1370 - DNA, 1603 bp, Glycine max
  misc_feature (1)..(1603): Ceres CLONE ID no. 597624
  misc_feature (1)..(1603): GEMINI ID 531B11
  misc_feature: Encodes the peptide sequence at SEQ ID NO. 1289
  misc_feature: Encodes the peptide sequence at SEQ ID NO. 1371
  misc_feature: Encodes the peptide sequence at SEQ ID NO. 1958
ccacccaaactcatctatctttgcttccccttagtcaaacaaagtaacacaccatccatcctctctctcttctcttcttctgttctctagtttcctgctcttgtttcttagaatccgtacggtctaatcaacacaacaaaatggatgcaattagttgcctggatgagagcaccaccaccgagtcactctccataagtcaggcgaagccttcttcgacgattatgtcgtccgagaaggcttctccttccccgccgccgccgaacaggctgtgccgcgtcggtagcggtgctagcgcagtcgtggattccgacggcggcggcgggggtggcagcaccgaggtggagtcgcggaagctcccctcgtccaagtataagggcgtcgtgccccagcccaacggccgctggggctcgcagatttacgagaagcaccagcgcgtgtggctgggaacgttcaacgaggaagacgaggcggcgcgtgcgtacgacgtcgccgtgcagcgattccgcggcaaggacgccgtcacaaacttcaagccgctctccggcaccgacgacgacgacggggaatcggagtttctcaactcgcattcgaaatccgagatcgtcgacatgctgcgtaagcatacgtacaatgacgagctggaacaaagcaagcgcagccgcggcttcgtacgtcggcgcggctccgccgccggcgccggaaacggaaactcaatctccggcgcgtgtgttatgaaggcgcgtgagcagctattccagaaggccgttacgccgagcgacgttgggaaactgaaccgtttggtgataccgaagcagcacgcggagaagcactttcctttacagagcgctgctaacggcgttagcgcgacggcggcggcggcgaagggcgttttgttgaacttcgaagacgttggagggaaagtgtggcggtttcgttactcgtattggaacagtagccagagttacgtcttgaccaaaggttggagccggttcgttaaggagaagaatctgaaagccggtgacacggtttgttttcaacggtccactggaccggacaggcagctttacatcgattggaagacgaggaatgttgttaacgaggtcgcgttgttcggaccggttgtcgaaccgatccagatggttcggctctttggtgttaacattttgaaactacccggttcagattctatcgccaataacaataatgcaagtgggtgctgcaatggcaagagaagagaaatggaactcttttcattagagtgtagcaagaaacctaagattattggtgctttgtagcgttacgttactttttttgagttttttttttttttgagttttgtgactgatgaaagaaagaaggtacaagaagaacggcggtgtagtggcatagtggcatcgcaagttgctgcaaaaggtgaattgtatattacttaatattagatgctgaaatattaggtgtaatgtaacaaaaaactgtacaaggagaagaaaaaaggttctaagaaggggagaagctagaagaaaaaaaatgatgtcatcatgggataactgtttaattgtatatgttgataatattgttgaatgttgattattatgttcacggc

SEQ ID NO: 1371 - protein, 384 aa, Glycine max
  misc_feature (1)..(384): Ceres CLONE ID no. 597624
  misc_feature (1)..(384): GEMINI ID 531B11
  misc_feature (204)..(318): Pfam Name: B3 Pfam Description: B3 DNA binding domain
  misc_feature (75)..(124): Pfam Name: AP2 Pfam Description: AP2 domain
MDAISCLDESTTTESLSISQAKPSSTIMSSEKASPSPPPPNRLCRVGSGASAVVDSDGGGGGGSTEVESRKLPSSKYKGVVPQPNGRWGSQIYEKHQRVWLGTFNEEDEAARAYDVAVQRFRGKDAVTNFKPLSGTDDDDGESEFLNSHSKSEIVDMLRKHTYNDELEQSKRSRGFVRRRGSAAGAGNGNSISGACVMKAREQLFQKAVTPSDVGKLNRLVIPKQHAEKHFPLQSAANGVSATAAAAKGVLLNFEDVGGKVWRFRYSYWNSSQSYVLTKGWSRFVKEKNLKAGDTVCFQRSTGPDRQLYIDWKTRNVVNEVALFGPVVEPIQMVRLFGVNILKLPGSDSIANNNNASGCCNGKRREMELFSLECSKKPKIIGAL

SEQ ID NO: 1372 - DNA, 1104 bp, Populus balsamifera subsp. trichocarpa
  misc_feature (1)..(1104): Ceres ANNOT ID no. 1464039
atggatggaagctgcatagatgaaagcacaactagtagtgctgataactccatatccattacaccaacctccctccctcccttcccaccaactgctaccactacaaaatcaccacctgagtcactttgccgtgttaggagcggcaatagtagtgttattcttgattcggaatcaggtgtcgaagctgaatcgagaaaactcccttcttctaaatacaaaggtgttgtcccccaaccaaatggtcgctggggtgcacagatttacgagaagcaccagcgtgtgtggctcgggacgttcaatgaagaaaatgaagcagcaagagcctatgatattgctgctcagagattccgtggaagggatgccgtgactaacttcaagcaagttaatgagaccgaagatgatgaaatagaggctgctttcctgaacgctcattcgaaagctgaaatcgttgacatgttgaggaaacacacgtacagcgatgagctagagcaaagcaaaaggaaccacaggagtaacaatgggggaaatgggaagcaatacaagaatacagcaaactacgagaataatagttatgatcatggttgtggtcgggtgttgaaagcgcgtgaacagctttttgagaaagctgtgactccgagtgatgttgggaaattgaatcggcttgtgataccaaaacaacatgcggaaaagcattttcctttgcaaagtacatcaagcaatagtactaaaggtgtattgcttaacttggaagatgtgagcggcaaagtgtggaggtttcgttattcttattggaatagtagccaaagttatgttttgacaaaagggtggagccgatttgttaaagaaaagaacttgaaagctggtgacattgtttgctttcaaagatcaactggacctgataaccagctttacattgattggaaagcaagatgcgggtccaaccaggtccaaccggttcagatggtgaggttgtttggggttaatatttttaatgtacctgggatggaaaatgggtgtgatgggaagagatcaataagggatatggagcttttgtcaatagatcgtcagtatagtaagaaacaaaggatcgttggagccttgtaa

SEQ ID NO: 1373 - protein, 367 aa, Populus balsamifera subsp. trichocarpa
  misc_feature (1)..(367): Ceres ANNOT ID no. 1464039
  misc_feature (1)..(367): Functional Homolog of  Ceres  ID no. 597624
  misc_feature (205)..(313): Pfam Name: B3 Pfam Description: B3 DNA binding domain
  misc_feature (70)..(119): Pfam Name: AP2 Pfam Description: AP2 domain
MDGSCIDESTTSSADNSISITPTSLPPFPPTATTTKSPPESLCRVRSGNSSVILDSESGVEAESRKLPSSKYKGVVPQPNGRWGAQIYEKHQRVWLGTFNEENEAARAYDIAAQRFRGRDAVTNFKQVNETEDDEIEAAFLNAHSKAEIVDMLRKHTYSDELEQSKRNHRSNNGGNGKQYKNTANYENNSYDHGCGRVLKAREQLFEKAVTPSDVGKLNRLVIPKQHAEKHFPLQSTSSNSTKGVLLNLEDVSGKVWRFRYSYWNSSQSYVLTKGWSRFVKEKNLKAGDIVCFQRSTGPDNQLYIDWKARCGSNQVQPVQMVRLFGVNIFNVPGMENGCDGKRSIRDMELLSIDRQYSKKQRIVGAL

SEQ ID NO: 1374 - DNA, 1486 bp, Panicum virgatum; identical to SEQ ID NO: 1291
  misc_feature (1)..(1486): Ceres CLONE ID no.1781615

SEQ ID NO: 1375 - protein, 374 aa, Panicum virgatum; identical to SEQ ID NO: 1292
  misc_feature (1)..(374): Ceres CLONE ID no. 1781615
  misc_feature (1)..(374): Functional Homolog of  Ceres  ID no. 597624
  misc_feature (199)..(312): Pfam Name: B3 Pfam Description: B3 DNA binding domain
  misc_feature (72)..(121): Pfam Name: AP2 Pfam Description: AP2 domain

SEQ ID NO: 1376 - DNA, 1103 bp, Arabidopsis thaliana
  misc_feature (1)..(1103): Ceres CLONE ID no. 108109
  misc_feature (1)..(1103): GEMINI ID 531E9
cttctcgctctgtgacagattctcgctctctctacaaactgtcaggttgattgatgtagaggaatggatattagccggcgtgaaagtaagacggaagcaagtagtagagagaaacggatttatgagaaagatcagatgaatcaagagtcttttattgagggattggcagaggagtttcggttgccaattactcatagggttactgaaaatgttgatttggaggatgtggagcaagcttcgttagatgtaaagatatcgtcgtcgaatgtcgggtttcgtcttcttcagaaaatgggttggaaaggaaaaggtcttggaaagcaagagcaaggtataacggagcctataaagtccggtataagagatcgaagactcggtttagggaaacaagaagaagatgattatttcactgcagaggaaaacatccagcggaagaaacttgatatcgagattgaggagactgaggaaatcgcaaagaaacgggaggtcctagcagaacgtgagcagaagatccagagcgatgttaaagaaatccgtaaagtcttctattgtgaactatgcagcaaacagtatagaacggtgatgaagtttgaaggtcacttgagctcatacgatcacaaccataagaagcgattcaaagaaatgaaagaaatgcacggagcaagcggccgcgatgacaggaagaaacgagagcagcaacgtcaagagagggagatgactaaaatggctgatgctcgcaaacaacatcagatgcaacagagccagcaagaagtcccagagaatgtcccggtttctgcaccggctaagaccacggttgcaccacttgctgtccaagatcagcgaaaaacattgaagtttggcttctcttctaaaagcggcattatatcaaagagccaacccacaagcagcatcaagaagccgaaagtagcaatcgcgtccgttttcgggaacgatagcgacgaagattaactttgctacattatatgatcagaaacattgattgtactttatgtaattctacgctatggttcctttcacagattttaaaacagaatataaaaaattaacatttgtcttcaattttattcatatgtttgtttgtt

SEQ ID NO: 1377 - protein, 301 aa, Arabidopsis thaliana
  misc_feature (1)..(301): Ceres CLONE ID no. 108109
  misc_feature (1)..(301): GEMINI ID 531E9
  misc_feature (66)..(109): Pfam Name: G-patch Pfam Description: G-patch domain
MDISRRESKTEASSREKRIYEKDQMNQESFIEGLAEEFRLPITHRVTENVDLEDVEQASLDVKISSSNVGFRLLQKMGWKGKGLGKQEQGITEPIKSGIRDRRLGLGKQEEDDYFTAEENIQRKKLDIEIEETEEIAKKREVLAEREQKIQSDVKEIRKVFYCELCSKQYRTVMKFEGHLSSYDHNHKKRFKEMKEMHGASGRDDRKKREQQRQEREMTKMADARKQHQMQQSQQEVPENVPVSAPAKTTVAPLAVQDQRKTLKFGFSSKSGIISKSQPTSSIKKPKVAIASVFGNDSDED

SEQ ID NO: 1378 - DNA, 888 bp, Populus balsamifera subsp. trichocarpa
  misc_feature (1)..(888): Ceres ANNOT ID no. 1469082
atggattgcagatggttcattgataaacaggaaacaagcacccgcaatgaacagcaacttgacagagagcaggactcgcttattgaggatttcacagaggattttcgattgccgaaaaatcacagacccactgaaaatgttgatcttgacaatgttgaacaagcatcactggacacaaagttgacagcatcaaacgttggttttaggcttctccagaaaatgggatggaaaggaaagggtctcggaaaggacgagcaaggaatcattgagcctataaagtctggaattagagatccaaagttaggaattggaaaacaagaagaagatgatttttttactgcagaagaaaatattcagcgaaggaaacttgacatcgaggttgaagaaactgaggaagacacaaaaaagcgggaggtattagctgaacgggagcagaaaattcaaactgaggtgaaagagataaggaaggtgttcttttgtgatctttgcaacaagcaatacaaattggcgatggaatttgaagctcatctgagttcatacgatcataatcatagaaagcgatttaaggaaatgagagagatgcatggtacaagcagtcgtgatgatcggcaaaagcgggaactacaacgacaggagagggagatggctaagtttgcacagatggcagatgctcgtaaacaggagcagcagctgcagcaacaggaagaatctggatctgctcagcagaaaagtgcaactgcacttgtggatcaggatcagcggaaggcattaaaatttgggttttcttctaaagggggcttttcaaagaactcctctgccaaagctgcaaagaagccgaaatcagctgtagcctctgttttcagcaatgatagcgatgaagaacagtga

SEQ ID NO: 1379 - protein, 295 aa, Populus balsamifera subsp. trichocarpa
  misc_feature (1)..(295): Ceres ANNOT ID no. 1469082
  misc_feature (1)..(295): Functional Homolog of  Ceres  ID no. 108109
  misc_feature (63)..(106): Pfam Name: G-patch Pfam Description: G-patch domain
MDCRWFIDKQETSTRNEQQLDREQDSLIEDFTEDFRLPKNHRPTENVDLDNVEQASLDTKLTASNVGFRLLQKMGWKGKGLGKDEQGIIEPIKSGIRDPKLGIGKQEEDDFFTAEENIQRRKLDIEVEETEEDTKKREVLAEREQKIQTEVKEIRKVFFCDLCNKQYKLAMEFEAHLSSYDHNHRKRFKEMREMHGTSSRDDRQKRELQRQEREMAKFAQMADARKQEQQLQQQEESGSAQQKSATALVDQDQRKALKFGFSSKGGFSKNSSAKAAKKPKSAVASVFSNDSDEEQ

SEQ ID NO: 1380 - DNA, 876 bp, Populus balsamifera subsp. trichocarpa
  misc_feature (1)..(876): Ceres ANNOT ID no. 1522474
atggattgcagatggttcattgataaacaggaaacaagcacccgcaatgaacagcaacttgacagagagcaggactcgcttattgaggatttcacagaggattttcgattgccgaaaaatcacagacccactgaaaatgttgatcttgacaatgttgaacaagcatcactggacacaaagttgacagcatcaaacgttggttttaggcttctccagaaaatgggatggaaaggaaagggtctcggaaaggacgagcaaggaatcattgagcctataaagtctggaattagagatccaaagttaggaattggaaaacaagaagaagatgatttttttactgcagaagaaaatattcagcgaaggaaacttgacatcgaggttgaagaaactgaggaagacacaaaaaagcgggaggtattagctgaacgggagcagaaaattcaaactgaggtgaaagagataaggaaggtgttcttttgtgatctttgcaacaagcaatacaaattggcgatggaatttgaagctcatctgagttcatacgatcataatcatagaaagcgatttaaggaaatgagagagatgcatggtacaagcagtcgtgatgatcggcaaaagcgggaactacaacgacaggagagggagatggctaaggcagatgctcgtaaacaggagcagcagctgcagcaacaggaagaatctggatctgctcagcagaaaagtgcaactgcacttgtggatcaggatcagcggaaggcattaaaatttgggttttcttctaaagggggcttttcaaagaactcctctgccaaagctgcaaagaagccgaaatcagctgtagcctctgttttcagcaatgatagcgatgaagaacagtga

SEQ ID NO: 1381 - protein, 291 aa, Populus balsamifera subsp. trichocarpa
  misc_feature (1)..(291): Ceres ANNOT ID no. 1522474
  misc_feature (1)..(291): Functional Homolog of  Ceres  ID no. 108109
  misc_feature (63)..(106): Pfam Name: G-patch Pfam Description: G-patch domain
MDCRWFIDKQETSTRNEQQLDREQDSLIEDFTEDFRLPKNHRPTENVDLDNVEQASLDTKLTASNVGFRLLQKMGWKGKGLGKDEQGIIEPIKSGIRDPKLGIGKQEEDDFFTAEENIQRRKLDIEVEETEEDTKKREVLAEREQKIQTEVKEIRKVFFCDLCNKQYKLAMEFEAHLSSYDHNHRKRFKEMREMHGTSSRDDRQKRELQRQEREMAKADARKQEQQLQQQEESGSAQQKSATALVDQDQRKALKFGFSSKGGFSKNSSAKAAKKPKSAVASVFSNDSDEEQ

SEQ ID NO: 1382 - DNA, 1203 bp, Arabidopsis thaliana
  misc_feature (1)..(1203): Ceres CLONE ID no. 115924
  misc_feature (1)..(1203): GEMINI ID 539B6
attcgtcgatcgagcgataagaagaagactggaatttttttgaggaggactctgctccatcgccgcccgccctgtaacccaccggactcagtaaactagtctgtaacacaatatcttctatttcagataagatttagcttggagaagagcaagttccgaaaatggaggggcgtcgtgtatagatccaccacccacagccctgatggaagcagacaacggaggccccaattctagtcatgcatccaaacaacgtctgcgttggacgcatgagctacatgaacgcttcgttgatgccgttgctcaacttggtggccctgatagagctacacccaaaggcgttcttagagtgatgggtgtacaaggcttaactatatatcatgtcaagagtcacttacagaaatatcgacttgcaaagtatcttccagattcgtcttctgaagggaaaaaaactgataagaaagaatctggagatatgctctctgggttggacggctcgtcgggaatgcagataactgaagccctcaagttgcagatggaagttcagaaacgattgcacgagcaactagaagtgcaaagacagctgcaactacggatagaagcacaaggaaagtacttgaagaagataattgaagagcaacaacgactcagtggagtactcggcgaaccctcagccccagtaacgggcgattcagatcctgcaacccctgccccaacatctgagtctcctcttcaagacaagtctggcaaggactgtggaccagacaaaagtctctcagttgacgagtctctctcatcttaccgggagcctttaacaccagactcagggtgtaacattgggtctccagatgagagcacaggagaggagagattatcaaagaagcctcgattggtgagaggtgcagctggttatacacctgatattgtagtgggtcacccaatactagaatcaggcttgaacacttcttaccatcagtcagaccatgtcctcgcctttgaccagccatctacatcactgcttggggccgaagaacagttggataaggtttcaggagataatctttgagttgttgagtgtaccacatgtagtgttgtttatcctaatccttattagttaggagtttcctctaataatgtgatcacaagtcgttaattctctaggcactatcacgagcatgaagaatgaatatgtctgtgttgtgctgc

SEQ ID NO: 1383 - protein, 286 aa, Arabidopsis thaliana
  misc_feature (1)..(286): Ceres CLONE ID no. 115924
  misc_feature (1)..(286): GEMINI ID 539B6
  misc_feature (17)..(68): Pfam Name: Myb_DNA-binding Pfam Description: Myb-like DNA-binding domain
MEADNGGPNSSHASKQRLRWTHELHERFVDAVAQLGGPDRATPKGVLRVMGVQGLTIYHVKSHLQKYRLAKYLPDSSSEGKKTDKKESGDMLSGLDGSSGMQITEALKLQMEVQKRLHEQLEVQRQLQLRIEAQGKYLKKIIEEQQRLSGVLGEPSAPVTGDSDPATPAPTSESPLQDKSGKDCGPDKSLSVDESLSSYREPLTPDSGCNIGSPDESTGEERLSKKPRLVRGAAGYTPDIVVGHPILESGLNTSYHQSDHVLAFDQPSTSLLGAEEQLDKVSGDNL

SEQ ID NO: 1384 - DNA, 1251 bp, Populus balsamifera subsp. trichocarpa
  misc_feature (1)..(1251): Ceres ANNOT ID no. 1453127
atgggaaagcagcagcagcagcagctccgaaattccagcaagatcagcaaaggtacaggggatgggattaacaagagtccgacgatagatctggggagaaatcttggtggaaataaccttgaattcattgcagcagccagagatagtgttgaggatcaattggggtcccaatcacttcccttttctattcagcttagttttcaacaaccccttttgcggaaccaaagatcaactctttctttgcgttattcaacatctttaaggtcagggtgtggaatattgctggagagcgttcctagttcaagttcggtccataaaaacttattagttaatgatcagtatttagattgtgatgatatgacaatggatcccatcaatggagggaacaatctcaacaacaatcctaatcttgcctcaaagcaaagattgcgttggactcatgagcttcacgaacgctttgttgatgctgtggctcagcttggtgggccagatcgggctacgcctaaaggtgttcttagagtcatgggtgtgcaaggcttaacaatataccatgttaaaagccatttacagaaatatcgacttgcaaaataccttcctgactcctcatctgatgggaaaaaagcggacaagaaggaaacaggggatatgatttccaatttggatggttcatctggcatgcaaattacagaagcactcaagctgcagatggaggtacagagacagctacaattacgcatagaagcccaagggaagtatttgaagaagataattgaagagcaacaacgattgagtggagttcttgaagatgtgcctggctcgggggtcactgccccagtatcaggtgataactgcccagaatctgacaagacagacccagcaacccctgccccaacttctgaatcacccctccaagacaaggctgccaaggaacgtgccccagcaaagagcctttcaattgatgaatcattctcttctcagcctgagccactgacaccagattcacgttgcaatgctggctccccagcagagagccctagaggtgagagatctatgaagaagcaacgggtaagcatgggtgtaacatatggtaaacaagagatggttcttacacaccagatactcgagtcaagcttaaattcctatccacgaccacactctgccttcctgggtagagagcagtttgatccttcatctgggttatcaatgggaatcgaagatcaaatggagaaagtttcaggcagtgatgtttag

SEQ ID NO: 1385 - protein, 295 aa, Populus balsamifera subsp. trichocarpa
  misc_feature (1)..(295): Ceres ANNOT ID no. 1453127
  misc_feature (1)..(295): Functional Homolog of  Ceres  ID no. 115924
  misc_feature (21)..(72): Pfam Name: Myb_DNA-binding Pfam Description: Myb-like DNA-binding domain
MDPINGGNNLNNNPNLASKQRLRWTHELHERFVDAVAQLGGPDRATPKGVLRVMGVQGLTIYHVKSHLQKYRLAKYLPDSSSDGKKADKKETGDMISNLDGSSGMQITEALKLQMEVQRQLQLRIEAQGKYLKKIIEEQQRLSGVLEDVPGSGVTAPVSGDNCPESDKTDPATPAPTSESPLQDKAAKERAPAKSLSIDESFSSQPEPLTPDSRCNAGSPAESPRGERSMKKQRVSMGVTYGKQEMVLTHQILESSLNSYPRPHSAFLGREQFDPSSGLSMGIEDQMEKVSGSDV

SEQ ID NO: 1386 - DNA, 888 bp, Populus balsamifera subsp. trichocarpa
  misc_feature (1)..(888): Ceres ANNOT ID no. 1506261
atggatcccatcaatggagggaacaatctcaacaacaatcctaatcttgcctcaaagcaaagattgcgttggactcatgagcttcacgaacgctttgttgatgctgtggctcagcttggtgggccagatcgggctacgcctaaaggtgttcttagagtcatgggtgtgcaaggcttaacaatataccatgttaaaagccatttacagaaatatcgacttgcaaaataccttcctgactcctcatctgatgggaaaaaagcggacaagaaggaaacaggggatatgatttccaatttggatggttcatctggcatgcaaattacagaagcactcaagctgcagatggaggtacagagacagctacaattacgcatagaagcccaagggaagtatttgaagaagataattgaagagcaacaacgattgagtggagttcttgaagatgtgcctggctcgggggtcactgccccagtatcaggtgataactgcccagaatctgacaagacagacccagcaacccctgccccaacttctgaatcacccctccaagacaaggctgccaaggaacgtgccccagcaaagagcctttcaattgatgaatcattctcttctcagcctgagccactgacaccagattcacgttgcaatgctggctccccagcagagagccctagaggtgagagatctatgaagaagcaacgggtaagcatgggtgtaacatatggtaaacaagagatggttcttacacaccagatactcgagtcaagcttaaattcctatccacgaccacactctgccttcctgggtagagagcagtttgatccttcatctgggttatcaatgggaatcgaagatcaaatggagaaagtttcaggcagtgatgtttag

SEQ ID NO: 1387 - protein, 295 aa, Populus balsamifera subsp. trichocarpa; identical to SEQ ID NO: 1385
  misc_feature (1)..(295): Ceres ANNOT ID no. 1506261
  misc_feature (1)..(295): Functional Homolog of  Ceres  ID no. 115924
  misc_feature (21)..(72): Pfam Name: Myb_DNA-binding Pfam Description: Myb-like DNA-binding domain

SEQ ID NO: 1388 - DNA, 870 bp, Populus balsamifera subsp. trichocarpa
  misc_feature (1)..(870): Ceres ANNOT ID no. 1480332
atggatcccatcaatggagggaacagtctcaacaacaatcctaatcttgcctcaaagcaacgattgcgttggactcatgagcttcacgaacgctttgttgatgctgtggctcagcttggtgggccagatcgggctacacctaaaggtgttctcagagtcatgggtgtgcaaggcttaacaatttaccataaatatcgacttgcaaaataccttcccgactcctcatccgatgggaaaaaagtggacaagaaggaaacaggggatgtgctttccaattcggatggttcttctggaatgcaaattacagaagcactcaagctgcagatggaggtgcagagacagctacaattacgcatagaagcccaagggaagtatttgaagaagataattgaagagcaacaacgattgagcggagttcttgaagatgtgcctggttcaggggtctctgccccagtatcaggtgacaactgcccagtatctgacaacaaaacagacccagcaacccctgccccaacttctgaatcacccctccaagacaaggttgccaaggaatgtgccccaacaaagagcctttcaattgatgaatcattctcctctcagcacgagccattaacaccagattcacgttgcaatactggttccccagcagagagccctagaggtgagaggtcactgaagaagcaaatggtaagcatgggtgtagcatttggtaaaccagagatggttcttacacaccagatattggagtcgagcttaaattcctatccacaaccgcactctgccttcttgaccagagagcaattcgatccttcatctgggttatcaatgggaaacgaagatcaatcggaggtcttaggcagtgacctttag

SEQ ID NO: 1389 - protein, 289 aa, Populus balsamifera subsp. trichocarpa
  misc_feature (1)..(289): Ceres ANNOT ID no. 1480332
  misc_feature (1)..(289): Functional Homolog of  Ceres  ID no. 115924
  misc_feature (21)..(69): Pfam Name: Myb_DNA-binding Pfam Description: Myb-like DNA-binding domain
MDPINGGNSLNNNPNLASKQRLRWTHELHERFVDAVAQLGGPDRATPKGVLRVMGVQGLTIYHKYRLAKYLPDSSSDGKKVDKKETGDVLSNSDGSSGMQITEALKLQMEVQRQLQLRIEAQGKYLKKIIEEQQRLSGVLEDVPGSGVSAPVSGDNCPVSDNKTDPATPAPTSESPLQDKVAKECAPTKSLSIDESFSSQHEPLTPDSRCNTGSPAESPRGERSLKKQMVSMGVAFGKPEMVLTHQILESSLNSYPQPHSAFLTREQFDPSSGLSMGNEDQSEVLGSDL

SEQ ID NO: 1390 - DNA, 774 bp, Populus balsamifera subsp. trichocarpa
  misc_feature (1)..(774): Ceres ANNOT ID no. 1454197
atgggttcaagtcgctccgatgtatccaacaaagaaagattgcgctggacgcaagaactgcacgatcggttcgaggaggctgttaatcaacttggtggtcctgatagagcaacaccaaagggtatcttgagggctatgggcatctctgggttgactatctaccatgtcaagagccatttgcagaaatacagaatatcgaagtttatcccagaaaccaacagagggaagtatgaaaggagaaatatttcagaaatgttgccaaatttcagtgcgacatctggagctcagctcaatgaagcattactgatgcaaatggaggttcaaaagcgactgagcgatcaacttgaggttcaaaagagcttgaagattaagattgaagcccaagggagattccttgagagaatcgtggaggaaaacagaaaccgaagtgcgtccattaatccaatcccaaaacatagcaagtctttctctccagtatcacagccgtctttctgtgatgaatcagaatcaaatgctagagaatttgaaactgattcggagggtgagaaagctgaaatacagcctgaagaataccttcaagctcttaagagattgaggacagaaaaccatgctttaccttcgcggtatcaactccaacctctaaatcctgatccttacaatcaaaacatggttcttcaaagagatgcaaaattttcatatccatctcacgatgccaacttcccatggaacattttggccacctgtccatcacctctagtgcccagttttttctaa

SEQ ID NO: 1391 - protein, 257 aa, Populus balsamifera subsp. trichocarpa
  misc_feature (1)..(257): Ceres ANNOT ID no. 1454197
  misc_feature (1)..(257): Functional Homolog of  Ceres  ID no. 115924
  misc_feature (13)..(64): Pfam Name: Myb_DNA-binding Pfam Description: Myb-like DNA-binding domain
MGSSRSDVSNKERLRWTQELHDRFEEAVNQLGGPDRATPKGILRAMGISGLTIYHVKSHLQKYRISKFIPETNRGKYERRNISEMLPNFSATSGAQLNEALLMQMEVQKRLSDQLEVQKSLKIKIEAQGRFLERIVEENRNRSASINPIPKHSKSFSPVSQPSFCDESESNAREFETDSEGEKAEIQPEEYLQALKRLRTENHALPSRYQLQPLNPDPYNQNMVLQRDAKFSYPSHDANFPWNILATCPSPLVPSFF

SEQ ID NO: 1392 - DNA, 543 bp, Arabidopsis thaliana
  misc_feature (1)..(543): Ceres CLONE ID no. 118184
  misc_feature (1)..(543): GEMINI ID 549H3
  misc_feature: Encodes the peptide sequence at SEQ ID NO. 1201
  misc_feature: Encodes the peptide sequence at SEQ ID NO. 1393
atcacttacttaacatactaagagagttattagaacttgcaaaaaatggcttccaaggctttgattctgttaggtctcttctcagttcttctcgtcgtctccgaagtgtctgccgcaaggcaatcgggcatggtgaagccagagagtgaggaaactgtgcaacctgaaggttatggcggtggccacggaggacatggtggtcacggagggggaggaggccacggacatggaggacacaacggaggagggggccacggacttgacggatacggaggaggtggaggacactatggaggaggtggaggacactacggaggaggtggaggacactacggaggaggtggaggacactacggaggaggtggtggaggacacggaggtggaggacactacggaggtggaggccacgggctaaacgaacctgttcagactaagccgggtgtttaaaactatataatatcttcactaccatgcatgattgcatatatatatatacgcttatgtattatctatatgcctataaataaaccatggtgagtttgc

SEQ ID NO: 1393 - protein, 133 aa, Arabidopsis thaliana; identical to SEQ ID NO: 1201
  misc_feature (1)..(133): Ceres CLONE ID no. 118184
  misc_feature (1)..(133): GEMINI ID 549H3
  misc_feature (1)..(99): Pfam Name: GRP Pfam Description: Glycine rich protein family

SEQ ID NO: 1394 - DNA, 1178 bp, Arabidopsis thaliana
  misc_feature (1)..(1178): Ceres CLONE ID no. 120302
  misc_feature (1)..(1178): GEMINI ID 555C1
aaccaaacccaaaatccaagtgccccaccaaatgcttcaatcctcttccactacacaaaaaaacaacttaatccctttatacccttttagccaaaaccctcgctaaaagccaatccctcaatataaaataacaagtagaattgatctgcctatatataagattttgagacgaaataagatctaaaccacaagaaagaaagtaaacataaaagtatgggaaggtcaccgtgctgtgagaaagctcacataaacaaaggagcatggacgaaagaagaggacgagaggctcatcgcttacattaaagctcatggagaaggctgctggagatctctccccaaagccgccggacttcttcgctgtggcaagagctgccgtctccggtggatcaactatctccggcctgaccttaagcgtggaaacttcaccgaggaagaagacgagctcatcatcaagctccatagccttcttggcaacaaatggtcgcttattgccgggagattaccgggaagaacagataacgagataaagaactattggaacacacatatacgaagaaagcttataaacagagggattgatccaacgagtcacagaccaatccaagaatcatcagcttctcaagattctaaacctacacaactagaaccagttacgagtaacaccattaatatctcattcacttctgctccaaaggtcgaaacgttccatgaaagtataagctttccgggaaaatcagaaaaaatctcaatgcttacgttcaaagaagaaaaagatgagtgtccagttcaagaaaagttcccagatttgaatcttgagctcagaatcagtcttcctgatgatgttgatcgtcttcaaggacatggaaagtcaacaacgccacgttgtttcaagtgcagcttagggatgataaacsgcatggagtgcagatgcggaagamtsagatgcgatgtagtcggaggtagcagcaaggggagtgacatgagcaatggatttgattttttagggttggcaaagaaagagaccacttctcttttgggttttcgaagcttggagatgaaataatattgtcaaattttaggcgtaactgtacaaaacttttgccttgataatttgaaaagtaaatcttcaacttgtatgagaaatttaactgctgaattataatatatagaatttgtttt

SEQ ID NO: 1395 - protein, 282 aa, Arabidopsis thaliana
  misc_feature (1)..(282): Ceres CLONE ID no. 120302
  misc_feature (1)..(282): GEMINI ID 555C1
  misc_feature (67)..(112): Pfam Name: Myb_DNA-binding Pfam Description: Myb-like DNA-binding domain
  misc_feature (234)..(234): Xaa is any aa, unknown, or other
  misc_feature (242)..(242): Xaa is any aa, unknown, or other
MGRSPCCEKAHINKGAWTKEEDERLIAYIKAHGEGCWRSLPKAAGLLRCGKSCRLRWINYLRPDLKRGNFTEEEDELIIKLHSLLGNKWSLIAGRLPGRTDNEIKNYWNTHIRRKLINRGIDPTSHRPIQESSASQDSKPTQLEPVTSNTINISFTSAPKVETFHESISFPGKSEKISMLTFKEEKDECPVQEKFPDLNLELRISLPDDVDRLQGHGKSTTPRCFKCSLGMINXMECRCGRXRCDVVGGSSKGSDMSNGFDFLGLAKKETTSLLGFRSLEMK

SEQ ID NO: 1396 - DNA, 1068 bp, Populus balsamifera subsp. trichocarpa
  misc_feature (1)..(1068): Ceres ANNOT ID no. 1450548
atggaagcaaggttatcggtcatagaaaaggtacgaaactggaccttgctacagatccactccctcactggtgtcagttccaacagcaataaggatataaatctaaggggtgtccgtgaattctggtacatgtgttgtctacaacaagaagaagaaggaaggcctccatttctaccacaacagtaccgcacgcccgtcaaaaaaagaaaagacgcaccaaaaacattgaggttaccattcctacttgtaaatcctactgaaatgggaaggtctccttgctgtgaaaaagctcatacaaacaaaggcgcatggactaaggaagaagatgatcgccttattgcttacattagaacccacggtgaaggttgctggcgttcacttcctaaagctgctggccttctaagatgcggcaagagctgcagacttcgttggatcaactatttaagacctgaccttaaacgtggcaattttactgaagaagaagatgagctcattatcaaactccatagtctcctcggcaacaaatggtcacttatagccggaaggttaccagggagaacagataatgagataaagaattattggaacacacatataagaaggaagctcttgaatagaggcatagatcctgcgactcataggccactcaatgaaccagcccaagaagcttcaacaacaatatctttcagcactactacctcagttaaagaagagtcgttgagttctgttaaagaggaaagtaataaggagaagataattagcgcagctgcttttatatgcaaagaagagaaaaccccagttcaagaaaggtgtccagacttgaatcttgaacttagaattagccttccttgccaaaaccagcctgatcgtcaccaggcattcaaaactggaggaagtacaagtctttgttttgcttgcagcttggggctacaaaacagcaaggattgcagttgcagtgtcattgtgggtactattggaagcagcagtagtgctggctccaaaactggctatgacttcttagggatgaaaagtggtgtgttggattatagaggtttggagatgaaatga

SEQ ID NO: 1397 - protein, 355 aa, Populus balsamifera subsp. trichocarpa
  misc_feature (1)..(355): Ceres ANNOT ID no. 1450548
  misc_feature (1)..(355): Functional Homolog of  Ceres  ID no. 120302
  misc_feature (154)..(199): Pfam Name: Myb_DNA-binding Pfam Description: Myb-like DNA-binding domain
MEARLSVIEKVRNWTLLQIHSLTGVSSNSNKDINLRGVREFWYMCCLQQEEEGRPPFLPQQYRTPVKKRKDAPKTLRLPFLLVNPTEMGRSPCCEKAHTNKGAWTKEEDDRLIAYIRTHGEGCWRSLPKAAGLLRCGKSCRLRWINYLRPDLKRGNFTEEEDELIIKLHSLLGNKWSLIAGRLPGRTDNEIKNYWNTHIRRKLLNRGIDPATHRPLNEPAQEASTTISFSTTTSVKEESLSSVKEESNKEKIISAAAFICKEEKTPVQERCPDLNLELRISLPCQNQPDRHQAFKTGGSTSLCFACSLGLQNSKDCSCSVIVGTIGSSSSAGSKTGYDFLGMKSGVLDYRGLEMK

SEQ ID NO: 1398 - DNA, 816 bp, Populus balsamifera subsp. trichocarpa
  misc_feature (1)..(816): Ceres ANNOT ID no. 1460633
atgggaaggtctccttgctgtgaaaaagcccatacaaacaagggtgcgtggaccaaggaggaagacgatcgccttgttgcttacattagagctcacggtgaaggttgctggcgctcacttcctaaagccgctggccttcttagatgtggcaagagttgcagacttcgttggatcaactatttaagacctgaccttaaacgtggcaatttcaccgaagcagaagatgagctcattatcaaactccatagcctccttggaaacaaatggtcactcatagctggaagattaccagggagaacagataatgagataaagaattattggaacacacatataagaaggaagcttttgaacagaggcatagatcccgcaactcataggccactcaacgaaccagcagtacaagaagccacaacaacaatatctttcaccacgactactacttcagtacttgaagaagagtctctgggttctataattaaagaggaaaataaagagaagataattagcgcaactgctttcgtatgcaaagaagagaaaacccaagttcaagaaaggtgtccagacttgaatctcgagcttggaattagccttccttcccaaaaccagcctgatcatcaccagccattcaaaactggaggaagtagaagtctttgttttgcttgcagtttggggctacaaaacagcaaggattgcagctgcaatgttattgtgagcactgttgggagcagtggcagcactagcacaaagactggttatgacttcttgggcatgaaaagtggtgttttggattatagaagtttagagatgaaataa

SEQ ID NO: 1399 - protein, 271 aa, Populus balsamifera subsp. trichocarpa
  misc_feature (1)..(271): Ceres ANNOT ID no. 1460633
  misc_feature (1)..(271): Functional Homolog of  Ceres  ID no. 120302
  misc_feature (67)..(112): Pfam Name: Myb_DNA-binding Pfam Description: Myb-like DNA-binding domain
MGRSPCCEKAHTNKGAWTKEEDDRLVAYIRAHGEGCWRSLPKAAGLLRCGKSCRLRWINYLRPDLKRGNFTEAEDELIIKLHSLLGNKWSLIAGRLPGRTDNEIKNYWNTHIRRKLLNRGIDPATHRPLNEPAVQEATTTISFTTTTTSVLEEESLGSIIKEENKEKIISATAFVCKEEKTQVQERCPDLNLELGISLPSQNQPDHHQPFKTGGSRSLCFACSLGLQNSKDCSCNVIVSTVGSSGSTSTKTGYDFLGMKSGVLDYRSLEMK

SEQ ID NO: 1400 - DNA, 960 bp, Populus balsamifera subsp. trichocarpa
  misc_feature (1)..(960): Ceres ANNOT ID no. 1480232
atgggcagatctccttgctgtgagaaagaacacaccaacaaaggtgcatggactaaagaagaagatgaacgtcttgttaattatatcaaagctcaaggtgaaggttgttggagatctctccctaaggctgctggtttgcttagatgtggcaagagttgtagactaaggtggataaactacctaaggcctgatctcaagagaggaaacttcagtgatgaagaagatgaactcatcatcaaccttcacagcttacttggtaacaagtggtctctcattgctgctaggctaccaggaagaactgacaatgagataaagaattattggaatactcatatcaaaaggaagctttttacccgtggaattgatcctcaaactcaccgtccactcaaatccaccaccaccaccacctcctcctccaccaccaccaccaccactactaacagcaccaacaataaaaatagcaaactggataccaaaaggagtactgattttcaactggaagaacaaaactattcgtttcttcaagtgcagcctgagtttacgatgagcaacatgaccaaaacggaaaacaattccagtattatcaaggtaggtggcagcagtgactcggctgaagattccaatagtagcagtggagtgacaacagaactagaagtgtatccagatcataaactggtcaatcttgagctctctattggccttccgtgtcagtctctagtctcttctatgaacaatcttaagcaagcaaaacaacaagaacaagaagaagtggtcacacatcaattgtttgagacatctactactcctacttctagtgctcctgtttctgttcataaagcagcatgtttgtgttacaaactagggttcaagaacagtcaagcatgtagcagttgtaatgccatggaaaaaacagtaacagctgataatcttcatagattttacagacctttggatgcttga

SEQ ID NO: 1401 - protein, 319 aa, Populus balsamifera subsp. trichocarpa
  misc_feature (1)..(319): Ceres ANNOT ID no. 1480232
  misc_feature (1)..(319): Functional Homolog of  Ceres  ID no. 120302
  misc_feature (67)..(112): Pfam Name: Myb_DNA-binding Pfam Description: Myb-like DNA-binding domain
MGRSPCCEKEHTNKGAWTKEEDERLVNYIKAQGEGCWRSLPKAAGLLRCGKSCRLRWINYLRPDLKRGNFSDEEDELIINLHSLLGNKWSLIAARLPGRTDNEIKNYWNTHIKRKLFTRGIDPQTHRPLKSTTTTTSSSTTTTTTTNSTNNKNSKLDTKRSTDFQLEEQNYSFLQVQPEFTMSNMTKTENNSSIIKVGGSSDSAEDSNSSSGVTTELEVYPDHKLVNLELSIGLPCQSLVSSMNNLKQAKQQEQEEVVTHQLFETSTTPTSSAPVSVHKAACLCYKLGFKNSQACSSCNAMEKTVTADNLHRFYRPLDA

SEQ ID NO: 1402 - DNA, 957 bp, Populus balsamifera subsp. trichocarpa
  misc_feature (1)..(957): Ceres ANNOT ID no. 1478804
atgggcagatctccttgttgtgagaaagaacacaccaacaaaggtgcctggactaaagaagaagatgaacgtctcattaattatatcaaatctcatggtgaaggttgttggaggtctctccctaaggcagctggtttgcttagatgtggcaaaagttgtagactgaggtggataaactacctaaggcctgatctcaagagaggaaacttcagtgacgaagaagatgaactcatcatcaaccttcacagcttacttggaaacaagtggtctctcattgctgctaggctgccaggaagaactgacaatgagataaagaattattggaatactcatatcaagagaaagctctttagccgtggagttgatcctcaaactcaccgtccactcaattccaccaccacctcctccaccacttccaccaccacaaacagcaccaacaataaaaatagcaacatgggcaccaaaaggattactaactttaaacttgaagaacaaaactatttatttgttcaagcccagccagagtttatgatgagcaacatagtcaagaaggctagcgattcaagtattatcaaggtaggtggcagcagtgactctgctgaagattccaatagtagcagtggcgtgacagcagaattagaagtgcatccaaatcataaactcaatcttgagctctctattggtcttccatgtcaatctcaactttcttctgtcaatgatcttaatgattcaaagcaagcaaaccaacagcatcaagaacaagtagtcacatatcaattgtttgggacccctgctactcccacctccagtgcccctgctgttgttcatagaacagcatgtttgtgttcttacaatcgagggttcaagaacagtcaagcatgtagttgttgtaatgccgtggaaaaatttgtaacagctgatagtctttatagattttacagacctttggatgcttga

SEQ ID NO: 1403 - protein, 318 aa, Populus balsamifera subsp. trichocarpa
  misc_feature (1)..(318): Ceres ANNOT ID no. 1478804
  misc_feature (1)..(318): Functional Homolog of  Ceres  ID no. 120302
  misc_feature (67)..(112): Pfam Name: Myb_DNA-binding Pfam Description: Myb-like DNA-binding domain
MGRSPCCEKEHTNKGAWTKEEDERLINYIKSHGEGCWRSLPKAAGLLRCGKSCRLRWINYLRPDLKRGNFSDEEDELIINLHSLLGNKWSLIAARLPGRTDNEIKNYWNTHIKRKLFSRGVDPQTHRPLNSTTTSSTTSTTTNSTNNKNSNMGTKRITNFKLEEQNYLFVQAQPEFMMSNIVKKASDSSIIKVGGSSDSAEDSNSSSGVTAELEVHPNHKLNLELSIGLPCQSQLSSVNDLNDSKQANQQHQEQVVTYQLFGTPATPTSSAPAVVHRTACLCSYNRGFKNSQACSCCNAVEKFVTADSLYRFYRPLDA

SEQ ID NO: 1404 - DNA, 796 bp, Arabidopsis thaliana
  misc_feature (1)..(796): Ceres CLONE ID no. 12071
  misc_feature (1)..(796): GEMINI ID 535A9
aacctattagagtttccttcctccaacaaaccatctttataagactccaaaatggagggtaagagatcacaaggacaaggttacatgaaaaagaagtcttaccttgtggaagaagatatggagactgatacggatgaagaagaggaagtaggtagggatagagttagagggtctagaggtagcatcaatcgtggtggctcgttgcggctttgccaagtagatagatgcacagctgatatgaaagaggcaaaactgtatcaccggagacacaaagtgtgtgaagttcatgcaaaggcatcttctgtctttctctcaggacttaaccaacgcttttgtcaacaatgcagtaggtttcatgacctccaagagtttgatgaagctaagagaagttgtaggaggcgcttagctggacacaatgagcgaagaaggaagagctctggtgagagtacttatggagaaggatcaggtcggagaggaatcaatggtcaggtggtgatgcagaatcaagaaagatcaagggtagagatgacacttcctatgccaaactcatcattcaagcgaccacagattagatagagaagctgtctgctctctctcttctgtcatctaaacttctctcttagaatcctaaaattgtggtatctaacaatgttatagagaaataaataactaccactctctctagtactctctaatgttatcagctatatgcaaacgctaagactatacttgaaccttgagtgttatcttgtatgtttcaaagatatggctaatgatatgtgtaatacttctacct

SEQ ID NO: 1405 - protein, 174 aa, Arabidopsis thaliana
  misc_feature (1)..(174): Ceres CLONE ID no. 12071
  misc_feature (1)..(174): GEMINI ID 535A9
  misc_feature (53)..(131): Pfam Name: SBP Pfam Description: SBP domain
MEGKRSQGQGYMKKKSYLVEEDMETDTDEEEEVGRDRVRGSRGSINRGGSLRLCQVDRCTADMKEAKLYHRRHKVCEVHAKASSVFLSGLNQRFCQQCSRFHDLQEFDEAKRSCRRRLAGHNERRRKSSGESTYGEGSGRRGINGQVVMQNQERSRVEMTLPMPNSSFKRPQIR

SEQ ID NO: 1406 - protein, 169 aa, Glycine max
  misc_feature (1)..(169): Public GI no. 55419652
  misc_feature (1)..(169): Functional Homolog of  Ceres  ID no. 12071
  misc_feature (41)..(119): Pfam Name: SBP Pfam Description: SBP domain
MQEEEEEGVGGDHGFPDDEKKKKGYGRRGAAGGGGGVSPPACQVEKCGLDLSDAKRYHRRHKVCEIHAKAPFVVVAGLRQRFCQQCSRFHELPEFDEAKRSCRRRLAGHNERRRKSSAESSSAAESSNRRGMMISAQLKESHYLADDQRARVNPMAIHGSSSFKRSQIR

SEQ ID NO: 1407 - protein, 131 aa, Glycine max
  misc_feature (1)..(131): Public GI no. 1183866
  misc_feature (1)..(131): Functional Homolog of  Ceres  ID no. 12071
  misc_feature (51)..(129): Pfam Name: SBP Pfam Description: SBP domain
MDTSKGEGKRVIKLPGSQEQGEEEDDIGEDSKKTRALTPSGKRASGSTQRSCQVENCAAEMTNAKPYHRRHKVCEFHAKAPVVLHSGLQQRFCQQCSRFHELSEFDEAKRSCRRRLAGHNERRRKSSHDTH

SEQ ID NO: 1408 - protein, 138 aa, Glycine max
  misc_feature (1)..(138): Ceres CLONE ID no. 538817
  misc_feature (1)..(138): Functional Homolog of  Ceres  ID no. 12071
  misc_feature (56)..(134): Pfam Name: SBP Pfam Description: SBP domain
MDGSWSEGKRSMSYKEEDEYEEEEEEEVSEYGDDGKKKRVVSNKRGSKAGGSVPPSCQVDGCNADLSEAKPYHRRHKVCEYHAKAPAVVIGDQHQRFCQQCSRFHELSEFDDSKRSCRRRLAGHNERRRKNASEYHGL

SEQ ID NO: 1409 - protein, 134 aa, Glycine max
  misc_feature (1)..(134): Public GI no. 30577630
  misc_feature (1)..(134): Functional Homolog of  Ceres  ID no. 12071
  misc_feature (49)..(127): Pfam Name: SBP Pfam Description: SBP domain
MEASRAEGKRSFMEEEEDQEEEEEEEEKREMSTSSSRRASGSGGSTPPTCQVENCNADLTDAKHYHRRHKVCESHAKAPIVYVAGGQKRFCQQCSRFHDLSEFDEYKKSCRKRLAGHNERRRKSSSDFHREGSN

SEQ ID NO: 1410 - protein, 174 aa, Glycine max; identical to SEQ ID NO: 1405
  misc_feature (1)..(174): Public GI no. 30577630
  misc_feature (1)..(134): Functional Homolog of  Ceres  ID no. 12071
  misc_feature (53)..(131): Pfam Name: SBP Pfam Description: SBP domain

SEQ ID NO: 1411 - DNA, 753 bp, Populus balsamifera subsp. trichocarpa
  misc_feature (1)..(753): Ceres ANNOT ID no. 1466704
atgtggcttgtggtcctcccaacttttttcaccttttcctcaacacactcttctgcagaccttcatcttagcacttcaagtatccctcctcaccttgctagatatcacgcaataccccaattgtgtgatatcctccctgaaagaattatggatgctaagactcttgaagggaagcgtaactatttgaaagagaaaatgatcaacaaggatgatttcccgatcgaggatgatttggaagatgacatggaagaggatgagggtggggggggctgttttggttttaccgatgatgaaaagaagaaaggagttgggaagagagggactggtggcggcggagcttctccgccgtcttgccaagtagagaagtgtggagctaacttgactgatgctaaaaggtaccacaggagacacaaggtttgcgaggttcatgcgaaatcaccagctgtggttgttgctggcctcaggcagcggttctgtcagcaatgcagcaggatttacttccatggtatgaaaaggttccatgagctactggagtttgatgaaacaaagaggagttgccgtaggcgtttggcaggacacaatgagcggcgccggaagaacacggctgaatcttatggagaaggttcgagccgcaaaggggttggtactcaactgaaagaaagcccgtgcaggcaagctgatgaaagaggaagatatcagatgagcatcccatcccaaggaagttcctcttacaagcgatcccagatcagataa

SEQ ID NO: 1412 - protein, 250 aa, Populus balsamifera subsp. trichocarpa
  misc_feature (1)..(250): Ceres ANNOT ID no. 1466704
  misc_feature (1)..(250): Functional Homolog of  Ceres  ID no. 12071
  misc_feature (117)..(203): Pfam Name: SBP Pfam Description: SBP domain
MWLVVLPTFFTFSSTHSSADLHLSTSSIPPHLARYHAIPQLCDILPERIMDAKTLEGKRNYLKEKMINKDDFPIEDDLEDDMEEDEGGGGCFGFTDDEKKKGVGKRGTGGGGASPPSCQVEKCGANLTDAKRYHRRHKVCEVHAKSPAVVVAGLRQRFCQQCSRIYFHGMKRFHELLEFDETKRSCRRRLAGHNERRRKNTAESYGEGSSRKGVGTQLKESPCRQADERGRYQMSIPSQGSSSYKRSQIR

SEQ ID NO: 1413 - DNA, 1114 bp, Arabidopsis thaliana
  misc_feature (1)..(1114): Ceres CLONE ID no. 12997
  misc_feature (1)..(1114): GEMINI ID 555E5
accagtcttcttcttcttcctccaaactctctctttctctctcgagaaccttaagaaaacgttacaaatggctgttgaagcaagacacatgaatctcttctcttctcaatacattaccaacagagaatgtgttaaatctcaaacgaatatgaacaacggacaacaaatcgccggcggtggttttccgttaacaatcggtgatcggaatttacagtacatagatccgattaacagcttcaacaaatcagaaagcgagctcacagctatttcaaaacgtcagagagattcaacgtttgattcagacgctttaatcgcatctcagaaacgcagagcaatcgcgttttctccggcgtcattaatcgacgcagagttagtttcacagatccaacagcaaaactcagaaatcgatagattcgtagcgcaacaaacggaaacgttgagaatcgaattagaagcgagacaaagaacgcaaacgcggatgttagcgtcagcggtacaaaacgcgatattgaaaaagctgaaagcgaaagacgaagagattataagaatggggaaattaaactgggttttacaagaacgtgtgaagaatctctacgtagagaatcagatctggcgtgatttagcacaaactaatgaagctactgctaataatctcagatcaaatctcgaacaagttttagctcaagtcgatgatttagatgcgtttcgtcgtcctttggttgaagaagctgatgatgcagaatctagctgtggaagctgtgacggaggtgatgtaacggcggttgttaacggaggatgtaaacggtgcggtcaattaacggcgagtgtgttggtgttgccttgtcgtcatttgtgtttgtgtacggtttgtggatcgtcggctttgttacggacgtgtcctgtatgtgatatggtcatgactgctagtgtacatgttaacatgtcatcatgaccattttatttatttttttcaagttaaaaagtttagttttattgttttgatttgaggattaaagagtaaaattaggtgaaaaacaaaagaagaagaaatgtgactcttttttgactttttttggagacttttaaagatggaattgattcattatttgtttgc

SEQ ID NO: 1414 - protein, 294 aa, Arabidopsis thaliana
  misc_feature (1)..(294): Ceres CLONE ID no. 12997
  misc_feature (1)..(294): GEMINI ID 555E5
MAVEARHMNLFSSQYITNRECVKSQTNMNNGQQIAGGGFPLTIGDRNLQYIDPINSFNKSESELTAISKRQRDSTFDSDALIASQKRRAIAFSPASLIDAELVSQIQQQNSEIDRFVAQQTETLRIELEARQRTQTRMLASAVQNAILKKLKAKDEEIIRMGKLNWVLQERVKNLYVENQIWRDLAQTNEATANNLRSNLEQVLAQVDDLDAFRRPLVEEADDAESSCGSCDGGDVTAVVNGGCKRCGQLTASVLVLPCRHLCLCTVCGSSALLRTCPVCDMVMTASVHVNMSS

SEQ ID NO: 1415 - protein, 323 aa, Zea mays
  misc_feature (1)..(323): Ceres CLONE ID no. 465893
  misc_feature (1)..(323): Functional Homolog of  Ceres  ID no. 12997
  misc_feature (277)..(277): Xaa is any aa, unknown, or other
  misc_feature (279)..(279): Xaa is any aa, unknown, or other
MAVEAHRLLLAGGHRQQQQQQQLASAGWPWAGADEDRCATTARPSQHHHHQQQQPQQELRLHNASCVGVLAPRVSTIAAGGQMFLGDAAESDVTFGGGGAAARQEVTAVAPAPKRRKRAEQQQTPPVFQVCAADDVAAQFQQHIVDVNRLVFQQTANMWAALTELRRRQARQVVAAVEAAAATRLRAREEEVQRTARINGTLEERARSLYVEAQLWRDLARANEATANELRAELQQALDDQRTRGAPGAGADADDAGSCCRGGEDGGTGTSLARTCXVXGLSAADVLLLPCRHLCACAPCAGAARACPACGCAKNGSVCVNFS

SEQ ID NO: 1416 - DNA, 1005 bp, Populus balsamifera subsp. trichocarpa
  misc_feature (1)..(1005): Ceres ANNOT ID no. 1483367
atggcagttgaagctcctcatacaaaccttaatttcccttcacatcttctcacaaacagggattttgcgaaagtaaatcaagcaaacatgagtttgtacaatacccagatggattctggccttgtttttaatgaaccaatgcctgaaacactcttgtcgttctatcaatcctctcttggttgtgacccagtttctgctaaagcttctaataaagatgatagtgggctcacctacaatgttcctgctgttgttgctccaagaaagaggtctagagattcaatcaatgacaactttgatgcttttcatgcctctcagaagaccaaagtctgccctttttcttcttttattgatcaagacatcatctttcagatccaacaacaacaatctgaaattgaccgcttcattgctgaacataatcagaaagttagaatggaacttgaagacaggagaaagaggcagtcaagaatgctggtatcggcaatacaaggagggatggtgaggaaattaatagagaaagatgaagagattcaaaggatgggaaaattgaactgggttcttcaagaaaaagtgaagagcttatacgttgagactcaaatttggagggatttagctcaagccaatgaggctacagcaaattcattacgcagcaatttagaacaagttttggcgcacgttagcgaggaccgctacataaatggtggtggtgccacggtggcagatgacgcggaatccagttgtggaagtagtgatcatgggaggtgcccgttagcaggtggagaagagggcgcggtgaaggataagttggtggtggtgaaggataacaatagcagcaaaaatattaaccacaaccggatgtgtaaaaagtgtggggagagggaatcaagtgtgttgctgctgccatgcaggcatctgtgcctgtgtacattatgtgggtccaatctgattggtacttgcccagtatgtgattctgtcatggatgctagtgtacatgttaacatggcttga

SEQ ID NO: 1417 - protein, 334 aa, Populus balsamifera subsp. trichocarpa
  misc_feature (1)..(334): Ceres ANNOT ID no. 1483367
  misc_feature (1)..(334): Functional Homolog of  Ceres  ID no. 12997
MAVEAPHTNLNFPSHLLTNRDFAKVNQANMSLYNTQMDSGLVFNEPMPETLLSFYQSSLGCDPVSAKASNKDDSGLTYNVPAVVAPRKRSRDSINDNFDAFHASQKTKVCPFSSFIDQDIIFQIQQQQSEIDRFIAEHNQKVRMELEDRRKRQSRMLVSAIQGGMVRKLIEKDEEIQRMGKLNWVLQEKVKSLYVETQIWRDLAQANEATANSLRSNLEQVLAHVSEDRYINGGGATVADDAESSCGSSDHGRCPLAGGEEGAVKDKLVVVKDNNSSKNINHNRMCKKCGERESSVLLLPCRHLCLCTLCGSNLIGTCPVCDSVMDASVHVNMA

SEQ ID NO: 1418 - DNA, 981 bp, Populus balsamifera subsp. trichocarpa
  misc_feature (1)..(981): Ceres ANNOT ID no. 1474088
atggcagttgaaactcctcatatgagcctcaatttcccttcacaacttatcacaaacagggatcttgtgaaagcaaatcacgcaaacatgaatttatacaatacccagatggattctggccttgttttcaatgaaccagtgcctgaaacactcatgtcgttctatcagtcttctcttggttgtgacccaatttctgctgctaaggcttctaataaagatgatagtagtctcacctacaatgttcctgctgttgctgctccaagaaagagggctagagactcgatcaatgatgacaactttgatgcttttcatgcctctcaaaagaccaaagtctctcctttatcttctttcattgatcacgatatcctctttcagatccaacaacagcaatctgaaatcgaccgtttcattgatgatcataatcagaaagttagaatggaacttgaagagaggaaaaagaggcaatcaagaatgttggtatcagcaatacaagaaggaatgattaagaaagtgaaagagaaagacgaagagattcaaagaatgggaaaaataaactggtttcttcaagaaaaagcgaagagtttatacgtagagaatcaaatttggagggatttagcacaagccaatgaggccacagcaaattcattacggagcaatttagaacaagtcttggcgcacgcaagtggtggcgctgccactctggcagatgatgcagaatccagttgctgtggaagtagtgatcatgggaggtgcacgttagctggtggagaagagggtgcggtgaaggataagatggtagtggttaaggataatcttaaccacaacaggatgtgtaaaaagtgtggggagagggagtcaagtgtgctgctgctgccgtgcaggcatctttgcctgtgtacattatgtgggtccaatctgattggttcttgcccagtatgtgattctgtcatgactgctagtgtccatgttaacatgtcttga

SEQ ID NO: 1419 - protein, 326 aa, Populus balsamifera subsp. trichocarpa
  misc_feature (1)..(326): Ceres ANNOT ID no. 1474088
  misc_feature (1)..(326): Functional Homolog of  Ceres  ID no. 12997
MAVETPHMSLNFPSQLITNRDLVKANHANMNLYNTQMDSGLVFNEPVPETLMSFYQSSLGCDPISAAKASNKDDSSLTYNVPAVAAPRKRARDSINDDNFDAFHASQKTKVSPLSSFIDHDILFQIQQQQSEIDRFIDDHNQKVRMELEERKKRQSRMLVSAIQEGMIKKVKEKDEEIQRMGKINWFLQEKAKSLYVENQIWRDLAQANEATANSLRSNLEQVLAHASGGAATLADDAESSCCGSSDHGRCTLAGGEEGAVKDKMVVVKDNLNHNRMCKKCGERESSVLLLPCRHLCLCTLCGSNLIGSCPVCDSVMTASVHVNMS

SEQ ID NO: 1420 - DNA, 1094 bp, Arabidopsis thaliana
  misc_feature (1)..(1094): Ceres CLONE ID no. 13930
  misc_feature (1)..(1094): GEMINI ID 332000
  misc_feature (1)..(1094): GEMINI ID 535G10
atcgccggcgttagggttgtttttctcaacaatggtgtctctggccaagtttcactactgtgatcaaacactccacctccgactcgacactcaccgtaaaccgcagcctaaacctgtttcataccgaatcttacataaacctcctccttctcgcgtcatcagagcttcttcgttttcatcaaaccctaaaccctctttcctcaaaaccacctgcgtgaccttaacaacagccgccgctttactctccgcttccctccacctctccaccaaacccgtcaccgcagcaactctcgtctcacctcctcctccaccatccacggcggcggatctcacttccgatcaaatctcgtcgcgtccaaaggaagaagaagaagaagcagcgctggagaagcacctcactaagaatccaaacgacgtcgaagctcttcaatcactgatgaaaatcaaattccaaaccaaaaacatcgaccacgccttagagattctaaaccgtttgatcgaaatccaacccgaagaacaagaatggcggatcctaaaagctcaggtacaaacctacggcggcgatttcgattcagcgacgaaaggattcgaagaggttctatctaaagatccatttcgtgtagaagcttatcacggattagtaatggcttactccgaatccgaatcgaaattatcagagatcgagagtagaatcaacgaagcgattgagaaatgcaagaaggagaacaagaaagattttagagatttcatgttgttgattgctcagattagggttatcaaaggtaatccaattgaagcacttagggtttatcaagagttggtgaaagatgagcctaaagactttagaccatatctatgtcaaggtttgatttatacattgatgaagaagaaagatgaagcagagaagcaatttgcagagtttagaagattggttcctgagaatcatccttacaaagagtatttagatgctaatgtactcaatactaacaagcttttcgctaagaatcagtgaaaatttgtgtttttgtttgaatatgcttagaaatgtgactttgaacttttatttgtgatcactgcgaaattattctactacc

SEQ ID NO: 1421 - protein, 326 aa, Arabidopsis thaliana
  misc_feature (1)..(326): Ceres CLONE ID no. 13930
  misc_feature (1)..(326): GEMINI ID 332000
  misc_feature (1)..(326): GEMINI ID 535G10
  misc_feature (271)..(304): Pfam Name: TPR_2 Pfam Description: Tetratricopeptide repeat
MVSLAKFHYCDQTLHLRLDTHRKPQPKPVSYRILHKPPPSRVIRASSFSSNPKPSFLKTTCVTLTTAAALLSASLHLSTKPVTAATLVSPPPPPSTAADLTSDQISSRPKEEEEEAALEKHLTKNPNDVEALQSLMKIKFQTKNIDHALEILNRLIEIQPEEQEWRILKAQVQTYGGDFDSATKGFEEVLSKDPFRVEAYHGLVMAYSESESKLSEIESRINEAIEKCKKENKKDFRDFMLLIAQIRVIKGNPIEALRVYQELVKDEPKDFRPYLCQGLIYTLMKKKDEAEKQFAEFRRLVPENHPYKEYLDANVLNTNKLFAKNQ

SEQ ID NO: 1422 - DNA, 1451 bp, Arabidopsis thaliana
  misc_feature (1)..(1451): Ceres CLONE ID no. 14246
  misc_feature (1)..(1451): GEMINI ID 179A12
  misc_feature (1)..(1451): GEMINI ID 532D11
atatttttgtgattagaaattaggatcttacagaaatctttcaaaaagaaattcataacagttccattttttttggtaagattcataaaaaaattcaagttaaatgcattttataaaaatgtaggaaaaactttcaacaaaaatcgttgagaagaacatacagtatatcttatccactctcttcctcatccacgcggcaaaggcacaaacctctttagaaaaatgtcgtcagcttattgttcctccgccgtggctgtatccgccgcagccaccgcttcctccgccgctacctttaatccattactctcctcccactccaattcccaactcttctatcgctttacaccaaaatccttcaaactcgttgccaattgccctaatccactaatcctccactcaaatatccgccgccaccgcttcttctgcgccgccgaaaccgaagctagttccgccgatgatgaaatccaggcatcagtagaagaagaagaagaggtagaagaagaaggagatgaaggtgaagaagaagtagaggaagaaaaacagacgacgcaagcgagtggtgaagaagggaggctttacgttgggaatttaccttacacaatcacttcttctgagctctctcagatttttggagaagctggaactgtcgtcgatgttcagattgtttatgataaagttactgatagaagcagaggatttggatttgtaacaatgggaagcattgaagaagctaaagaagcgatgcagatgtttaacagctctcaaattggtggtagaacggtgaaagtgaacttcccggaggtgccgagaggcggtgagaacgaagtaatgagaaccaaaatccgtgataataaccggagttatgttgatagtcctcataaggtatatgcaggaaaccttggttggaatctaacctcacaaggtttaaaggatgcatttggtgatcaacctggtgtgcttggtgctaaagttatctatgaaagaaatactgggaggtctagggggtttggtttcatctcgttcgagtcagcggaaaatgttcagtctgctttggctacaatgaatggcgtggaagttgaaggacgagcgctgaggctaaatttggcttcagagagagagaaacccactgtgtctcctccttccgtagaagaaggagaaaccgaggaggccagtctagagagtaacgaggtgctttcgaatgttagtgcatgaagcagcaaaagcacaatagattccggataagtttcagactgatctgctcgaggtgccaaaaatgaaaattttgttgtctttataaatgtgttgttttgttctagtgaggctgaagaagaagacaatatatgagatagaaaacaagagattgtttgtaatttttattgagaatgtttttaatccataaatggtgtaatgtaacaacatatcttgattccagtaaactgcaaatttctgcc

SEQ ID NO: 1423 - protein, 329 aa, Arabidopsis thaliana
  misc_feature (1)..(329): Ceres CLONE ID no. 14246
  misc_feature (1)..(329): GEMINI ID 179A12
  misc_feature (1)..(329): GEMINI ID 532D11
  misc_feature (118)..(189): Pfam Name: RRM_1 Pfam Description: RNA recognition motif. (a.k.a. RRM, RBD, or RNP domain)
MSSAYCSSAVAVSAAATASSAATFNPLLSSHSNSQLFYRFTPKSFKLVANCPNPLILHSNIRRHRFFCAAETEASSADDEIQASVEEEEEVEEEGDEGEEEVEEEKQTTQASGEEGRLYVGNLPYTITSSELSQIFGEAGTVVDVQIVYDKVTDRSRGFGFVTMGSIEEAKEAMQMFNSSQIGGRTVKVNFPEVPRGGENEVMRTKIRDNNRSYVDSPHKVYAGNLGWNLTSQGLKDAFGDQPGVLGAKVIYERNTGRSRGFGFISFESAENVQSALATMNGVEVEGRALRLNLASEREKPTVSPPSVEEGETEEASLESNEVLSNVSA

SEQ ID NO: 1424 - protein, 344 aa, Hordeum vulgare subsp. vulgare
  misc_feature (1)..(344): NCBI gi  no. 3550485
  misc_feature (1)..(344): Functional Homolog of  Ceres  ID no. 14246
  misc_feature (110)..(181): Pfam Name: RRM_1 Pfam Description: RNA recognition motif. (a.k.a. RRM, RBD, or RNP domain)
MATAVVAFRSFLHPTATAAAIPLPPSHFNLNNFQGHCIGLRLFSSHRSHPILLPASASAASGQEFSSDGEYYSEEYVEEEGEEAEPEVEAVRGYYPPRNRPALGQEPGRIYVGNLPYTFTAAELTAAFSEAGSVDDVQIIYDKITDRSRGFAFVTMATAEEAAKAVQMFNGALLGGRTVRVNFPEVPRGGERAVASAAVARTSLRVVDDGTYKVYAGNLGWGVRADALKTAFEGQPGLVGARVIFERDTGRSRGFGFVSFHTIQDAKAALQAMDGVELDGRPLRLSLAAQNPPAGSTPSTAQSQQEKTASRGSEAEPQVDNNTITSGQFGGEMEKSNLQATASY

SEQ ID NO: 1425 - protein, 341 aa, Zea mays
  misc_feature (1)..(341): Ceres CLONE ID no. 1537388
  misc_feature (1)..(341): Functional Homolog of  Ceres  ID no. 14246
  misc_feature (114)..(185): Pfam Name: RRM_1 Pfam Description: RNA recognition motif. (a.k.a. RRM, RBD, or RNP domain)
MATAAAAVAATFRTLIQHAAACGAPVPLPSVRFQSLQRHRVGLRRLAPPRGRPVLTPPFAAEDFSSYVDDFSGDDGEEHFDEEEGSEPEEEAEAPRAYSSPRSRPPRGDDPGRLFVGNLPYTYTSEELAQVFSEAGRVDDAQIIYDKVTNRSRGFAFVTMATAEEAAKAIQMFDGALLGGRTARVNYPEVPRGGERRTVTMSGRRRDDGTYKIYAGNLGWGVRADTLRNVFEGRAGLLDARVIFERETGRSRGFGFVSFSTAEDAQAALESLDGVELEGRPLRLSLAEQNPPPGSPPSTAQAQQEETDSGAPAGAGTEAASSSEPSEAEVGESNLQTAANY

SEQ ID NO: 1426 - protein, 314 aa, Glycine max
  misc_feature (1)..(314): Ceres CLONE ID no. 511197
  misc_feature (1)..(314): Functional Homolog of  Ceres  ID no. 14246
  misc_feature (107)..(178): Pfam Name: RRM_1 Pfam Description: RNA recognition motif. (a.k.a. RRM, RBD, or RNP domain)
MAAVSSSICNRIYNLSFTHPSLSLTTCNFRQRPISQKPFTLNLKSQSFTLSFFPLHRLPPPSAAFDGFEVAQDTTEFQQDEPETEPVEKTEQEEEQKVSDSYDAGRLYVGNLPYSITNSALAELFGEAGTVASVEIMYDRVTDRSRGFAFVTMGNVEDAKEAIRMFDGSQVGGRTVKVNFPEVPKGGERLVMGSKIRNSYRGFVDSPHKIYAGNLGWGLTSQGLREAFAEQPGVLSAKVIYERDSGRSRGFGFVSFETAESAQAALDIMNGVEVQGRPLRLNLAEARAPSSPPVIQKNVGSNVESSELVSSAST

SEQ ID NO: 1427 - protein, 324 aa, Nicotiana tabacum
  misc_feature (1)..(314): Public GI NO. 133249
  misc_feature (1)..(324): Functional Homolog of  Ceres  ID no. 14246
  misc_feature (116)..(187): Pfam Name: RRM_1 Pfam Description: RNA recognition motif. (a.k.a. RRM, RBD, or RNP domain)
MSGCCFSFAATASTSSTSLLYLFTQKPKFSVDHLSLSTYNTHFNFKINSTKLKAHFPISSLYRSSIFLSTCASVSDGVEVVQEDDEEEVALSAEEEEEIEEKEERVESESVEGGRLYVGNLPFSMTSSQLSEIFAEAGTVANVEIVYDRVTDRSRGFAFVTMGSVEEAKEAIRLFDGSQVGGRTVKVNFPEVPRGGEREVMSAKIRSTYQGFVDSPHKLYVANLSWALTSQGLRDAFADQPGFMSAKVIYDRSSGRSRGFGFITFSSAEAMNSALDTMNEVELEGRPLRLNVAGQKAPVSSPPVVETSPENDSDNSELLSSLSS

SEQ ID NO: 1428 - protein, 319 aa, Nicotiana sylvestris
  misc_feature (1)..(314): Public GI NO. 311952
  misc_feature (1)..(319): Functional Homolog of  Ceres  ID no. 14246
  misc_feature (111)..(182): Pfam Name: RRM_1 Pfam Description: RNA recognition motif. (a.k.a. RRM, RBD, or RNP domain)
MSVAATASTCSTSSLYLFTQKPKFSVEHLSLSTYNAHFNFKINSTKLKAHFPISSLYRSSIFLSTCASVSDGVEVVQEDDEEEVALSAEEEEEIEEKEESVESESVEGGRLYVGNLPFSMTSSQLSEIFAEAGTVANVEIVYDRVTDRSRGFAFVTMGSVEEAKEAIRLFDGSQVGGRTVKVNFPEVPRGGEREVMSAKIRSTYQGFVDSPHKLYVANLSWALTSQGLRDAFADQPGFMSAKVIYDRSSGRSRGFGFITFSSAEAMKSALDTMNEVELEGRPLRLNVAGQKAPLSSPSVVETSPENDSENNELLSSLSS

SEQ ID NO: 1429 - protein, 348 aa, Oryza sativa
  misc_feature (1)..(314): Public GI NO. 115470657
  misc_feature (1)..(348): Functional Homolog of  Ceres  ID no. 14246
  misc_feature (120)..(191): Pfam Name: RRM_1 Pfam Description: RNA recognition motif. (a.k.a. RRM, RBD, or RNP domain)
MAAVAFRSLLHPAAAALTERVPLPPAHLRLQGLHRHRVGVLNLFVASGHRRRILLPLAAAGGEFSSEEEEYANEEEEEGEEYVEEEEEDGEEEEAAAVAAPRGYYPPRSRPALGQEPGRLFVGNLPYTMTSGEISQTFSEAGRVDNVQIIYDKVTDRSRGFAFVTMATAEEAATAIQMFNGALLGGRTARVNYPEVPRGGERAVGSAAATRENRRDDGTFKIYAGNLGWGVRADALRAAFEGQPGLLDARVIFERDSGRSRGFGFVSFRTAEDAQAALEALDGVELEGRPLRLSMAEQNPTAGSPSTVQSQEEETASESSDAETEQSITSEPSEAETEESNLQTAASY

SEQ ID NO: 1430 - DNA, 981 bp, Populus balsamifera subsp. trichocarpa
  misc_feature (1)..(981): Ceres ANNOT ID no. 1454534
atgtcagctttctccatggcagcttcaactataacttcctctccattacacacaaagctttcaaacctctccttcactcactctccacttccactcccttcccacttctcatcaaaacccttacttaaacctctaaaacccccccaactcaacaaccacgactctaattccctttctctcctctccctccctcatttccatggcatttttgctgcctcctctgacagttttgaatctggaacagaagaaaacaccacagctctagatgacccacaaagtgaaacggacgaatttgaccaagaaattgtagaagaagaaggagatgtggaggccataaaagcaactgaagaaggcaagctttatgtgggaaatctaccatattcaatgacttcttcggaattgactgaggtttttgaggaagctggtcgtgttttcagtgctgaggttatttatgatcgagttacggataggagcaggggctttgggtttgttaccatgggaagtgttgaagaagctaaaaaggcgattcagatgttcaatggaacacaatttggaggtcgatctgtgagggtgaacttcccagaagtgccaaggggaggtgagagggaagtaatgggaccaaggatacagagtggctacaaggggtttatagacagcgaacacaagatatatgcaggaaaccttggttggcgcctcacatctgagggtcttagagacgcatttgctaaccagccaggggtattaagtgccaaagtcatctacgagagggactcaagaagatcacgaggttttggctttgtctcttttgaatctgctgagaatgcagaagctgctttagaagccatgaatggagaggaggtggaagggcggcctatgcgattgaatttggccggagaaagatcacctcctccttcagccaaggaaaataacacagaaaacaatcttgagagcggtgaattgctgtccagctttggaacctga

SEQ ID NO: 1431 - protein, 326 aa, Populus balsamifera subsp. trichocarpa
  misc_feature (1)..(326): Ceres ANNOT ID no. 1454534
  misc_feature (1)..(326): Functional Homolog of  Ceres  ID no. 14246
  misc_feature (120)..(191): Pfam Name: RRM_1 Pfam Description: RNA recognition motif. (a.k.a. RRM, RBD, or RNP domain)
  misc_feature (272)..(298): Pfam Name: DbpA Pfam Description: DbpA RNA binding domain
MSAFSMAASTITSSPLHTKLSNLSFTHSPLPLPSHFSSKPLLKPLKPPQLNNHDSNSLSLLSLPHFHGIFAASSDSFESGTEENTTALDDPQSETDEFDQEIVEEEGDVEAIKATEEGKLYVGNLPYSMTSSELTEVFEEAGRVFSAEVIYDRVTDRSRGFGFVTMGSVEEAKKAIQMFNGTQFGGRSVRVNFPEVPRGGEREVMGPRIQSGYKGFIDSEHKIYAGNLGWRLTSEGLRDAFANQPGVLSAKVIYERDSRRSRGFGFVSFESAENAEAALEAMNGEEVEGRPMRLNLAGERSPPPSAKENNTENNLESGELLSSFGT

SEQ ID NO: 1432 - DNA, 966 bp, Populus balsamifera subsp. trichocarpa
  misc_feature (1)..(966): Ceres ANNOT ID no. 1507701
atggcagcttcaactataacttcctctccattacacacaaagctttcaaacctctccttcactcactctccacttccactcccttcccacttctcatcaaaacccttacttaaacctctaaaacccccccaactcaacaaccacgactctaattccctttctctcctctccctccctcatttccatggcatttttgctgcctcctctgacagttttgaatctggaacagaagaaaacaccacagctctagatgacccacaaagtgaaacggacgaatttgaccaagaaattgtagaagaagaaggagatgtggaggccataaaagcaactgaagaaggcaagctttatgtgggaaatctaccatattcaatgacttcttcggaattgactgaggtttttgaggaagctggtcgtgttttcagtgctgaggttatttatgatcgagttacggataggagcaggggctttgggtttgttaccatgggaagtgttgaagaagctaaaaaggcgattcagatgttcaatggaacacaatttggaggtcgatctgtgagggtgaacttcccagaagtgccaaggggaggtgagagggaagtaatgggaccaaggatacagagtggctacaaggggtttatagacagcgaacacaagatatatgcaggaaaccttggttggcgcctcacatctgagggtcttagagacgcatttgctaaccagccaggggtattaagtgccaaagtcatctacgagagggactcaagaagatcacgaggttttggctttgtctcttttgaatctgctgagaatgcagaagctgctttagaagccatgaatggagaggaggtggaagggcggcctatgcgattgaatttggccggagaaagatcacctcctccttcagccaaggaaaataacacagaaaacaatcttgagagcggtgaattgctgtccagctttggaacctga

SEQ ID NO: 1433 - protein, 321 aa, Populus balsamifera subsp. trichocarpa
  misc_feature (1)..(321): Ceres ANNOT ID no. 1507701
  misc_feature (1)..(321): Functional Homolog of  Ceres  ID no. 14246
  misc_feature (115)..(186): Pfam Name: RRM_1 Pfam Description: RNA recognition motif. (a.k.a. RRM, RBD, or RNP domain)
  misc_feature (267)..(293): Pfam Name: DbpA Pfam Description: DbpA RNA binding domain
MAASTITSSPLHTKLSNLSFTHSPLPLPSHFSSKPLLKPLKPPQLNNHDSNSLSLLSLPHFHGIFAASSDSFESGTEENTTALDDPQSETDEFDQEIVEEEGDVEAIKATEEGKLYVGNLPYSMTSSELTEVFEEAGRVFSAEVIYDRVTDRSRGFGFVTMGSVEEAKKAIQMFNGTQFGGRSVRVNFPEVPRGGEREVMGPRIQSGYKGFIDSEHKIYAGNLGWRLTSEGLRDAFANQPGVLSAKVIYERDSRRSRGFGFVSFESAENAEAALEAMNGEEVEGRPMRLNLAGERSPPPSAKENNTENNLESGELLSSFGT

SEQ ID NO: 1434 - DNA, 1648 bp, Arabidopsis thaliana
  misc_feature (1)..(1648): Ceres CLONE ID no. 149496
  misc_feature (1)..(1648): GEMINI ID 555B2
  misc_feature: Encodes the peptide sequence at SEQ ID NO. 1436
aattctctgtctgtgataaaagaaaaattgaatttttttcttctatctatctacctctgttcttcctcgtcatttcttacccagaaaaatagaggataacaaaaatctgtttctttcgatgatcatcgtgacactttctctgtgatttttcctttcttctgttgttgttgatcatcgtgatcatcgtctttccttacatgcgaacccccatgtcagacactcagcatgtacagagctctttggtgtcgattcgatcttccgacaaaatcgaagatgcctttaggaagatgaaagtaaatgagaccggcgtggaggaactgaatccgtatccagatcgtcccggtgaaagagattgccaattctatttaagaactggtctctgtggctatggaagcagttgccgttacaatcatcctactcatcttccacaggatgttgcttattacaaggaggagctccctgagagaattggacagccggattgtgagtattttctgaagacaggagcttgtaagtacggcccaacttgtaaatatcatcatccaaaggacaggaacggtgcacaacctgtaatgttcaatgttatcggtttacctatgcgtctgggtgagaagccatgtccatattacctgcgaacgggaacttgcagattcggagttgcttgcaaattccaccatcctcaacctgataatggacattctactgcatatggaatgtctagctttcctgctgcagatttacgatatgctagtggtttaacaatgatgtctacatatggaactttgcctcgtccgcaagttccccagtcctatgtgccaatcctggtttcaccctctcaaggctttttacctcctcaaggctgggccccttacatggctgcatctaactccatgtacaatgtgaagaatcaaccttattactccggtagtagtgcatccatggccatggctgtggcattgaaccgtggtttgtcagaaagttctgaccaaccagaatgtcggttttttatgaacaccgggacatgtaaatacggagacgattgcaaatacagccatcccggagtaaggatttcacaaccaccaccaagtcttataaaccctttagttcttccagcgagacctggacaaccagcttgtggtaacttcaggtcttatggattctgcaagtttggaccaaactgcaaattcgaccaccctatgctgccatatccgggcctgaccatggctacttctctgcctactccttttgcttcacctgttacaacccatcagaggatctcaccaacaccaaaccgctctgattcaaagtctctttctaatggtaaacctgatgtgaagaaagaaagctcagagactgagaaaccagacaatggagaagtgcaggatttgtctgaggatgcgtcatcaccatgatcatgattcttaaaaaccccaatgatctctctctgcccttttttgtggaagaggaggggaggtgaaaagtgtttctcttttctttttttttcttttttttttggcttggagatggccatggctgaaaacaatataggatgaaaccagtgatgttgtcacaggtttctcttctgtttttgactctgttaataaattttaatcagacttatcagaggaaaaatagagtttgtgttgtg

SEQ ID NO: 1435 - DNA, 1648 bp, Arabidopsis thaliana; identical to SEQ ID NO: 1434
  misc_feature (1)..(1648): Ceres CLONE ID no. 149496
  misc_feature (1)..(1648): GEMINI ID 555B2
  misc_feature: Encodes the peptide sequence at SEQ ID NO. 1436

SEQ ID NO: 1436 - protein, 404 aa, Arabidopsis thaliana
  misc_feature (1)..(404): Ceres CLONE ID no. 149496
  misc_feature (1)..(404): GEMINI ID 555B2
  misc_feature (136)..(162): Pfam Name: zf-CCCH Pfam Description: Zinc finger C-x8-C-x5-C-x3-H type (and similar)
MRTPMSDTQHVQSSLVSIRSSDKIEDAFRKMKVNETGVEELNPYPDRPGERDCQFYLRTGLCGYGSSCRYNHPTHLPQDVAYYKEELPERIGQPDCEYFLKTGACKYGPTCKYHHPKDRNGAQPVMFNVIGLPMRLGEKPCPYYLRTGTCRFGVACKFHHPQPDNGHSTAYGMSSFPAADLRYASGLTMMSTYGTLPRPQVPQSYVPILVSPSQGFLPPQGWAPYMAASNSMYNVKNQPYYSGSSASMAMAVALNRGLSESSDQPECRFFMNTGTCKYGDDCKYSHPGVRISQPPPSLINPLVLPARPGQPACGNFRSYGFCKFGPNCKFDHPMLPYPGLTMATSLPTPFASPVTTHQRISPTPNRSDSKSLSNGKPDVKKESSETEKPDNGEVQDLSEDASSP

SEQ ID NO: 1437 - protein, 417 aa, Pisum sativum
  misc_feature (1)..(417): Public GI no. 5616313
  misc_feature (1)..(417): Functional Homolog of  Ceres  ID no. 149496
  misc_feature (325)..(351): Pfam Name: zf-CCCH Pfam Description: Zinc finger C-x8-C-x5-C-x3-H type (and similar)
MEFDTIPQEAMWQMNLRSSETMESGPYPEHPGEPDCSYYIRTGLCRFGATCRFNHPPNRKLAIATARMKGEFPERLGQPECQYYLKTGTCKFGATCRFHHPKDKAGVAGRVALNILGYPLRPNESERAYYLRTGQCKFGNTCKFHHPQPSNMVLSMRGSTVYPTVQSPTTPGQQSYAAGITNWSSSSYVPSPRWQGPSSYAPLILPQGVVSVPGWSTYGGQMGSESPQQTMRNDQTYGTSHQGELENAGLQGAYSQYRSGSVPVGFYALQRDNIFPERPDQPECQFYMKTGDCKFGAVCRFHHPRERQIPAPDCVLSPIGLPLRPGEPLCVFYSRYGICKFGPSCKFDHPMGIFTYNVASPLADTPGRRLLGSSSGTAALSLSSEGLVESGTAKPRRLSLSETRPIPPGDDNIDDEG

SEQ ID NO: 1438 - protein, 401 aa, Triticum aestivum
  misc_feature (1)..(401): Ceres CLONE ID  no. 751992
  misc_feature (1)..(401): Functional Homolog of  Ceres  ID no. 149496
  misc_feature (321)..(347): Pfam Name: zf-CCCH Pfam Description: Zinc finger C-x8-C-x5-C-x3-H type (and similar)
  misc_feature (243)..(243): Xaa is any aa, unknown, or other
  misc_feature (252)..(252): Xaa is any aa, unknown, or other
  misc_feature (295)..(295): Xaa is any aa, unknown, or other
MWQQMAMSSGATMQSGPYPVRPGEPDCTYYLRTGLCRFGMSCRFNHPQDRNTAIASARMKGEYPERVGQPECQYYLKTGTCKFGPTCKFHHPREKAGIAGMVQLNTLGYPLRPNERECAYYLKTGQCKYGNTCKFNHPEIFNAVASSRGSPIYPPVHNSGSTGPHSYTGTMASWTYPRGSFIPSPRWQSPSNYTPMIVPQGLVQVPNWNSYPGQMVPVSSPESRLQSPGAQQYYGTSRQGEAXAGNQGMQSXYRSSSFPAPQYALQRENVFPERPDQPECIYYIKTGDCKFGAVXKFHHPRVRSQPPPDCILSPMGLPLRPGEELCKFYSRYGICKFGVNCKFDHPMAAPMGVYAYGYSASASPNAPMGSASPGVPLRVCVRLLRQGSLAFDPTLIDLDDV

SEQ ID NO: 1439 - protein, 435 aa, Triticum aestivum
  misc_feature (1)..(435): Ceres CLONE ID  no. 833872
  misc_feature (1)..(435): Functional Homolog of  Ceres  ID no. 149496
  misc_feature (373)..(399): Pfam Name: zf-CCCH Pfam Description: Zinc finger C-x8-C-x5-C-x3-H type (and similar)
MDEAGRASAPAVVTVTASAAAPSPPPPPPPATATAAAADPPSPDPDALYEEGMWQQMAMSSGATMQSGPYPVRPGEPDCTYYLRTGLCRFGMSCRFNHPQDRNTAIASARMKGEYPERVGQPECQYYLKTGTCKFGPTCKFHHPREKAGIAGMVQLNTLGYPLRPNERECAYYLKTGQCKYGNTCKFNHPEIFNAVASSRGSPIYPPVHNSGSTGPHSYTGTMASWTYPRGSFIPSPRWQSPSNYTPMIVPQGLVQVPNWNSYPGQMVPVSSPESRLQSPGAQQYYGTSRQGEASAGNQGMQSPYRSSSFPAPQYALQRENVFPERPDQPECIYYIKTGDCKFGAVCKFHHPRVRSQPPPDCILSPMGLPLRPGEELCKFYSRYGICKFGVNCKFDHPMAAPMGVYAYGYSASASPNAPMGRRLLESPSGSAYAS

SEQ ID NO: 1440 - protein, 439 aa, Oryza sativa
  misc_feature (1)..(439): Public GI no. 62901482
  misc_feature (1)..(439): Functional Homolog of  Ceres  ID no. 149496
  misc_feature (379)..(405): Pfam Name: zf-CCCH Pfam Description: Zinc finger C-x8-C-x5-C-x3-H type (and similar)
MDDAGRASAPAVVTVTASAAAPTPPLPPPPPPPPPSQLPATAAATDEPSHDPAALYGEGMWQQMTMSGSGAMQPGPYPERSGEPDCTYYLRTGLCRFGMSCRFNHPQDRNLAIASARMKGEYPERMGQPECQYYLKTGTCKFGPTCKFHHPREKAGIAGRVQLNTLGYPLRPSEKECAYYLKTGQCKYGNTCKFHHPELFNAMASSRGSPIYPSVHSSATAGPPYTGTMASWAFPRGSFIPSPRWQNPSNYAPMIVPQGLVQVPSWNSYTGQMMPVSSSESRLQSPGAQQTYGTSQQVDASAGNQGMLSPYRSSSYPVPQYALQRENVFPERPDQPECQYYMKTGDCKFGAVCKFHHPRVRSMPTPDCVLSPVGLPLRPGEELCKFYSRYGICKFGANCKFDHPTMAPPMGVYAYGSASTNVPMVRRLLQSPSASAYTS

SEQ ID NO: 1441 - protein, 420 aa, Oryza sativa
  misc_feature (1)..(420): Public GI no. 34906988
  misc_feature (1)..(420): Functional Homolog of  Ceres  ID no. 149496
  misc_feature (335)..(361): Pfam Name: zf-CCCH Pfam Description: Zinc finger C-x8-C-x5-C-x3-H type (and similar)
MDDAGRASAPAVVTLPATAAATDEPSHDPAALYGEGMWQQMTMSGSGAMQPGPYPERSGEPDCTYYLRTGLCRMKGEYPERMGQPECQYYLKTGTCKFGPTCKFHHPREKAGIAGRVQLNTLGYPLRPSEKECAYYLKTGQCKYGNTCKFHHPELFNAMASSRGSPIYPSVHSSATAGPPYTGTMASWAFPRGSFIPSPRWQNPSNYAPMIVPQGLVQVPSWNSYTGQMMPVSSSESRLQSPGAQQTYGTSQQVDASAGNQGMLSPYRSSSYPVPQYALQRENVFPERPDQPECQYYMKTGDCKFGAVCKFHHPRVRSMPTPDCVLSPVGLPLRPGEELCKFYSRYGICKFGANCKFDHPTMAPPMGVYAYGSASTNVPMIVGIGFSGSWQQGAKDPTDSSGAPPNTHVLGEDPIPYRKI

SEQ ID NO: 1442 - protein, 443 aa, Zea mays
  misc_feature (1)..(443): Ceres CLONE ID  no. 1579587
  misc_feature (1)..(443): Functional Homolog of  Ceres  ID no. 149496
  misc_feature (308)..(334): Pfam Name: zf-CCCH Pfam Description: Zinc finger C-x8-C-x5-C-x3-H type (and similar)
MAAPSGGGGGGAGEGSSSAAAAMTIGAHGVDQVTEAMWQMNLGDAMELGPYPERVGDPDCSYYMRTGMCRFGMTCKFNHPADRKLAVAAARMKGEYPQRIGQPECQYYLKTGTCKFGATCKFHHPREKAAMATRVQLNELGYPLRLNEKECAYYLRTGQCKFGSTCKFHHPQPSTMMVAVRGSVYSPGQSATSPGHHAYQGAVTSWPLSRSASFIASPRWPGHSSYAQVIVPPGLVQVPGWSPYAAQIGSSSSDDQQRTPGAAQYYTGSRQSGTPGIGDRGMFSSYQAGSVPVGLYAVQTENVFPERPDQPECQFYMKTGDCKFGSVCKFHHPRERIIPTPNCALSPLGLPLRPGEPICSFYNRYGMCKFGPNCKFHHPMGNPMYGHASSPTSEAQTSRRMLAHVPSHPEVSPDSGSGRSRRIVHSDSQQIPSVERITEREAS

SEQ ID NO: 1443 - DNA, 640 bp, Arabidopsis thaliana
  misc_feature (1)..(640): Ceres CLONE ID no. 16204
  misc_feature (1)..(640): GEMINI ID 531H7
  misc_feature (1)..(640): GEMINI ID 572C1
aatcgtcgtctctccccaattcaaaaaaagaaataacctaaacgtgttcacacagagatctcgagatgaaagataaccaaacggaagttgaatcgaggagcactgatgatagattgaaagttagagggaacaaagttggaaagaaaacaaaggatccaaacaggcctaagaaaccaccaagtcctttcttcgtcttcctggacgatttccgaaaggagtttaatctggctaaccctgacaacaaatccgtcggtaatgttggtagagcagctggaaagaaatggaaaaccatgactgaggaagaaagagcaccttttgtagcaaaatcacagagcaaaaagactgagtatgctgtgactatgcaacagtataacatggaactggctaatggaaacaagacaactggagatgatgagaaacaagagaaagctgctgatgattaggaagttggatcagtgatttgtgtatcaactatatctgttgttttatgtcaacttttagctagcttttagggagaacaattgttacattcctgttttatcctttctgtcaactgtgggattattcagatgtaactttggatttagctttgagcttcaattccaccttttatgagatcatatcatatgtttgcaatctt

SEQ ID NO: 1444 - protein, 125 aa, Arabidopsis thaliana; identical to SEQ ID NO: 689
  misc_feature (1)..(125): Ceres CLONE ID no. 16204
  misc_feature (1)..(125): GEMINI ID 531H7
  misc_feature (1)..(125): GEMINI ID 572C1
  misc_feature (34)..(103): Pfam Name: HMG_box Pfam Description: HMG (high mobility group) box

SEQ ID NO: 1445 - protein, 178 aa, Arabidopsis thaliana
  misc_feature (1)..(178): Ceres CLONE ID no. 98140
  misc_feature (1)..(178): Functional Homolog of  Ceres  ID no. 16204
  misc_feature (53)..(122): Pfam Name: HMG_box Pfam Description: HMG (high mobility group) box
MKTAKGKDKVKTTKEALKPVDDRKVGKRKAPAEKPTKRETRKEKKAKKDPNKPKRAPSAFFVFLEDFRVTFKKENPNVKAVSAVGKAGGQKWKAMSQAEKAPYEEKAAKRKAEYEKQMDAYNKNLEEGSDESEKSRSEINDEDEASGEEELLEKEAAGDDEEEEEEEDDDNDDDEEED

SEQ ID NO: 1446 - protein, 178 aa, Arabidopsis thaliana
  misc_feature (1)..(178): Ceres CLONE ID no. 98140
  misc_feature (1)..(178): Functional Homolog of  Ceres  ID no. 16204
  misc_feature (53)..(122): Pfam Name: HMG_box Pfam Description: HMG (high mobility group) box
MKTAKGKDKVKTTKEALKPVDDRKVGKRKAPAEKPTKRETRKEKKAKKDPNKPKRAPSAFFVFLEDFRVTFKKENPNVKAVSAVGKAGGQKWKSMSQAEKAPYEEKAAKRKAEYEKQMDAYNKNLEEGSDESEKSRSEINDEDEASGEEELLEKEAAGDDEEEEEEEDDDDDDDEEED

SEQ ID NO: 1447 - protein, 169 aa, Glycine max
  misc_feature (1)..(169): Ceres CLONE ID no. 480916
  misc_feature (1)..(169): Functional Homolog of  Ceres  ID no. 16204
  misc_feature (53)..(122): Pfam Name: HMG_box Pfam Description: HMG (high mobility group) box
MKTAKGKGAARPSKESLKPVDDRKVGKRKASGKPEKSRAPKKEKKAKKDPNKPKRPPSAFFVFLEEFRKTFKAENPLVKAVSVVGKAGGEKWKSLSSAEKAPYEAKAAKRKAEYEKLIKAYEKKQASSADDDESDKSKSEVNDEDDASGEEDHQEDEDDEEEEDDEDDD

SEQ ID NO: 1448 - protein, 146 aa, Glycine max
  misc_feature (1)..(146): Ceres CLONE ID no. 1043468
  misc_feature (1)..(146): Functional Homolog of  Ceres  ID no. 16204
  misc_feature (44)..(102): Pfam Name: HMG_box Pfam Description: HMG (high mobility group) box
  misc_feature (119)..(119): Xaa is any aa, unknown, or other
MTERLESGRLPVSLGEVVHQRRRRRPRKTPTSLKDHPVLSLCSLEEFRKTFKAENPNVKAVSVVGKAGGEKWKSLSSAEKAPYEAKAAKRKAEYEKLIKAYDKKQASSADDEESDKSKXEVNDEDDASGEEEEEDDEEEEDDEDDD

SEQ ID NO: 1449 - protein, 141 aa, Brassica napus
  misc_feature (1)..(141): Ceres CLONE ID no. 873113
  misc_feature (1)..(141): Functional Homolog of  Ceres  ID no. 16204
  misc_feature (35)..(104): Pfam Name: HMG_box Pfam Description: HMG (high mobility group) box
MKGGETKAQSKSTDERLKTRGKKAGKKAAKDPNKPKRPPSAFFVFLEGFRKEFNLANPDNKSVGAVGKAAGAKWKSMTDEDKAPYVAKAETKKTEYTKTMQKYNMKLANGTSTAGDDDSDKSKSEVNDEAEGASEEEEDDD

SEQ ID NO: 1450 - protein, 140 aa, Brassica napus; identical to SEQ ID NO: 691
  misc_feature (1)..(140): Ceres CLONE ID no. 956177
  misc_feature (1)..(140): Functional Homolog of  Ceres  ID no. 16204
  misc_feature (34)..(103): Pfam Name: HMG_box Pfam Description: HMG (high mobility group) box

SEQ ID NO: 1451 - protein, 152 aa, Glycine max
  misc_feature (1)..(152): Ceres CLONE ID no. 641329
  misc_feature (1)..(152): Functional Homolog of  Ceres  ID no. 16204
  misc_feature (44)..(113): Pfam Name: HMG_box Pfam Description: HMG (high mobility group) box
MKGGKSKTESKRADAKLAVNKKGAATKTRKPAGKGKAAKDPNKPKRPPSAFFVFMEEFRKVFNKEHPDNKAVSAVGKAAGAKWKTMSDAEKAPYVAKSEKRKVEYEKNMRAYNKKQAEGPTGGDEEESEKSVSEVNDEDDDEEGSGEEEDDD

SEQ ID NO: 1452 - protein, 152 aa, Glycine max; identical to SEQ ID NO: 1451
  misc_feature (1)..(152): Ceres CLONE ID no. 641329
  misc_feature (1)..(152): Functional Homolog of  Ceres  ID no. 16204
  misc_feature (44)..(113): Pfam Name: HMG_box Pfam Description: HMG (high mobility group) box

SEQ ID NO: 1453 - protein, 152 aa, Glycine max
  misc_feature (1)..(152): Ceres CLONE ID no. 782784
  misc_feature (1)..(152): Functional Homolog of  Ceres  ID no. 16204
  misc_feature (44)..(113): Pfam Name: HMG_box Pfam Description: HMG (high mobility group) box
MKGGKSKTESKRADPKLAVNKKGAATKARKPAGKGKAAKDPNKPKRPPSAFFVFMEEFRKVFNKEHPENKAVSAVGKAAGAKWKTMSDAEKAPYVAKSEKRKVEYEKNMRAYNKKQAEGPTGGDEEESEKSVSEVNDEDDDEEGSGEEEDDD

SEQ ID NO: 1454 - protein, 152 aa, Glycine max; identical to SEQ ID NO: 1453
  misc_feature (1)..(152): Public GI no. 18645
  misc_feature (1)..(152): Functional Homolog of  Ceres  ID no. 16204
  misc_feature (44)..(113): Pfam Name: HMG_box Pfam Description: HMG (high mobility group) box

SEQ ID NO: 1455 - protein, 146 aa, Ipomoea nil
  misc_feature (1)..(146): Public GI no. 1052956
  misc_feature (1)..(146): Functional Homolog of  Ceres  ID no. 16204
  misc_feature (36)..(105): Pfam Name: HMG_box Pfam Description: HMG (high mobility group) box
MKGGKSKAKSDNKLAVKKRGCETKKSKKSVKDPNKPKRPPSAFFVFMEDFRKTYKEKHPNNKSVAAVGKAGGDKWKQLTDAEKAPFIAKAEKRKQEYEKSMQAYNRKQAGEAADEEESDKSRSEVNDDEEDEDGSAEDDDDDDDDE

SEQ ID NO: 1456 - protein, 154 aa, Pisum sativum
  misc_feature (1)..(154): Public GI no. 436424
  misc_feature (1)..(154): Functional Homolog of  Ceres  ID no. 16204
  misc_feature (45)..(114): Pfam Name: HMG_box Pfam Description: HMG (high mobility group) box
MKGGKSKGESKKAETKLAVNKKGAPATKGGKKPAKGKEPKDPNKPKRPPSAFFVFMEDFRKQFKKGNADNKAVSAVGKAAGAKWKSMTEAEKAPYAAKAEKRKAEYEKSMKSYNKKQAEGPAAVEEEEESEKSESEVHDENDDEEESEEEDDDE

SEQ ID NO: 1457 - protein, 141 aa, Solanum tuberosum
  misc_feature (1)..(141): Public GI no. 2894109
  misc_feature (1)..(141): Functional Homolog of  Ceres  ID no. 16204
  misc_feature (36)..(105): Pfam Name: HMG_box Pfam Description: HMG (high mobility group) box
MKGAKSKAKADTKLGVRKKATESKKAKNAAKDPNKPKRPPSAFFVFMEEFRKTYKEKHPNNKSVAVVGKAGGDKWKQLSDEEKAPYQAKAEKRKAEYQKNMDAYNKKLAAGDADDEESDKSKSEVHDDDEDDDGSEQEDDD

SEQ ID NO: 1458 - protein, 124 aa, Triticum aestivum
  misc_feature (1)..(124): Ceres CLONE ID no. 686294
  misc_feature (1)..(124): Functional Homolog of  Ceres  ID no. 16204
  misc_feature (28)..(97): Pfam Name: HMG_box Pfam Description: HMG (high mobility group) box
MKAKAGSRAGDSRLAVKKSKAEKDPNKPKRPPSAFFVFMDTFRKEYKEKHPDVKQVSVVGKAGGEKWKSLSDAEKAPYTAKAEKLKAEYTKKINAYNNPQAGEASGDSDKSKSEVNDEDSEGDE

SEQ ID NO: 1459 - protein, 127 aa, Oryza sativa
  misc_feature (1)..(127): Public GI no. 50726318
  misc_feature (1)..(127): Functional Homolog of  Ceres  ID no. 16204
  misc_feature (28)..(97): Pfam Name: HMG_box Pfam Description: HMG (high mobility group) box
MKARSRSSNGDSRLSVRKTKAEKDPNKPKRPPSAFFVFMEQFRKDYKEKHPNVKQVSVIGKAGGDKWKSMTDADKAPFVTKAEKLKAEYTKKIDAYNNKQAGGPATSGDSDKSKSEVNDEDEGSGDE

SEQ ID NO: 1460 - protein, 149 aa, Vicia faba
  misc_feature (1)..(149): Public GI no. 729737
  misc_feature (1)..(149): Functional Homolog of  Ceres  ID no. 16204
  misc_feature (45)..(114): Pfam Name: HMG_box Pfam Description: HMG (high mobility group) box
MKGGKSKGESKKAETKLAVNKKGAAATKGGKKPAKGKEPKDPNKPKRPPSAFFVFMADFREQYKKDHPNNKSVAAVGKACGEEWKSLSEEEKAPYVDRALKKKEEYEITLQAYNKKLEGKDDEEGSDKSKSEVNDEDEDEEDEEDEDDD

SEQ ID NO: 1461 - protein, 144 aa, Ipomoea nil
  misc_feature (1)..(144): Public GI no. 729736
  misc_feature (1)..(144): Functional Homolog of  Ceres  ID no. 16204
  misc_feature (36)..(105): Pfam Name: HMG_box Pfam Description: HMG (high mobility group) box
MKGGKSKAKSDNKLAVKKQAADTKKTKKAVKDPNKPKRPPSAFFVFMEDFRKTYKEKHPNNKSVAVVGKAGGDKWKQLTAAEKAPFISKAEKRKQEYEKNLQAYNKKQAAGAAEEEESDKSRSEVNDDDEDQDGSGEDDSEDDD

SEQ ID NO: 1462 - protein, 145 aa, Zea mays
  misc_feature (1)..(145): Ceres CLONE ID no. 1060767
  misc_feature (1)..(145): Functional Homolog of  Ceres  ID no. 16204
  misc_feature (38)..(107): Pfam Name: HMG_box Pfam Description: HMG (high mobility group) box
MKGGKSKTETRSSKLSVAKKPAKAAGRSKAAAKDPNKPKRPASAFFVFMEDFRQTYKKDHPNNKSVAAVGKAGGEKWKSLSDSEKAPFVAKADKRKVEYEKTMKAYNKKLEEGPKEDEEESDKSVSEVNDEDDADDGSDEEEDDD

SEQ ID NO: 1463 - protein, 141 aa, Canavalia gladiata
  misc_feature (1)..(141): Public GI no. 7446231
  misc_feature (1)..(141): Functional Homolog of  Ceres  ID no. 16204
  misc_feature (37)..(106): Pfam Name: HMG_box Pfam Description: HMG (high mobility group) box
MPKVKADAKAADNRLKRKGAGAGRKQSKKAAKDPNKPKRPPSAFFVFMSEFREQYKKEHPTNKSVAVVGKAGGDKWKSLSDAEKAPFVARAEKKKEEYDKSILAYNRKLEGKNPSEEEKSDKSKSEVNDEDEDEEEDQDDE

SEQ ID NO: 1464 - DNA, 1307 bp, Arabidopsis thaliana
  misc_feature (1)..(1307): Ceres CLONE ID no. 207419
  misc_feature (1)..(1307): GEMINI ID 539D5
aatttcaccgctctttctctttcgcttctctgagaagtttcaaagctaattcagctttcgagaaattgcaacaatggagaaactcgcggcgtctactgttacagatctagcttgcgtaacggcgataaactcaccaccgcctccactatcaccgatctctgaacaaagcttcagcaacaaacaccaagaagagttcgcagcaagcttcgcatcactctacaactcaattttctcaccggaatctcaattctctccttctcctccgtcctcttcctcaccaccatctcgcgtcgatacaactacagagcatcgtcttcttcaagcgaaacttatcctcgagtacgatgaactcaacgatcattacgagctttgccttaaccgtcttcaatctctaatgacggaacttgactctcttcgtcacgaaaacgattctctccgctttgaaaactcagatctactcaaacttattcatatctctacttcatcctcctcctccgtctctcctccggcgccgatccataaccgtcaattccgtcaccagatctccgattctcgctccgcgaagagaaacaatcaagagagaaactcgttgcctaagagcatctccgtcagatctcaaggatatctcaagatcaaccatggatttgaagcttcagatcgccaaacgagtcaactcagctctaactcggtgttgtcttctcaaaaggtgtgtgtagtacaaaccaaaggggagagagaagcattagagcttgaggtatatcgtcaagggatgatgaagacggagctttgtaacaaatggcaagagactggagcttgttgttacggcgataattgccaattcgctcacggaatcgacgagctacgtcctgtgattaggcatccacgctacaaaactgaggtttgcagaatgattgtcaccggagctatgtgtccttacggtcaccgttgccatttccgtcactcacttactgatcaagagaggatgatgatgatgatgcttactcgctgatctggagaagaagaagaaaggtcattgaaaaagagaaataattagtggttgtgtacagatttcagatttgataccttataaatatcgtaacttttctgggtatttgctataggaataaggaagagaaagtgtttaataaatgtttgataggattataggaatataattagggttgaagaaatgtgtggttctcggataaagctggagagacctgaaagaggatttagatttaacaaagatatggaatttgtattgataaaagtttttgactttgtgcaaaactatgcaactttcttcc

SEQ ID NO: 1465 - protein, 311 aa, Arabidopsis thaliana
  misc_feature (1)..(311): Ceres CLONE ID no. 207419
  misc_feature (1)..(311): GEMINI ID 539D5
  misc_feature (234)..(260): Pfam Name: zf-CCCH Pfam Description: Zinc finger C-x8-C-x5-C-x3-H type (and similar)
MEKLAASTVTDLACVTAINSPPPPLSPISEQSFSNKHQEEFAASFASLYNSIFSPESQFSPSPPSSSSPPSRVDTTTEHRLLQAKLILEYDELNDHYELCLNRLQSLMTELDSLRHENDSLRFENSDLLKLIHISTSSSSSVSPPAPIHNRQFRHQISDSRSAKRNNQERNSLPKSISVRSQGYLKINHGFEASDRQTSQLSSNSVLSSQKVCVVQTKGEREALELEVYRQGMMKTELCNKWQETGACCYGDNCQFAHGIDELRPVIRHPRYKTEVCRMIVTGAMCPYGHRCHFRHSLTDQERMMMMMLTR

SEQ ID NO: 1466 - DNA, 930 bp, Populus balsamifera subsp. trichocarpa
  misc_feature (1)..(930): Ceres ANNOT ID no. 1517208
atgatgagagtggctagcaacctgcaacgagcaagtatactgagagggaattcattcagaaaggaaacgcaaaaagacacctcctccactttaaacagcgaaatcgccaccacccgtaccgcaacaaagttccaggactaccgtctaaacgacgttgcttacaactccgatatcttccccctctctcaagcctcccactcagtagacaactctcgcttcataatgcgacaccaggacctaataaaccgaagcgcactctgcctcgcgcgcctccgtgaagtaaccgtcgaaatggagtgtctccgccaagacaacgccgatcttcgatctatcaatcgcgagctcaacaatcaactcagcgtccttatccaagcctcactccacaaacactacaacgactctacaaggacgccgtttgacattgatattggtttccacaatttgtgcaacatcagcagcggaggaggtggaggtcatgacatgtgcgaagaggatgaaagtccgacgagcgtcatggaggcagggggcgatgaccgggagaggatttcgctgcctaagagtatttcagtgaggtctaatagctactcgaagaggaaccaggagcagaaggtttatgtgcgtagaggcaagaaacaggaggagccacttgagctggaagtgtataaccaaggcatgttcaaaacagagttgtgcaacaaatggcaggagacaggggcttgcctatacggcaaccattgtcagtttgctcatggaattgaggagctccgcccagtcatccgtcaccctcgctacaagactgaggtctgcaaaatggtccttgctggtggtatctgtccttatggccatcgctgtcacttccgccatgccctcacggagcaggacaggttccttagccacatcaagcccagggaaatcaagcctgacaggtaa

SEQ ID NO: 1467 - protein, 309 aa, Populus balsamifera subsp. trichocarpa
  misc_feature (1)..(309): Ceres ANNOT ID no. 1517208
  misc_feature (1)..(309): Functional Homolog of  Ceres  ID no. 207419
  misc_feature (226)..(252): Pfam Name: zf-CCCH Pfam Description: Zinc finger C-x8-C-x5-C-x3-H type (and similar)
MMRVASNLQRASILRGNSFRKETQKDTSSTLNSEIATTRTATKFQDYRLNDVAYNSDIFPLSQASHSVDNSRFIMRHQDLINRSALCLARLREVTVEMECLRQDNADLRSINRELNNQLSVLIQASLHKHYNDSTRTPFDIDIGFHNLCNISSGGGGGHDMCEEDESPTSVMEAGGDDRERISLPKSISVRSNSYSKRNQEQKVYVRRGKKQEEPLELEVYNQGMFKTELCNKWQETGACLYGNHCQFAHGIEELRPVIRHPRYKTEVCKMVLAGGICPYGHRCHFRHALTEQDRFLSHIKPREIKPDR

SEQ ID NO: 1468 - DNA, 1211 bp, Arabidopsis thaliana
  misc_feature (1)..(1211): Ceres CLONE ID no. 20769
  misc_feature (1)..(1211): GEMINI ID 534G9
accatctctctctgtaatcgctcttctcgatgtcaactatttccttcttcctttgctcttagggttagggtttattttgttctttctctatatccttcaatcaatgtgaaaaaaaagctctcccttttggcagtttccgatgtttggtcgccattcgattatcccaaataaccagattggtaccgcctctgcttccgctggtgaagaccatgtctctgcctccgctacgtctggtcacattccttacgacgatatggaagaaatccctcatcctgactctatctatggtgctgcctccgatttgattcccgatggctctcaattggttgctcaccgatccgatggctctgaattacttgtttctcggccaccggaaggggcgaatcagcttacgatctcgttccgtggacaagtttacgtttttgatgccgttggtgctgacaaggtggatgctgtgttgtcgctgttgggtggttctactgagcttgctcctggtccgcaggtgatggaactagctcaacagcagaatcatatgcctgttgtagaatatcagagccgctgtagccttccgcaacgggcacaatccttggataggtttcggaagaagaggaatgctagatgtttcgagaagaaagtaagatacggtgttcgccaagaagttgccttaagaatggcacgtaataaaggtcaattcacctcttcaaagatgacagatggggcttataactctggcacagatcaagattctgcccaagatgatgcccatccagaaatatcgtgtactcattgcggcattagttccaaatgtacaccaatgatgcgacgtggcccttccggccccaggactctctgcaatgcctgtggacttttttgggctaacaggggtacattgagggatctctcaaagaaaacagaagagaatcagttggctttaatgaaaccggatgatggtgggagtgttgctgatgctgctaacaacttaaacactgaagctgcaagtgttgaagaacacacttccatggtttctcttgccaatggggataattctaatctgttaggtgatcactaaatactgtgataagaatcagaagatagaaatctttgtagaatcagatggtcttctctatgaatttatcttttcaccatcacatgtattatagaaaccgtaaccgaacctcaaatcaaataccatatcagatgtctttggttcc

SEQ ID NO: 1469 - protein, 309 aa, Arabidopsis thaliana
  misc_feature (1)..(309): Ceres CLONE ID no. 20769
  misc_feature (1)..(309): GEMINI ID 534G9
  misc_feature (146)..(190): Pfam Name: CCT Pfam Description: CCT motif
  misc_feature (214)..(251): Pfam Name: GATA Pfam Description: GATA zinc finger
  misc_feature (77)..(112): Pfam Name: tify Pfam Description:
MFGRHSIIPNNQIGTASASAGEDHVSASATSGHIPYDDMEEIPHPDSIYGAASDLIPDGSQLVAHRSDGSELLVSRPPEGANQLTISFRGQVYVFDAVGADKVDAVLSLLGGSTELAPGPQVMELAQQQNHMPVVEYQSRCSLPQRAQSLDRFRKKRNARCFEKKVRYGVRQEVALRMARNKGQFTSSKMTDGAYNSGTDQDSAQDDAHPEISCTHCGISSKCTPMMRRGPSGPRTLCNACGLFWANRGTLRDLSKKTEENQLALMKPDDGGSVADAANNLNTEAASVEEHTSMVSLANGDNSNLLGDH

SEQ ID NO: 1470 - DNA, 834 bp, Populus balsamifera subsp. trichocarpa
  misc_feature (1)..(834): Ceres ANNOT ID no. 1443644
atgtacactccctcgcagcctatgaacgttcacaatcagatcgtctctcctggcgttgacgacgacggtgccccagccgatcctatcgaccaccaccatcacattcactacgaagacggcacccctgcagtcgttgtcgaagacgtctctcccgattccgtctacgttaccgccggtgtcgctgcgtcggaactcgggattcagcctagtgatggttcgagtcagctcaccctgacgtttcgtggacaagtttatgttttcgattccgttactcctgacaaggttcaagctgtattgttattactgggaggatgtgaattaactcctggtctggaactgactcctcaaaatcaaaggggtgtgggggagtacccaccgcggtgtactcaacctcaacgagcagcttcattaagtaggttccggcagaagagaaaagagcgatgctttgataagaaagttagatatggtgtccgtcaggaggttgcactcaggatgcagcggaataagggtcaattcacctctgccaagaagtctgagggaggatatggctgggatggtggtcaggattcagcacaagatgatagccaacatgaaacctcgtgtacacattgtggcactaattcaaaatccactccaatgatgcggcgtggtccatctggtccaaggtctctttgcaatgcctgtgggcttttttgggcaaacagaaggatgacagtagctctggtgctatcctattggcagtgggtagccgagtccaagtcttcattttcacttttttatgatgagagagctgacctcgaaaaaggaacagacttagagatgctaatggaatga

SEQ ID NO: 1471 - protein, 270 aa, Populus balsamifera subsp. trichocarpa
  misc_feature (1)..(270): Ceres ANNOT ID no. 1443644
  misc_feature (1)..(270): Functional Homolog of  Ceres  ID no. 20769
  misc_feature (126)..(170): Pfam Name: CCT Pfam Description: CCT motif
  misc_feature (194)..(231): Pfam Name: GATA Pfam Description: GATA zinc finger
  misc_feature (62)..(97): Pfam Name: tify Pfam Description:
MNVHNQIVSPGVDDDGAPADPIDHHHHIHYEDGTPAVVVEDVSPDSVYVTAGVAASELGIQPSDGSSQLTLTFRGQVYVFDSVTPDKVQAVLLLLGGCELTPGLELTPQNQRGVGEYPPRCTQPQRAASLSRFRQKRKERCFDKKVRYGVRQEVALRMQRNKGQFTSAKKSEGGYGWDGGQDSAQDDSQHETSCTHCGTNSKSTPMMRRGPSGPRSLCNACGLFWANRRMTVALVLSYWQWVAESKSSFSLFYDERADLEKGTDLEMLME

SEQ ID NO: 1472 - DNA, 1684 bp, Arabidopsis thaliana
  misc_feature (1)..(1684): Ceres CLONE ID no. 21240
  misc_feature (1)..(1684): GEMINI ID 332F4
  misc_feature (1)..(1684): GEMINI ID 553C1
atccttcgaagacccttcctctatataaggaagttcatttcakttggagctctagaacacgggggatccycygggctgcaggaattcgcacsacwscagtggtacctagaacatcctaatcgaaaaaaaaccaaaacgatggcgtttcatcacaatcatctctcacaagacctctccttcaatcatttcaccgaccaacaccaacctccacctccgcaaccgcctcctcctcctccgcaacagcaacaacatttccaagaagcaccgcctcctaattggttaaacacagcgcttcttcgttcctcagataacaacaataacttcctcaacctccacacagccaccgctaacaccacaaccgcaagcagctccgattctccttcctccgccgccgccgccgccgctgctaaccagtggctatctctctcctcctctttcctccaacgaaacaacaacaacaacgcttccatagtcggagatgggatcgatgatgtcaccggaggagcagacactatgattcagggagagatgaaaaccggcggtggagaaaacaaaaacgacggcggaggagctacggcggcggatggagtagtgagctggcagaatgcgagacacaaggcggagatcctttcgcatcctctttacgagcagcttttgtcggcgcacgttgcttgtttgagaatcgcgactccggttgatcagcttccgagaatcgatgctcagcttgctcagtctcaacacgtcgtcgctaaatactcagctttaggcgccgccgctcaaggtctcgtcggcgacgataaagaacttgaccagttcatgacacattatgtgttgctactgtgttcatttaaagagcaattgcaacaacatgtgcgtgttcatgcaatggaagctgtgatggcttgttgggagattgagcagtctcttcaaagcttaacaggagtgtctcctggagaagggatgggagcaacaatgtctgacgatgaagatgaacaagtagagagtgatgctaatatgttcgatgggggattagatgtgttgggttttggtcctttgattcctactgagagtgagaggtcgttgatggaaagagttagacaagaacttaaacatgaactcaaacagggttacaaggagaagatagtagacataagagaggagatattaaggaagagaagagctgggaagttaccaggagataccacctctgttctcaaagcttggtggcaatctcattccaaatggccttaccctactgaggaagataaggcgaggttggtgcaagagacaggtttgcagctaaaacagataaacaattggttcatcaatcagagaaagaggaactggcatagcaatccatcttcttccactgtattgaagaacaaacgcaaaagcaatgcaggtgacaatagcggaagagagcggttcgcgtagaaacaacaaacatatgatgtgaattggggaggtggaagatgggatttgaaagcagggttttagggatttaaagttgagaattttatggaggagtttggattatacagagagaggggacagtattagaaagtaactttttgtgcaattacatagtaacgtagtttggttatgtgattatgcccatatattttattaagtagcacacaaaccaaaaagaaaatatgaaaactgaagatgcaggcttttgttc

SEQ ID NO: 1473 - protein, 431 aa, Arabidopsis thaliana
  misc_feature (1)..(431): Ceres CLONE ID no. 21240
  misc_feature (1)..(431): GEMINI ID 332F4
  misc_feature (1)..(431): GEMINI ID 553C1
  misc_feature (157)..(201): Pfam Name: KNOX1 Pfam Description: KNOX1 domain
  misc_feature (213)..(268): Pfam Name: KNOX2 Pfam Description: KNOX2 domain
  misc_feature (322)..(343): Pfam Name: ELK Pfam Description: ELK domain
MAFHHNHLSQDLSFNHFTDQHQPPPPQPPPPPPQQQQHFQEAPPPNWLNTALLRSSDNNNNFLNLHTATANTTTASSSDSPSSAAAAAAANQWLSLSSSFLQRNNNNNASIVGDGIDDVTGGADTMIQGEMKTGGGENKNDGGGATAADGVVSWQNARHKAEILSHPLYEQLLSAHVACLRIATPVDQLPRIDAQLAQSQHVVAKYSALGAAAQGLVGDDKELDQFMTHYVLLLCSFKEQLQQHVRVHAMEAVMACWEIEQSLQSLTGVSPGEGMGATMSDDEDEQVESDANMFDGGLDVLGFGPLIPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSSSTVLKNKRKSNAGDNSGRERFA

SEQ ID NO: 1474 - DNA, 888 bp, Arabidopsis thaliana
  misc_feature (1)..(888): Ceres CLONE ID no. 21374
  misc_feature (1)..(888): GEMINI ID 531H9
gcattaaaaagggttcaaagaaaaattctcaaattctctaacaaagagctctgagatttttggaaatctgaatcgttgttcgaggtttaatgttaccatttccggcaatgaacttgaagaagtctcgatcggaaaactcatcagttgcttcatctggaagtgagattgaagagcagactgagaaatccagytgaaccaacaaccatttaaggtgcagaaaaaagccggtactccagggagggtcgatagaatgtctttgctgtgcagtgtgagaagtgcatgaagtggagraagattgaatactcaagatgagtatgaagatatcagaagtagagtacaagaggacccgtttttttgcaagacgaaagaaggtgtgtcctgtgaagatgttggagatcttaaactatgattcctccagaacatgggtcatcgacaagcctggcttgccgaggacaccaagagggttcaaaaggagcttaattctgagaaaggattactcgaaaatggatgcgtactacataactcctactgggaagaagctcaagtctcgtaatgaaatcgcagccttcatcgatgccaatcaggattacmagtatgcactgcttggagatttcaatttcacagtcccaaaggtgatggaagagacggttcctagtgggatattatctgacaggacccccaagccatcaaggaaagttacaattgattgagctacatagcgcttcccagcttcttatggtgttgaagttgttattggagtcagttttaggtttctatctggtttagtcttttaagggtgtcggacttcttactgtagaatgtttcttaaactcatctctttgactctgattggatctttattttctaatgaaggattatcttttcttc

SEQ ID NO: 1475 - protein, 133 aa, Arabidopsis thaliana
  misc_feature (1)..(133): Ceres CLONE ID no. 21374
  misc_feature (1)..(133): GEMINI ID 531H9
  misc_feature (39)..(112): Pfam Name: MBD Pfam Description: Methyl-CpG binding domain
MSMKISEVEYKRTRFFARRKKVCPVKMLEILNYDSSRTWVIDKPGLPRTPRGFKRSLILRKDYSKMDAYYITPTGKKLKSRNEIAAFIDANQDYKYALLGDFNFTVPKVMEETVPSGILSDRTPKPSRKVTID

SEQ ID NO: 1476 - DNA, 549 bp, Populus balsamifera subsp. trichocarpa
  misc_feature (1)..(549): Ceres ANNOT ID no. 1471763
atggcactgaaagagcgtagtcccgaaacccctaaaacctcctccaagaatccacgagttgcagtgcgatcaattgatacatatgctgcacaatgcgacaaatgcttaaaatggagggtgattgcaactgaagaagagtatgaggagatcagaagtaaaatggaagagtctccatttgtttgcaacagaaaacctggtgtatcttgtgatgatcctgctgacattgagtacaatgccactcgaacctgggtcattgataggcctggcattccaaagacaccagaaggttttaaaaggagcttggttcttagacgtgatttctccaaaatggatgcttactatatcacacccacaggaaagaagctgagaacacgtaacgagatagcagcatttatagatgcaaatccaaaatacaaagatgtaaacctatctgacttcaattttacctctccgaaggtaatggaagacaccatcccagaagatgctgtgagaaaggtttcctctagtggaaatggcaacaaaaggaaggcattaaaggatgcagcttaa

SEQ ID NO: 1477 - protein, 182 aa, Populus balsamifera subsp. trichocarpa
  misc_feature (1)..(182): Ceres ANNOT ID no. 1471763
  misc_feature (1)..(182): Functional Homolog of  Ceres  ID no. 21374
  misc_feature (27)..(76): Pfam Name: zf-CW Pfam Description: CW-type Zinc Finger
  misc_feature (83)..(156): Pfam Name: MBD Pfam Description: Methyl-CpG binding domain
MALKERSPETPKTSSKNPRVAVRSIDTYAAQCDKCLKWRVIATEEEYEEIRSKMEESPFVCNRKPGVSCDDPADIEYNATRTWVIDRPGIPKTPEGFKRSLVLRRDFSKMDAYYITPTGKKLRTRNEIAAFIDANPKYKDVNLSDFNFTSPKVMEDTIPEDAVRKVSSSGNGNKRKALKDAA

SEQ ID NO: 1478 - DNA, 549 bp, Populus balsamifera subsp. trichocarpa
  misc_feature (1)..(549): Ceres ANNOT ID no. 1482788
atggcactgaaagagcgtagtcctgaaacccctaaaacatcccccaagaatccacgagttgccgtgcgatcaattgatacatatgctgcacaatgcgacaaatgcttaaaatggagggtgattccgactgaagaagagtacgaggagataagaagtaaaatggaagagaatccatatgtttgtgacagaaaacctggcgtatcttgtgatgatcctgctgacattgagtacaatgccactcgaacctgggtcattgataggcctggtgttcccaagactccggaaggttttaaaaggagcttggtgcttagacgtgatttctcaaaaatggatgcttactatatcactcccacaggaaagaagctgagaacacgcaatgagatagcagcatttatagaagcaaatccaaaatacaaagatgtaaacctctctgccttcaattttacttctccaaaggtaatggaagacaccatccctgaagatgctgtgagaaaggttccctctagtgcaaatggcaacaaaaagaaggcattaaaggattcagcttga

SEQ ID NO: 1479 - protein, 182 aa, Populus balsamifera subsp. trichocarpa
  misc_feature (1)..(182): Ceres ANNOT ID no. 1482788
  misc_feature (1)..(182): Functional Homolog of  Ceres  ID no. 21374
  misc_feature (27)..(76): Pfam Name: zf-CW Pfam Description: CW-type Zinc Finger
  misc_feature (83)..(156): Pfam Name: MBD Pfam Description: Methyl-CpG binding domain
MALKERSPETPKTSPKNPRVAVRSIDTYAAQCDKCLKWRVIPTEEEYEEIRSKMEENPYVCDRKPGVSCDDPADIEYNATRTWVIDRPGVPKTPEGFKRSLVLRRDFSKMDAYYITPTGKKLRTRNEIAAFIEANPKYKDVNLSAFNFTSPKVMEDTIPEDAVRKVPSSANGNKKKALKDSA

SEQ ID NO: 1480 - DNA, 1345 bp, Arabidopsis thaliana
  misc_feature (1)..(1345): Ceres CLONE ID no. 21863
  misc_feature (1)..(1345): GEMINI ID 553H9
aaacctctctgtcattactctggtcagcgattcttctttcttcttcttctcagatcctttcaccgagtaagaagattttaaagatgccgtcaacgccgacgacgccgactacaacaacgccgatcacggcttcgtattggtgttacagctgtacgcgtttcgtcagcgtttgggctgatcaaggcacaacaaccgtcggtagcgtcgcttgccctcactgcgacggcggttttatcgaacagattaacgattcttcctccgccgctaccgaattaacgattccggcttctactgaagtaagatcgatcaataacaaccgtagatccgtgattagacgccggagatccggtcgtcgtccgtcctttaatccggtcatcgtacttcaaggaggcgccggcgagagagaagagggagaagaaggagatgcggctagagatcgacgcgcttttgagttttattacgatgacggatccggatcgggtcttagaccgcttccggattctgtatctgagatcttgatgggatctggattcgagcggttacttgaacagctaagccaaatcgaagcgtcggctactggaattggtagatctggaaaccctccggcgtctaaatcggcgattgagtctttacctagagtcgaaatctcggattgccacataggctcggaggctaattgcgctgtttgcacggagattttcgagacggagacggaggcgcgtgagatgccgtgtaaacaccttttccacgacgattgcatcgtaccgtggctatcgattcgaaactcttgtcccgtgtgcagattcgagctaccttaagagcctaatcgacggagcaacaacaacgaggaggataacgccgtggggatgacgatttggagacttcccggtggtggattcgccgtagggaggtttaacgcagcaatgagagacggagagagagttttgccagtggtgttaacagaaatggatggtggtgggattggtaatagccaggatggtcctagacggatctcatgggttaggtcacacggtacactcgaatcggatagtaacggtactggctcaggttccggctccggtggaagattgaggaggatggttcgtggaatggtgtcgttaatgaggagagtgagaccaaaccgtagctcttcttcttcatcagctgcgatatcaacttcttctgataatctggatttgaacattgaagtagaatctagggttttggataggtcaaattcagtgatgagaagatacttcagaagaaacagaagtaacagggattcttcgtcttcagttcttcattgattcagaaatatatatatatattattttttggtttgtcc

SEQ ID NO: 1481 - protein, 244 aa, Arabidopsis thaliana
  misc_feature (1)..(244): Ceres CLONE ID no. 21863
  misc_feature (1)..(244): GEMINI ID 553H9
  misc_feature (199)..(239): Pfam Name: zf-C3HC4 Pfam Description: Zinc finger, C3HC4 type (RING finger)
MPSTPTTPTTTTPITASYWCYSCTRFVSVWADQGTTTVGSVACPHCDGGFIEQINDSSSAATELTIPASTEVRSINNNRRSVIRRRRSGRRPSFNPVIVLQGGAGEREEGEEGDAARDRRAFEFYYDDGSGSGLRPLPDSVSEILMGSGFERLLEQLSQIEASATGIGRSGNPPASKSAIESLPRVEISDCHIGSEANCAVCTEIFETETEAREMPCKHLFHDDCIVPWLSIRNSCPVCRFELP

SEQ ID NO: 1482 - DNA, 1212 bp, Populus balsamifera subsp. trichocarpa
  misc_feature (1)..(1212): Ceres ANNOT ID no. 1464854
atgtcatctccaactacgccgtcgtattggtgctatagatgcaaccgtttcgttcaggtttggagacaagactcggtaacttgcccagaatgtgaatccgggttcattgaagaaatcgaaaaccctccgcacatgattcaaacagaagcatcacgtgaaaggcaccgccgactttctcccgctgccggaacgatgttcatgatcggtaaccgctcaaacccccatcgccgtaaccgtcgcggtggagccgccgggagcggagaccggtccccgatcaatccagtgatcgtgcttcgtggcgggcctggaggggcggcggaggacgtagtgggagatgacggtggccgcggtggtggagggttcgagctttattatgatgacggtggtgggtccgggttgaggccgttgccgccgagcatgtcggaatttttattgggatcagggtttgagagattgttagatcagttaacacatattgaaatgaatggagggtttggccgctatgagaatcagcacccgccggcgtcaaagtcggcgattgaatcgatgcctacggtaattattaacgaatctcatacttttaccgaatcgcattgtgctgtttgtaaggaggcttttgaattagaatccgaagcacgagagatgccttgtaaacatatctatcatactgattgtatacttccttggttatctattcgtaattcttgtccggtttgtcgacatgaattgccttctggtgatgatgacggtgaggatggggttgggagtccgttacctgaagcagggaatggacagggaaataacgaggaggaggcagttgggctgacgatatggaggttacctggaggagggtatgcggtggggaggtttacaggggcgaggaggggagaaagagagttgcccgtggtttatacagagatggatggtgcgtttaacaatggtgggttgccgaggaggatatcttgggggtctagagggggtggaaggagggagaatggtggtggggttaatggtggtagagacggtggtaatagagggtttggttttgggagagttttgaggcattggtttgcttgttttggcgtgggacggggttcgagttcaaactccagagtcactgggaggaataggccttctcctgtttttagcagttcctcttcgatgaggagaaggggttggggcgctgagattaatactggaaggagacggtga

SEQ ID NO: 1483 - protein, 403 aa, Populus balsamifera subsp. trichocarpa
  misc_feature (1)..(403): Ceres ANNOT ID no. 1464854
  misc_feature (1)..(403): Functional Homolog of  Ceres  ID no. 21863
  misc_feature (199)..(239): Pfam Name: zf-C3HC4 Pfam Description: Zinc finger, C3HC4 type (RING finger)
  misc_feature (272)..(370): Pfam Name: DUF1117 Pfam Description: Protein of unknown function (DUF1117)
MSSPTTPSYWCYRCNRFVQVWRQDSVTCPECESGFIEEIENPPHMIQTEASRERHRRLSPAAGTMFMIGNRSNPHRRNRRGGAAGSGDRSPINPVIVLRGGPGGAAEDVVGDDGGRGGGGFELYYDDGGGSGLRPLPPSMSEFLLGSGFERLLDQLTHIEMNGGFGRYENQHPPASKSAIESMPTVIINESHTFTESHCAVCKEAFELESEAREMPCKHIYHTDCILPWLSIRNSCPVCRHELPSGDDDGEDGVGSPLPEAGNGQGNNEEEAVGLTIWRLPGGGYAVGRFTGARRGERELPVVYTEMDGAFNNGGLPRRISWGSRGGGRRENGGGVNGGRDGGNRGFGFGRVLRHWFACFGVGRGSSSNSRVTGRNRPSPVFSSSSSMRRRGWGAEINTGRRR

SEQ ID NO: 1484 - DNA, 1359 bp, Populus balsamifera subsp. trichocarpa
  misc_feature (1)..(1359): Ceres ANNOT ID no. 1511378
atgtcatctccaacaacgccgtctttttggtgctatggatgcagccgtttcgttcaggtttggagacaagactcgttaacttgcgcagaatgtgaatccgggttcattgaagaaatcgaaaacccaccgcacgtaattcaaacagaaatatcgagtgaccgacaccgcaggttttctcccgctgccggaaccatgttcatgatcggtaaccgctcaaacccccataaccggaaccgacggggtggtggcgccgggagcggagaccggtctccgatgaatcctgtgatcttgcttcgtggtggggctggaggggcggcggatgacgtggtgggagacgacggtggccgaggtggtggtgggtttgagctttattacgatgacggtggtgggtccgggttgaggccgttgccgccgagcatgtcggagtttttgttgggatcagggtttgagagattgttagatcagttagcacagattgaaataaatggagggtttggtcggtatgagaatcagcatccaccggcctcgaaatccgcgattgaatcgatgcctacggtaattgttaatgaatcccatatttttactgaatctcattgtgctgtttgtaaagaggcttttgaattagaatccgaagcacgggagatgccttgtaaacatatttatcatactgattgtatacttccttggttatctattcgtaattcttgccctgtttgtcgacgtgagttgccttctggtgatgatgatggtggcgatggtgataatggggttgtgagtccgttgcctgaagcggggaatgggcagggaaataacgaggaggaggcagttggattgacgatatggaggttacccggaggagggtatgcggtggggaggtttacaggggcgaggaggggagaaagggagttgcctgtggtttatacagagatggatggtgcctttaacaatggtggattgccgaggaggatatcttgggggtctagagggggtggaaggagggaaaatggtggtgggggtagtggtggtaatagacggcttggttttgggagagttttgaggcactggtttgcttgttttggcacggggcagagttcgaatttggattccagagttacagggagcagtaggccatattcagtttttagcagttcctcttcaatgaggagaagagactgggctagagagattaacagtgcaaggagacggtgcttgttactgaaatgtatatatggagatttgagaatgactccaattgcgagttcaattcataatctatcgaaaactgatggtttgatgaattgtggaggaacaatgcaatctcaacaaatgacctgcgaagaagcattaggagcaagctag

SEQ ID NO: 1485 - protein, 452 aa, Populus balsamifera subsp. trichocarpa
  misc_feature (1)..(452): Ceres ANNOT ID no. 1511378
  misc_feature (1)..(452): Functional Homolog of  Ceres  ID no. 21863
  misc_feature (199)..(239): Pfam Name: zf-C3HC4 Pfam Description: Zinc finger, C3HC4 type (RING finger)
  misc_feature (275)..(394): Pfam Name: DUF1117 Pfam Description: Protein of unknown function (DUF1117)
MSSPTTPSFWCYGCSRFVQVWRQDSLTCAECESGFIEEIENPPHVIQTEISSDRHRRFSPAAGTMFMIGNRSNPHNRNRRGGGAGSGDRSPMNPVILLRGGAGGAADDVVGDDGGRGGGGFELYYDDGGGSGLRPLPPSMSEFLLGSGFERLLDQLAQIEINGGFGRYENQHPPASKSAIESMPTVIVNESHIFTESHCAVCKEAFELESEAREMPCKHIYHTDCILPWLSIRNSCPVCRRELPSGDDDGGDGDNGVVSPLPEAGNGQGNNEEEAVGLTIWRLPGGGYAVGRFTGARRGERELPVVYTEMDGAFNNGGLPRRISWGSRGGGRRENGGGGSGGNRRLGFGRVLRHWFACFGTGQSSNLDSRVTGSSRPYSVFSSSSSMRRRDWAREINSARRRCLLLKCIYGDLRMTPIASSIHNLSKTDGLMNCGGTMQSQQMTCEEALGAS

SEQ ID NO: 1486 - DNA, 936 bp, Populus balsamifera subsp. trichocarpa
  misc_feature (1)..(936): Ceres ANNOT ID no. 1454043
atggcttcatcaatcgagtcctcattctggtgctacagatgcaaccgatccatccggctccccacccaagattcaattctctgccccgactgcggcggcggattcatcgaagaaatcggcatcacccgtccccaccaccgactcaccgccgcccatcgcacccgtctccgtaccggcggagaccactctcccttcaatccagtcatcatcctccgcggtgccactaccgacttagcatccgggaacttcgagctttactacgacgacggtgcagcgtcgggtctcaggcctttgcccgctagcatatcggagctcttgatggattctgggtttgaacgcctccttgatcagttgactcaaatggaaatcaacggcgtaggtcgattcgatcatccacaagcatctaaagcagccatcgaatcgatgccagtaataaaaatactgaattctcacgtttctatggaatcccaatgcgctgtttgcaaagaagcttttgaaattaataccgaggctcgcgaaatgccttgtaatcacatttatcattctgattgtattttaccctggttatcaatccgtaattcgtgtccggtttgtcgtcatgagttacccaccgaaactggaagtgggagtgggagaaattcgccggaatcagatgaggagaccgttggtttaatgatatggagattgcccggacgtggttttgcagttgggaggttttctggaggaaggagagcagcagagagggagctaccgcttgtgtttacggagatggatggtggatttaataatgcgggtttgcctaggagtatttcatgggctcctgatgggaggagatcaagagagagtggaggagtggggcgtgcttttcggaatttcttctcgtttttcaggaggattggaaggcgttcgagtaaccattctggtcaaagagcatga

SEQ ID NO: 1487 - protein, 311 aa, Populus balsamifera subsp. trichocarpa
  misc_feature (1)..(311): Ceres ANNOT ID no. 1454043
  misc_feature (1)..(311): Functional Homolog of  Ceres  ID no. 21863
  misc_feature (158)..(198): Pfam Name: zf-C3HC4 Pfam Description: Zinc finger, C3HC4 type (RING finger)
  misc_feature (221)..(298): Pfam Name: DUF1117 Pfam Description: Protein of unknown function (DUF1117)
MASSIESSFWCYRCNRSIRLPTQDSILCPDCGGGFIEEIGITRPHHRLTAAHRTRLRTGGDHSPFNPVIILRGATTDLASGNFELYYDDGAASGLRPLPASISELLMDSGFERLLDQLTQMEINGVGRFDHPQASKAAIESMPVIKILNSHVSMESQCAVCKEAFEINTEAREMPCNHIYHSDCILPWLSIRNSCPVCRHELPTETGSGSGRNSPESDEETVGLMIWRLPGRGFAVGRFSGGRRAAERELPLVFTEMDGGFNNAGLPRSISWAPDGRRSRESGGVGRAFRNFFSFFRRIGRRSSNHSGQRA

SEQ ID NO: 1488 - protein, 244 aa, Arabidopsis thaliana; identical to SEQ ID NO: 1481
  misc_feature (1)..(244): Public GI no. 34902106
  misc_feature (199)..(239): Pfam Name: zf-C3HC4 Pfam Description: Zinc finger, C3HC4 type (RING finger)

SEQ ID NO: 1489 - protein, 279 aa, Oryza sativa
  misc_feature (1)..(279): Public GI no. 34902106
  misc_feature (1)..(279): Functional Homolog of  Ceres  ID no. 21863
  misc_feature (135)..(175): Pfam Name: zf-C3HC4 Pfam Description: Zinc finger, C3HC4 type (RING finger)
  misc_feature (191)..(275): Pfam Name: DUF1117 Pfam Description: Protein of unknown function (DUF1117)
MASSPVSYWCYHCSRFVRVSPSTVVCPECDGGFLEQFPQPPPRGGGGSGRRGAMNPVIVLRGGSLSGFELYYDDGSGDGLRPLPGDVSHLLMGSGFHRLLDQFSRLEAAAPRPPASKAAVESMPSVTVAGSGAHCAVCQEAFEPGASAREMPCKHVYHQDCILPWLSLRNSCPVCRRELPAAAAPESEADAGLTIWRLPRGGFAVGRFAGGPREQLPVVYTELDGGFSNGVGPRRVTWPEGDGHVDGGEGRIRRVFRNLFGCFGRSSRPESSSSQSRSG

SEQ ID NO: 1490 - protein, 280 aa, Triticum aestivum
  misc_feature (1)..(280): Ceres CLONE ID  no. 677852
  misc_feature (1)..(280): Functional Homolog of  Ceres  ID no. 21863
  misc_feature (137)..(177): Pfam Name: zf-C3HC4 Pfam Description: Zinc finger, C3HC4 type (RING finger)
  misc_feature (193)..(267): Pfam Name: DUF1117 Pfam Description: Protein of unknown function (DUF1117)
MASSPVSYWCYHCSRFVRVSPATVVCPDCDGGFLEQFPQPPPPRGGGGSGRRGAMNPVIVLRGGSLSGFELYYEDGSGDGLRPLPGDVSHLLMGSGFHRLLDQFSRLEAAAPRPPASKAAVESMPSVTVAGGGGAHCAVCQEAFEPGAAAREMPCKHVYHQDCILPWLSLRNSCPICRSELPAAAVPEAEADAGLTIWRLPRGGFAVGRFAGGPREQLPVVYTELDGGFSNGVGPRRVTWPEGEGQVDGGEGRIRRVFRNLFGCFGRGGRPESSSQSRSG

SEQ ID NO: 1491 - protein, 307 aa, Glycine max
  misc_feature (1)..(307): Ceres CLONE ID  no. 637282
  misc_feature (1)..(307): Functional Homolog of  Ceres  ID no. 21863
  misc_feature (158)..(198): Pfam Name: zf-C3HC4 Pfam Description: Zinc finger, C3HC4 type (RING finger)
  misc_feature (214)..(293): Pfam Name: DUF1117 Pfam Description: Protein of unknown function (DUF1117)
  misc_feature (168)..(168): Xaa is any aa, unknown, or other
MASLGSPSSFWCYRCNRIVRVPQNHAVLLCPDCNSGFLEELQTPPHSRRSTRGGGGSPFNPVIVLRNANDVVSPETRNFELYYNDAVSGSSGPSSLRPLPQGVSEFLMGSGFDNVLDHLDAAAGGAGALPPTAASKAAIESMPVVKILASHTYAESHCAVCMENFEIXCDAREMPCGHVYHSECIVPWLSVRNSCPVCRHEVPSDEVEESNNNTVGLTIWRLPGGGFAVGRFIGGRELPLVYTEMDGGFNGANGVPRRVAWDSSVGRSRENRGFGAAFRNVFSYIGRVRSSFSRRTRNSRANGRSRS

SEQ ID NO: 1492 - DNA, 865 bp, Arabidopsis thaliana
  misc_feature (1)..(865): Ceres CLONE ID no. 250132
  misc_feature (1)..(865): GEMINI ID 532G5
attgtcaatttccctttattttctcgacggaatcataaataaaaaccctaaacctaaagtcacaaattcattcttcatctgttattcacgatttgtgttgtcttttcttttgcagtaagatttcgactttagaattgggagatctttccattatgggttctgagcaaaacgacagcacaagcttctctccttcagagccaaagctctgcgtcaaaggatgtggcttcttcggatctccatcgaacatgaacctctgctctaaatgctaccagagacatccgagccacggaggaacaaaccgcttccgctaaagccgccgtcgagaaatctctaaaccctaataaacccaaaactcaaccacaacagagccaagaaatcactcaaggcgtcctcggatctggatcgtcttcctcatcaacgagagggggtgattcggctgctgctccgttggatccaccgaaatcgacggctacgagatgcttgagctgtaacaagaaagttggcgtgacgggtttcaagtgtaggtgtggaagcactttctgtggaactcatagatatccagagagtcacgagtgccaattcgatttcaaaggagttgcgagagaagctattgctaaagctaatcctgtggtgaaggctgataaggttgataggatatgaattggtgaagaaactgttgtgttctcttttgtttttttattttcaagtctcgtgatgttggtggtttggctctctgttttctgctcttattatggttttatttgcttttagggtttcttaggaaaggccttagattctgctattatgtggtttcatgttttgcaacattggatttgttgttctgtaataaagtgttggttatatt

SEQ ID NO: 1493 - protein, 168 aa, Arabidopsis thaliana
  misc_feature (1)..(168): Ceres CLONE ID no. 250132
  misc_feature (1)..(168): GEMINI ID 532G5
  misc_feature (109)..(149): Pfam Name: zf-AN1 Pfam Description: AN1-like Zinc finger
  misc_feature (16)..(40): Pfam Name: zf-A20 Pfam Description: A20-like zinc finger
MGSEQNDSTSFSPSEPKLCVKGCGFFGSPSNMNLCSKCYRDIRATEEQTASAKAAVEKSLNPNKPKTQPQQSQEITQGVLGSGSSSSSTRGGDSAAAPLDPPKSTATRCLSCNKKVGVTGFKCRCGSTFCGTHRYPESHECQFDFKGVAREAIAKANPVVKADKVDRI

SEQ ID NO: 1494 - protein, 172 aa, Brassica napus
  misc_feature (1)..(172): Ceres CLONE ID no. 962327
  misc_feature (1)..(172): Functional Homolog of  Ceres  ID no. 250132
  misc_feature (113)..(153): Pfam Name: zf-AN1 Pfam Description: AN1-like Zinc finger
  misc_feature (16)..(40): Pfam Name: zf-A20 Pfam Description: A20-like zinc finger
  misc_feature (143)..(143): Xaa is any aa, unknown, or other
  misc_feature (151)..(151): Xaa is any aa, unknown, or other
MSSEQNNSTSFPPTEPKLCDNGCGFFGSPSNMNLCSKCYRSLRAEEDQTAVAKAAVKNSLKLPSCSLIITPEQKQPLETKPASVVVTAEPSSVPIATGQEEAEPSKPARTNRCFSCNKKVGVMGFKCKCGSTFCGSHRYPEKXECSFDFKXVGRDAIAKANPVIKADKVERI

SEQ ID NO: 1495 - protein, 158 aa, Glycine max
  misc_feature (1)..(158): Ceres CLONE ID no. 1101577
  misc_feature (1)..(158): Functional Homolog of  Ceres  ID no. 250132
  misc_feature (10)..(34): Pfam Name: zf-A20 Pfam Description: A20-like zinc finger
  misc_feature (99)..(139): Pfam Name: zf-AN1 Pfam Description: AN1-like Zinc finger
MAEEHRCQAPRFCANNCGFFGSPATQNMCSKCYRDFQLKEQQSSNAKMVLNQSLVPSPPPAVISQPSSSSSAAVDPSSAVVDDAPRESEEVKAPQQNRCMTCRRRVGLTGFKCRCGMMLCGTHRYPEQHACEFDFKGMGREQIAKANPVVKGEKLDKI

SEQ ID NO: 1496 - protein, 160 aa, Triticum aestivum
  misc_feature (1)..(160): Ceres CLONE ID no. 634261
  misc_feature (1)..(160): Functional Homolog of  Ceres  ID no. 250132
  misc_feature (101)..(141): Pfam Name: zf-AN1 Pfam Description: AN1-like Zinc finger
  misc_feature (19)..(43): Pfam Name: zf-A20 Pfam Description: A20-like zinc finger
MAQESWKESEETVQTPEAPILCVNNCGFFGSSMTNNMCSKCYRDFIKATTMAAPVVEKKVFSVASSSSVTLEQAKADEVPAVAVADSQAAQEPPKPPSNRCLSCRKKIGLTGFQCRCGGTFCSMHRYADSHECTFDYKKAGREQIAKQNPVVIAKKINKI

SEQ ID NO: 1497 - protein, 173 aa, Prunus armeniaca
  misc_feature (1)..(173): Public GI no. 5031281
  misc_feature (1)..(173): Functional Homolog of  Ceres  ID no. 250132
  misc_feature (114)..(154): Pfam Name: zf-AN1 Pfam Description: AN1-like Zinc finger
  misc_feature (15)..(39): Pfam Name: zf-A20 Pfam Description: A20-like zinc finger
MEHEETGCQPHPEGPILCVNNCGFFGSVATRNMCSKCHKDMMLKEEQAKLAASSFGNIVNGTSNSNGNEPVVAAGVDVQAHLVEPKTISLQPSFSFGSGSGGSGEAKPEGPKRCGTCNKRVGLTGFNCRCGHLFCAVHRYSDKHDCPYDYHTAARDVIAKANPVVKADKLEKI

SEQ ID NO: 1498 - protein, 171 aa, Oryza sativa
  misc_feature (1)..(171): Public GI no. 35187687
  misc_feature (1)..(171): Functional Homolog of  Ceres  ID no. 250132
  misc_feature (112)..(152): Pfam Name: zf-AN1 Pfam Description: AN1-like Zinc finger
  misc_feature (14)..(38): Pfam Name: zf-A20 Pfam Description: A20-like zinc finger
MEHKETGCQQPKGPILCINNCGFFGSAATMNMCSKCHKEMIMKQEQAKLAASSIDSIVNGGDSGKEPIIAGHAEVAVAQVEVKTLVAQPAEIAGPSEGVTVNPKGREGPNRCSTCRKRVGLTGFNCRCGNLYCAMHRYSDKHDCQFDYRTAARDAIAKANPVVKAEKLDKI

SEQ ID NO: 1499 - protein, 160 aa, Oryza sativa
  misc_feature (1)..(160): Public GI no. 34978689
  misc_feature (1)..(160): Functional Homolog of  Ceres  ID no. 250132
  misc_feature (101)..(141): Pfam Name: zf-AN1 Pfam Description: AN1-like Zinc finger
  misc_feature (21)..(45): Pfam Name: zf-A20 Pfam Description: A20-like zinc finger
MAQESWKKEAEETGVHTPEAPILCVNNCGFFGSRMTENMCSKCYRDTVKAKTVATVVEKKPLASLSSTPLVTEVTDGGSGSVADGKQVMEEDTPKPPSNRCLSCRKKVGLTGFKCRCGGTFCSMHRYADSHKCTFDYKQVGREQIAKQNPLVKADKITKI

SEQ ID NO: 1500 - protein, 165 aa, Oryza sativa
  misc_feature (1)..(165): Public GI no. 34909836
  misc_feature (1)..(165): Functional Homolog of  Ceres  ID no. 250132
  misc_feature (105)..(145): Pfam Name: zf-AN1 Pfam Description: AN1-like Zinc finger
  misc_feature (12)..(36): Pfam Name: zf-A20 Pfam Description: A20-like zinc finger
MSSEQQASAGQPVLCASGCGFYGNPATLDMCSVCYRQHCLLNGATMATGPSSSVAAASAATVATGAVTSDSCSVPSAEVNGAAFSSKNNPEPATVVEKKAPANRCASCKKKVGLLGFACRCGATYCGTHRYPEKHACGFDFKGASRDAIARANPLIKGEKLTNKI

SEQ ID NO: 1501 - DNA, 150 bp, Populus balsamifera subsp. trichocarpa
  misc_feature (1)..(150): Ceres ANNOT ID no. 1527653
atggattcacaagacaatttgactcgtacgctgtgcgccaagggctgtggcttctttgggtctccagagaacaaaaatctatgttcaaagtgttacaaagattatctcaaagaagaggtgattgttaaagactgccaacaaactctctga

SEQ ID NO: 1502 - protein, 49 aa, Populus balsamifera subsp. trichocarpa
  misc_feature (1)..(49): Ceres ANNOT ID no. 1527653
  misc_feature (1)..(49): Functional Homolog of  Ceres  ID no. 250132
  misc_feature (9)..(33): Pfam Name: zf-A20 Pfam Description: A20-like zinc finger
MDSQDNLTRTLCAKGCGFFGSPENKNLCSKCYKDYLKEEVIVKDCQQTL

SEQ ID NO: 1503 - DNA, 981 bp, Arabidopsis thaliana
  misc_feature (1)..(981): Ceres CLONE ID no. 251466
  misc_feature (1)..(981): GEMINI ID 532H5
agaacacaaacaaaaacacattgtaacattagtttaagcattaagcttctttatgtcgaataataataattctccgaccaccgtgaatcaagaaacgacgacgtctcgtgaagtctcaatcacattgcctactgatcaatctcctcaaacctcaccaggatcatcttcttctccttcaccgagaccttccggtggatcaccggcgagaagaacggcgactggattatccggcaagcactctattttcagggggattcgactacgtaacggaaaatgggtatcggagattagagagccacgtaaaacgacaagaatttggctcgggacttatccggtaccggagatggctgccgccgcttacgacgtggctgcgttasstttaaaaggaccaggccgttttgaattttcctggtttagctttgacttacgtggctccggtttcaaactctgctgcggatataagagcggctgctagtagagcagcggagatgaagcaaccggatcagggtggggatgagaaggtattggaaccggttcaacccggcaaagaggaagaattagaagaagtgtcgtgtaactcgtgttcgttggagtttatggatgaggaagcgatgttgaatatgccgactttgttgacggagatggctgaagggatgttgatgagtccaccgagaatgatgatacatccgacgatggaagatgattcgccggagaatcatgaaggagataatctttggagttataaatgaatccattgaagctgctctcttttttattgttttccggtcgaatgagattttccccctttttttttctttttgggtcgctgttatggaaagtcaaataggttattaatatgatctattaatatttttgaaacataatgagtttgaatttgaatttttccatttttatataaatatggtttatatgagggaaaaatagatacatatcgaagatataagaattgtttttctgctt

SEQ ID NO: 1504 - protein, 140 aa, Arabidopsis thaliana
  misc_feature (1)..(140): Ceres CLONE ID no. 251466
  misc_feature (1)..(981): GEMINI ID 532H5
  misc_feature (63)..(113): Pfam Name: AP2 Pfam Description: AP2 domain
MSNNNNSPTTVNQETTTSREVSITLPTDQSPQTSPGSSSSPSPRPSGGSPARRTATGLSGKHSIFRGIRLRNGKWVSEIREPRKTTRIWLGTYPVPEMAAAAYDVAALALKGPGRFEFSWFSFDLRGSGFKLCCGYKSGC

SEQ ID NO: 1505 - protein, 261 aa, Oryza sativa
  misc_feature (1)..(261): Public GI no. 50253268
  misc_feature (1)..(261): Functional Homolog of  Ceres  ID no. 251466
  misc_feature (69)..(119): Pfam Name: AP2 Pfam Description: AP2 domain
MADLTEHPSPTAPPQVQTAGLPAAASPGPASPHSPSEQGDKTAPGAATASTMTTASSGEPSPRSSGKHAFYRGIRCRSGKWVSEIREPRKARRIWLGTYPTAEMAAAAYDVAARALRGADAVLNFPGATASRPVPASASPADIRAAAAAAAAAAAHLERPHGPTGTAYPATAAAEHHQQQQQQQYGSGSPAADDVSGYPPMEGGIGNDDFMDEEAIFELPQLLRNMAAGMMMSPPRLSPTTSDVSPEPSEAGESLWSYRDP

SEQ ID NO: 1506 - protein, 210 aa, Lycopersicon esculentum
  misc_feature (1)..(210): Public GI no. 45826359
  misc_feature (1)..(210): Functional Homolog of  Ceres  ID no. 251466
  misc_feature (53)..(104): Pfam Name: AP2 Pfam Description: AP2 domain
MNIFETYYSDSLILTESSSSSSSSSFSEEEVILASNNPKKPAGRKKFRETRHPIYRGIRKRNSGKWVCEVREPNKKTRIWLGTFPTAEMAARAHDVAALALRGRSACLNFSDSAWRLPIPASSNSKDIQKAAAQAVEIFRSEEVSGESPETSENVQESSDFVDEEAIFFMPGLLANMAEGLMLPPPQCAEMGDHCVETDAYMITLWNYSI

SEQ ID NO: 1507 - protein, 220 aa, Lycopersicon esculentum
  misc_feature (1)..(220): Public GI no. 45826360
  misc_feature (1)..(220): Functional Homolog of  Ceres  ID no. 251466
  misc_feature (61)..(112): Pfam Name: AP2 Pfam Description: AP2 domain
MDIFESYYSNSFVESLLSSSLSISDTNNLNHYSPNEEVIILASNNPKKPAGRKKFRETRHPVYRGIRKRNSGKWVCEVREPNKKTRIWLGTFPTAEMAARAHDVAAIALRGRSACLNFADSVWRLPIPASSNSKDIQKAAAEAAEIFRSEEVSGESPETSENVQESSDFVDEEALFSMPGLLANMAEGLMLPPPQCLEIGDHYVELADVHAYMPLWNYSI

SEQ ID NO: 1508 - protein, 216 aa, Gossypium hirsutum
  misc_feature (1)..(216): Public GI no. 37993864
  misc_feature (1)..(216): Functional Homolog of  Ceres  ID no. 251466
  misc_feature (54)..(105): Pfam Name: AP2 Pfam Description: AP2 domain
MDFVVQDYDMVDSGSVSESGTDRPVNFSDEYVMLASSYPKRPAGRKKFRETRHPVYRGVRRRNPGKWVSEVREPNKKSRIWLGTFPKADMAARAHDVAAIALRGKSACLNFADSAWKLPVPASSDPKDIQKTVAEVAETFRTAEHSSGNSRNDAKRSENTEMEKGFYLDEEALFGTQRFWANMAAGMMMSPPRSGHDGGWEEHEVDDYVPLWSYSI

SEQ ID NO: 1509 - protein, 205 aa, Glycine max
  misc_feature (1)..(205): Ceres CLONE ID no. 707775
  misc_feature (43)..(93): Pfam Name: AP2 Pfam Description: AP2 domain
  misc_feature (1)..(205): Functional Homolog of  Ceres  ID no. 251466
  misc_feature (101)..(101): Xaa is any aa, unknown, or other
MDGNSFGNVPPPPIQVPDNLAISSSSSPTPTTSSPSPTPSGGFRYRGTRCRSGKWVSEIREPRKTNRIWLGTYPTAEMAAAAYDVAALALKGPDTPVNFPXSILSYPIPASLSSTDIRAAAAAAAQARIVRAPQESEETVNPDDGGQGLSERREEYIYEDELLNMPNLLDEMARGMQVSPLRITSYSSDDSPGNSDGDNLWSYTL

SEQ ID NO: 1510 - protein, 229 aa, Cucumis melo
  misc_feature (1)..(229): Public GI no. 38257023
  misc_feature (1)..(229): Functional Homolog of  Ceres  ID no. 251466
  misc_feature (41)..(92): Pfam Name: AP2 Pfam Description: AP2 domain
MSSSKEQSPSPETESSSSSSSDSNKKPKRINSNSSSNSKHAVYRGVRMRNWGKWVSEIREPRKKSRIWLGTFPSPEMAARAHDVAALSIKGNSAILNFPDLVHLLPRPVSLAPRDVQAAAAKAAHMHNLSSNANTNNHNTNSNSSSAFSDELSEIVELPALGTSYDGGVGVGGEFVFVESELESAAWLYQPPWVQSLQEDYDDIDGDGDCGKLGMGFVSNGFKGFLFDY

SEQ ID NO: 1511 - protein, 215 aa, Capsicum annuum
  misc_feature (1)..(215): Public GI no. 37147896
  misc_feature (1)..(215): Functional Homolog of  Ceres  ID no. 251466
  misc_feature (59)..(110): Pfam Name: AP2 Pfam Description: AP2 domain
MNIFRSYYSDPLTESSSSFSDSSIYSPNRAIFSDEEVILASNNPKKPAGRKKFRETRHPVYRGVRKRNSGKWVCEVREPNKKSRIWLGTFPTAEMAARAHDVAAIALRGRSACLNFADSAWRLPVPASSDTKDIQKAAAEAAEAFRPLKLEGISKESSSSTPESMFFMDEEALFCMPGLLTNMAEGLMLPPPQCAEIGDHVETADADTPLWSYSI

SEQ ID NO: 1512 - protein, 216 aa, Thellungiella salsuginea
  misc_feature (1)..(216): Public GI no. 41351817
  misc_feature (1)..(216): Functional Homolog of  Ceres  ID no. 251466
  misc_feature (49)..(100): Pfam Name: AP2 Pfam Description: AP2 domain
MNSFSAFAEMFGSEYESPVTVGGDYCPTLATSCPKKPAGRKKFRETRHPIYRGVRRRNSGKWVCEVREPNKKSRIWLGTFPTAEMAARAHDVAAIALRGRSACLNFADSAWRLRIPESTCAKDIQKAAAEAAVAFQAEMSDTMTSDHGLDMEETTVEVIVTEEEQSEGFYMDEEAMFGMPRLLANMAEGMLLPPPSVQWGHNYDCDGDADVSLWSY

SEQ ID NO: 1513 - protein, 234 aa, Glycine soja
  misc_feature (1)..(234): Public GI no. 55824656
  misc_feature (1)..(234): Functional Homolog of  Ceres  ID no. 251466
  misc_feature (63)..(114): Pfam Name: AP2 Pfam Description: AP2 domain
MFTLNHSSDLYHVSPELSSSLDTSSPASEGSRGVAFSDEEVRLAVRHPKKRAGRKKFRETRHPVYRGVRRRNSDKWVCEVREPNKKTRIWLGTFPTPEMAARAHDVAAMALRGRYACLNFADSAWRLPVPATAEAKDIQKAAAEAAQAFRPDQTLKNANTRQECVEAVAVAVADTTTATAQGVFYMEEEEQVLDMPELLRNMVLMSPTHCLGYEYEDADLDAQDAEVSLWNFSI

SEQ ID NO: 1514 - protein, 231 aa, Hevea brasiliensis
  misc_feature (1)..(231): Public GI no. 66269671
  misc_feature (1)..(231): Functional Homolog of  Ceres  ID no. 251466
  misc_feature (66)..(117): Pfam Name: AP2 Pfam Description: AP2 domain
MDVFPQYSDSLPFATHSCSLHYPESSTLSDTCSALRANLSDEEVLLASSYPKKRAGRKKFRETRHPIYRGVRRRNSGKWVCEIREPNKKSRIWLGTFPTEEMAARAHDVAALALRGRSACLNFADSSWRLPVPASREAKDIRKAAAEAAMAFQPEGTEGFSGELKQENKWTTESAPEDVFYMDEEAVFAMPGLLASMAEGMLLPPPQCVAGSGGEDGEMDAADVSLWSFSI

SEQ ID NO: 1515 - protein, 225 aa, Oryza sativa
  misc_feature (1)..(225): Public GI no. 33638194
  misc_feature (1)..(225): Functional Homolog of  Ceres  ID no. 251466
  misc_feature (48)..(99): Pfam Name: AP2 Pfam Description: AP2 domain
MDDSSFGSEPTTSSSGGEAPASPPSTASSSSDGAGGKKKRPRKDGHHPTYRGVRMRSWGKWVSEIREPRKKSRIWLGTFATAEMAARAHDVAALAIKGRAAHLNFPDLAHELPRPATAAPKDVQAAAALAAAADFPASSANAGASNNPDGSDDASAGSASPPPPPDAADDALFDLPDLLLDLRYGPPSSGLSCASSWEDEVGLISGAGAAAAGVFRLEEPLLWEY

SEQ ID NO: 1516 - protein, 281 aa, Zea mays
  misc_feature (1)..(281): Public GI no. 21908034
  misc_feature (1)..(281): Functional Homolog of  Ceres  ID no. 251466
  misc_feature (93)..(144): Pfam Name: AP2 Pfam Description: AP2 domain
MAQELHETSSCSATTTSSCTTSCCSSTVTDSSSSPPSPAAANAAPATRKRQALEAEAEAEAGGEEEEEEEEGCAGNKAAPAKKRPRGSEGKHPTFRGVRMRAWGKWVSEIREPRKKSRIWLGTFPTAEMAARAHDVAALAIKGRAAHLNFPDLAGALPRAASAAPKDVQAAAALAAAFTSPSSEPGAGAHEEPAAKDGAAPEEAAADAQAPVPVALPPPAASRPGTPSSGVEDERQLFDLPDLLLDIRDGFGRFPPMWAPLTDVEDVVNAELRLEEPLLWE

SEQ ID NO: 1517 - DNA, 497 bp, Arabidopsis thaliana
  misc_feature (1)..(497): Ceres CLONE ID no. 25795
  misc_feature (1)..(497): GEMINI ID 554G8
cttcttgtttctcgagatttattctctttctctctctctttctctgtgtgtttcgtgtcttcagattagttcgatgtttcgttcagacaaggcggaaaaaatggataaacgacgacggagacagagcaaagccaaggcttcttgttccgaagaggtgagtagtatcgaatgggaagctgtgaagatgtcagaagaagaagaagatctcatttctcggatgtataaactcgttggcgacaggtgggagttgatcgccggaaggatcccgggacggacgccggaggagatagagagatattggcttatgaaacacggcgtcgtttttgccaacagacgaagagacttttttaggaaatgattttttttgtttggattaaaagaaaattttcctctccttaattcacaagacaagaaaaaaaggaaatgtacctgtccttgaattactattttggaatgtataattatctatatatataagaagaaaaaattgcttaggt

SEQ ID NO: 1518 - protein, 94 aa, Arabidopsis thaliana
  misc_feature (1)..(94): Ceres CLONE ID no. 25795
  misc_feature (1)..(94): GEMINI ID 554G8
  misc_feature (35)..(80): Pfam Name: Myb_DNA-binding Pfam Description: Myb-like DNA-binding domain
MFRSDKAEKMDKRRRRQSKAKASCSEEVSSIEWEAVKMSEEEEDLISRMYKLVGDRWELIAGRIPGRTPEEIERYWLMKHGVVFANRRRDFFRK

SEQ ID NO: 1519 - DNA, 267 bp, Populus balsamifera subsp. trichocarpa
  misc_feature (1)..(267): Ceres ANNOT ID no. 1471291
atggatagacgtcgcaagaagcaagccaagactacatcttgttgttctgaacaagaggtgagcagcattgagtgggagttcattaacatgtcagaacaagaagaagatctcatttacagaatgcataatctggtgggggacaggtgggctttgatcgctggtcgaattccaggacgcaaagctgaagaaatagagagattttggctaatgagacacggtgaagggtttgccagtcgacgaagagagcaaaagagatgtcattcctaa

SEQ ID NO: 1520 - protein, 88 aa, Populus balsamifera subsp. trichocarpa
  misc_feature (1)..(88): Ceres ANNOT ID no. 1471291
  misc_feature (1)..(88): Functional Homolog of  Ceres  ID no. 25795
  misc_feature (27)..(72): Pfam Name: Myb_DNA-binding Pfam Description: Myb-like DNA-binding domain
MDRRRKKQAKTTSCCSEQEVSSIEWEFINMSEQEEDLIYRMHNLVGDRWALIAGRIPGRKAEEIERFWLMRHGEGFASRRREQKRCHS

SEQ ID NO: 1521 - DNA, 279 bp, Populus balsamifera subsp. trichocarpa
  misc_feature (1)..(279): Ceres ANNOT ID no. 1444391
atggatagacgtcgcaggaagcaagccaagacaacaactcattgctctgatcaagaggtaagcagcattgaatgggaattcatcaacatgtcagaacaagaagaagatctcatttacagaatgtataagctggtcggagacaggtgggctttgatcgcaggtcgaattccaggccgcaaagctgaggaaatagagagatattggattatgagacactgtgaagggtttgccagtcgacgaaaggaacaaaaaagagatgtaattcctaatacctcttaa

SEQ ID NO: 1522 - protein, 92 aa, Populus balsamifera subsp. trichocarpa
  misc_feature (1)..(92): Ceres ANNOT ID no. 1444391
  misc_feature (1)..(92): Functional Homolog of  Ceres  ID no. 25795
  misc_feature (27)..(72): Pfam Name: Myb_DNA-binding Pfam Description: Myb-like DNA-binding domain
MDRRRRKQAKTTTHCSDQEVSSIEWEFINMSEQEEDLIYRMYKLVGDRWALIAGRIPGRKAEEIERYWIMRHCEGFASRRKEQKRDVIPNTS

SEQ ID NO: 1523 - DNA, 285 bp, Populus balsamifera subsp. trichocarpa
  misc_feature (1)..(285): Ceres ANNOT ID no. 1488042
atggctgacttggatcactcctctagtgatgacaactctgttgattctagagaggaaaccagccaagattcgaagcttgaattctcagaagatgaggaaactcttatcaccaggatgtacaatctggttggtgagaggtggcccttaattgctgggaggattccaggaagaacagcagaagaaattgagaagtactggacttcaagatactctacaaggatggctctggctctggctctggctctggcacaggcacaggcacagggcagagttgtaagccattga

SEQ ID NO: 1524 - protein, 94 aa, Populus balsamifera subsp. trichocarpa
  misc_feature (1)..(94): Ceres ANNOT ID no. 1488042
  misc_feature (1)..(94): Functional Homolog of  Ceres  ID no. 25795
  misc_feature (25)..(66): Pfam Name: Myb_DNA-binding Pfam Description: Myb-like DNA-binding domain
MADLDHSSSDDNSVDSREETSQDSKLEFSEDEETLITRMYNLVGERWPLIAGRIPGRTAEEIEKYWTSRYSTRMALALALALAQAQAQGRVVSH

SEQ ID NO: 1525 - DNA, 800 bp, Arabidopsis thaliana
  misc_feature (1)..(800): Ceres CLONE ID no. 26867
  misc_feature (1)..(800): GEMINI ID 535B8
aaaacaacactcaaaagtctcttcttcttcttcttcacatcgatcatcatacaacaacaaaaaatggattacagagaatccaccggtgaaagtcagtcaaagtacaaaggaatccgtcgtcggaaatggggcaaatgggtatcagagattagagttccgggaactcgtgaccgtctctggttaggttcattctcaacagcagaaggcgccgccgtagcacacgacgttgctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggcgatacgacgacgtattacgagaatggagctgatcaagtggagccgttgaatatttcagtgtatgattatctgggcggccacgatcacgtttgatttatctcgacggtcatgatcacgtttgatcttcttttgagtaagattttgtaccataatcaaaacaggtgtggtgctaaaatcttactcaaaacaagattaggtaccacagagaaacaatcaaatggttgtgaatatacattataaggttgattaatgtttgtttcactgatttagtgaagtttggtccattgtatacaaatctattcaagaaacctagcgcgagatcatgtttcgtgattgaagattgagatttttaagtattcgtaatatttttgtaaaatacaaatatgtttctgatc

SEQ ID NO: 1526 - protein, 144 aa, Arabidopsis thaliana
  misc_feature (1)..(144): Ceres CLONE ID no. 26867
  misc_feature (1)..(144): GEMINI ID 535B8
  misc_feature (12)..(63): Pfam Name: AP2 Pfam Description: AP2 domain
MDYRESTGESQSKYKGIRRRKWGKWVSEIRVPGTRDRLWLGSFSTAEGAAVAHDVAFFCLHQPDSLESLNFPHLLNPSLVSRTSPRSIQQAASNAGMAIDAGIVHSTSVNSGCGDTTTYYENGADQVEPLNISVYDYLGGHDHV

SEQ ID NO: 1527 - DNA, 507 bp, Populus balsamifera subsp. trichocarpa
  misc_feature (1)..(507): Ceres ANNOT ID no. 1486918
atgagcggtagtagcagcagcagaacagatcaagaaagtggagcaagtgcagctcggaagaaattcaagggagtgaggaggcggaaatggggcaagtgggtgtctgaaataaggattcctggcaagcaagatcgactttggttaggttcttattcaacacccgaggcagctgcggtggctcatgacatagcctcttattgtttacgcggaccttcttcgatagagagtctcaatttccctctaatgttgcctgcaagtgtaagggaagacatgtcacctaagtccatacagaaagctgcttcagatgctggcatggcaattgatgctcaaatgatactgaacagggtaccagaaaatgaggtcaagttctggactgcaagtggtggggttaatcatgggctggagatagagttatgcgaacctgcaggtggcgatcatggtggtaattggcatggaaacaatactggaatgagagaaggggacatctccattgaagattatctctag

SEQ ID NO: 1528 - protein, 168 aa, Populus balsamifera subsp. trichocarpa
  misc_feature (1)..(168): Ceres ANNOT ID no. 1486918
  misc_feature (1)..(168): Functional Homolog of  Ceres  ID no. 26867
  misc_feature (20)..(71): Pfam Name: AP2 Pfam Description: AP2 domain
MSGSSSSRTDQESGASAARKKFKGVRRRKWGKWVSEIRIPGKQDRLWLGSYSTPEAAAVAHDIASYCLRGPSSIESLNFPLMLPASVREDMSPKSIQKAASDAGMAIDAQMILNRVPENEVKFWTASGGVNHGLEIELCEPAGGDHGGNWHGNNTGMREGDISIEDYL

SEQ ID NO: 1529 - protein, 263 aa, Triticum aestivum
  misc_feature (1)..(263): Ceres CLONE ID no. 902699
  misc_feature (1)..(263): Functional Homolog of  Ceres  ID no. 31044
  misc_feature (72)..(123): Pfam Name: AP2 Pfam Description: AP2 domain
MESDAGENLFGTFSSSTTSITASSSSSPTSSTTTSSNSCTKHDSKISPPQNQNTPNSKKRQRSDDNENKHHPSYRGVRMRAWGKWVSEIREPRKKSRIWLGTYPTAEMAARAHDVAALAVKGHSAFLNFPNLAQDLPRPTTTSPKDIQAAAAKAATTTFFDDEIVNHCQAEKAEQNHGEQQASPSTLCMMDNSTEAEQIQAEQASSTQESSSSHSTADEETLFDLPDLFPDGNSGLFSYSSCWHLCAVDSGFRLEEQFLWENF

SEQ ID NO: 1530 - protein, 274 aa, Glycine max
  misc_feature (1)..(274): Ceres CLONE ID no. 709819
  misc_feature (1)..(274): Functional Homolog of  Ceres  ID no. 31044
  misc_feature (100)..(151): Pfam Name: AP2 Pfam Description: AP2 domain
TTIIKVSTMRKRINMESDADFNSFATSSSSTTPSIFFDTNTSSTSSSSTSPTSNSESCTKEHSKTPQNDSTTSQTSLENGKDSKGCKKRQIDNSNQNHHPTYRGVRMRNWGKWVSEIREPRKKSRIWLGTYPTAEMAARAHDVAALAIKGHSAYLNFPELAQELPRPVSTSPKDIQAAAAKAANTAFEEVRHCQITEEEAEQNQAEQASSSTLSMDNPQEPSSSHSTIDDDTLFDLPDLFPDGNNGLCSFSSSWHLCAVDSGFRLEESFFYENH

SEQ ID NO: 1531 - protein, 289 aa, Glycine max
  misc_feature (1)..(289): Public GI no. 37536842
  misc_feature (1)..(289): Functional Homolog of  Ceres  ID no. 31044
  misc_feature (94)..(145): Pfam Name: AP2 Pfam Description: AP2 domain
MAMAKELQETSSSSSSSAASTSSCSSAVTDAWSSPARPNAVAGGKRKKEVVGEADEAAGGGAGEEEEEEAEAAAAGKSSAATKKRKRSSDGKHPVYRGVRMRAWGKWVSEIREPRKKSRIWLGTFPTADMAARAHDVAALAIKGRAAHLNFPDLAGVLPRAASASPKDVQAAAALAAAFTTSPSSSPSSSLSADDVAPCVVHADADEQPAAAAKNDDDDGSTTAPVAAAAAAAAADEQQLFDLPDLLFDIQDGPFGFPAMWAPLADVDEVNAELRLEEPLLWDLGVTDA

SEQ ID NO: 1532 - protein, 281 aa, Glycine max; identical to SEQ ID NO: 1516
  misc_feature (1)..(281): Public GI no. 21908034
  misc_feature (1)..(281): Functional Homolog of  Ceres  ID no. 31044
  misc_feature (93)..(144): Pfam Name: AP2 Pfam Description: AP2 domain

SEQ ID NO: 1533 - protein, 281 aa, Glycine max
  misc_feature (1)..(281): Public GI no. 25990951
  misc_feature (1)..(281): Functional Homolog of  Ceres  ID no. 31044
  misc_feature (93)..(144): Pfam Name: AP2 Pfam Description: AP2 domain
MAQELHETSSCSATTTSSCTTSCCSSTVTDSSSSPPSPAAANAAPATRKRQALEAEAEAEAGGEEEEEEEEGCAGNKAAPAKKRPRGSEGKHPTFRGVRMRAWGKWVSEIREPRKKSRIWLGTFPTAEMAARAHDVAALAIKGRAAHLNFPDLAGALPRAASAAPKDVQAAAALAAAFTSPSSEPGAGAHEEPAAKDGAAPEEAAADAQAPVPVALPPPAASRPGTPSSGVEDERQLFDLPDLLLDIRDGFGRFPPMWAPLTDVEEVVNAELRLEEPLLWE

SEQ ID NO: 1534 - protein, 295 aa, Glycine max
  misc_feature (1)..(295): Public GI no. 25990951
  misc_feature (1)..(295): Functional Homolog of  Ceres  ID no. 31044
  misc_feature (98)..(149): Pfam Name: AP2 Pfam Description: AP2 domain
MARQINIESSVSQVTFISSAIPAVSSSSSITASASLSSSPTTSSSSSSSTNSNFIEEDNSKRKASRRSLSSLVSVEDDDDQNGGGGKRRKTNGGDKHPTYRGVRMRSWGKWVSEIREPRKKSRIWLGTYPTAEMAARAHDVAALAIKGTTAYLNFPKLAGELPRPVTNSPKDIQAAASLAAVNWQDSVNDVSNSEVAEIVEAEPSRTVVAQLFSSDTSTTTTTQSQEYSEASCASTSACTDKDSEEEKLFDLPDLFTDENEMMIRNDAFCYYSSTWQLCGADAGFRLEEPFFLSE

SEQ ID NO: 1535 - DNA, 810 bp, Populus balsamifera subsp. trichocarpa
  misc_feature (1)..(810): Ceres ANNOT ID no. 1486207
atggaaaaacatatcatccttgagattgatgcacaagacaattcccttacatcatcttccacttccaccaccaccaccaccaccaccacttcttcctcctcctcttctttttctaccaccatttcatacactgatcgaatctcaaaaaaagaagagaattctattgctgatccaaagggatcgagaaaatctcaagagttgcaaagtggcaatgagggtaataaaaagcgaaagactaccagaaatgagaataatgggaagcatccaacatacagaggagtaagaatgaggagctggggcaaatgggtgtgtgagatcagagagccaaggaagaagtcaagaatatggcttggaacataccctacagccgaaatggctgctcgagcccatgatgtagccgccttagccattaaaggcggctcagcctacctcaatttccctgaattggttgatgaactgcctcgtccactcagcaagtctcctaaggacattcaagctgcagctgccaaggcagccgccgcttcattccccgaaacaagacactgtgaagcagaagctgaagctgaagctgatatgagccatgccgagcttaacgtttccaatttatcagataatttggccatggacaacatacaagagtcaagcagttctccttcaactgatgttgatgacaagttgtttgaccttcctgatctcttcatcgacggcgttaatcacagtgatggattttgttattattctccaccatggcaattatgttctgctgatactggcttccggcttgaagagccatttttatgggagtactag

SEQ ID NO: 1536 - protein, 269 aa, Populus balsamifera subsp. trichocarpa
  misc_feature (1)..(269): Ceres ANNOT ID no. 1486207
  misc_feature (1)..(269): Functional Homolog of  Ceres  ID no. 31044
  misc_feature (89)..(140): Pfam Name: AP2 Pfam Description: AP2 domain
MEKHIILEIDAQDNSLTSSSTSTTTTTTTTSSSSSSFSTTISYTDRISKKEENSIADPKGSRKSQELQSGNEGNKKRKTTRNENNGKHPTYRGVRMRSWGKWVCEIREPRKKSRIWLGTYPTAEMAARAHDVAALAIKGGSAYLNFPELVDELPRPLSKSPKDIQAAAAKAAAASFPETRHCEAEAEAEADMSHAELNVSNLSDNLAMDNIQESSSSPSTDVDDKLFDLPDLFIDGVNHSDGFCYYSPPWQLCSADTGFRLEEPFLWEY

SEQ ID NO: 1537 - DNA, 786 bp, Populus balsamifera subsp. trichocarpa; identical to SEQ ID NO: 681
  misc_feature (1)..(786): Ceres ANNOT ID no. 1496976

SEQ ID NO: 1538 - protein, 261 aa, Populus balsamifera subsp. trichocarpa
  misc_feature (1)..(261): Ceres ANNOT ID no. 1496976
  misc_feature (1)..(261): Functional Homolog of  Ceres  ID no. 31044
  misc_feature (86)..(137): Pfam Name: AP2 Pfam Description: AP2 domain
MEKHINLEIDAQDNPLASSSTTTSTTKGNISSSSTPISCIKHQGSKKEENCIAPRVSRKAQELQSSGNEGGKRRKTTENEKNGKHPTYRGVRMRSWGKWVSEIREPRKKSRIWLGTYPTAEMAARAHDVAALAIKGGSAYLNFPEFAHELPPPLSKSPKDIQAAAAKAAAASFTETRYCEGEGGGEAELNVSNLSDSLAMDNTQESSSSPSTDSDDTLFDLPDLFIDGVHHSDGFCYYSSSWQLCAADTGFRLGEPFLLEY

SEQ ID NO: 1539 - DNA, 1569 bp, Zea mays
  misc_feature (1)..(1569): Ceres CLONE ID no. 325800
  misc_feature (1)..(1569): GEMINI ID 552D1
aagaagagaccaagattagtaccacttgtactgtacactcctcgttccgcgtgcgaagcgaaccctgttccatgttcttgaatctctctgagcccagtccttgtagctagcagatcagatcgctcaggcggaaagatcgagagaaggtcgccccaggatcgagatctagagcgagaaaggtttaagagggaaaggcgcggcaaggagtcgagagaatagaatgttcccttcctccaagaagcaggccagcaccggtgccgcgaacccaaatgatcggcctatgtgcgggcaaggcggcgactccggcggtctcgtcctcaccaccgaccccaagccccgcctccggtggacacccgagctccatgaccgcttcgtcgatgccgtcgcccagctcggaggcccggacaaggcaacgcccaagaccatcatgagggttatgggagtcaagggcctcaccctctaccacctcaagagtcaccttcagaaattcaggctagggaagcagcacaaggagttgggtgaccatacagcaatggagatgcaacgtagcgtggcctcttcttcaggcatgatagcaagaagcatgaacgaccgcagcgtgaatgtgaacgaggccttaaggatccaaatggaagtccaaagaaggctccatggagaactagaggtgcagaagcacctccagatgagggttgaagcccaggggaagtacatgcagtccatcgtggagaaagcataccaagccctcgggtccagcgactgcgccacgtggcccgctgggtacagaactctaggcagccaaggggtccttgacatcggcaccagctccacgagcttctcgtccgtccaggacctgcagtgcttctatggaggaagcagccacatggaccagctcctgcatcagatggagaggccaatggatggcttcctgacgctgggcgagagctgcttcattgggtccgcggacaacaagaaggaccctaataaccattgcagctccagtggcaagagctcgatgatgtgggccagcgaagagcagcaggcaaagagcggcaacgatcagcttcagatggggtcgtcgacaaggatggagggtgcaggcattgatgtcatggatccagtagtcaccgggctgtacgagggcgccgtgtcgggagactccatggacagcaagggttttgagggttcgaactccaggctcgagatgaagccgcctgcacaacaagcacctgtaggaagtcagaggatacgcatatagtcgtccaatatataatggtttggaactcacgtaaagaactgtatactacaatatatggataagcaaggtcaagctaaggtatttaaatgcaagtgtcagttttgttgtgaaccatcaaagttcagacgattagcgtgtgatcggagttgtagtacatgcagtcattagttttgttggatacaagatattatggagatcaattctccatatatatgtttgtttattttgtccctaagattcgccatatatatgctgtattatattggatttgtgtgacacccttgtaacattgatcagagatcttttgtgggtgc

SEQ ID NO: 1540 - protein, 344 aa, Zea mays
  misc_feature (1)..(344): Ceres CLONE ID no. 325800
  misc_feature (1)..(344): GEMINI ID 552D1
  misc_feature (40)..(91): Pfam Name: Myb_DNA-binding Pfam Description: Myb-like DNA-binding domain
MFPSSKKQASTGAANPNDRPMCGQGGDSGGLVLTTDPKPRLRWTPELHDRFVDAVAQLGGPDKATPKTIMRVMGVKGLTLYHLKSHLQKFRLGKQHKELGDHTAMEMQRSVASSSGMIARSMNDRSVNVNEALRIQMEVQRRLHGELEVQKHLQMRVEAQGKYMQSIVEKAYQALGSSDCATWPAGYRTLGSQGVLDIGTSSTSFSSVQDLQCFYGGSSHMDQLLHQMERPMDGFLTLGESCFIGSADNKKDPNNHCSSSGKSSMMWASEEQQAKSGNDQLQMGSSTRMEGAGIDVMDPVVTGLYEGAVSGDSMDSKGFEGSNSRLEMKPPAQQAPVGSQRIRI

SEQ ID NO: 1541 - DNA, 1071 bp, Populus balsamifera subsp. trichocarpa
  misc_feature (1)..(1071): Ceres ANNOT ID no. 1517851
atgttccataccaagaaaccctcaactatgaattcccatgatagacccatgtgtgttcaaggggactctggtcttgtcctcaccacagaccccaagccccgtctccgctggactgttgagctccatgaacgctttgtggatgccgttactcagcttggaggcccagataaggccactcccaaaaccatcatgagagtcatgggtgtgaagggtcttaccctttaccacctcaaaagccatcttcagaaattcagacttggaaagcaaccacacaaggatttcaatgatcattcaattaaggatgcttcggcgttagatcttcaacgaagtgcagcatcttcatctggcatgatgagccgcagtatgaatgagatgcaaatggaggtgcagagaagactgcatgaacaattagaggttcaaagacaccttcaattaaggaccgaggctcaagggaaatatatacaaagtttgttggagaaagcttgccaaaccctagcaggtgatcaaaacttggcttctggaagctataagggaatggggaatcaaggaattcctggtatgggtgcaatgaaagaatttggcacgctgaattttccagcatttcaagaccttaacatttatgggggtgaccaacttgaccttcaacacaatatggataggccatcactcgatggtttcatgccgaacaacgacaacatttgtttgggaaagaagaggcctagtccttacgatggtagtggaaagagccctttgatttggccggacgatctgcgtttgcaggatttgggatcaggaccggcatgtcttgaaccccaagatgatcctttcaaaggtgatcaaatccagatggcaccaccatcaatggataggggtactgatctggattccatatctgacatgtatgaaataaagccagcgcttcagggtgatgcactggatgagaagaaatttgaagcatcagcaaagctaaaaaggccatccccaagaagatcaccactagcagccgaaaggatgagccctatgatcaatactggcgccatgccacaaggcagaaactcaccatttggttga

SEQ ID NO: 1542 - protein, 356 aa, Populus balsamifera subsp. trichocarpa
  misc_feature (1)..(356): Ceres ANNOT ID no. 1517851
  misc_feature (1)..(356): Functional Homolog of  Ceres  ID no. 325800
  misc_feature (34)..(85): Pfam Name: Myb_DNA-binding Pfam Description: Myb-like DNA-binding domain
MFHTKKPSTMNSHDRPMCVQGDSGLVLTTDPKPRLRWTVELHERFVDAVTQLGGPDKATPKTIMRVMGVKGLTLYHLKSHLQKFRLGKQPHKDFNDHSIKDASALDLQRSAASSSGMMSRSMNEMQMEVQRRLHEQLEVQRHLQLRTEAQGKYIQSLLEKACQTLAGDQNLASGSYKGMGNQGIPGMGAMKEFGTLNFPAFQDLNIYGGDQLDLQHNMDRPSLDGFMPNNDNICLGKKRPSPYDGSGKSPLIWPDDLRLQDLGSGPACLEPQDDPFKGDQIQMAPPSMDRGTDLDSISDMYEIKPALQGDALDEKKFEASAKLKRPSPRRSPLAAERMSPMINTGAMPQGRNSPFG

SEQ ID NO: 1543 - DNA, 1044 bp, Populus balsamifera subsp. trichocarpa
  misc_feature (1)..(1044): Ceres ANNOT ID no. 1464534
atgaattcccatgatagacccatgtgtgttcaaggggactctggtcttgtcctcaccacagaccccaagccccgtctccgctggactgttgagctccatgaacgctttgtggatgccgttactcagcttggaggcccagataaggccactcccaaaaccatcatgagagtcatgggtgtgaagggtcttaccctttaccacctcaaaagccatcttcagaaattcagacttggaaagcaaccacacaaggatttcaatgatcattcaattaaggatgcttcggcgttagatcttcaacgaagtgcagcatcttcatctggcatgatgagccgcagtatgaatgagatgcaaatggaggtgcagagaagactgcatgaacaattagaggttcaaagacaccttcaattaaggaccgaggctcaagggaaatatatacaaagtttgttggagaaagcttgccaaaccctagcaggtgatcaaaacttggcttctggaagctataagggaatggggaatcaaggaattcctggtatgggtgcaatgaaagaatttggcacgctgaattttccagcatttcaagaccttaacatttatgggggtgaccaacttgaccttcaacacaatatggataggccatcactcgatggtttcatgccgaacaacgacaacatttgtttgggaaagaagaggcctagtccttacgatggtagtggaaagagccctttgatttggccggacgatctgcgtttgcaggatttgggatcaggaccggcatgtcttgaaccccaagatgatcctttcaaaggtgatcaaatccagatggcaccaccatcaatggataggggtactgatctggattccatatctgacatgtatgaaataaagccagcgcttcagggtgatgcactggatgagaagaaatttgaagcatcagcaaagctaaaaaggccatccccaagaagatcaccactagcagccgaaaggatgagccctatgatcaatactggcgccatgccacaaggcagaaactcaccatttggttga

SEQ ID NO: 1544 - protein, 347 aa, Populus balsamifera subsp. trichocarpa
  misc_feature (1)..(347): Ceres ANNOT ID no. 1464534
  misc_feature (1)..(347): Functional Homolog of  Ceres  ID no. 325800
  misc_feature (25)..(76): Pfam Name: Myb_DNA-binding Pfam Description: Myb-like DNA-binding domain
MNSHDRPMCVQGDSGLVLTTDPKPRLRWTVELHERFVDAVTQLGGPDKATPKTIMRVMGVKGLTLYHLKSHLQKFRLGKQPHKDFNDHSIKDASALDLQRSAASSSGMMSRSMNEMQMEVQRRLHEQLEVQRHLQLRTEAQGKYIQSLLEKACQTLAGDQNLASGSYKGMGNQGIPGMGAMKEFGTLNFPAFQDLNIYGGDQLDLQHNMDRPSLDGFMPNNDNICLGKKRPSPYDGSGKSPLIWPDDLRLQDLGSGPACLEPQDDPFKGDQIQMAPPSMDRGTDLDSISDMYEIKPALQGDALDEKKFEASAKLKRPSPRRSPLAAERMSPMINTGAMPQGRNSPFG

SEQ ID NO: 1545 - DNA, 1071 bp, Populus balsamifera subsp. trichocarpa
  misc_feature (1)..(1071): Ceres ANNOT ID no. 1511678
atgttccataccaagaaaccctcaactatgaattcccatgatagacccatgtgtgttcaagactctggtcttgtcctcaccacagaccctaagccccgtctccgctggactgttgagctccatgaacgctttgtggatgctgttgctcagcttggaggccctgacaaggccactccaaaaaccatcatgagagtcatgggtgtgaagggtcttaccctttaccacctcaaaagccatcttcagaaattcagacttggaaagcaactacacaaagaattcaatgatcattcaatcaaggatgcttcggcgttagatcttcaacgaagcgcagcatcttcatccggcatgattagccgcagtatgaatgagatgcaaatggaggtgcagagaagactgcacgaacaattagaggttcaaagacaccttcaattaaggactgaagctcaaggaaaatatatacaaagtttgttggagaaagcttgccaaaccctagcaggtgatcaagacttggcttctggaagctacaagggaattgggaatcaaggagttcctgatatgggtgcaatgaaagactttggtccgcttaattttccaccatttcaagaccttaacatttatgggagtggccagcttgaccttctacacaatatggataggccatcacttgatggtttcatgtccaacaatcatgacgacatttgtttgggaaagaagaggactaatccttatgctggtagtggcaagagccctttgatttggtcggacgatctgcgtttgcaagatttgggatcgggactgtcatgtcttggacctcaagatgatcctttgaaaggtgaccagatccagattgcaccaccattaatggatagtggcactgatctggattcgttatctggtttatatggaacaaagccagtacatcagggtgatgcactggatgaaaagaaattggaagcatcagcaaagactgaaaggccatcaccaagaagagcaccacttgcagcagacaggatgagccctatgatcaataccggtgtcatgccacaaggcagaaactcaccatttggttga

SEQ ID NO: 1546 - protein, 356 aa, Populus balsamifera subsp. trichocarpa
  misc_feature (1)..(356): Ceres ANNOT ID no. 1511678
  misc_feature (1)..(356): Functional Homolog of  Ceres  ID no. 325800
  misc_feature (33)..(84): Pfam Name: Myb_DNA-binding Pfam Description: Myb-like DNA-binding domain
MFHTKKPSTMNSHDRPMCVQDSGLVLTTDPKPRLRWTVELHERFVDAVAQLGGPDKATPKTIMRVMGVKGLTLYHLKSHLQKFRLGKQLHKEFNDHSIKDASALDLQRSAASSSGMISRSMNEMQMEVQRRLHEQLEVQRHLQLRTEAQGKYIQSLLEKACQTLAGDQDLASGSYKGIGNQGVPDMGAMKDFGPLNFPPFQDLNIYGSGQLDLLHNMDRPSLDGFMSNNHDDICLGKKRTNPYAGSGKSPLIWSDDLRLQDLGSGLSCLGPQDDPLKGDQIQIAPPLMDSGTDLDSLSGLYGTKPVHQGDALDEKKLEASAKTERPSPRRAPLAADRMSPMINTGVMPQGRNSPFG

SEQ ID NO: 1547 - DNA, 1044 bp, Populus balsamifera subsp. trichocarpa
  misc_feature (1)..(1044): Ceres ANNOT ID no. 1458433
atgaattcccatgatagacccatgtgtgttcaagactctggtcttgtcctcaccacagaccctaagccccgtctccgctggactgttgagctccatgaacgctttgtggatgctgttgctcagcttggaggccctgacaaggccactccaaaaaccatcatgagagtcatgggtgtgaagggtcttaccctttaccacctcaaaagccatcttcagaaattcagacttggaaagcaactacacaaagaattcaatgatcattcaatcaaggatgcttcggcgttagatcttcaacgaagcgcagcatcttcatccggcatgattagccgcagtatgaatgagatgcaaatggaggtgcagagaagactgcacgaacaattagaggttcaaagacaccttcaattaaggactgaagctcaaggaaaatatatacaaagtttgttggagaaagcttgccaaaccctagcaggtgatcaagacttggcttctggaagctacaagggaattgggaatcaaggagttcctgatatgggtgcaatgaaagactttggtccgcttaattttccaccatttcaagaccttaacatttatgggagtggccagcttgaccttctacacaatatggataggccatcacttgatggtttcatgtccaacaatcatgacgacatttgtttgggaaagaagaggactaatccttatgctggtagtggcaagagccctttgatttggtcggacgatctgcgtttgcaagatttgggatcgggactgtcatgtcttggacctcaagatgatcctttgaaaggtgaccagatccagattgcaccaccattaatggatagtggcactgatctggattcgttatctggtttatatggaacaaagccagtacatcagggtgatgcactggatgaaaagaaattggaagcatcagcaaagactgaaaggccatcaccaagaagagcaccacttgcagcagacaggatgagccctatgatcaataccggtgtcatgccacaaggcagaaactcaccatttggttga

SEQ ID NO: 1548 - protein, 347 aa, Populus balsamifera subsp. trichocarpa
  misc_feature (1)..(347): Ceres ANNOT ID no. 1458433
  misc_feature (1)..(347): Functional Homolog of  Ceres  ID no. 325800
  misc_feature (24)..(75): Pfam Name: Myb_DNA-binding Pfam Description: Myb-like DNA-binding domain
MNSHDRPMCVQDSGLVLTTDPKPRLRWTVELHERFVDAVAQLGGPDKATPKTIMRVMGVKGLTLYHLKSHLQKFRLGKQLHKEFNDHSIKDASALDLQRSAASSSGMISRSMNEMQMEVQRRLHEQLEVQRHLQLRTEAQGKYIQSLLEKACQTLAGDQDLASGSYKGIGNQGVPDMGAMKDFGPLNFPPFQDLNIYGSGQLDLLHNMDRPSLDGFMSNNHDDICLGKKRTNPYAGSGKSPLIWSDDLRLQDLGSGLSCLGPQDDPLKGDQIQIAPPLMDSGTDLDSLSGLYGTKPVHQGDALDEKKLEASAKTERPSPRRAPLAADRMSPMINTGVMPQGRNSPFG

SEQ ID NO: 1549 - DNA, 906 bp, Populus balsamifera subsp. trichocarpa
  misc_feature (1)..(906): Ceres ANNOT ID no. 1529923
atgtactctgcaatacactcactgcctttggatggacatggggactttcaagcttcattagatggaattaatctgcctggggatgcgtgcttggttctcaccacggatccaaagccaaggctccgctggactgctgagttacatgagagatttgttgatgctgttactcaacttggtggacctgacaaagcaacacctaagacaattatgagaacaatgggggtaaaaggcctcaccctttatcacttgaaatctcacctacagaaataccggttgggaaagcagtcctgcaaggaatcaactgataactccaaggatgaaagtcaggatactggttcatcgacatctgcatcatcaagaatgattgcgcaggatctgaatgatggttaccaggttactgaggctttgagagtgcagatggaagtccaacgaagattgcatgagcagctggaggtgcaacatcatctccaacttcgcattgaagctcaggggaaatacttacagtcaatacttgagaaagcttgtaaagctctgaatgaccaggctgttgcaactgcaggacttgaagctgctagggaagagctttctgaattagcaatcaaggtttccaatgaatgtgcaggaattgccccacttgataccatgaaaatgccttccttatctgaacttgctgctgctttagggaacagaaatgcttccaatgtgcctgctcgcattggtgattgctctgtcgaaagctgcttgacttcaactagtagcccagtttctcccatgggtgtgggctcacaagttgcttccacgaagaaaagatcaaggcctgtgcttggtaacggagattcattgcccttcgaaggcaactttcggcaagaagtagaatggacaatgagtaatattgtggatgaatag

SEQ ID NO: 1550 - protein, 301 aa, Populus balsamifera subsp. trichocarpa
  misc_feature (1)..(301): Ceres ANNOT ID no. 1529923
  misc_feature (1)..(301): Functional Homolog of  Ceres  ID no. 325800
  misc_feature (40)..(91): Pfam Name: Myb_DNA-binding Pfam Description: Myb-like DNA-binding domain
MYSAIHSLPLDGHGDFQASLDGINLPGDACLVLTTDPKPRLRWTAELHERFVDAVTQLGGPDKATPKTIMRTMGVKGLTLYHLKSHLQKYRLGKQSCKESTDNSKDESQDTGSSTSASSRMIAQDLNDGYQVTEALRVQMEVQRRLHEQLEVQHHLQLRIEAQGKYLQSILEKACKALNDQAVATAGLEAAREELSELAIKVSNECAGIAPLDTMKMPSLSELAAALGNRNASNVPARIGDCSVESCLTSTSSPVSPMGVGSQVASTKKRSRPVLGNGDSLPFEGNFRQEVEWTMSNIVDE

SEQ ID NO: 1551 - DNA, 1338 bp, Arabidopsis thaliana
  misc_feature (1)..(1338): Ceres CLONE ID no. 33333
  misc_feature (1)..(1338): GEMINI ID 553C11
acgaccttttgtttctctcttctctattaatactatagttttcctcaaactctctgattagctcataattactaaaccagttgaccatttttttctgataaacaatcaatggcaaggtcaccttgttgcgagaagaacggactcaagaaagggccatggacatctgaagaagaccagaagcttgttgactatatccagaaacatggttatggtaactggagaaccctccccaaaaatgccggtttgcaaagatgtggcaaaagttgtaggttaaggtggactaattatctccgaccagatataaagcgaggaaggttctcttttgaggaagaagaaaccattattcagcttcatagcttcttaggaaacaagtggtctgcgattgcggcgcgtttaccaggaagaacagataatgagatcaagaacttttggaacactcatataagaaagaagctacttagaatggggattgatccagtgactcacagtccacgactcgatctcctcgatatctcatccatcttagcttcatctctatacaattcatcttcacatcacatgaacatgtcaagactcatgatggatactaatcgtcgtcatcaccagcaacatccattggttaaccccgagatactcaagctcgctacctctctcttctctcaaaatcaaaaccaagaaccttgtggtggatcatgactcgagaactcaagagaagcaaacagtttatagccaaaccggagtaaaccaataccaaaccgaccaatatttcgagaacacgattactcaagaactccaatcttccatgccaccattccccaatgaagctcatcagtttaacaacatggatcatcacttcaatggttttggagaacaaaatcttgtttcaacttctactacgtcagtccaagattgctataatccgtcattcaacgattattcaagttcaaattttgtcttggatccttcttattcggatcagagcttcaacttcgcaaattcggtcttaaacacgccatcctcgagcccgagcccgactacgttaaactcgagttacatcaatagtagcagttgcagcactgaggatgaaatagaaagctattgcagtaatctcatgaagtttgatattcccgatttcttggacgttaatggttttattatataattccaagaaacaaaataaaactcgagtgggatacagttttctttttattctttgttgtaatcttaagacttttttttttgtttttccgatttgtttacttgtaaaatactgttttcgttttgttgttaatttgttatatttctctagagtttatagctaataccatttttaaaatt

SEQ ID NO: 1552 - protein, 195 aa, Arabidopsis thaliana
  misc_feature (1)..(195): Ceres CLONE ID no. 33333
  misc_feature (1)..(195): GEMINI ID 553C11
  misc_feature (67)..(112): Pfam Name: Myb_DNA-binding Pfam Description: Myb-like DNA-binding domain
MARSPCCEKNGLKKGPWTSEEDQKLVDYIQKHGYGNWRTLPKNAGLQRCGKSCRLRWTNYLRPDIKRGRFSFEEEETIIQLHSFLGNKWSAIAARLPGRTDNEIKNFWNTHIRKKLLRMGIDPVTHSPRLDLLDISSILASSLYNSSSHHMNMSRLMMDTNRRHHQQHPLVNPEILKLATSLFSQNQNQEPCGGS

SEQ ID NO: 1553 - DNA, 1038 bp, Populus balsamifera subsp. trichocarpa
  misc_feature (1)..(1038): Ceres ANNOT ID no. 1501772
atgggtagagcaccttgttgtgacaaaaatgggctaaagaaagggccttggaccccggaagaggatcagaagctggttgattacatacaaaaacatggctatggcaactggaggacacttccaaagaatgctgggttgcaaaggtgcggaaagagttgtcgtcttcgttggaccaactatctgaggcctgatatcaagagaggtcggttttctttcgaagaagaggagacaataattcagctgcatagtatattgggaaacaagtggtctgccattgctgctcgattgcctggaagaacagacaacgagatcaagaactactggaacacacacattaggaagaggcttctaagaatgggaattgatccggtgactcatagtccaagacttgatcttcttgacctctcctcaatcctgagctcatctctttacaactcctctgatcaaatgaacatgtcaagaatgcttggtgtcccacctttagtgaacccaggacttctaaggctagccacatctctcttatcttctcaacgtgaccaaacccaaaacttcgtcatccaaaatggtcaagaagaaaaccatcttcccaacccacaagtccaacaaagccaatacgaatcgatgattcatcaagctaatatccagtttcaaaccccaggtcaagaaatgcctacttgcaccacattgactaccagcccctgtgttacattttctaacgaatggcaaaacaatggaatgggctccaatttagctgaagattattatgtgcctgctgtatcaagttacaacagcaacggctactatgggtctgaccttatggacccttcttccgagacctcgacttttatctccaacagcagcaaccagaactttggttttgcttcagttttatcaactccttcttcaagtcctacgccattgaactccaattcaacttacatcaatagcagcagcgctgaagatgagagggaaagctactgcagcaacatcttgaaattcgaaatcccagatattttggatgctattaacttcatgtaa

SEQ ID NO: 1554 - protein, 345 aa, Populus balsamifera subsp. trichocarpa
  misc_feature (1)..(345): Ceres ANNOT ID no. 1501772
  misc_feature (1)..(345): Functional Homolog of  Ceres  ID no. 33333
  misc_feature (67)..(112): Pfam Name: Myb_DNA-binding Pfam Description: Myb-like DNA-binding domain
MGRAPCCDKNGLKKGPWTPEEDQKLVDYIQKHGYGNWRTLPKNAGLQRCGKSCRLRWTNYLRPDIKRGRFSFEEEETIIQLHSILGNKWSAIAARLPGRTDNEIKNYWNTHIRKRLLRMGIDPVTHSPRLDLLDLSSILSSSLYNSSDQMNMSRMLGVPPLVNPGLLRLATSLLSSQRDQTQNFVIQNGQEENHLPNPQVQQSQYESMIHQANIQFQTPGQEMPTCTTLTTSPCVTFSNEWQNNGMGSNLAEDYYVPAVSSYNSNGYYGSDLMDPSSETSTFISNSSNQNFGFASVLSTPSSSPTPLNSNSTYINSSSAEDERESYCSNILKFEIPDILDAINFM

SEQ ID NO: 1555 - DNA, 1014 bp, Populus balsamifera subsp. trichocarpa
  misc_feature (1)..(1014): Ceres ANNOT ID no. 1519164
atggggagggcaccttgctgtgaaaaaaaggggctaaagaaagggccgtggacaccagatgaggatcagaagctgattgattacatacaaaaacatggctatggcaactggagaacacttccaaagaatgctgggttgcagaggtgtggaaagagttgtcgtcttcgttggactaactatttgaggcctgatatcaagagaggtcgattttctttcgaggaagaagagacaataattcagctacatggtattttgggaaacaagtggtctgccattgctgctcgactgcctggaagaaccgacaacgaaatcaagaactactggaacacacacatcaggaaaaggcttctgagaatgggaattgatccagtgactcatagtccaaggcttgatcttttagacctctcctcaatcctcaactcgcctctttacgactccaggatgaacatgtcaagagttcttggggttcaacctctaggcgacccagaactcttaaggctagccacatctctcttatcttctcaacgtgaccaaacccaagattttgctatccaaaatggtcatcaagaaaaccatctttccagcccacaagtccatcaaacacagcaaatggaccccaacgtagaccaataccaattaagcactattaccagctttagctctccaaattctcagttaagcacacatgatcagtggcaaagcaacaggatgggctcgaatttatcacaagattattatctgcctgcagtatcaagttacaacagcgccgacaactgccatgggactgatcttgtagacccttcttctgaggcctcaacttttatttccaataacagcaaccaaacctttggttttgcttcagttttatcaactccttcctcaagtccagcgccattgaactccaattcaacatacatcaattgcagcagcactgaagatgagagggatagctattgcagcaacatcttgaaattcgaaatcccagatattttagatgtcagtaacttcatgtaa

SEQ ID NO: 1556 - protein, 337 aa, Populus balsamifera subsp. trichocarpa
  misc_feature (1)..(337): Ceres ANNOT ID no. 1519164
  misc_feature (1)..(337): Functional Homolog of  Ceres  ID no. 33333
  misc_feature (14)..(61): Pfam Name: Myb_DNA-binding Pfam Description: Myb-like DNA-binding domain
MGRAPCCEKKGLKKGPWTPDEDQKLIDYIQKHGYGNWRTLPKNAGLQRCGKSCRLRWTNYLRPDIKRGRFSFEEEETIIQLHGILGNKWSAIAARLPGRTDNEIKNYWNTHIRKRLLRMGIDPVTHSPRLDLLDLSSILNSPLYDSRMNMSRVLGVQPLGDPELLRLATSLLSSQRDQTQDFAIQNGHQENHLSSPQVHQTQQMDPNVDQYQLSTITSFSSPNSQLSTHDQWQSNRMGSNLSQDYYLPAVSSYNSADNCHGTDLVDPSSEASTFISNNSNQTFGFASVLSTPSSSPAPLNSNSTYINCSSTEDERDSYCSNILKFEIPDILDVSNFM

SEQ ID NO: 1557 - DNA, 1095 bp, Populus balsamifera subsp. trichocarpa
  misc_feature (1)..(1095): Ceres ANNOT ID no. 1480076
atgggaagagtaccttgctgtgacaaaaatggactcaagaaaggtccttggaccccagaagaagatcacaagctcatcagttttattcaacttcacggacctggcaactggcggtccctccccaaaaatgcagggcttcaaagatgtggaaagagctgtcgccttcgttggacaaattacctgagacctgatatcaagagaggaagattttcatttgaagaagaagagactataattcaacttcacagtgttttgggaaacaagtggtcagctatagcagctcgtttgccaggaagaactgacaatgaaatcaagaattactggaatactcatataagaaaaaggttgcttagaaatggaattgatcctgtgactcatgccccacgtcttgatcttcttgacctatcctccattataagttcagctttgtgcaacccatcaacacttctcaatctgtcaaccttggtgggcaacactcaagccctactaaatcctaatattttaagactagccaccactctatcatcattgaaacaagaaaattcggacatgtttttgcagaaactacaagaaaaccagcttttcaacccactgttacaaaaccaagatgtcccttcattattttcacaacctaggcagtttcataatctagctcaacaagttcctgcttgtactactgctactacatctactggcgggtttatagaccaaacaacacaagtcatgcaagcaaatgtagaagggttttcgtcgaatccgacgagcactttcaactgccaaaattccccagaaaacttcgtgccttcaagtttgaatgagagtttggtttcactgccaaacttttattgcaatggtactactacagatcctacagttcctgaacctggagagcactcaggattccaatcagcaaacaatggatatcagaacttcagcatcgactcagttatatcaacgcctttaatgagcccggatccattgaactcatcatcaacttatctcaacagcagcagtactgaggatgagagggagtgctacagcagcttgttgaagtttgaaattcctgagagtttgaacattgatgatttcctgtaa

SEQ ID NO: 1558 - protein, 364 aa, Populus balsamifera subsp. trichocarpa
  misc_feature (1)..(364): Ceres ANNOT ID no. 1480076
  misc_feature (1)..(364): Functional Homolog of  Ceres  ID no. 33333
  misc_feature (67)..(112): Pfam Name: Myb_DNA-binding Pfam Description: Myb-like DNA-binding domain
MGRVPCCDKNGLKKGPWTPEEDHKLISFIQLHGPGNWRSLPKNAGLQRCGKSCRLRWTNYLRPDIKRGRFSFEEEETIIQLHSVLGNKWSAIAARLPGRTDNEIKNYWNTHIRKRLLRNGIDPVTHAPRLDLLDLSSIISSALCNPSTLLNLSTLVGNTQALLNPNILRLATTLSSLKQENSDMFLQKLQENQLFNPLLQNQDVPSLFSQPRQFHNLAQQVPACTTATTSTGGFIDQTTQVMQANVEGFSSNPTSTFNCQNSPENFVPSSLNESLVSLPNFYCNGTTTDPTVPEPGEHSGFQSANNGYQNFSIDSVISTPLMSPDPLNSSSTYLNSSSTEDERECYSSLLKFEIPESLNIDDFL

SEQ ID NO: 1559 - DNA, 1089 bp, Populus balsamifera subsp. trichocarpa
  misc_feature (1)..(1089): Ceres ANNOT ID no. 1524008
atgggaagagcaccttgctgtgacaaaaatggactcaagaaaggtccttggactcctgaagaagatcaaaagctcaccgcttatattcaacttcagggacctggaaactggcgttccctccccaaaaatgctgggctccaaaggtgtggaaagagctgtcgtcttcgttggacaaactacctgaggcctgatatcaagagaggaagattttcatttgaagaagaagagtctataattcaacttcacagtattttgggaaacaagtggtcagctatagcagctcgtttaccaggaagaactgacaatgaaatcaagaattattggaacactcatataaggaaaaggttgcttagaaatggaattgatccagtgactcatgcctcacgtcttgatcttcttgacctatcctctattctgagttcagctttgtgtaacccatcatcactactcactctgtcaaccttggtgggcaatactcaagccctactaaatcctgatatttttagactatccaccactctatcatcgttgaaacaagaaaattcagacctgtttttgcagcaactacaagaaaacgagctttgcagctcactgttacaaaaccaagctatccctacattatcgtcacaatctaaccagtttcagaatcaagctgaactaattcctgcttgcactactactacatctactggcacatttctaaaccaaacaacaccacttatgctagcaaatgtggaagggttttcaccgaatacaacaagtacttttagctgccaaaattcacaagaaaattccgtgcctttgaacgagggattggtttcacagccaaacttttattgcaatagtactactacaacaaatcctacagttcctgaacttgaagagtactcaggattccaatcagcaaacaacggctatcggaattttagcattggctcggttatttcaacgcgttttacgagcccggatccattgaattcaccatcaacatatgtcaacagcagcagtactgaggatgacagggagtgctacagcagcttgttgaagttcgaaattccagagagtttcgacattgatgatttcctgtaa

SEQ ID NO: 1560 - protein, 362 aa, Populus balsamifera subsp. trichocarpa
  misc_feature (1)..(362): Ceres ANNOT ID no. 1524008
  misc_feature (1)..(362): Functional Homolog of  Ceres  ID no. 33333
  misc_feature (67)..(112): Pfam Name: Myb_DNA-binding Pfam Description: Myb-like DNA-binding domain
MGRAPCCDKNGLKKGPWTPEEDQKLTAYIQLQGPGNWRSLPKNAGLQRCGKSCRLRWTNYLRPDIKRGRFSFEEEESIIQLHSILGNKWSAIAARLPGRTDNEIKNYWNTHIRKRLLRNGIDPVTHASRLDLLDLSSILSSALCNPSSLLTLSTLVGNTQALLNPDIFRLSTTLSSLKQENSDLFLQQLQENELCSSLLQNQAIPTLSSQSNQFQNQAELIPACTTTTSTGTFLNQTTPLMLANVEGFSPNTTSTFSCQNSQENSVPLNEGLVSQPNFYCNSTTTTNPTVPELEEYSGFQSANNGYRNFSIGSVISTRFTSPDPLNSPSTYVNSSSTEDDRECYSSLLKFEIPESFDIDDFL

SEQ ID NO: 1561 - DNA, 1056 bp, Populus balsamifera subsp. trichocarpa
  misc_feature (1)..(1056): Ceres ANNOT ID no. 1480159
atgggaaaatctccttgttgtgagaaaaatggactaaagaaaggtccatggacagaagaggaagataaaaaattgattagctacattcagaaacatgggcatggaagatggcgactcctaccaaaaaatgcaggactcaaaagatgtggaaagagttgtcgtcttcgatggactaattacttgaggcccgacatcaagagaggaaagctctcatttgaagaagaagagacaataattcagctgcatagtgttttgggaaataagtggtctgcaattgctactcgcttgcctggacgaactgataacgaaatcaagaattattggaacacccacataaggaaacggctactgaggatgggaatcgatcctgtgactcataagccacacctagatcttcttcaactctactcggttctcaactcgactgtccacaactcatctcagcttaatatttcaagttcgcttggcattggacccattttgagcccagatctcttgaatctagccactccttacttgtcatgccaaggcaactatattagccaagatgtcagtccaaaacttgttcaagatagccaagttggaaacaaccatgttcaaaaccaatttcaatgcttccaaccaaacgagctccaaaaccaaatccaagcttgtacaaatacactaagtgctcaatttctgtatgaaacccagattagtgcagccaatttggaacaactttcttgcaaccccaccaactttagttgtcaaaattctctacgaagttcgtggcacgctaacggagagagtactcccgatatttgtgaaagtctcatgtcaaactacgtgtatcatgattctaataataaacccatcaccaacgatatttcctttgagacactacaaagtttgagtttcggctcgcttctgtctacaccttcatctagtacaactcccttgcgttcttcatcaacgacttatgtcaatgtcagcactgaagatgagaaggatagttactgcagcaatatgttggtgttcgacatgcccaacagcttggatgccagtaggctcatttag

SEQ ID NO: 1562 - protein, 351 aa, Populus balsamifera subsp. trichocarpa
  misc_feature (1)..(351): Ceres ANNOT ID no. 1480159
  misc_feature (1)..(351): Functional Homolog of  Ceres  ID no. 33333
  misc_feature (14)..(61): Pfam Name: Myb_DNA-binding Pfam Description: Myb-like DNA-binding domain
MGKSPCCEKNGLKKGPWTEEEDKKLISYIQKHGHGRWRLLPKNAGLKRCGKSCRLRWTNYLRPDIKRGKLSFEEEETIIQLHSVLGNKWSAIATRLPGRTDNEIKNYWNTHIRKRLLRMGIDPVTHKPHLDLLQLYSVLNSTVHNSSQLNISSSLGIGPILSPDLLNLATPYLSCQGNYISQDVSPKLVQDSQVGNNHVQNQFQCFQPNELQNQIQACTNTLSAQFLYETQISAANLEQLSCNPTNFSCQNSLRSSWHANGESTPDICESLMSNYVYHDSNNKPITNDISFETLQSLSFGSLLSTPSSSTTPLRSSSTTYVNVSTEDEKDSYCSNMLVFDMPNSLDASRLI

SEQ ID NO: 1563 - DNA, 1364 bp, Zea mays
  misc_feature (1)..(1364): Ceres CLONE ID no. 333416
  misc_feature (1)..(1364): GEMINI ID 538H6
atcagtccaatcatatcccagcacgaagagccgccgcaatcctcctccccgtcccctaccttcgtcggtgctctcacccgccgctggtcgccattcctccagatcggcgcccagctcgcagcccactaggcgttgcgctccctctccaaacccaacgaaaccccaggggaaccctcatccccctgtcgtctcccttattgggggccagacatggagagcaagcaatgggggaagacgccccaggaggtggtgggcgcaggcggcggtcgccaagtggatctagatgaagaggatgacctggaggagttccggctgcccatgggccaccgccccaccgagaacctcgacacggaggggctccagcaggcctctgtctacacccagctcaccgcgtccaacgtcggtttcaggctactgcagaagatgggctggaagaccggcaaggggctcggcaagaacgagcaaggtatactagagccaataagagctgacatgagagatgcaaaattaggtgttgggaagcaagaggaagatgacttcttcacatctgaagagaatgtgcaacgaaagaaattgaatattgaacttgaggagactgaggaacatataaagaaacgggaggtcatagcagagcgtgagcacaaaatccgcagtgaagtcaaggagatacagaaggtgtttttttgcaacctctgcaataagcagtacaagctggctcatgaatttgagagtcacttgagctcatatgaccacaatcataggaagaggtttaaggaaatgagagaaatgcagagcagcagtggtagtcgagatgacagacagaaacgtgaacaacaacgagaagagaaggagctggcaaaaattgctcaacttgcggatgctcataggaagcagcagaagggataagcaagaaaagtcagagacggaggatgcggcacccaaaaacatggcagcctctagcaaccaggatcagaggcaaaccttgaagttcggattctctaaaatggctccttccaaggttctagttggtagtgccagcaagaagccaaaggttgccacgaaagtttcttctgtctttggcaacgagagtgatgaggactcgtgacctttgccagagggtggcagttgcttcttctgtcgtggcatttggtctggggacttgataacagcatcgagaattgtatgaacttttgagggtacactgtataaggaaatctgtactgttgttgctggattttggaagctgtttattaaccattcgcccttgtaggcaggcaatacccttcagtttgggacacacctttgtattgtaggctgtactatcgttgttggcttttaatgttaaaaaaaaacctttgtattcg

SEQ ID NO: 1564 - protein, 297 aa, Zea mays
  misc_feature (1)..(297): Ceres CLONE ID no. 333416
  misc_feature (1)..(297): GEMINI ID 538H6
  misc_feature (61)..(105): Pfam Name: G-patch Pfam Description: G-patch domain
MESKQWGKTPQEVVGAGGGRQVDLDEEDDLEEFRLPMGHRPTENLDTEGLQQASVYTQLTASNVGFRLLQKMGWKTGKGLGKNEQGILEPIRADMRDAKLGVGKQEEDDFFTSEENVQRKKLNIELEETEEHIKKREVIAEREHKIRSEVKEIQKVFFCNLCNKQYKLAHEFESHLSSYDHNHRKRFKEMREMQSSSGSRDDRQKREQQREEKELAKIAQLADAHRKQQKDKQEKSETEDAAPKNMAASSNQDQRQTLKFGFSKMAPSKVLVGSASKKPKVATKVSSVFGNESDEDS

SEQ ID NO: 1565 - DNA, 888 bp, Populus balsamifera subsp. trichocarpa; identical to SEQ ID NO: 1378
  misc_feature (1)..(888): Ceres ANNOT ID no. 1469082

SEQ ID NO: 1566 - protein, 295 aa, Populus balsamifera subsp. trichocarpa; identical to SEQ ID NO: 1379
  misc_feature (1)..(295): Ceres ANNOT ID no. 1469082
  misc_feature (1)..(295): Functional Homolog of  Ceres  ID no. 333416
  misc_feature (63)..(106): Pfam Name: G-patch Pfam Description: G-patch domain

SEQ ID NO: 1567 - DNA, 876 bp, Populus balsamifera subsp. trichocarpa; identical to SEQ ID NO: 1380
  misc_feature (1)..(876): Ceres ANNOT ID no. 1522474

SEQ ID NO: 1568 - protein, 291 aa, Populus balsamifera subsp. trichocarpa; identical to SEQ ID NO: 1381
  misc_feature (1)..(291): Ceres ANNOT ID no. 1522474
  misc_feature (1)..(291): Functional Homolog of  Ceres  ID no. 333416
  misc_feature (63)..(106): Pfam Name: G-patch Pfam Description: G-patch domain

SEQ ID NO: 1569 - DNA, 1190 bp, Arabidopsis thaliana
  misc_feature (1)..(1190): Ceres CLONE ID no. 34589
  misc_feature (1)..(1190): GEMINI ID 535F5
ataaaagaccattctacttctatatatatatatagtgtgagtgagacagagcctcacataaataaaaagtctcctaatctgaatacaactattactaacaataattcacttatctaaagaccatcatctgactgactctacgctgaatcatcacgaggaagaacttgaatcgaccggagaagagatacgtgtagagatctgattggctcaccggagagaacaaaacaagaaatggggaggacgacgtggttcgacgttgacgggttgaggaaaggagagtggacggcggaggaagaccggaagctcgtggtttacatcaacgaacacggtctaggcgagtggggttcactgcctaagagagccggtctacaaagatgtggaaagagttgtagattaagatggctgaattatttgaggcctgggattaaaagaggcaagttcactcctcaggaggaagaagaaatcatcaaataccatgctcttcttggaaacaggtgggcagcaatagctaagcaaatgccaaacagaacagacaataacataaagaaccattggaactcatgccttaagaaaagacttgctaaaaaaggaatcgatccaatgacccatgagccaacaacaacaacaagcctcaccgtcgatgtcacctcctcatcaactacgtcgtctcctacaccgagccctacttcttcttctttttcctcctgttcctctactggctctgcacgtttccttaacaagctcgctgctggaatctcgtcaagaaaacacggactagagagtatcaagacagtgatattggcagaacaaccaagagaagccgttgatgaagagaagatgatgacaattaacatgaaagagaaggaattgattagttgttacatggagattgatgagacgatgagtattgatgaactaccttgtgatgactcgacgtctggcttcgtggcttttgacgactactcattaatcgacccatacagagacagtgtgtacgtatctgatttctacgatgagactgaacaccttgacctgttccttctttgaatcacatttcctttgtctaaataaatccgcttctttagtgtgacgagagagacagtggagagagatgtctgaaaaaaacaagtgctgattagtactttgaatgacatgcatggtcaatgttgttttacagctttgagcctttg

SEQ ID NO: 1570 - protein, 271 aa, Arabidopsis thaliana
  misc_feature (1)..(271): Ceres CLONE ID no. 34589
  misc_feature (1)..(271): GEMINI ID 535F5
  misc_feature (67)..(112): Pfam Name: Myb_DNA-binding Pfam Description: Myb-like DNA-binding domain
MGRTTWFDVDGLRKGEWTAEEDRKLVVYINEHGLGEWGSLPKRAGLQRCGKSCRLRWLNYLRPGIKRGKFTPQEEEEIIKYHALLGNRWAAIAKQMPNRTDNNIKNHWNSCLKKRLAKKGIDPMTHEPTTTTSLTVDVTSSSTTSSPTPSPTSSSFSSCSSTGSARFLNKLAAGISSRKHGLESIKTVILAEQPREAVDEEKMMTINMKEKELISCYMEIDETMSIDELPCDDSTSGFVAFDDYSLIDPYRDSVYVSDFYDETEHLDLFLL

SEQ ID NO: 1571 - protein, 191 aa, Glycine max
  misc_feature (1)..(191): Ceres CLONE ID no. 539578
  misc_feature (1)..(191): Functional Homolog of  Ceres  ID no. 34589
  misc_feature (108)..(171): Pfam Name: bZIP_1 Pfam Description: bZIP transcription factor
MSLPRPSEGKAPSQLKEGVAPAAAEASTSSSWNNRLNTFPPLSLHNKNSKIEDSDEDMFTVPDVEATPINVHSAVTLQNSNLNQRNVTDPQFQSGFPGKRRRGRNPADKEHRRLKRLLRNRVSAQQARERKKVYVNDLESRAKEMQDKNAILEERISTLINENTMLRKVLMNARPKNDDSIEQKQDQLSKS

SEQ ID NO: 1572 - DNA, 969 bp, Arabidopsis thaliana
  misc_feature (1)..(969): Ceres CLONE ID no. 36272
  misc_feature (1)..(969): GEMINI ID 531H5
  misc_feature (1)..(969): GEMINI ID 87F4
aagattttccagatcttaaattctctcctcccccaattccatcttcgcaaattctccagattcttccgtcaatctttgagtttggtagagaaatggatcaacaaggacaatcatcagctatgaactatggttcaaacccatatcaaaccaacgccatgaccactacaccaaccggttcagaccatccagcttaccatcagatccaccagcaacaacaacaacagctcactcaacagcttcaatctttctgggagactcaattcaaagagattgagaaaaccactgatttcaagaaccatagccttccattggcaagaatcaagaaaatcatgaaagctgatgaagatgtgcgtatgatctcggccgaggcgcctgttgtgttcgccagggcctgcgagatgtttattctggagcttacgttaaggtcttggaaccatactgaggagaacaagagaaggacgttgcagaagaatgatatcgcggctgcggtgactagaactgatatttttgattttcttgtggatattgttcctcgggaggatcttcgtgatgaagtcttgggtggtgttggtgctgaagctgctacagctgcgggttatccgtatggatacttgcctcctggaacagctccaattgggaacccgggaatggttatgggtaacccgggcgcgtatccgccgaacccgtatatgggtcagccaatgtggcaacaaccaggacctgagcagcaggatcctgacaattagcttggcctaataaactagccgtctaattcgaagctctccccggtggatctactcaagaagaagaatgttaatagaaaactattgcgacataaaaagtttggtgtagtagaataatttctgttttatgatccatggatttatctattgttattcagtttggtttatcttgtcatcaaactgttttcggtcaatgtaacaaattcataaactgagaattgaactt

SEQ ID NO: 1573 - protein, 217 aa, Arabidopsis thaliana
  misc_feature (1)..(217): Ceres CLONE ID no. 36272
  misc_feature (1)..(217): GEMINI ID 531H5
  misc_feature (1)..(217): GEMINI ID 87F4
  misc_feature (69)..(133): Pfam Name: CBFD_NFYB_HMF Pfam Description: Histone-like transcription factor (CBF/NF-Y) and archaeal histone
MDQQGQSSAMNYGSNPYQTNAMTTTPTGSDHPAYHQIHQQQQQQLTQQLQSFWETQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGGVGAEAATAAGYPYGYLPPGTAPIGNPGMVMGNPGAYPPNPYMGQPMWQQPGPEQQDPDN

SEQ ID NO: 1574 - DNA, 711 bp, Populus balsamifera subsp. trichocarpa
  misc_feature (1)..(711): Ceres ANNOT ID no. 1469342
atggatcagcaagggtatgggacaaatccatatcagccaaaccaaatgcctgctgcctcaaatcctggatcagttcctggtcagcctgcaggagctcagcttgaacagcatcaacttgcctatcagcagatccaccagcaacagcaacagcaactccagcaacaacgccagtctttttggacaaatcagtataaagaaatagacaaagttactgatttcaaaaatcacagtcttcccttggcaaggatcaagaagatcatgaaggctgatgaggatgtcaagatgatatcagctgaggcaccagttatattcgccagggcttgtgaaatgtttattttagagttgaccttgcagtcttggaatcacacggaggagaacaagaggaggacactacagaagaatgatattgctgcagctatcactaggactgatatctttgatttcctggttgacattgtacctagggaggatatgaaagatgaagtgcttgcatcaatcccaagaggaacaatgcctgttggagggcctgttgatgcactcccttactgctatatgccacatccacatgcacctcaggtcgggactcctgggatgataatgggcaagcctgtgacagacccagccatgtatgcccagcaatctcatccctatatggcacagcatatgtggccacagggaccagagcagcagcagtcaccctcagatcagtag

SEQ ID NO: 1575 - protein, 236 aa, Populus balsamifera subsp. trichocarpa
  misc_feature (1)..(236): Ceres ANNOT ID no. 1469342
  misc_feature (1)..(236): Functional Homolog of  Ceres  ID no. 36272
  misc_feature (76)..(140): Pfam Name: CBFD_NFYB_HMF Pfam Description: Histone-like transcription factor (CBF/NF-Y) and archaeal histone
MDQQGYGTNPYQPNQMPAASNPGSVPGQPAGAQLEQHQLAYQQIHQQQQQQLQQQRQSFWTNQYKEIDKVTDFKNHSLPLARIKKIMKADEDVKMISAEAPVIFARACEMFILELTLQSWNHTEENKRRTLQKNDIAAAITRTDIFDFLVDIVPREDMKDEVLASIPRGTMPVGGPVDALPYCYMPHPHAPQVGTPGMIMGKPVTDPAMYAQQSHPYMAQHMWPQGPEQQQSPSDQ

SEQ ID NO: 1576 - DNA, 777 bp, Populus balsamifera subsp. trichocarpa
  misc_feature (1)..(777): Ceres ANNOT ID no. 1513277
atggaccagcaaggccatgtgcagccgccagcagtaggcatggttggaagtacagctccggttccttatggcataccttcatatcaacataaccagatgatgggaccttctgcaaccggatcacttcaatctcctactcagccagcagttcttactgcttcttcagctcatcttgctcaacaccaacttgcttaccagcacatccaccaccagcagcagcagcagttgcagcaacaacttcaaactttctgggcaaatcagtatcaagaaattgagcagactactgattttaagaaccatagcctgcccttggctaggattaagaagattatgaaggcagatgaagatgtaaggatgatatcagctgaagctcccatcatatttgccagggcctgtgagatgtttattttagaactgaccttgcgatcttggaatcatacagaggagaacaaaaggagaacactccaaaagaatgacattgctgcagctatcacaagaactgatatttttgattttctggttgatattgtcccaagagaggatttgaaagatgaggtgttagcatcagtcccgagagggagtcttcctgtaggaggtccagctgatgctcttccttactattacatgccacctcagcttgcaccccaggtctctgcgccggggatgactgtaggaaagcctgtggtggatcaagctttttatggccaacagtctcgcccttatgtaccacagcagatttggccacagcaaacacagcagccacctgaagattcctga

SEQ ID NO: 1577 - protein, 226 aa, Populus balsamifera subsp. trichocarpa
  misc_feature (1)..(226): Ceres ANNOT ID no. 1513277
  misc_feature (1)..(226): Functional Homolog of  Ceres  ID no. 36272
  misc_feature (68)..(132): Pfam Name: CBFD_NFYB_HMF Pfam Description: Histone-like transcription factor (CBF/NF-Y) and archaeal histone
MMGPSATGSLQSPTQPAVLTASSAHLAQHQLAYQHIHHQQQQQLQQQLQTFWANQYQEIEQTTDFKNHSLPLARIKKIMKADEDVRMISAEAPIIFARACEMFILELTLRSWNHTEENKRRTLQKNDIAAAITRTDIFDFLVDIVPREDLKDEVLASVPRGSLPVGGPADALPYYYMPPQLAPQVSAPGMTVGKPVVDQAFYGQQSRPYVPQQIWPQQTQQPPEDS

SEQ ID NO: 1578 - DNA, 777 bp, Populus balsamifera subsp. trichocarpa
  misc_feature (1)..(777): Ceres ANNOT ID no. 1470275
atggaccagcaaggccatgggcagcctccaacagtaggcatgattggaaggacagctccggttccttatggaatggcttcatatcaacctaaccagatgatgggaccttctgcaactggatcagttcaatctcctactcaaccagcagttcttgctgctgcttcagctcagcttgctcaacaccaacttgcttaccagcacatccaccagcaacagcagcaacagttgcagcaacaacttcaaactttctgggcaaatcagtatcaagaaattgagcagactgctgattttaagaaccatagcctgcccttggctaggattaagaagattatgaaggcagatgaagatgtaaggatgatatcagctgaagctcctgtcatatttgccagggcctgtgagatgtttattttagaactgacattgcgttcttggaatcacacagaggagaacaaaaggagaacactccaaaagaatgacattgctgcagcaattacaagaactgatatttttgattttctggttgatattgtcccaagggaggatttgaaagatgaggtgttagcatcagtcccaagagggagtcttccagttggaggtccacctgatgctcttccctactattacatgccacatcagcttgctccccaggtctctgctccggggatgactgtaggaaagcctgtggtggatcaatctctttatggccaacagtctcgcccttatgtggcacagcagatttggccacagcaaacaccgcagccacctgaagattcctga

SEQ ID NO: 1579 - protein, 234 aa, Populus balsamifera subsp. trichocarpa
  misc_feature (1)..(234): Ceres ANNOT ID no. 1470275
  misc_feature (1)..(234): Functional Homolog of  Ceres  ID no. 36272
  misc_feature (76)..(140): Pfam Name: CBFD_NFYB_HMF Pfam Description: Histone-like transcription factor (CBF/NF-Y) and archaeal histone
MASYQPNQMMGPSATGSVQSPTQPAVLAAASAQLAQHQLAYQHIHQQQQQQLQQQLQTFWANQYQEIEQTADFKNHSLPLARIKKIMKADEDVRMISAEAPVIFARACEMFILELTLRSWNHTEENKRRTLQKNDIAAAITRTDIFDFLVDIVPREDLKDEVLASVPRGSLPVGGPPDALPYYYMPHQLAPQVSAPGMTVGKPVVDQSLYGQQSRPYVAQQIWPQQTPQPPEDS

SEQ ID NO: 1580 - DNA, 1603 bp, Zea mays
  misc_feature (1)..(1603): Ceres CLONE ID no. 389585
  misc_feature (1)..(1603): GEMINI ID 539A11
atttttcggattgggatcatcagcggctgtagcgtggacccgacgggggtgcccggaccacatccctatttcatcttggtaccccgtccgtctccgattttagaagcacggcgggctccccggcagcctcaaccgagcagaaagctgagttctaccccagaaccgaggcatggaggacgaagaaaacatcgagggagaactgttgctcgtggagtcacaactccacgacatccaaggacaaattaaaacattactcgatcgccaagaggagttgtatgaacgccaggcacagttgaaggctttgctcgaagcatctaaattgaccagaaatacaacaattaacacatcttcagttgctccggaagattggtctgggagcttcccatgggatctggaggctgacgataccaggttcaatatatttggcatttcctcctaccgatcaaatcaacgagaaataattaatgcagtcatgagtggaagagatgttctggtcataatggcagctggtggagggaagagtctatgttaccagctcccagctgtacttcgtgatggaattgcactggttgtcagtcctttactttcccttattcaggaccaggtcataggactgtcagctttaggtataccagcatacatgctaacttcaactaccaacaaggaagttgagaagttcatctataagacacttgataaaggagaaggagaactaaagatattatatgtgacacctgaaaagatctcaaaaagtaaaaggttcatgtctaagctcgagaaatgccatcatgccggtcgtctttctctgattgcaatagatgaggctcactgctgtagccaatggggtcatgattttcgtcctgactacaagaatcttggcattttgaaaattcaatttcccagtgttccaatgatagctttaactgcaactgcaacaagtaaggtccaaatggatttaatggagatgctccacatcccgagatgcatcaagtttgtcagcacagttaacaggcccaaccttttttataaggtgtctgagaaatcgccagttggaaaggttgtcattgatgagatcacaaagtttataagtgaatcatacccaaataatgagtctggaattatatactgcttttcaaggaaggaatgtgaacaggttgcaaaagaactgcgcgaaaggggtatttcagcagattattatcatgcagacatggatatcgttaatcgtgagaaaattcatatgcggatcgacacacaagggatgtgattgggactggccgtcgccgtaaatcttcgcctcgcctctacatcttggacaccttgcgtcttccttcacaccatatcactacaactcatgtgcttgctgcttcaggtcccacgacgtcgttcgcccagtggcatcattgtcttggtcacttatgtggatctcgtctgtctactctaataaagtcaggatgtttaggtcctacacatgttgagtctagttttcattgtaaaggttgtcatcttggcaaacaaatacaacctccatattttacccgtttgtttctaaaggtggtcataaatattatgtcattttattgatgattattctcgttatacttgg

SEQ ID NO: 1581 - protein, 364 aa, Zea mays
  misc_feature (1)..(364): Ceres CLONE ID no. 389585
  misc_feature (1)..(364): GEMINI ID 539A11
  misc_feature (91)..(263): Pfam Name: DEAD Pfam Description: DEAD/DEAH box helicase
MEDEENIEGELLLVESQLHDIQGQIKTLLDRQEELYERQAQLKALLEASKLTRNTTINTSSVAPEDWSGSFPWDLEADDTRFNIFGISSYRSNQREIINAVMSGRDVLVIMAAGGGKSLCYQLPAVLRDGIALVVSPLLSLIQDQVIGLSALGIPAYMLTSTTNKEVEKFIYKTLDKGEGELKILYVTPEKISKSKRFMSKLEKCHHAGRLSLIAIDEAHCCSQWGHDFRPDYKNLGILKIQFPSVPMIALTATATSKVQMDLMEMLHIPRCIKFVSTVNRPNLFYKVSEKSPVGKVVIDEITKFISESYPNNESGIIYCFSRKECEQVAKELRERGISADYYHADMDIVNREKIHMRIDTQGM

SEQ ID NO: 1582 - DNA, 2160 bp, Populus balsamifera subsp. trichocarpa
  misc_feature (1)..(2160): Ceres ANNOT ID no. 1500154
atggaaactgaagcggatgtattagaagagctactcaatatagagacagagattgaagatgttcaagaccagataaagttattactagaaagacaagagaagttgcacgagagacaatctgaattgaagtttttgttggaagcatataaagcatctggaactgggaattctgcaaatgaaaatgcttctcgatcttcttctttggaagactggtcaggttcatttgagtgggattctcaagctgatgatgttaggcttaatatttttggcataccctcttatcgtcaaaatcaaaaggagcttaaactcaaccagatcataaatgctatcatgagcggaagagatgttctagtgattatggctgcaggtggtggtaagagcctttgttaccagctgccagctattcttcgtgatggtgtggccctcgttattagtcctttactctctttgatccaagatcaggttatgggtttgactgctttaggcattccggctttcatgttgacatcgaccactagcaaggaaaatgagaagttcatatacaaggcccttgaaaagggtgagggtgagcttaagatcttgtatgtcacaccagaaaagatatcaaagagcaaaagattcatgtcaaaacttgaaaaatgccataatgcggggcgtctctcactaatttcaattgatgaggcgcattgctgcagtcagtggggtcatgactttcgccccgactacaagagcctcagtatcctcaagactcagttttccaatgttcccgtggtggctttgactgcaactgccacacaaaaagttcagtatgatgtaatggagatgctgcgcattccaaaatgtgttaaatttgtcagtacggtcaataggccaaaccttttctacacggtacggagcaagtcatctgttggtaaggtggttgttgatgaaattgctgaattcattcaagaatcttattcaaacagtgaatctgggatagtgtactgcttctcgagaaaagaatgtgaacaggttgcggcagagttacgtgagagaggaattgcagctgattattaccatgcagatatggatgtaaacgctcgtgagaaagttcatacgtggtggagcaaaaacaagctgcaagtcattgttggtacagtggcatttggaatgggaatcaacaaaccagatggtgttaggtttgtcatccatcacagcctgagtaaatcaatggaaacatattaccaggaaagtggtcgagctggacgagatgggctgccttctgaatgtgtactcttttataggcctgctgatgttcccaggcagagttcgatggttttctatgagaattctggattgcagaatttatatgacatagtaagatactgtcagtctaaaagacaatgtcgtcgaaatgcctttttccgacattttgctgagccattacaagactgcaatgggatgtgtgataattgtgcttttcttagtgaagttatggaagttgatgtatctcgtcatgcgaaagttatggtttcattgctgcaagatacgcaagagaaagatcagaggctgacaatgttgcaattagtggacaaaatgaaaaataagaaggaactaggttctgacataaagaaggaggaaatggaacagcttgtcatacagcttatacttgactttgtttttaaagaagaatatcaacatacagcctatgctacaaatgcttatgtgacaataggtccattggcaaatcaggtgctgcaaggcaagaagatagttaagcttgagatctctagcaaacagaagaataagggtgacagcatgaaatcagcaaagcacagccttgcattttcaggtttggagttgaaacttgatgagttgcgggagaaactctcttcaggtcatggtggaatattcccccattctgtcttgtctagccagcagatgagcatgataagttcccagaaaccaagttcagcacaagagttggagaagataattggaaagctgaagacagaaaagtatgggagtaaaattctagatgagatcaagaagtacactggctctgagccgcctgataatggcatgttgaatgaggaagaaggaagcgggaatagagctagcaagcggttaaagacgaaaaagggtattgttgttatcgagagcagtgatgaggaattataa

SEQ ID NO: 1583 - protein, 719 aa, Populus balsamifera subsp. trichocarpa
  misc_feature (1)..(719): Ceres ANNOT ID no. 1500154
  misc_feature (1)..(719): Functional Homolog of  Ceres  ID no. 389585
  misc_feature (105)..(272): Pfam Name: DEAD Pfam Description: DEAD/DEAH box helicase
  misc_feature (341)..(418): Pfam Name: Helicase_C Pfam Description: Helicase conserved C-terminal domain
  misc_feature (533)..(591): Pfam Name: RQC Pfam Description: Helicase conserved C-terminal domain
  misc_feature (609)..(677): Pfam Name: HRDC Pfam Description: HRDC domain
METEADVLEELLNIETEIEDVQDQIKLLLERQEKLHERQSELKFLLEAYKASGTGNSANENASRSSSLEDWSGSFEWDSQADDVRLNIFGIPSYRQNQKELKLNQIINAIMSGRDVLVIMAAGGGKSLCYQLPAILRDGVALVISPLLSLIQDQVMGLTALGIPAFMLTSTTSKENEKFIYKALEKGEGELKILYVTPEKISKSKRFMSKLEKCHNAGRLSLISIDEAHCCSQWGHDFRPDYKSLSILKTQFSNVPVVALTATATQKVQYDVMEMLRIPKCVKFVSTVNRPNLFYTVRSKSSVGKVVVDEIAEFIQESYSNSESGIVYCFSRKECEQVAAELRERGIAADYYHADMDVNAREKVHTWWSKNKLQVIVGTVAFGMGINKPDGVRFVIHHSLSKSMETYYQESGRAGRDGLPSECVLFYRPADVPRQSSMVFYENSGLQNLYDIVRYCQSKRQCRRNAFFRHFAEPLQDCNGMCDNCAFLSEVMEVDVSRHAKVMVSLLQDTQEKDQRLTMLQLVDKMKNKKELGSDIKKEEMEQLVIQLILDFVFKEEYQHTAYATNAYVTIGPLANQVLQGKKIVKLEISSKQKNKGDSMKSAKHSLAFSGLELKLDELREKLSSGHGGIFPHSVLSSQQMSMISSQKPSSAQELEKIIGKLKTEKYGSKILDEIKKYTGSEPPDNGMLNEEEGSGNRASKRLKTKKGIVVIESSDEEL

SEQ ID NO: 1584 - DNA, 1092 bp, Zea mays
  misc_feature (1)..(1092): Ceres CLONE ID no. 397320
  misc_feature (1)..(1092): GEMINI ID 539D12
aaaaatctcgccgtttctcgccgctgcctcctctcttctcctctagagaaaccggccgaacattctcggcaataattaaaaaaaaaaacagtccagcctgcctgtgcctgtttcgtgtgtctgaggatctcctgatctcctcctcccccctcccctgctccctccccatcgtcatccacctcctccacccatcccctcctcgctcgctctctcgcggcttccctctcctcctctgacctgcgcatcaagcatagatagcaagcaaggaccctgctcagtgctcacctcgccggaggtgctgctgctacggcggcggcggcgtactactactactacgacgagactctgcgcgcgcacaagcccacaggagtgcagaattgaccgcgcgcacgacgacgacgaccaccaacagcaacaggagagaggaggagatcgataagggatggagggcggcgagacgacgctgtccgggttcggcggtgccggggcccccggcgtggacaccaaggtgctgcacgcgttccagaccagcttcgtgcaggtgcagacgctgctggaccagaaccgcctcctgatcaacgagatcaaccacaaccacgagtccaaggtgcccggcgacctctcccgcaaacgtgggcctcatcagggagctcaacaacaacatccgccgcgtcgtcgacctytacgccgacctctcctcgctcttcgccgcggccgacggcggcggcggccgcgccgcgtccgagggcgggtccgtgggcaccgtccgccaccaggcgggcgccggccacaagaggatcaggtccggcctcgactgatttgttgccaggcatttcttcttcgcagagaaaaggagtagcagtactaagtacatgtagctagccacgtaccaccagccgcagcgaaaccacctcccttttgtcttctgacttgagctcttcttgtatctatcgacatacgctatatatctatctatctatttatatgtctccattacgactgttaccatattcttgttgctaagagctactactacttagtatgcgattagtctgtattttcgatgcaatgcaattcatggacgatgcacgc

SEQ ID NO: 1585 - protein, 138 aa, Zea mays
  misc_feature (1)..(138): Ceres CLONE ID no. 397320
  misc_feature (1)..(138): GEMINI ID 539D12
  misc_feature: Bit Score of 238.3 for HMM based on sequences of FIGURE 107
  misc_feature (16)..(62): Pfam Name: DUF1313 Pfam Description: Protein of unknown function (DUF1313)
  misc_feature (81)..(81): Xaa is any aa, unknown, or other
MEGGETTLSGFGGAGAPGVDTKVLHAFQTSFVQVQTLLDQNRLLINEINHNHESKVPGDLSRKRGPHQGAQQQHPPRRRPXRRPLLALRRGRRRRRPRRVRGRVRGHRPPPGGRRPQEDQVRPRLICCQAFLLRREKE

SEQ ID NO: 1586 - DNA, 345 bp, Populus balsamifera subsp. trichocarpa
  misc_feature (1)..(345): Ceres ANNOT ID no. 1484716
atggagggtgacacattctcaggacttggcaatggtacccagatagatggcaagatcttgcagacatttcaaaagaactttgttcaggtccaaaatatcttggatcagaataggcttctcattaatgagataaatcagaaccatgaatccaagatccctgacaacctgagcagaaatgtgggtttgataagggagctcaacaacaatatcaggagggtagttgacctttatgctgatctttctacctccttcaccaaatccatggacgcctcttctgagggggattctagtggtgccttgaaatctgatggcaaaggtggccacaagagaaatagacctgcatag

SEQ ID NO: 1587 - protein, 114 aa, Populus balsamifera subsp. trichocarpa
  misc_feature (1)..(114): Ceres ANNOT ID no. 1484716
  misc_feature: Bit Score of 235.9 for HMM based on sequences of FIGURE 107
  misc_feature (1)..(114): Functional Homolog of  Ceres  ID no. 397320
  misc_feature (12)..(100): Pfam Name: DUF1313 Pfam Description: Protein of unknown function (DUF1313)
MEGDTFSGLGNGTQIDGKILQTFQKNFVQVQNILDQNRLLINEINQNHESKIPDNLSRNVGLIRELNNNIRRVVDLYADLSTSFTKSMDASSEGDSSGALKSDGKGGHKRNRPA

SEQ ID NO: 1588 - DNA, 345 bp, Populus balsamifera subsp. trichocarpa
  misc_feature (1)..(345): Ceres ANNOT ID no. 1499354
atggaaggtgatttatttccaggtttaagcaatggaaaccaagtagatggtaaggttttgcaaacattccagaagagttttgtgcaagtccaggacattctggatcaaaacaggttgctaatcaatgaaataaaccaaaaccacgagtcgaagatcccagacaacctgactcgaaatgttggtttgatcaaggagctaaacaataacattagaagggtggtggatctttatgctgatctttcgagcaatttcaccaggtcaatggaaccttcatcagagggtgaatcaagcgggatattgaagtccaatggaaaggcaaattcgaagagaattagatccgggtaa

SEQ ID NO: 1589 - protein, 114 aa, Populus balsamifera subsp. trichocarpa
  misc_feature (1)..(114): Ceres ANNOT ID no. 1499354
  misc_feature: Bit Score of 236.0 for HMM based on sequences of FIGURE 107
  misc_feature (1)..(114): Functional Homolog of  Ceres  ID no. 397320
  misc_feature (12)..(100): Pfam Name: DUF1313 Pfam Description: Protein of unknown function (DUF1313)
MEGDLFPGLSNGNQVDGKVLQTFQKSFVQVQDILDQNRLLINEINQNHESKIPDNLTRNVGLIKELNNNIRRVVDLYADLSSNFTRSMEPSSEGESSGILKSNGKANSKRIRSG

SEQ ID NO: 1590 - DNA, 345 bp, Populus balsamifera subsp. trichocarpa
  misc_feature (1)..(345): Ceres ANNOT ID no. 1491719
atggaaggtgatttattttcaggcttaagcaatggaaaccaagtagatggcaaggtcttgcaaacattccagaagagttttgtgcaagttcaggatattctagatcaaaacaggttgctaattaatgagataaaccaaaaccatgaatcgaagatccctgacaacttgactcgaaatgttggtttgattaaggagctaaacaacaacattagaagggtggttgacctttatgctgatctttcgaacaatttcaccaggtcaatggaaccttcatcagaaggtgaatcaagtgggatattgaagtctaatggaaaggccaattcgaagagaattagatccgggtaa

SEQ ID NO: 1591 - protein, 114 aa, Populus balsamifera subsp. trichocarpa
  misc_feature (1)..(114): Ceres ANNOT ID no. 1491719
  misc_feature: Bit Score of 237.7 for HMM based on sequences of FIGURE 107
  misc_feature (1)..(114): Functional Homolog of  Ceres  ID no. 397320
  misc_feature (12)..(100): Pfam Name: DUF1313 Pfam Description: Protein of unknown function (DUF1313)
MEGDLFSGLSNGNQVDGKVLQTFQKSFVQVQDILDQNRLLINEINQNHESKIPDNLTRNVGLIKELNNNIRRVVDLYADLSNNFTRSMEPSSEGESSGILKSNGKANSKRIRSG

SEQ ID NO: 1592 - DNA, 321 bp, Populus balsamifera subsp. trichocarpa
  misc_feature (1)..(321): Ceres ANNOT ID no. 1533409
atgccaggcttaagcaatggaaaccaagtacatagcaagattttgcaaacattccagaagagttttgtgcaagttgaggacattctggatcaaaacaggttactaatcaatgaaataaaccaaaaccaggaatcgaagatcccagacaaattgactcgagatgttggtttgatcaaggagctaaacattaacatcagaagggcggtcggtctttatgctgatctttcctgcaatttcaatatcaggtcaatggaaccttcatcagaaggtgaatcaagtgggatatcgaagtccaattccatgagaactaaatccgggtaa

SEQ ID NO: 1593 - protein, 106 aa, Populus balsamifera subsp. trichocarpa
  misc_feature (1)..(106): Ceres ANNOT ID no. 1533409
  misc_feature: Bit Score of 150.2 for HMM based on sequences of FIGURE 107
  misc_feature (1)..(106): Functional Homolog of  Ceres  ID no. 397320
  misc_feature (7)..(96): Pfam Name: DUF1313 Pfam Description: Protein of unknown function (DUF1313)
MPGLSNGNQVHSKILQTFQKSFVQVEDILDQNRLLINEINQNQESKIPDKLTRDVGLIKELNINIRRAVGLYADLSCNFNIRSMEPSSEGESSGISKSNSMRTKSG

SEQ ID NO: 1594 - DNA, 1142 bp, Arabidopsis thaliana
  misc_feature (1)..(1142): Ceres CLONE ID no. 41439
  misc_feature (1)..(1142): GEMINI ID 531F6
aagcacttcactctctaatttccttctctctatctctcaccatattcgcgattaaaaactctcaacttttctctcaaatttctgatcctttaatccaacagttagaagaagattcatctgatcatggccctcgaagcgatgaacactccaacttcttctttcaccagaatcgaaacgaaagaagatttgatgaacgacgccgttttcattgagccgtggcttaaacgcaaacgctccaaacgtcagcgttctcacagcccttcttcgtcttcttcctcaccgcctcgatctcgacccaaatcccagaatcaagatcttacggaagaagagtatctcgctctttgtctcctcatgctcgctaaagatcaaccgtcgcaaacgcgatttcatcaacagtcgcaatcgttaacgccgccgccagaatcaaagaaccttccgtacaagtgtaacgtctgtgaaaaagcgtttccttcctatcaggctttaggcggtcacaaagcaagtcaccgaatcaaaccaccaaccgtaatctcaacaactgccgatgattcaacagctccgaccatctccatcgtcgccggagaaaaacatccgattgctgcctccggaaagatccacgagtgttcaatctgtcataaagtgtttccgacgggtcaagctttaggcggtcacaaacgttgtcactacgaaggcaacctcggcggcggaggaggaggaggaagcaaatcaatcagtcacagtggaagcgtgtcgagcacggtatcggaagaaaggagccaccgtggattcatcgatctaaacctaccggcgttacctgaactcagccttcatcacaatccaatcgtcgacgaagagatcttgagtccgttgaccggtaaaaaaccgcttttgttgaccgatcacgaccaagtcatcaagaaagaagatttatctttaaaaatctaatactcgactattaattcttgtgttttcattttcatttttttagttacaaatttttaattgttctgatttggattgaatattggtatattgttagggattgatacaaaaatttgatgattgattaagtcagaatttctttttaattatggtaactaatctcttgatcagtccactctgtataaatattgcgtggcatt

SEQ ID NO: 1595 - protein, 273 aa, Arabidopsis thaliana
  misc_feature (1)..(1142): Ceres CLONE ID no. 41439
  misc_feature (1)..(273): GEMINI ID 531F6
  misc_feature (106)..(128): Pfam Name: zf-C2H2 Pfam Description: Zinc finger, C2H2 type
MALEAMNTPTSSFTRIETKEDLMNDAVFIEPWLKRKRSKRQRSHSPSSSSSSPPRSRPKSQNQDLTEEEYLALCLLMLAKDQPSQTRFHQQSQSLTPPPESKNLPYKCNVCEKAFPSYQALGGHKASHRIKPPTVISTTADDSTAPTISIVAGEKHPIAASGKIHECSICHKVFPTGQALGGHKRCHYEGNLGGGGGGGSKSISHSGSVSSTVSEERSHRGFIDLNLPALPELSLHHNPIVDEEILSPLTGKKPLLLTDHDQVIKKEDLSLKI

SEQ ID NO: 1596 - protein, 235 aa, Arabidopsis thaliana
  misc_feature (1)..(235): Public GI no. 7228329
  misc_feature (1)..(235): Functional Homolog of  Ceres  ID no. 41439
  misc_feature (84)..(106): Pfam Name: zf-C2H2 Pfam Description: Zinc finger, C2H2 type
MAMEALNSPTTATPFTPFEEPNLSYLETPWTKGKRSKRSRMDQSSCTEEEYLALCLIMLARSGNNNDKKSDSVATPLTTVKLSHKCSVCNKAFSSYQALGGHKASHRKAVMSATTAEDQITTTSSAVTTSSASNGKNKTHECSICHKSFPTGQALGGHKRCHYEGSVGAGAGAGSNAVTASEGVGLSHSHHRDFDLNLPAFPDFSKKFFVDDEVFSPLPAAKKPCLFKLEIPSHY

SEQ ID NO: 1597 - protein, 273 aa, Arabidopsis thaliana
  misc_feature (1)..(273): Public GI no. 2981169
  misc_feature (1)..(273): Functional Homolog of  Ceres  ID no. 41439
  misc_feature (105)..(127): Pfam Name: zf-C2H2 Pfam Description: Zinc finger, C2H2 type
MTLEALKSPTAATPTLPPRYEDDDEIHNLDSWAKGKRSKRPRIDAPPTEEEYLALCLIMLARSGTGTRTGLTDATTSQQPADKKTAELPPVHKKEVATEQAEQSYKCSVCDKAFSSYQALGGHKASHRKTTTTATAASDDNNPSTSTSTGAVNISALNPTGRSHVCSICHKAFPTGQALGGHKRRHYEGKLGGNSRDLGGGGGGGHSGSVLTTSDGGASTHTLRDFDLNMPASPELQLGLSIDCGRKSQLLPMVQEVESPMPAKKPRLLFSLG

SEQ ID NO: 1598 - protein, 259 aa, Arabidopsis thaliana
  misc_feature (1)..(259): Public GI no. 55734108
  misc_feature (1)..(259): Functional Homolog of  Ceres  ID no. 41439
  misc_feature (104)..(126): Pfam Name: zf-C2H2 Pfam Description: Zinc finger, C2H2 type
MALEALNSPTTPTPVFQYENAATLRYLDQPWAKGKRSKRPRSVEPPPPQHQQQQQPTEEEYLALCLIMLARGGAPSTTTLPLPPPPQQHNIPSSSSSDPPKLLYKCSVCDKAFSSYQALGGHKASHRKLSTASAGGGDDQSTTSTSTTTAAAATGRTHECSICHKCFPSGQALGGHKRCHYEGGAGAVGSTGNAASGVTSSEGMGSTNTHSNRDFDLNLPALPEFWLAAAAGDDEVSSPHPAKRSRFALPIKVENHQIN

SEQ ID NO: 1599 - protein, 253 aa, Arabidopsis thaliana
  misc_feature (1)..(253): Public GI no. 439493
  misc_feature (1)..(253): Functional Homolog of  Ceres  ID no. 41439
  misc_feature (98)..(120): Pfam Name: zf-C2H2 Pfam Description: Zinc finger, C2H2 type
MALEALNSPTTTTPPSFQFENNGLKYLESWTKGKRSKRQRSMERQCTEEEYLALCLIMLARSDGSVNNSRSLPPPPLPPSVPVTSQINATLLEQKNLYKCSVCGKGFGSYQALGGHKASHRKLVSMGGDEQSTTSTTTNVTGTSSANVNGNGRTHECSICHKCFPTGQALGGHKRCHYDGGNGNGNGSVSVGVTSSEGVGSTISHHRDFDLNIPALPEFWPGFGSGEDEVESPHPAKKSRLSLPPKLELFKGL

SEQ ID NO: 1600 - protein, 240 aa, Arabidopsis thaliana
  misc_feature (1)..(240): Public GI no. 7488707
  misc_feature (1)..(240): Functional Homolog of  Ceres  ID no. 41439
  misc_feature (85)..(107): Pfam Name: zf-C2H2 Pfam Description: Zinc finger, C2H2 type
MALEALNSPTTTAPSFPFDDPTIPWAKRKRSKRSRDHPSEEEYLALCLIMLARGGTTTVNNRHVSPPPLQPQPQPTPDPSTKLSYKCSVCDKSFPSYQALGGHKASHRKLAGAAEDQPPSTTTSSAAATSSASGGKAHECSICHKSFPTGQALGGHKRCHYEGNGNGNNNNSNSVVTVASEGVGSTHTVSHGHHRDFDLNIPAFPDFSTKVGEDEVESPHPVMKKPRLFVIPKIEIPQFQ

SEQ ID NO: 1601 - protein, 253 aa, Arabidopsis thaliana
  misc_feature (1)..(253): Public GI no. 33771374
  misc_feature (1)..(253): Functional Homolog of  Ceres  ID no. 41439
  misc_feature (93)..(115): Pfam Name: zf-C2H2 Pfam Description: Zinc finger, C2H2 type
MALEALNSPTTTTPPTFQFENNGPLRYLENWTKGKRSKRPRSMERQPTEEEYLALCLIMLARSDGSANREQSLPPPPVPVMKIHAPPEEKMVYKCSVCGKGFGSYQALGGHKASHRKLVAGGGGGDDQSTTSTTTNATGTTSSANGNGNGSGKTHECSICHKRFPTGQALGGHKRCHYDGGNSNGGVSVSASVGLTSSEGVGSTVSHRDFDLNIPALPEFWPGFGSGEDEVESPHPTKKSRLSLPPKFELFRE

SEQ ID NO: 1602 - protein, 239 aa, Triticum aestivum
  misc_feature (1)..(239): Ceres CLONE ID no. 701379
  misc_feature (1)..(239): Functional Homolog of  Ceres  ID no. 41439
  misc_feature (85)..(107): Pfam Name: zf-C2H2 Pfam Description: Zinc finger, C2H2 type
MAVEAVLEAATMIPSPPSKEMEASSSTSEEASALLGQAEGWSKRKRSRRQRALDPSEEEYLALCLLMLAHGHRDSAPAAAPEQQHGCSVCGKVFASYQALGGHKASHRKPTAAPAGAEDQKPLAAVAAASSSGSGEAAVSAGGGKVHECNVCRKTFPTGQALGGHKRCHYDGTIGSAAAGPTQKLAAKAAAASATAASQGFDLNLPALPDIPERCAVTEDGEEVLSPASFKKPRLMLAA

SEQ ID NO: 1603 - protein, 235 aa, Triticum aestivum
  misc_feature (1)..(235): Public GI no. 2058504
  misc_feature (1)..(235): Functional Homolog of  Ceres  ID no. 41439
  misc_feature (90)..(112): Pfam Name: zf-C2H2 Pfam Description: Zinc finger, C2H2 type
MALETLNSPTSATASARPLLRYREEMEPENLEQWAKRKRTKRQRFDQSRLNQETAPSEEEYLALCLLMLARGSAVQSPLPPSSSSDHRGYKCTVCGKSFSSYQALGGHKTSHRKPASNVNVPINQEQSNNSHSNSNGGSVVINGNGVSQSGKIHTCSICFKSFSSGQALGGHKRCHYDAGNNGNGNGSSSNSVEVVGGSDGSYVDDERSSEQSATGDNRGFDLNLPADQVAVVIS

SEQ ID NO: 1604 - protein, 233 aa, Glycine max
  misc_feature (1)..(233): Ceres CLONE ID no. 638614
  misc_feature (1)..(233): Functional Homolog of  Ceres  ID no. 41439
  misc_feature (78)..(100): Pfam Name: zf-C2H2 Pfam Description: Zinc finger, C2H2 type
MALETLNSPTTTAPSFPFDDPTIPWAKRKRSKRCSRDHPSEEEYLALCLIMLARGGTTRRVSTPPPQPTPDPSTKLSYKCSVCNKSFPSYQALGGHKASHRKLAASGGEDQPTTTSSAASSANTASGGRTHECSICHKSFPTGQALGGHKRCHYEGNSNGNNNNSNSSVTAASEGVGSTHTVSHGHHRDFDLNIPAFPDFSTKVGEDEVESPHPVMKKPRPFVIPKIEIPQYQ

SEQ ID NO: 1605 - protein, 261 aa, Glycine max
  misc_feature (1)..(261): Public GI no. 33331578
  misc_feature (1)..(261): Functional Homolog of  Ceres  ID no. 41439
  misc_feature (102)..(124): Pfam Name: zf-C2H2 Pfam Description: Zinc finger, C2H2 type
MALEALNSPTGTPTPPPFQFESDGQQLRYIENWRKGKRSKRSRSMEHQPTEEEYLALCLIMLARSGGSVNHQRSLPPPAPVMKLHAPSSSSAAEEEKEKMVYKCSVCGKGFGSYQALGGHKASHRKLVPGGDDQSTTSTTTNATGTTTSVNGNGNRSGRTHECSICHKCFPTGQALGGHKRCHYDGGIGNGNANSGVSASVGVTSSEGVGSTVSHRDFDLNIPALPEFWLGFGSGEDEVESPHPAKKSRLCLPPKYELFQH

SEQ ID NO: 1606 - protein, 247 aa, Glycine max
  misc_feature (1)..(247): Public GI no. 4666360
  misc_feature (1)..(247): Functional Homolog of  Ceres  ID no. 41439
  misc_feature (89)..(111): Pfam Name: zf-C2H2 Pfam Description: Zinc finger, C2H2 type
MALEALNSPTTATPVFHYDDPSLNYLEPWTKRKRSKRTRLDSPHTEEEYLAFCLIMLARGRVASANRRDSQSSIQIQPEATTSATKVSYKCSVCDKAFSSYQALGGHKASHRKLAGGEDQSTSFATTNSATVTTTTASGGGGRSHECSICHKSFPTGQALGGHKRCHYEGSIGGNSIHHHNNTTNSGSNGGMSMTSEVGSTHTVSHSHRDFDLNIPALPEFRSNFFISGDDEVESPHPAKKPRILMK

SEQ ID NO: 1607 - protein, 250 aa, Glycine max
  misc_feature (1)..(250): Public GI no. 28849865
  misc_feature (1)..(250): Functional Homolog of  Ceres  ID no. 41439
  misc_feature (91)..(113): Pfam Name: zf-C2H2 Pfam Description: Zinc finger, C2H2 type
MAVEAVLEASRSSSEEEAEVIVTHGGGGGGGGGGGQVEGWGKRKRSRRRRPQLPPSEEEYLALCLLMLARGRRDGDDVAASASAAAAAVEHRCSVCGKAFASYQALGGHKASHRKPPPPPPPAMVDDDEVVVETKPAAIATPSSSASGVSGGGGGRAHECNVCGKAFPTGQALGGHKRCHYDGTIGSAAGAGASKPAAKTTVAVAASRGFDLNLPALPDVAAAADQRCAAEDDEVLSPLAFKKPRLMIPA

SEQ ID NO: 1608 - protein, 237 aa, Glycine max
  misc_feature (1)..(237): Public GI no. 2058506
  misc_feature (1)..(237): Functional Homolog of  Ceres  ID no. 41439
  misc_feature (90)..(112): Pfam Name: zf-C2H2 Pfam Description: Zinc finger, C2H2 type
MALETLNSPTSATASARPLLRYREEMEPENLEQWAKRKRTKRQRFDQSRLNQETAPSEEEYLALCLLMLARGSAVQSPLPPSSSSDHRGYKCTVCGKSFSSYQALGGHKTSHRKPASNVNVPINQEQSNNSHSNSNGGSVAINGNGVSQSGKIHTCSICFKSFSSGQALGGHKRCHYDAGINGNGNGSSSNSVEVVGGSDGNYVDDERSSEQSATGDNRGFDLNLPADQVAVVISKR

SEQ ID NO: 1609 - DNA, 1512 bp, Arabidopsis thaliana
  misc_feature (1)..(1512): Ceres CLONE ID no. 42530
  misc_feature (1)..(1512): GEMINI ID 531E8
accccacggcgcagatcctacgagtttggtctttgtctctatcttttcaatctttctctctcaatcgctcttcaatttgataacagcaaagtcatggcaggaatggcatctgatggaactcaatatgatcctcgtcagtttgatactaagatgaatgccattctcggcgaggaaggagaggaaacattctacactaactatgacgaagtttgcgacagctttgatgcaatggaattgcaaccagatcttctcaggggtatttatgcttacggtttcgagaagccttctgctattcagcaaagaggaattattccattctgcaagggtcttgatgtgatccagcaagctcaatctggaactggaaagaccgctaccttttgctctggtgttttacagcagctcgatattagtttggttcaatgccaagctcttgttttggcacctacccgagaacttgcccagcaaattgaaaaggttatgagggcacttggtgactaccttggcgtcaaggctcaggcttgtgttggtggaacaagtgttcgtgaggatcaacgtgttcttcagtctggtgttcatgttgttgttggaacccctggtcgtgtctttgacttgttacgcagacaatccctccgtgctgatgcaatcaaaatgtttgttcttgatgaagctgatgaaatgctctctcgtggtttcaaggatcagatatacgacatcttccagcttcttccttccaaggttcaggttggtgttttctctgctacaatgcctcccgaagcccttgagatcacaaggaagttcatgaacaaaccagtcaggattctggtcaagcgagacgagctgactcttgaaggtatcaagcagttttatgtcaatgtagacaaggaagagtggaaactcgagacactatgcgatctctacgagacactggccatcacgcaaagcgtcatctttgtgaacacaaggcgtaaggttgattggctaaccgacaaaatgagaagccgtgaccacactgtttcagctacacacggagacatggaccagaacacaagagacatcatcatgcgcgaattccgctctgggtcttcccgtgtcctcataaccactgacctccttgctcgtggtatcgatgttcagcaagtctctctggtcataaactttgacctcccaacccaaccggagaattaccttcatcgtattggaagaagtggaaggtttgggagaaagggagtagcaatcaatttcatgacatcggaggatgagagaatgatggctgatattcagaggttttacaatgtggtcgttgaggagttgccaagcaatgttgctgatcttctctgaagcctttcttttttctgttttttactgagaaagtgctgtgtttaccccttttttggcagcttctctatgctttgatttttgttttcaggctactacttagatttatagttcttggctaaaagcgaacataactcattacatgattttgcttttttggcaatcaagaatttcggc

SEQ ID NO: 1610 - protein, 414 aa, Arabidopsis thaliana
  misc_feature (1)..(393): Ceres CLONE ID no. 42530
  misc_feature (1)..(393): GEMINI ID 531E8
  misc_feature (299)..(375): Pfam Name: Helicase_C Pfam Description: Helicase conserved C-terminal domain
  misc_feature (65)..(231): Pfam Name: DEAD Pfam Description: DEAD/DEAH box helicase
MAGMASDGTQYDPRQFDTKMNAILGEEGEETFYTNYDEVCDSFDAMELQPDLLRGIYAYGFEKPSAIQQRGIIPFCKGLDVIQQAQSGTGKTATFCSGVLQQLDISLVQCQALVLAPTRELAQQIEKVMRALGDYLGVKAQACVGGTSVREDQRVLQSGVHVVVGTPGRVFDLLRRQSLRADAIKMFVLDEADEMLSRGFKDQIYDIFQLLPSKVQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFMTSEDERMMADIQRFYNVVVEELPSNVADLL

SEQ ID NO: 1611 - DNA, 1242 bp, Populus balsamifera subsp. trichocarpa
  misc_feature (1)..(1242): Ceres ANNOT ID no. 1490273
atggcaggtctggcaccagaaggatcgcaatatgatgctaagcaatatgatgccaaaatgaatgatctgcttgcaaatgatgggcaagatttcttcacaatgtatgaggaggtttttgaaacctttgattcgatgggattgcaagagaaccttctgaggggcatctatgcctatggttttgagaagccatctgcaatccagcaaagaggaattgttccattttgtaaaggccttgatgtgattcagcaggcacaatctggaactgggaaaacagcaactttctgttctggcattctccagcaacttgattatggtttggtgcaatgtcaagcattggtcctggctcccaccagggaactagcacaacagattgaaaaggttatgcgagcacttggtgattatcttggtgtcaaagttcatgcttgtgttggtggcacaagtgttcgtgaggaccaacgcattcttcaagctggtgttcatgttgttgttggcacacctggtcgtgtgtttgacatgttgagaaggcagtcacttcgtcaagattacattaaaatgtttgtcttggatgaggctgatgaaatgctttcacgtggttttaaggatcagatctatgatattttccagttgctgccatcaaaagttcaagttggtgtgttctccgctactatgccacctgaagctcttgagatcacaaggaagttcatgaataagcctgtgaggatcttggttaagcgtgatgagcttactcttgaaggtatcaagcaattttatgttaatgtcgataaggaggagtggaagctcgaaacactatgtgatctatatgagaccctagccatcactcagagtgtcatttttgttaacacccggcgcaaggttgactggctgacagacaagatgcgaggccgtgatcacacagtctcggctactcatggagatatggaccagaacactcgtgatatcattatgcgagaattcaggtccggctcttctcgtgttctcatcactaccgatctcttggctcgtggtattgatgttcagcaagtttcccttgtcataaattatgatctgccgactcaacctgaaaactatcttcaccgtattggacgaagtggacggtttggaagaaagggtgttgctattaactttgtgacaagtgatgatgacagaatgctgtttgatatccagaagttctataatgtggtcgtcgaggagctgccatcgaatgtggccgatctcctttga

SEQ ID NO: 1612 - protein, 380 aa, Populus balsamifera subsp. trichocarpa
  misc_feature (1)..(380): Ceres ANNOT ID no. 1490273
  misc_feature (1)..(380): Functional Homolog of  Ceres  ID no. 42530
  misc_feature (265)..(341): Pfam Name: Helicase_C Pfam Description: Helicase conserved C-terminal domain
  misc_feature (31)..(197): Pfam Name: DEAD Pfam Description: DEAD/DEAH box helicase
MYEEVFETFDSMGLQENLLRGIYAYGFEKPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHVVVGTPGRVFDMLRRQSLRQDYIKMFVLDEADEMLSRGFKDQIYDIFQLLPSKVQVGVFSATMPPEALEITRKFMNKPVRILVKRDELTLEGIKQFYVNVDKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTSDDDRMLFDIQKFYNVVVEELPSNVADLL

SEQ ID NO: 1613 - DNA, 1242 bp, Populus balsamifera subsp. trichocarpa
  misc_feature (1)..(1242): Ceres ANNOT ID no. 1446198
atggcgggtttggcaccagaagggtcacaattcgattctaagcaatatgatgccaaaatgaatgatttgctcgcaaatgatggacaagatttcttcacatcatatgatgaggtttatgacacttttgattcaatgggactgcaagagaaccttttgaggggcatctatgcctatggttttgagaagccatctgcaatccagcaaagaggaattgttccattctgcaagggccttgatgtgattcagcaggctcagtcaggaactgggaaaacagcaaccttctgctctggtattctccagcaacttgattatggtctagtgcaatgtcaagctttggtccttgcgcccactagggaacttgcacaacagattgaaaaggttatgcgggcacttggtgattatcttggcgtcaaagttcatgcttgtgttggtggcacaagtgttcgtgaggaccaacgcattcttcaagctggagttcatgttgttgttggcactcctggtcgtgtgtttgatatgttaagaaggcagtcacttcgtccagattacattaaaatgtttgtcctggatgaggctgatgaaatgctgtcccgtggttttaaggatcagatctacgatattttccagttgctgccatctaaagttcaagttggtgtgttctccgctactatgccacctgaagcccttgagatcacaaggaagttcatgaacaagcctgtgaggatcttggttaagcgtgatgagcttacccttgaaggtatcaaacagtttcatgtcaatgttgataaggaggagtggaagcttgaaactctatgtgatctatacgagaccctagccatcactcagagtgttatttttgttaacacccgccgcaaggttgactggctgacagacaagatgcgaagccgtgaccacacagtctcagctactcatggagatatggaccagaacactcgtgatatcattatgcgagaattccggtctggctcttctcgagttctcatcacaactgatctcctggcccgtggaattgatgtgcagcaagtgtcccttgtcataaattatgatctgccgactcaaccagaaaactaccttcaccgtattggacgaagtggacgttttggaagaaagggtgtcgccattaactttgtgacaagggatgatgacagaatgctgtttgatatccagaagttctataatgtggtcatcgaggagcttccatctaacgtggctgatctcctgtga

SEQ ID NO: 1614 - protein, 413 aa, Populus balsamifera subsp. trichocarpa
  misc_feature (1)..(413): Ceres ANNOT ID no. 1446198
  misc_feature (1)..(413): Functional Homolog of  Ceres  ID no. 42530
  misc_feature (298)..(374): Pfam Name: Helicase_C Pfam Description: Helicase conserved C-terminal domain
  misc_feature (64)..(230): Pfam Name: DEAD Pfam Description: DEAD/DEAH box helicase
MAGLAPEGSQFDSKQYDAKMNDLLANDGQDFFTSYDEVYDTFDSMGLQENLLRGIYAYGFEKPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHVVVGTPGRVFDMLRRQSLRPDYIKMFVLDEADEMLSRGFKDQIYDIFQLLPSKVQVGVFSATMPPEALEITRKFMNKPVRILVKRDELTLEGIKQFHVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDDRMLFDIQKFYNVVIEELPSNVADLL

SEQ ID NO: 1615 - DNA, 1242 bp, Populus balsamifera subsp. trichocarpa
  misc_feature (1)..(1242): Ceres ANNOT ID no. 1455209
atggctagttcggcacctgaaggatcccagtttgatgctcgtcaatttgattctaggatgaatgagctgctcacagctgaaggacaggatttctttacctcctatgatgaggtgcatgaaacttttgatgctatgaatttgaaggagaaccttctgaggggtatttacgcatatggttttgagaagccatctgcaattcagcaaagagggattgtcccattctgcaagggacttgatgtaatccaacaagcacaatcaggaactggaaagacagctacgttttgctctgggattttgcagcagcttgattatgatatagttgaatgccaagcattggttcttgcacctacccgagaactagctcaacagattgaaaaggttatgagagcactaggtgattatctgggtgtgaaggttcatgcttgtgttggtggaaccagtgttcgtgaggatcagcgtattctctcagctggggttcatgttgtagtcggtactcctggtcgtgtgtttgacatgttgcggagacaatcacttcgccctgactatatcaagatgtttgtattggatgaagcagatgaaatgctctcaagaggattcaaggatcagatatatgatattttccaattactgcccccaaagattcaggttggggtcttctctgctactatgccacctgaggccctagaaattacgaggaagttcatgaataaacctgtgaggattttagtgaagcgtgatgagcttacgcttgagggtatcaagcaattctatgttaatgttgacaaggaggaatggaagcttgagacactttgtgatctatatgagaccttggcaataacccaaagtgttatctttgtgaacaccaggcgcaaggtggattggctcacagacaagatgcgcagtcgtgatcacacagtctctgccactcatggagatatggaccaaaacacaagggacattattatgcgagaattccgctctggttcctctcgtgtgctgatcactactgatctgttggcccgtggtattgatgtccagcaagtctcacttgtgatcaattatgatctccctacccagccagagaactacctccatcgtattggtcgtagtggacgttttggaaggaagggtgttgctataaactttgttaccagggatgatgaaagaatgctttctgacatccagagattctataatgtaacggttgaggagctgccatcaaatgttgctgatcttctttga

SEQ ID NO: 1616 - protein, 413 aa, Populus balsamifera subsp. trichocarpa
  misc_feature (1)..(413): Ceres ANNOT ID no. 1455209
  misc_feature (1)..(413): Functional Homolog of  Ceres  ID no. 42530
  misc_feature (298)..(374): Pfam Name: Helicase_C Pfam Description: Helicase conserved C-terminal domain
  misc_feature (64)..(230): Pfam Name: DEAD Pfam Description: DEAD/DEAH box helicase
MASSAPEGSQFDARQFDSRMNELLTAEGQDFFTSYDEVHETFDAMNLKENLLRGIYAYGFEKPSAIQQRGIVPFCKGLDVIQQAQSGTGKTATFCSGILQQLDYDIVECQALVLAPTRELAQQIEKVMRALGDYLGVKVHACVGGTSVREDQRILSAGVHVVVGTPGRVFDMLRRQSLRPDYIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLSDIQRFYNVTVEELPSNVADLL

SEQ ID NO: 1617 - DNA, 1224 bp, Populus balsamifera subsp. trichocarpa
  misc_feature (1)..(1224): Ceres ANNOT ID no. 1530603
atggctggtttggcacctgaaggatcccaattcgatgctcgtcaattcgattctaagatgaatgagttgctcacaactgatgggcaagatttctttacttcatacgatgaggtgtatgacacttttgatgctatgggtttgaaggagaaccttctgaggggtatttatgcatatggttttgagaagccatctgcaattcaacaaagggggattgtcccattctgcaagggacttgatgtaatccagcaagcacaatcaggaactggaaaaacagctaccttttgctctggaattttgcagcagcttgattatgatgtagttgaatgccaagcactagttcttgcacctactcgagaactagcacaacagattgaaaaggttatgagagcactaggtgattatctgggtgtcaaggttcatgcttgtgttggtggaactagtgttcgtgaggaccagcgcattctctcagctggggttcatgttgtagttggtacccctggtcgtgtgttcgacatgttgcggagacaatcacttcggcctgactatatcaagatgtttgtattggatgaagcagatgaaatgctctcacgaggtttcaaggatcagttgctgcccccaaagattcaggttggggttttctccgctactatgccacctgaggcactagaaattacaaggaagttcatgaataaacctgtgaggattttagtgaagcgtgatgagcttacgcttgagggtatcaagcaattctatgttaatgttgacaaggaggaatggaagcttgagacgctttgtgatctatatgagaccttggcaataacccaaagtgtcatctttgtgaacactaggcgcaaggtagattggcttacagacaagatgcgcagtcgcgatcacacagtctctgccactcatggagatatggaccaaaacacaagggacattattatgcgggaatttcgctctggttcctctcgtgtgctgatcactactgatctgttagcccgtggtattgatgtccagcaagtatcacttgtgatcaattatgatctgccaacacagccagagaactacctccatcgtattggtcgtagtggacgttttggaaggaagggtgttgctataaattttgttaccaaggatgatgaaagaatgctttctgacatccagagattttataatgtgacagttgaggagctgccgtcaaatgttgctgatcttctttga

SEQ ID NO: 1618 - protein, 407 aa, Populus balsamifera subsp. trichocarpa
  misc_feature (1)..(407): Ceres ANNOT ID no. 1530603
  misc_feature (1)..(407): Functional Homolog of  Ceres  ID no. 42530
  misc_feature (292)..(368): Pfam Name: Helicase_C Pfam Description: Helicase conserved C-terminal domain
  misc_feature (64)..(224): Pfam Name: DEAD Pfam Description: DEAD/DEAH box helicase
MAGLAPEGSQFDARQFDSKMNELLTTDGQDFFTSYDEVYDTFDAMGLKENLLRGIYAYGFEKPSAIQQRGIVPFCKGLDVIQQAQSGTGKTATFCSGILQQLDYDVVECQALVLAPTRELAQQIEKVMRALGDYLGVKVHACVGGTSVREDQRILSAGVHVVVGTPGRVFDMLRRQSLRPDYIKMFVLDEADEMLSRGFKDQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLSDIQRFYNVTVEELPSNVADLL

SEQ ID NO: 1619 - DNA, 893 bp, Arabidopsis thaliana
  misc_feature (1)..(893): Ceres CLONE ID no. 45
  misc_feature (1)..(893): GEMINI ID 554G4
caaccattgttgcgtgtttggttatctcttctttcttctctctcacctaaatcaagggatttgttctgatcaactttgaacagaatttacaacaaatccctagaaaaatctgacccttccttcttcctctggaagatttaagatacttgttgataaggatattcggaagaagcttttgaaatttttggcaaaagtctcatttgatccgacttttctgttgaaggtgaaatagatacaaaaaaaaatgggctcagaggaaaacaacagcacaagctttccaccaacagagccaaagctctgtggataacggatgtggattcttcgggtcaccatccaacatgaatctctgctcgaaatgttacagaagcttaagagccgaggaagatcaaaccgcggtagcgaaagctgcggtgaagaactctttaaagcttccatcttgcagtatcattgcacctggacaaaaacatcctctggaaattaaaccagctcatttggaaaccgttgttgtaaccgctgagccgtcttcggtgcctgtagccgcggaacaggacgaggctgagccgtcgagacctgttagaccgaacaacaggtgtttcagctgtaacaagaaggttggtgtaatggggtttaagtgcaaatgcggtagcacgttttgcgggagtcataggtacccggagaagcatgagtgtagcttcgatttcaaagaagttggacgtgatgcaatcgcaaaggcgaatcctttggttaaggctgataaagttcagaggatttgaagaaaacaaactttgttatttttaagtatttctttgtcttctgcatttgatcagtttctgcctgggatgttcgatgtttggtttccatgaataaaaatgaaaattgctgctcttgctttc

SEQ ID NO: 1620 - protein, 175 aa, Arabidopsis thaliana
  misc_feature (1)..(175): Ceres CLONE ID no. 45
  misc_feature (1)..(175): GEMINI ID 554G4
  misc_feature (116)..(156): Pfam Name: zf-AN1 Pfam Description: AN1-like Zinc finger
  misc_feature (16)..(40): Pfam Name: zf-A20 Pfam Description: A20-like zinc finger
MGSEENNSTSFPPTEPKLCDNGCGFFGSPSNMNLCSKCYRSLRAEEDQTAVAKAAVKNSLKLPSCSIIAPGQKHPLEIKPAHLETVVVTAEPSSVPVAAEQDEAEPSRPVRPNNRCFSCNKKVGVMGFKCKCGSTFCGSHRYPEKHECSFDFKEVGRDAIAKANPLVKADKVQRI

SEQ ID NO: 1621 - protein, 172 aa, Brassica napus; identical to SEQ ID NO: 1494
  misc_feature (1)..(172): Ceres CLONE ID no. 962327
  misc_feature (113)..(153): Pfam Name: zf-AN1 Pfam Description: AN1-like Zinc finger
  misc_feature (16)..(40): Pfam Name: zf-A20 Pfam Description: A20-like zinc finger
  misc_feature (1)..(172): Functional Homolog of  Ceres  ID no. 45
  misc_feature (143)..(143): Xaa is any aa, unknown, or other
  misc_feature (151)..(151): Xaa is any aa, unknown, or other

SEQ ID NO: 1622 - protein, 175 aa, Zea mays
  misc_feature (1)..(175): Ceres CLONE ID no. 1360570
  misc_feature (1)..(175): Functional Homolog of  Ceres  ID no. 45
  misc_feature (116)..(156): Pfam Name: zf-AN1 Pfam Description: AN1-like Zinc finger
  misc_feature (16)..(40): Pfam Name: zf-A20 Pfam Description: A20-like zinc finger
MSSEQNNSTSFPPTEPKLCDNGCGFFGSPSNMNLCSKCYRSLRAEEDQTAVAKAAVEKSLKLPSCNLITAPEPKQPLETKPASLETVVIAGTSSVPPVATGQDEGEPSKPTRPNRCFSCNKKVGVMGFKCKCGSTFCGSHRYPEKHECSFDFKEVGRGAIAKANPVVKADKVQRI

SEQ ID NO: 1623 - DNA, 525 bp, Populus balsamifera subsp. trichocarpa
  misc_feature (1)..(525): Ceres ANNOT ID no. 1447323
atgggttctgagcaaaacgatggcacaagcttcccaccagcagagccaaagctttgtgttaatgggtgtggattttttggtacggctgcaaacatgaacctttgctccaagtgttaccgtgaccttcgtgccgaagaagagcaagctgcctctgccaaggctgccatggaaaagacactgaatatcaatccaaaacaaaatattgattctaaggttgttgtcgatgcccctcaagttgtggtggctaattccgtgcagtcagttgtgtctgctgaagcttcttcgtcagcagaaactgttgttgctggtggtgatcaggtgccatcaaagccggcaaataggtgctttagctgcagtaagaaggttggtttgacaggattccagtgcaagtgcggtggcacttactgcgggactcataggtacgcagagaatcacgagtgcctctttgatttcaaaggtgctggccgtgatgcaatcgcgaaggcaaatcctgtgattaaggctaataaggtggagaggttctga

SEQ ID NO: 1624 - protein, 174 aa, Populus balsamifera subsp. trichocarpa
  misc_feature (1)..(174): Ceres ANNOT ID no. 1447323
  misc_feature (1)..(174): Functional Homolog of  Ceres  ID no. 45
  misc_feature (115)..(155): Pfam Name: zf-AN1 Pfam Description: AN1-like Zinc finger
  misc_feature (16)..(40): Pfam Name: zf-A20 Pfam Description: A20-like zinc finger
MGSEQNDGTSFPPAEPKLCVNGCGFFGTAANMNLCSKCYRDLRAEEEQAASAKAAMEKTLNINPKQNIDSKVVVDAPQVVVANSVQSVVSAEASSSAETVVAGGDQVPSKPANRCFSCSKKVGLTGFQCKCGGTYCGTHRYAENHECLFDFKGAGRDAIAKANPVIKANKVERF

SEQ ID NO: 1625 - DNA, 516 bp, Populus balsamifera subsp. trichocarpa
  misc_feature (1)..(516): Ceres ANNOT ID no. 1491680
atgggttctgagcaaaacgaaggtacaagctttccatcgtcacagccacagctttgtgctaatggatgtggtttttttggcacggctgcaaacatgaacctttgctccaagtgttaccgtgaccttcgtgctgaagaagagcaagctgcctttgctaaggctgctatggaaaagacgctaaacatgaagtcacaacaacatattgactctagggttgctgttgatgcccctcaagttgcggtggctaattccatgcaatccgctgaagcctcttcttcggcagaaactgctgttgctgctggcgatcaggtgtcatcgaagccggcaaataggtgcttcagctgcaataagaaggttggcttgacaggattcatgtgcaaatgcggtggcacatactgtgggactcataggtactctgagaatcacgagtgctccttcgatttcaagggtgctggccgtaatgctattgccaaggcgaatcctgtgattaaggctgataaggtggggaggttctga

SEQ ID NO: 1626 - protein, 140 aa, Populus balsamifera subsp. trichocarpa
  misc_feature (1)..(140): Ceres ANNOT ID no. 1491680
  misc_feature (1)..(140): Functional Homolog of  Ceres  ID no. 45
  misc_feature (81)..(121): Pfam Name: zf-AN1 Pfam Description: AN1-like Zinc finger
MNLCSKCYRDLRAEEEQAAFAKAAMEKTLNMKSQQHIDSRVAVDAPQVAVANSMQSAEASSSAETAVAAGDQVSSKPANRCFSCNKKVGLTGFMCKCGGTYCGTHRYSENHECSFDFKGAGRNAIAKANPVIKADKVGRF

SEQ ID NO: 1627 - DNA, 583 bp, Glycine max
  misc_feature (1)..(583): Ceres CLONE ID no. 560731
  misc_feature (1)..(583): GEMINI ID 537H2
aatatgttgctactcatcactcactctcatcaccaacattttttaacagtcatttggaattatatcaccttacctctgatgttttaaaaatcttcatcatttgctccctctccacccttaaactggacatgctcgattctgtgcttctggcgcttttcttgccgtgcctcggcatgagcgccgttttcatcgtctacatgtgccttctctggtacgccaccaaccaccactccgaccccgcgctaccggccaagcctgtctccgacaccggaatctccccttcccagctcgacaagctccccagaatcaccggaaaggaccttctcatgggaaacgaatgcgccgtctgcctggacgagatcggaacagagcaaccggttcgggtggttcccggttgcaaccacgccttccatttggaatgcgccgacacctggctctccaagcaccctctctgccctctctgcagagccaaactcgacccttcgcttttctcttcttcccaaaatccatgctgaccaacaagctctagcgcaaagttggtagatgcatgacccagtttcttaaatatttcttgactgtatat

SEQ ID NO: 1628 - protein, 128 aa, Glycine max
  misc_feature (1)..(128): Ceres CLONE ID no. 560731
  misc_feature (1)..(128): GEMINI ID 537H2
  misc_feature (71)..(112): Pfam Name: zf-C3HC4 Pfam Description: Zinc finger, C3HC4 type (RING finger)
MLDSVLLALFLPCLGMSAVFIVYMCLLWYATNHHSDPALPAKPVSDTGISPSQLDKLPRITGKDLLMGNECAVCLDEIGTEQPVRVVPGCNHAFHLECADTWLSKHPLCPLCRAKLDPSLFSSSQNPC

SEQ ID NO: 1629 - DNA, 405 bp, Populus balsamifera subsp. trichocarpa
  misc_feature (1)..(405): Ceres GDNA ANNOT ID no. 1506045
atgcttgtctctgtgtttttggcacttttcctaccatgcgcaggcatgagcgctgtgtttattgtctatatctgtctcttgtggtatactgctaataatcagccagagattcgtttgcctgtaaagactgtgacagagaagggattgtcttcttcggagttagagaagttgcctaaggttaccgggaaagagcttgtcttggggactgaatgtgctgtttgtcttgatgacattgaaagtgaacaggtggctaggatggttcctggctgcaatcatgggtttcatttggaatgtgctgatacttggcttactaagcgtcctgtttgtcctgtttgtagggccaagcttgatgctcagctcttcagcacccctcctcctcctgctcaagagaacaatacttgttag

SEQ ID NO: 1630 - protein, 119 aa, Populus balsamifera subsp. trichocarpa
  misc_feature (1)..(119): Ceres GDNA ANNOT ID no. 1506045
  misc_feature (1)..(119): Functional Homolog of  Ceres  ID no. 560731
  misc_feature (56)..(97): Pfam Name: zf-C3HC4 Pfam Description: Zinc finger, C3HC4 type (RING finger)
MSAVFIVYICLLWYTANNQPEIRLPVKTVTEKGLSSSELEKLPKVTGKELVLGTECAVCLDDIESEQVARMVPGCNHGFHLECADTWLTKRPVCPVCRAKLDAQLFSTPPPPAQENNTC

SEQ ID NO: 1631 - DNA, 402 bp, Populus balsamifera subsp. trichocarpa
  misc_feature (1)..(402): Ceres GDNA ANNOT ID no. 1495397
atgcttgtctctgtgcttttcgcactttttctgccatgtgtaggtatgagcgtagtgttttttatctatatttgtctcctatggtatgctgctaataatcaaccagagaacattcctttaccggtaaaaactgtgacagagaagggtttgtcatcatcggagctcgagaagttgcctaaggtcaccgggaaagagcttgttttggggacagagtgtgctgtttgtctagatgacattgaaagtgaacagctggctaggatagttcctggctgcaatcatgggtttcatctggaatgtgctgatacttggctttccaagcaccctgtttgtcctgtttgtcgggcaaagcttgatgctcagttctccagtacttctgcttctccagagaacaatccttgttga

SEQ ID NO: 1632 - protein, 118 aa, Populus balsamifera subsp. trichocarpa
  misc_feature (1)..(118): Ceres GDNA ANNOT ID no. 1495397
  misc_feature (1)..(118): Functional Homolog of  Ceres  ID no. 560731
  misc_feature (57)..(98): Pfam Name: zf-C3HC4 Pfam Description: Zinc finger, C3HC4 type (RING finger)
MSVVFFIYICLLWYAANNQPENIPLPVKTVTEKGLSSSELEKLPKVTGKELVLGTECAVCLDDIESEQLARIVPGCNHGFHLECADTWLSKHPVCPVCRAKLDAQFSSTSASPENNPC

SEQ ID NO: 1633 - protein, 136 aa, Arabidopsis thaliana
  misc_feature (1)..(136): Ceres CLONE ID no. 4267
  misc_feature (1)..(136): Functional Homolog of  Ceres  ID no. 560731
  misc_feature (77)..(118): Pfam Name: zf-C3HC4 Pfam Description: Zinc finger, C3HC4 type (RING finger)
MIATVFMALLLPCVGMCIVFLIYLFLLWCSTRRRIERLRFAEPVKPVAGKGLSVLELEKIPKLTGRELAVIARSTECAVCLEDIESGQSTRLVPGCNHGFHQLCADTWLSNHTVCPVCRAELAPNLPQCNENQSPC

SEQ ID NO: 1634 - protein, 163 aa, Arabidopsis thaliana
  misc_feature (1)..(163): Ceres CLONE ID no. 4267
  misc_feature (1)..(163): Functional Homolog of  Ceres  ID no. 560731
  misc_feature (104)..(145): Pfam Name: zf-C3HC4 Pfam Description: Zinc finger, C3HC4 type (RING finger)
MHYTRISPALVPSLSPTAAAESSDGGTMIATVFMALLLPCVGMCIVFLIYLFLLWCSTRRRIERLRFAEPVKPVAGKGLSVLELEKIPKLTGRELAVIARSTECAVCLEDIESGQSTRLVPGCNHGFHQLCADTWLSNHTVCPVCRAELAPNLPQCNENQSPC

SEQ ID NO: 1635 - protein, 165 aa, Zea mays
  misc_feature (1)..(165): Ceres CLONE ID no. 1377336
  misc_feature (1)..(165): Functional Homolog of  Ceres  ID no. 560731
  misc_feature (106)..(147): Pfam Name: zf-C3HC4 Pfam Description: Zinc finger, C3HC4 type (RING finger)
MHYTRISPIILPSPPPTITATVESSGRGTMLATLFMALLLPCVGMCIVFLIYLFFLWCSTRRRIERLRFSEPVKLVTGKGLSVSELEKLPKLTGKELALEVRSTECPVCLENIESCQSARLVPGCNHGFHQLCADTWLSNHTVCPVCRGDLAQKVPQLSNNHSPC

SEQ ID NO: 1636 - DNA, 914 bp, Arabidopsis thaliana
  misc_feature (1)..(914): Ceres CLONE ID no. 6397
  misc_feature (1)..(914): GEMINI ID 531A4
  misc_feature: Encodes the peptide sequence at SEQ ID NO. 1637
  misc_feature: Encodes the peptide sequence at SEQ ID NO. 1755
acttcattagtctccaagaagaaaacatctctcactctctaaaatacacactctcatcaaaaaccttctcttcggttcagaagcattcaagaatccattatgagctcatctgattccgttaataacggcgttaactcacggatgtacttccgtaacccgagtttcagcaacgttatcttaaacgataactggagcgacttgccgttaagtgtcgacgattctcaagacatggctatttacaacactctccgtgatgccgttagctccgcctggacaccatccgttcctcccgttacctctccggcggaggaagataagcctccggcgacgaaggcgagtggctcacacgcgccgaggcagaaggggatgcagtacagaggagtgaggaggaggccgtgggggaaattcgcggcggagattagggatccgaagaagaacggagctagggtttggctcgggacttacgagacgccggaggacgcggcggtggcgtacgaccgagcggcgtttcagctcagaggatcgaaagctaagctgaattttccgcatttgattggttcttgtaagtatgagccggttaggattaggcctcgccgtcgctcgccggaaccgtcagtctccgatcagttaacgtcggagcagaagagggaaagccacgtggatgacggcaagtctagtttggttgtaccggagttggatttcacggtggatcagttttacttcgatggtagtttattaatggaccaatcagaatgttcttattctgataatcggatataattagttttaagattaagcaaaatttgtccaacgagttttgctgtatgaaatatctatcgatgactcaacaggttttgatcatgatcatatgtaatgtgatggaaattaaatattgacgtttgtttttttcttcc

SEQ ID NO: 1637 - protein, 226 aa, Arabidopsis thaliana
  misc_feature (1)..(226): Ceres CLONE ID no. 6397
  misc_feature (1)..(226): GEMINI ID 531A4
  misc_feature (90)..(142): Pfam Name: AP2 Pfam Description: AP2 domain
MSSSDSVNNGVNSRMYFRNPSFSNVILNDNWSDLPLSVDDSQDMAIYNTLRDAVSSAWTPSVPPVTSPAEEDKPPATKASGSHAPRQKGMQYRGVRRRPWGKFAAEIRDPKKNGARVWLGTYETPEDAAVAYDRAAFQLRGSKAKLNFPHLIGSCKYEPVRIRPRRRSPEPSVSDQLTSEQKRESHVDDGKSSLVVPELDFTVDQFYFDGSLLMDQSECSYSDNRI

SEQ ID NO: 1638 - protein, 211 aa, Glycine max
  misc_feature (1)..(211): Ceres CDNA ID no. 23401690
  misc_feature (1)..(211): Functional Homolog of  Ceres  ID no. 6397
  misc_feature (65)..(117): Pfam Name: AP2 Pfam Description: AP2 domain
MSSTTTDSDCSYLEQIQQYLLHNDSTILTPPQAFPSPSHDSSSDASVHFEHPSEAHDVNAPPKWRRYRGVRRRPWGKFAAEIRDPKKNGSRVWLGTYVNEEEAALAYDKAAFNMRGQKAKLNFPHLIGSAVQPEPPCLAVSKRSLPESSPPTSPYDSCESKGSKRRKSLVDLLNNLAKNKSQAKVVEMALEANEVEQWVNELNDCTLFWCS

SEQ ID NO: 1639 - protein, 202 aa, Glycine max
  misc_feature (1)..(202): Ceres CLONE ID no. 605218
  misc_feature (1)..(202): Functional Homolog of  Ceres  ID no. 6397
  misc_feature (1)..(202): GEMINI ID 531G11
  misc_feature (75)..(127): Pfam Name: AP2 Pfam Description: AP2 domain
MVSATVDSDFAFLESVQQYLLGHDSINLMSETHQAASHDPFSDPNKCDGDSGNIAFRSEDATAVVARDHAPPTWKHYRGVRRRPWGKFAAEIRDPKKNGARVWLGTYDTEEKAALAYDKAAFKMRGQKAKLNFPHLIDSDNSDELSEPVMMTTSKRSLLEISSPSSSCSDDSSESQGTKRRKSLAELLNKLAKNRSQVKVEC

SEQ ID NO: 1640 - protein, 233 aa, Nicotiana tabacum; identical to SEQ ID NO: 1073
  misc_feature (1)..(233): Public GI no. 57012759
  misc_feature (1)..(233): Functional Homolog of  Ceres  ID no. 6397
  misc_feature (97)..(149): Pfam Name: AP2 Pfam Description: AP2 domain

SEQ ID NO: 1641 - protein, 277 aa, Zea mays
  misc_feature (1)..(277): Ceres CLONE ID no. 282666
  misc_feature (1)..(277): Functional Homolog of  Ceres  ID no. 6397
  misc_feature (135)..(187): Pfam Name: AP2 Pfam Description: AP2 domain
MLLNPASETSVLDTIRQHLLEEPAAAEARPADESFGSLVADQWSGSLPFRTDDADDMVVFGVLQDAFAYGWLPDGSFVHVKPEPVRSPDSSSYHPCSYDGSPCFGLLDPEPPLTPGTTTPGRGQEEAAAAMARGKHYRGVRQRPWGKFAAEIRDPARNGARVWLGTYDTAEDAALAYDRAAYRMRGSRALLNFPLRIGSGDKRPSPAPPEPTTSSDSSSSSASGSHKRRKRGEAAAANMAMALVPSPSQLNRPAQPWFPAAPVEQAAMAPRVEQIVV

SEQ ID NO: 1642 - protein, 282 aa, Mesembryanthemum crystallinum; identical to SEQ ID NO: 1065
  misc_feature (1)..(282): Public GI no. 32401273
  misc_feature (1)..(282): Functional Homolog of  Ceres  ID no. 6397
  misc_feature (136)..(188): Pfam Name: AP2 Pfam Description: AP2 domain

SEQ ID NO: 1643 - protein, 223 aa, Glycine max
  misc_feature (1)..(223): Ceres CLONE ID no. 592713
  misc_feature (1)..(223): Functional Homolog of  Ceres  ID no. 6397
  misc_feature (84)..(136): Pfam Name: AP2 Pfam Description: AP2 domain
MATTISCDFSSVESIQHYLLELEHDFNTLMNASNHEICYSPTYNSFPSSTTFRLEGVHDAEGSLACKREHPKVEREFHAPPAWKRYRGVRRRPWGKFAAEIRDPKKNGARIWLGTYETEEEAGLAYDRAAFKMRGSKAKLNFPHLIGSHAPLKPIRVLTKTLKQNLLESDLSYSSAPQTQESKKRKNLTDLLNRLAKNRKQVEVFEMSLHASNDVNVDQWWSN

SEQ ID NO: 1644 - protein, 234 aa, Lycopersicon esculentum
  misc_feature (1)..(234): Public GI no. 3342211
  misc_feature (1)..(234): Functional Homolog of  Ceres  ID no. 6397
  misc_feature (104)..(156): Pfam Name: AP2 Pfam Description: AP2 domain
MDQQLPPTNFPVDFPVYRRNSSFSRLIPCLTEKWGDLPLKVDDSEDMVIYGLLKDALSVGWSPFNFTAGEVKSEPREEIESSPEFSPSPAETTAAPAAETPKGRHYRGVRQRPWGKFAAEIRDPAKNGARVWLGTYETAEEAAIAYDKAAYRMRGSKAHLNFPHRIGLNEPEPVRVTAKRRASPEPASSSGNGSMKRRRKAVQKCDGEMASRSSVMQVGCQIEQLTGVHQLLVI

SEQ ID NO: 1645 - protein, 237 aa, Nicotiana sylvestris; identical to SEQ ID NO: 1074
  misc_feature (1)..(237): Public GI no. 57012876
  misc_feature (1)..(237): Functional Homolog of  Ceres  ID no. 6397
  misc_feature (101)..(153): Pfam Name: AP2 Pfam Description: AP2 domain

SEQ ID NO: 1646 - protein, 289 aa, Triticum aestivum; identical to SEQ ID NO: 1079
  misc_feature (1)..(289): Ceres CLONE ID no. 555364
  misc_feature (1)..(289): Functional Homolog of  Ceres  ID no. 6397
  misc_feature (138)..(190): Pfam Name: AP2 Pfam Description: AP2 domain

SEQ ID NO: 1647 - protein, 166 aa, Brassica napus
  misc_feature (1)..(166): Ceres CLONE ID no. 944101
  misc_feature (48)..(100): Pfam Name: AP2 Pfam Description: AP2 domain
  misc_feature (1)..(166): Functional Homolog of  Ceres  ID no. 6397
  misc_feature (158)..(158): Xaa is any aa, unknown, or other
  misc_feature (162)..(162): Xaa is any aa, unknown, or other
MQQDLTSYDCSSVLDSIRRHLLEDDSESLSSFSSSSSPDLESTRRRGGNFKGVRRRPWGKYAAEIRDPNKHGARIWLGTYETAEEAAAAYDRAAFKLRGAKAKLNFPHLIGIDGPEPSRITKRRLSTPVSCSPVARRRNTDIINLTARVPCLAFHYFXNIDXTTWC

SEQ ID NO: 1648 - protein, 290 aa, Triticum aestivum
  misc_feature (1)..(290): Ceres CLONE ID no. 569593
  misc_feature (1)..(290): Functional Homolog of  Ceres  ID no. 6397
  misc_feature (139)..(191): Pfam Name: AP2 Pfam Description: AP2 domain
MLLNPASEAMVLDSIRQHLMEDTAAPAPEARRQRPAYCRSASFGSLVADQWSESLPFRADDSDDMVVYGALRDAFSCGWLPDGSFAAVKPEPLLPSPDSCYVGFLEPETPPATSPGGSEEEAAAAFMGEEAAAAVARGKHYRGVRQRPWGKFAAEIRDPAKNGARVWLGTYDTAEDAAVAYDRAAYRMRGSRALLNFPLRIGSEIAAAHAAAAAAGDKRPSPEPATSDSSSSSSSSGSPKRRKRGEAAAASMAMALVPPSSQLSRPAHAWYPAVPAEQVAMAPCVQQLVS

SEQ ID NO: 1649 - protein, 318 aa, Oryza sativa
  misc_feature (1)..(318): Public GI no. 50927517
  misc_feature (1)..(318): Functional Homolog of  Ceres  ID no. 6397
  misc_feature (151)..(203): Pfam Name: AP2 Pfam Description: AP2 domain
MTARSMLRNHPEASVLDTIRQHLLEEPRGGGGGEAAEASFGSLVADMWSDSLPFRDDDADDMVVFGAMRDAFSCGWLPDGVFAEVKPEPLLSPDSSSYDGSSCCFGFADVSEPVTPSDAASGAAEAAAAAAAATAEHGKEEEAAAAVARGKHYRGVRQRPWGKFAAEIRDPAKNGARVWLGTFDTAEDAALAYDRAAYRMRGSRALLNFPLRIGSEIAAAAAAAAAAAAGDKRPSPEPATSESSFSSSSSCTTTTTSSSTSSSGSPKRRKRGEAAAASMSMPLVPPPSQLNWPVQAWYPAAAPVEQVAITPRVEQLVI

SEQ ID NO: 1650 - protein, 237 aa, Arabidopsis thaliana; identical to SEQ ID NO: 1074
  misc_feature (1)..(237): Public GI no. 57012876
  misc_feature (1)..(237): Functional Homolog of  Ceres  ID no. 6397
  misc_feature (101)..(153): Pfam Name: AP2 Pfam Description: AP2 domain

SEQ ID NO: 1651 - protein, 234 aa, Arabidopsis thaliana; identical to SEQ ID NO: 1644
  misc_feature (1)..(234): Public GI no. 3342211
  misc_feature (1)..(234): Functional Homolog of  Ceres  ID no. 6397
  misc_feature (104)..(156): Pfam Name: AP2 Pfam Description: AP2 domain

SEQ ID NO: 1652 - DNA, 1338 bp, Glycine max
  misc_feature (1)..(1338): Ceres CLONE ID no. 660003
  misc_feature (1)..(1338): GEMINI ID 553H5
gtcataactttgctagatccatcaaagaagcagtgattcccccagcttccacatcaaatgaagccataatcatcatcatcatcaccacgcctcttctttctctttctccctaccattcacaatgtcatcgatacaccactactcaccggaaacaacactatactggaccagcgaccaccagcaacaacaacaacaacaacaacaacaacaacaacaagctgccacgtggcttagtaattcccacactccccgtttcaacctgaacgaagacgacgacgaggaagacgacgttgtcgtttcggacaaggctactaataatttggcgcaagaacaggagaaagaagcgatgttcgagaagccgttgacgccgagcgacgtcgggaagctgaaccggctcgtgatcccgaaacagcacgcggagaagtacttccctcttgactcgtccggcggtgactcggcggcggcgaaagggctcttgctgagtttcgaggacgagtcggggaagtgctggcgcttccgttactcttattggaacagtagccagagttacgttttgaccaaaggctggagccgttacgtcaaagacaaacgcctccacgcaggcgacgtcgttttgttccacagacaccgcgcccaccctcaacgcttcttcatctcctgcacccgccaccaacccaaccccaaccctcccgcgcacgttagcatcagatcctcctcctactctgcgctcccagcttatcctacgcaccatcatcatcacctccccttcccataccaacctcactctcttcacgcaccaggtggagggtcccaaggacagaacgaaacgacaccasgagggaacagttcaagtggcagggtgctgaggctgtttggggtgaacatggaatgccaacctgataatgataatgattcccaaaactccacacatgaatgctcctacacccacttataccaccatcaaacctcttcttatccttcttcaaaccctcaccatcacatgctacctcaacaaccataatagaaattagatatatatgcccccctctttattagattctcccccgttttttttttttcatttccagcttcagggttgaagtatgcccttaaattaattttagtcaatgaccgtgtcgttaacatgaacccgtgaaaggaacccttcttttattattagtatatttaggttgacgttgaagattatagaggatctttcttgtcttgaattagggagatgcatgcaaatggaaatgccttgtttattcgttttatcggatcttcttgttccctgtcactcgagcatattaattatcgactaagctgtgaatgcatgcc

SEQ ID NO: 1653 - protein, 299 aa, Glycine max
  misc_feature (1)..(1338): Ceres CLONE ID no. 660003
  misc_feature (76)..(181): Pfam Name: B3 Pfam Description: B3 DNA binding domain
  misc_feature (1)..(299): GEMINI ID 553H5
  misc_feature (239)..(239): Xaa is any aa, unknown, or other
MSSIHHYSPETTLYWTSDHQQQQQQQQQQQQQAATWLSNSHTPRFNLNEDDDEEDDVVVSDKATNNLAQEQEKEAMFEKPLTPSDVGKLNRLVIPKQHAEKYFPLDSSGGDSAAAKGLLLSFEDESGKCWRFRYSYWNSSQSYVLTKGWSRYVKDKRLHAGDVVLFHRHRAHPQRFFISCTRHQPNPNPPAHVSIRSSSYSALPAYPTHHHHHLPFPYQPHSLHAPGGGSQGQNETTPXGNSSSGRVLRLFGVNMECQPDNDNDSQNSTHECSYTHLYHHQTSSYPSSNPHHHMLPQQP

SEQ ID NO: 1654 - protein, 244 aa, Glycine max
  misc_feature (1)..(244): Public GI no. 26450255
  misc_feature (1)..(244): Functional Homolog of  Ceres  ID no. 660003
  misc_feature (37)..(146): Pfam Name: B3 Pfam Description: B3 DNA binding domain
MSINQYSSDFHYHSLMWQQQQQQQQHQNDVVEEKEALFEKPLTPSDVGKLNRLVIPKQHAERYFPLAAAAADAVEKGLLLCFEDEEGKPWRFRYSYWNSSQSYVLTKGWSRYVKEKHLDAGDVVLFHRHRSDGGRFFIGWRRRGDSSSSSDSYRHVQSNASLQYYPHAGAQAVESQRGNSKTLRLFGVNMECQLDSDWSEPSTPDGSNTYTTNHDQFHFYPQQQHYPPPYYMDISFTGDMNRTS

SEQ ID NO: 1655 - protein, 279 aa, Triticum aestivum
  misc_feature (1)..(279): Ceres CLONE ID no. 763852
  misc_feature (1)..(279): Functional Homolog of  Ceres  ID no. 660003
  misc_feature (36)..(140): Pfam Name: B3 Pfam Description: B3 DNA binding domain
MAMNPLSQEHPNAWPWGVAMYTNLHYQQYHYEKEHLFEKALTPSDVGKLNRLVIPKQHAERCFPLGGDSGEKGLLLSFDDEAGKPWRFRYSYWTSSQSYVLTKGWSRYVKEKHLEAGDVVHFERVRGLGTGDRLFIGCRRRGDVSAPTAVAPPPAVHVVPASGQSPREQQQHQQPWSPMCYSTSTSYPTSPATSHAYRRSAEHDHSDMHHAGESQWDADTRSCSPASAPTRRLRLFGVNLDCAPEPEAEAVPATPAMYGYVHQSPYAAVSPVPSNWGSS

SEQ ID NO: 1656 - DNA, 843 bp, Populus balsamifera subsp. trichocarpa
  misc_feature (1)..(843): Ceres ANNOT ID no. 1508184
atgtctataaaccatttctccacagaccttcaagaaacactcagctggtgggcacagcaacatcaacaacaacaacccatcatggaaccaaacccaaaccagcagcaagatgaaacacaacaagaacaagaagtactagtactagataaagaacccatgtttgagaaacccttaacaccaagtgatgtaggaaaactaaaccgtttagtaataccaaaacaacatgcagagaagtactttccacttagtggtgactcagtggataaagggttgttactgagttttgaagacgagtccggcaggtattggaagttcaggtactcatattggaacagtagtcaaagctatgtattgactaaagggtggagtagatatgtgaaagagaaacaacttgatgcaggtgatgtcgttttgtttgaacgacaccgtacggatggtgacagattgttcatagggtggaggaggagaggtgagagtggcagtaacagtggggtgatggtgcagggtagtggtggtggggtgtggagcagaggaatattatatccatcatcatcttctgggcctcatcatctttctactgctaatgtgccataccaaccttactgtctccatgcagggtccattgcacagaaccaaacaacaccgcttgggaactcaaagagactcaggttatttggggtgaacttggagtgccagcttgatgggtccgagccatcaacacctgatggttcttctgtgtccagcctgcagggtcccggccacccgcaattctactctcaatcttcttattcttcaaacagtactcatggtcaaatggagaatttgtttacgtatagccattaa

SEQ ID NO: 1657 - protein, 280 aa, Populus balsamifera subsp. trichocarpa
  misc_feature (1)..(280): Ceres ANNOT ID no. 1508184
  misc_feature (1)..(280): Functional Homolog of  Ceres  ID no. 660003
  misc_feature (53)..(159): Pfam Name: B3 Pfam Description: B3 DNA binding domain
MSINHFSTDLQETLSWWAQQHQQQQPIMEPNPNQQQDETQQEQEVLVLDKEPMFEKPLTPSDVGKLNRLVIPKQHAEKYFPLSGDSVDKGLLLSFEDESGRYWKFRYSYWNSSQSYVLTKGWSRYVKEKQLDAGDVVLFERHRTDGDRLFIGWRRRGESGSNSGVMVQGSGGGVWSRGILYPSSSSGPHHLSTANVPYQPYCLHAGSIAQNQTTPLGNSKRLRLFGVNLECQLDGSEPSTPDGSSVSSLQGPGHPQFYSQSSYSSNSTHGQMENLFTYSH

SEQ ID NO: 1658 - DNA, 852 bp, Populus balsamifera subsp. trichocarpa
  misc_feature (1)..(852): Ceres ANNOT ID no. 1528645
atgtctataaaccatttctccacagaccttcagcaaacactcagctggtggcaacaagaagaagcacaacgagaacacgaacaagaagggctagtacaagataaagaacccatgtttgagaaacccttaacaccaagtgatgtaggaaagctaaaccgtctagtaataccaaaacaacatgcggagaagtactttccacttagtggtgactcagtggataaagggttgttactgagtttcgaagacgagtcaggcaaatattggaggtttaggtactcatattggaacagtagtcaaagctatgtattgactaaagggtggagtaggtatgtgaaagagaaacaactcgatgcaggtgatgccgttttgtttgaacgacaccgaacggatggtgacagattgttcatagggtggaggaggagaggtgagatgagtagcagtagtagtgctaataatagtggggtgatggtgcagggtagtggtggtggggcgtggagaagaggattatattcttctccatcatcttctgggccttatcatctttctggtagtaatatgcaacatggccatggggctaatgtgagtgctacaactgtgccattccaatctgactttcttcatgcagtgtctgctgcacagaaccaaacagcacagccaggtaactcgaggagactgaggctatttggggttaacttggagtgccagctcgacgaggccgagccaccaacacctgacggttcatctctgtcgagcctacagggccctgttcaccagcaattctactcccaacctgcttattcttcaaacagtactcatagtcaaatggtaagcccacatgaccttataatttag

SEQ ID NO: 1659 - protein, 283 aa, Populus balsamifera subsp. trichocarpa
  misc_feature (1)..(283): Ceres ANNOT ID no. 1528645
  misc_feature (1)..(283): Functional Homolog of  Ceres  ID no. 660003
  misc_feature (38)..(144): Pfam Name: B3 Pfam Description: B3 DNA binding domain
MSINHFSTDLQQTLSWWQQEEAQREHEQEGLVQDKEPMFEKPLTPSDVGKLNRLVIPKQHAEKYFPLSGDSVDKGLLLSFEDESGKYWRFRYSYWNSSQSYVLTKGWSRYVKEKQLDAGDAVLFERHRTDGDRLFIGWRRRGEMSSSSSANNSGVMVQGSGGGAWRRGLYSSPSSSGPYHLSGSNMQHGHGANVSATTVPFQSDFLHAVSAAQNQTAQPGNSRRLRLFGVNLECQLDEAEPPTPDGSSLSSLQGPVHQQFYSQPAYSSNSTHSQMVSPHDLII

SEQ ID NO: 1660 - DNA, 686 bp, Glycine max
  misc_feature (1)..(686): Ceres CLONE ID no. 681088
  misc_feature (1)..(686): GEMINI ID 531F12
tgccactctatacactgtgaatggaccatcaacctccaccgtgccccgccgccgcctccgcaacggacaaccctcgtggcggaacgcgccaccccatgtaccgcggcgtccgcaagcgccggtggggcaaatgggtctccgaaatccgggagccacggaagaagaaccgcatatggttggggtcgtttccggtgccggagatggcggcacgagcatacgacgtcgcagcctactgcctcaaaggccggaaggcgcagctcaactttcccgacgacgtcgactccctgccgcttccgtcgtcccgcacggcaagagacattcagaccgccgcggcccaggcggcgcgtatgatgaaagcttccggcaatgatgagaaaagcggcattgcctccgacgacggcgatagcggttgcgatgatttttggggcgagattgagttgccagagctgatggacggcgagtgctactggggttgtccggccggcgcttcctcctggacttcctccggcgatctcgccgagtggccggaggaggagctttcgccgcagcaaccgtcgtttatggcatgtctataatctactgtatctctgtattaatgctgcatgttcagttgttgttggtatgtttcttgtattatatatcctattcctaatgttatatcctatgtgccaactgttcctgttgtc

SEQ ID NO: 1661 - protein, 184 aa, Glycine max
  misc_feature (1)..(184): Ceres CLONE ID no. 681088
  misc_feature (1)..(184): GEMINI ID 531F12
  misc_feature (25)..(76): Pfam Name: AP2 Pfam Description: AP2 domain
MDHQPPPCPAAASATDNPRGGTRHPMYRGVRKRRWGKWVSEIREPRKKNRIWLGSFPVPEMAARAYDVAAYCLKGRKAQLNFPDDVDSLPLPSSRTARDIQTAAAQAARMMKASGNDEKSGIASDDGDSGCDDFWGEIELPELMDGECYWGCPAGASSWTSSGDLAEWPEEELSPQQPSFMACL

SEQ ID NO: 1662 - DNA, 597 bp, Populus balsamifera subsp. trichocarpa
  misc_feature (1)..(597): Ceres ANNOT ID no. 1471330
atggagcaaccaccatacactgaagatgacccgaccacaaactctccagaggcagccaccgccaaaacccaccaaaattctgagactccacggggcagcggcactcgaaatcctgtctatcgcggtgtccgaaaacggaggtgggggaaatgggtgtctgaaattagagagccacgcaagaaatcacgtatctggctaggctcatttcctgtgccagaaatggcagccaaggcatatgatgtggcagcgtattgtcttaaaggttgtaaagcgcagcttaattttcccgacgaagtggatgacttgcctagaccgtccacgtgtacggccagggacatccaagcagcagcagcaaaggcagcacattcagtgctgcttccaacgaaaaagagcatcgaaacaaatagtgataatagtgttgacggagaagttgccgatgatgatttctggggcgagatagaattgccggaattgttgacgagtaacagtgggtgctgttggaattcttgtggatggagtactacttttgcaagtgatagttcaacgtggcagcaggatggagagggtctaccacagttcatggcatgtctttattag

SEQ ID NO: 1663 - protein, 198 aa, Populus balsamifera subsp. trichocarpa
  misc_feature (1)..(198): Ceres ANNOT ID no. 1471330
  misc_feature (1)..(198): Functional Homolog of  Ceres  ID no. 681088
  misc_feature (38)..(89): Pfam Name: AP2 Pfam Description: AP2 domain
MEQPPYTEDDPTTNSPEAATAKTHQNSETPRGSGTRNPVYRGVRKRRWGKWVSEIREPRKKSRIWLGSFPVPEMAAKAYDVAAYCLKGCKAQLNFPDEVDDLPRPSTCTARDIQAAAAKAAHSVLLPTKKSIETNSDNSVDGEVADDDFWGEIELPELLTSNSGCCWNSCGWSTTFASDSSTWQQDGEGLPQFMACLY

SEQ ID NO: 1664 - DNA, 534 bp, Populus balsamifera subsp. trichocarpa
  misc_feature (1)..(534): Ceres ANNOT ID no. 1444437
atgacccgactacaaattcccgatactacccggggaagcggcacccgacaccccgcctaccgcggtgtccgaaaacggaggtggggaaaatgggtgtctgaaattagagagccacgcaagaaatcacgcatttggctaggctcatttcctgtgccagaaatggcagccaaggcatatgatgtggcagcgtattgtcttaaaggtcgcaaagcgcagctcaattttccagaagaagccgatgacttgcctataccgtccacgtgtacggccagggatattcaagcagcagcagcaaaggctgcacattcggtactgattccaatgaaaaagagcagcgaaactaacaatgatggtggcggtgacggtgaagttgctggtgatgatttctggggcgagattgaattgccggaattgctgctgagtaatagcgggtacagttgggattcttgtggatggaatactactcttgcaagtgataattcaacgtggcagccggatggagagggtctacagccatccatggcatgtctttaa

SEQ ID NO: 1665 - protein, 177 aa, Populus balsamifera subsp. trichocarpa
  misc_feature (1)..(177): Ceres ANNOT ID no. 1444437
  misc_feature (1)..(177): Functional Homolog of  Ceres  ID no. 681088
  misc_feature (18)..(69): Pfam Name: AP2 Pfam Description: AP2 domain
MTRLQIPDTTRGSGTRHPAYRGVRKRRWGKWVSEIREPRKKSRIWLGSFPVPEMAAKAYDVAAYCLKGRKAQLNFPEEADDLPIPSTCTARDIQAAAAKAAHSVLIPMKKSSETNNDGGGDGEVAGDDFWGEIELPELLLSNSGYSWDSCGWNTTLASDNSTWQPDGEGLQPSMACL

SEQ ID NO: 1666 - DNA, 534 bp, Populus balsamifera subsp. trichocarpa
  misc_feature (1)..(534): Ceres ANNOT ID no. 1444439
atgacccgactacaaattcccgatactacccggggaagcggcaaccgacaccccgcctaccgcggtgtccgaaaacggaggtggggaaaatgggtgtctgaaattagagagccacgcaagaaatcacgcatttggctaggctcatttcctgtgccagaaatggcagccaaggcatacgatgtggcagcgtattgtcttaaaggtcgcaaagcgcagctcaattttcctgaagaagtcgatgacttgcctataccgtccacgtgtacggccagggctattcaagcagcagcagcaaaggctgcacattcggtactgattccaatgaaaaagagcagcgaaacaaacaatggtggtggcagtgacggtgaagttgctggtgatgatttctggggcgagattgaattgccggagttgctgctgagtaatagcgggtacagttgggattcttgtggatggaatactactcttgcaagtgataattcaacgtggcagccggatggagagggtctacagccatccatggcatgtctttaa

SEQ ID NO: 1667 - protein, 177 aa, Populus balsamifera subsp. trichocarpa
  misc_feature (1)..(177): Ceres ANNOT ID no. 1444439
  misc_feature (1)..(177): Functional Homolog of  Ceres  ID no. 681088
  misc_feature (18)..(69): Pfam Name: AP2 Pfam Description: AP2 domain
MTRLQIPDTTRGSGNRHPAYRGVRKRRWGKWVSEIREPRKKSRIWLGSFPVPEMAAKAYDVAAYCLKGRKAQLNFPEEVDDLPIPSTCTARAIQAAAAKAAHSVLIPMKKSSETNNGGGSDGEVAGDDFWGEIELPELLLSNSGYSWDSCGWNTTLASDNSTWQPDGEGLQPSMACL

SEQ ID NO: 1668 - DNA, 567 bp, Populus balsamifera subsp. trichocarpa
  misc_feature (1)..(567): Ceres ANNOT ID no. 1486891
atggaaggaagaaccagggacggccatccggggattagtcagccaagatatcgaggtgtacgacagcgaaaatgggggaaatgggtgtccgaaatccgggagcctggtaagaagacaagaatttggcttgggagttatgagatgcctgaaatggccgcggcggcatatgatgtggcagcattacaccttagaggacgtggggctcaactaaactttccagaaatggtggatagtttgccccggccggcgagctctagcactgaggatgtgcaaatggcagcacaagaggcggctttgctgtttcggagaccgataaaatgttcagagggagtaggtggtagctctagtggcggcgggggcagtttaggtcctgttagggttgggttgtcaccaagccaaattcaagctataaatgaggcaccactggactcaccaaaaatgtggatggagttagctggggctcttctgttggatgagcctgtggctatgggtgatgatattgatgtcgaactcagtgatgagtggggtgaaatggagcatgagcatgactccatttgggattattaa

SEQ ID NO: 1669 - protein, 188 aa, Populus balsamifera subsp. trichocarpa
  misc_feature (1)..(188): Ceres ANNOT ID no. 1486891
  misc_feature (1)..(188): Functional Homolog of  Ceres  ID no. 681088
  misc_feature (15)..(66): Pfam Name: AP2 Pfam Description: AP2 domain
MEGRTRDGHPGISQPRYRGVRQRKWGKWVSEIREPGKKTRIWLGSYEMPEMAAAAYDVAALHLRGRGAQLNFPEMVDSLPRPASSSTEDVQMAAQEAALLFRRPIKCSEGVGGSSSGGGGSLGPVRVGLSPSQIQAINEAPLDSPKMWMELAGALLLDEPVAMGDDIDVELSDEWGEMEHEHDSIWDY

SEQ ID NO: 1670 - DNA, 558 bp, Populus balsamifera subsp. trichocarpa
  misc_feature (1)..(558): Ceres ANNOT ID no. 1479637
atggaaggaagaatcagggacggccatcttgggattagtccgccgcgatatagaggtgtacgacaacggaaatgggggaaatgggtgtccgaaatccgggagcctggcaagaagacaagaatttggctcgggagttatgagatgcctgaaatggcggcggccgcatacgacgttgcagcattgcaccttagaggacgtggggcgcaactaaattttcctgagatggtggatattttgccccagccagcgagctctagcgcggaggatgtgcaaatggcggcacaagaggcggctttgatgtttcggagaccaatgaaatgctcggaggctgtaagcggcgattccagtgttggtggtggtttaggtcctgttagggttgggttgtcaccgagccaaattcaagctataaacgaggcaccattggactcaccaaaaatgtggatggagttagctggggctcttctgctggaagagcctatgatcatgagtgatgatattgatgttgcgtatagagatgagaggggagaaatgcagcatgattccatttgggattattaa

SEQ ID NO: 1671 - protein, 185 aa, Populus balsamifera subsp. trichocarpa
  misc_feature (1)..(185): Ceres ANNOT ID no. 1479637
  misc_feature (1)..(185): Functional Homolog of  Ceres  ID no. 681088
  misc_feature (15)..(66): Pfam Name: AP2 Pfam Description: AP2 domain
MEGRIRDGHLGISPPRYRGVRQRKWGKWVSEIREPGKKTRIWLGSYEMPEMAAAAYDVAALHLRGRGAQLNFPEMVDILPQPASSSAEDVQMAAQEAALMFRRPMKCSEAVSGDSSVGGGLGPVRVGLSPSQIQAINEAPLDSPKMWMELAGALLLEEPMIMSDDIDVAYRDERGEMQHDSIWDY

SEQ ID NO: 1672 - DNA, 570 bp, Populus balsamifera subsp. trichocarpa
  misc_feature (1)..(570): Ceres ANNOT ID no. 1446530
atggaaggaagaagcagggacgcccatggtgatcagattagtactccgagatatcgaggtattcggcaaagaaaatgggggacatgggtgtccgaaatccgggagcctggtcagaaaacaagaatttggctcggaagttacgagaagcctgaaatggctgcggtcgcgtatgatgtggcagcattgcaccttaggggacgtggggcacagctgaattttcctgaaatggaagatagcctcccccggccagccagttctagagcggaggacgtgcaagcggcagcacgggaggcagctttgctgtttagtactggaccagtaaaatgctcggatattgtaagctgtggctctattactagtgatggtggttttggtcctgttagagtggggttgtcaccgagccaaattcaagctattaacgaagcaccactggactcgccaaaaatgtggacggagtacttggctgagtctcttttgacgggagagccgatggctatggagaacgatattggtgtcggatatagtgaatgggaggaaattcaacaagaatccatttggggttactactaa

SEQ ID NO: 1673 - protein, 189 aa, Populus balsamifera subsp. trichocarpa
  misc_feature (1)..(189): Ceres ANNOT ID no. 1446530
  misc_feature (1)..(189): Functional Homolog of  Ceres  ID no. 681088
  misc_feature (16)..(67): Pfam Name: AP2 Pfam Description: AP2 domain
MEGRSRDAHGDQISTPRYRGIRQRKWGTWVSEIREPGQKTRIWLGSYEKPEMAAVAYDVAALHLRGRGAQLNFPEMEDSLPRPASSRAEDVQAAAREAALLFSTGPVKCSDIVSCGSITSDGGFGPVRVGLSPSQIQAINEAPLDSPKMWTEYLAESLLTGEPMAMENDIGVGYSEWEEIQQESIWGYY

SEQ ID NO: 1674 - DNA, 1681 bp, Glycine max
  misc_feature (1)..(1681): Ceres CLONE ID no. 691319
  misc_feature (1)..(1681): GEMINI ID 284E8
  misc_feature (1)..(1681): GEMINI ID 553H6
aaaagggtgtccaaagaaggaatcacacaagagaaattttgggtggatcttggtaatttaaatttggtccaaaaatagtaagaaaaaaaaaccatagttcatttaattttcatgtccttgctaacggtggcgcaccaaagggggtcaggtgagtttatccggttcacggaaagtcatggcggtggtggcgatgacgtcagtggtgacggtgaacatggttgtggacatgatgatggaagtggtgctggaggttcactagggttgaattttaaccaagtgatgcaacaaggtgaggtgacaatgcaaggtggttcattggtttcagggtataacaggggtgatccagagttgagagaaatagtttcagctttgacacacgtggtgtcttcagggtctggccagaggagcaccgaattgacccagcaaagtggttttcctatgatgtctgcttcttctctttcacgtttgtctgctttctcttcttcttctccttctccttcttctggagcctcttgggttggccacaaaagaggcagagaagaagaagagaatagtacttcacataacttgatgcaacaacaacaacaaagtgctccaagactcttcagaaacattggtgacttcatggtgccttctcaaggagactcatcatcagtgacagaagaagcccccacctccacaactacaactgtaaccgccgtcactgaaaacccaccaggaggtggggaaaggaggagaaagtacagaggagtgaggcagaggccatggggaaaatgggcagcagaaatccgtgatccacacaaagcagcaagagtttggctaggcacatttgacacagaagaagcagcagcaagagcctatgatgaagctgcattgaggttcagaggcaacagagcaaagcttaacttccctgaaaatgtaagagcagttccacccattcaaccttttcaagccaccactaggctaaccgtttctgattccaccacctctcaattccggccactctccgcggtggcgccacccttcattcagcagccacagattcagggctcctctgacttgatcagagactacttgcaatactctcagcttctacagagtgattttcaacagcaacaaatacaacaacaacagcagcagcagcggcagcagcagcagcggcagcggcagcagcggcagcagcagcagcaacaacaacaacaaccatctagtttgcttcagcagttgtactataatgcacaatttgcttcacttcaatcaccttcaatgctatcatcatctccttcattttcttcttctgtgtctccagcaccattcccattattcacaacctctgcttctttccccttgttttcaagtcaacaaatgggctatttccagccaccggaaagccgcaatcccgctggcggcgtgccggagtttccaacgtccacatggtcggataccagtagccagccaccaccttctggttgatacagtgttttagtttccttcatattttcctttttcttttttctttctttcattcttagcataaaaaaaaaagacttgttatacttatttcttttttcaagggtgaaactatgatatagttttttttaagtatttttggtactattctcgtatcagaattagagtttcagtaatttatgttgatattcaatacaaatctttattatgt

SEQ ID NO: 1675 - protein, 453 aa, Glycine max
  misc_feature (1)..(1681): Ceres CLONE ID no. 691319
  misc_feature (1)..(453): GEMINI ID 284E8
  misc_feature (1)..(453): GEMINI ID 553H6
  misc_feature (209)..(260): Pfam Name: AP2 Pfam Description: AP2 domain
MSLLTVAHQRGSGEFIRFTESHGGGGDDVSGDGEHGCGHDDGSGAGGSLGLNFNQVMQQGEVTMQGGSLVSGYNRGDPELREIVSALTHVVSSGSGQRSTELTQQSGFPMMSASSLSRLSAFSSSSPSPSSGASWVGHKRGREEEENSTSHNLMQQQQQSAPRLFRNIGDFMVPSQGDSSSVTEEAPTSTTTTVTAVTENPPGGGERRRKYRGVRQRPWGKWAAEIRDPHKAARVWLGTFDTEEAAARAYDEAALRFRGNRAKLNFPENVRAVPPIQPFQATTRLTVSDSTTSQFRPLSAVAPPFIQQPQIQGSSDLIRDYLQYSQLLQSDFQQQQIQQQQQQQRQQQQRQRQQRQQQQQQQQQPSSLLQQLYYNAQFASLQSPSMLSSSPSFSSSVSPAPFPLFTTSASFPLFSSQQMGYFQPPESRNPAGGVPEFPTSTWSDTSSQPPPSG

SEQ ID NO: 1676 - protein, 331 aa, Zea mays
  misc_feature (1)..(331): Ceres CLONE ID no. 1475648
  misc_feature (1)..(331): Functional Homolog of  Ceres  ID no. 691319
  misc_feature (136)..(187): Pfam Name: AP2 Pfam Description: AP2 domain
MCCAPKVANAEGRGPCRCCAGGEEDDEDGQQPAAAWRMLSGYERSREASMMVDALATVVAGGATPPATAGARQQQVSPEGQWWSDYYAGDVTPPPSLPAPAAHEHGAARIPATAASPSSSSQAPSPSSTGSGTPRRRYRGVRQRPWGKWAAEIRDPHKAARVWLGNFDTAEAAARAYDVAALRFRGSRAKLNFPESATLAAPPPTAAAAAVPPPPSPPPQRPEALLESQALALAGGREYSEYARFLQCPADPPRLYDQAPAATVPSAASGSASSSFPVLFRFGGGGESSGAASSQWWTQGSRSVSQEGAGSPPASWADSAWWPAPPRDPPR

SEQ ID NO: 1677 - protein, 391 aa, Arabidopsis thaliana
  misc_feature (1)..(391): Public GI no. 30725634
  misc_feature (1)..(391): Functional Homolog of  Ceres  ID no. 691319
  misc_feature (183)..(234): Pfam Name: AP2 Pfam Description: AP2 domain
MCVLKVANQEDNVGKKAESIRDDDHRTLSEIDQWLYLFAAEDDHHRHSFPTQQPPPSSSSSSLISGFSREMEMSAIVSALTHVVAGNVPQHQQGGGEGSGEGTSNSSSSSGQKRRREVEEGGAKAVKAANTLTVDQYFSGGSSTSKVREASSNMSGPGPTYEYTTTATASSETSSFSGDQPRRRYRGVRQRPWGKWAAEIRDPFKAARVWLGTFDNAESAARAYDEAALRFRGNKAKLNFPENVKLVRPASTEAQPVHQTAAQRPTQSRNSGSTTTLLPIRPASNQSVHSQPLMQSYNLSYSEMARQQQQFQQHHQQSLDLYDQMSFPLRFGHTGGSMMQSTSSSSSHSRPLFSPAAVQPPPESASETGYLQDIQWPSDKTSNNYNNSPSS

SEQ ID NO: 1678 - protein, 393 aa, Populus balsamifera subsp. trichocarpa
  misc_feature (1)..(393): Ceres ANNOT ID no. 1452324
  misc_feature (1)..(393): Functional Homolog of  Ceres  ID no. 691319
  misc_feature (158)..(209): Pfam Name: AP2 Pfam Description: AP2 domain
MGYSSSAEMSAMVSALTHVVSGHRGSTSDWGSYGASGLGGATITSTIVQAAPGSNTSPASPSLSAYSSTSGSGSWIGQKRGREKEAGAAAQLKESLPRVHRGFDDFRSSLGDSPSSGATATEEVSASTLVFSTTATPSTTATPSSETASLGETGERKRRYRGVRQRPWGKWAAEIRDPHKAARVWLGTFETAEAAARAYDEAALRFRGSRAKLNFPENARLLPAQMQNVTASQVPISRSQLPSHHQLQSISSPRQQAQRPQVPAPALFQSQPDIIRDYWEYSQLLQSSGDFHGQQQPPPSNLLEQMFYNPQLASLQSSTLSSLPSSTSGSSFAAIPSGSISSTLSPSASSFPLLFAGQQLGYFRPPENQNPAAGSDFPVPPWTDCSRRPSSTG

SEQ ID NO: 1679 - protein, 398 aa, Populus balsamifera subsp. trichocarpa
  misc_feature (1)..(398): Ceres ANNOT ID no. 1443093
  misc_feature (1)..(398): Functional Homolog of  Ceres  ID no. 691319
  misc_feature (158)..(209): Pfam Name: AP2 Pfam Description: AP2 domain
MGYSSSTEMSMVSELTHVVSGQRGSTSDWGSYGAVGLGGATITSNFGQAAPGSNTSTPASPPLSAYSSTSGSGLWIGQKRGREEEAGAAAQLMESLPRVYRGFNDFRSSQGDSSSSGATATEEVSASTIVIPTTTTPSTTATPSSEIASLEETGEQRRRYRGVRQRPWGKWAAEIRDPHKAARVWLGTFDTAEAAARAYDDAALRFRGNRAKLNFPENVRLLPAQTQNVTASQVPISHSQLSSHLQLQPISSPRQQAQRPQAPAPALFQSQADIIRDYWEYSQLLQSSGEFHHHQQQQQQQQQPSSLLQPMFYNPQVASLQSSALTSLSSSTSVSSLAAISSGSSPSTFSPSASSFPLLFAGQQLGYFRPPQNQNPASGSDFPVPPWTDSSHNPSSSG

SEQ ID NO: 1680 - DNA, 1208 bp, Arabidopsis thaliana
  misc_feature (1)..(1208): Ceres CLONE ID no. 7559
  misc_feature (1)..(1208): GEMINI ID 531D4
gtctcctttccagaacaatctaacgctttctcgaacatcttcttcttcttctttctcgaaattatttttccagtgatcaatttcttctcttctagatttttacaggaactaattttctgctctgaggtatcagatgagtagccgatggaatcgtacgatctacgttgggaatttgcctggagatattcgcaagtgtgaggttgaagatctcttctacaagtatggaccaattgtggacattgatttgaagattccaccgagacctcctggttatgcctttgtcgagtttgaagatcctcgtgatgcagacgatgcaatttatggacgtgatggttatgattttgatgggtgtcgacttcgggttgagattgcacatggtggtcgtagattttcaccatcagttgataggtacagcagcagctacagtgcgagccgtgcaccttcaagacgctctgactatcgcgtgcttgtgaccggattaccgccttctgcttcgtggcaggaccttaaggatcacatgcgcaaagctggagatgtctgcttctctgaagttttccctgaccgtaaaggcatgtctggggttgtggattatagcaactatgatgatatgaagtacgcaataaggaaacttgatgccactgaatttcgaaatgctttctctagtgcttatatacgggtgagggaatatgagtcgaggagtgtgagtcgaagcccagatgattctaaaagctatagaagcaggagtcggagccgtggtccaagctgtagctatagtagcaagagcaggagtgtgtcacctgctagatccatttccccgcgttcacggccccttagtcgttctcgctcgccatacagctctgtctcaaggtcccaatcaagatcaaaatcaagatcaagatcaagatcgaattctccagtttcacctgtgatatctggatgaaaatgaaaactggccactggctgtacccgaatcgtctcaagcttctcaggctccactgctaatagaatttgattccgatttgggattattatactggtcttcttgtatgggacgaccaatatgtctttctagttttagttgtgaacctggaatgtggtctgttattgtgtcattaaaaagccggaaactctgtctcggctgcataataaagttcatcagacgttgtgttgggtgtggtgaggtttttccatacatatacatttacatt

SEQ ID NO: 1681 - protein, 270 aa, Arabidopsis thaliana
  misc_feature (1)..(270): Ceres CLONE ID no. 7559
  misc_feature (1)..(270): GEMINI ID 531D4
  misc_feature (9)..(77): Pfam Name: RRM_1 Pfam Description: RNA recognition motif. (a.k.a. RRM, RBD, or RNP domain)
  misc_feature (255)..(255): Xaa is any aa, unknown, or other
  misc_feature (256)..(256): Xaa is any aa, unknown, or other
  misc_feature (257)..(257): Xaa is any aa, unknown, or other
MSSRWNRTIYVGNLPGDIRKCEVEDLFYKYGPIVDIDLKIPPRPPGYAFVEFEDPRDADDAIYGRDGYDFDGCRLRVEIAHGGRRFSPSVDRYSSSYSASRAPSRRSDYRVLVTGLPPSASWQDLKDHMRKAGDVCFSEVFPDRKGMSGVVDYSNYDDMKYAIRKLDATEFRNAFSSAYIRVREYESRSVSRSPDDSKSYRSRSRSRGPSCSYSSKSRSVSPARSISPRSRPLSRSRSPYSSVSRSQSRSKSRSXXXSRSNSPVSPVISG

SEQ ID NO: 1682 - DNA, 1146 bp, Populus balsamifera subsp. trichocarpa
  misc_feature (1)..(1146): Ceres ANNOT ID no. 1469241
  misc_feature: Encodes the peptide sequence at SEQ ID NO. 1683
atgagccgagcaagtcgaacactttacgtcggaaatcttcctggtgatattcgcctgagggaagttgaagatttgttttataagtatgggcccattgtcgacattgatttgaaaatcccgccaaggcctccaggctatgcttttgttgagtttgaagaagctcgtgatgctgaagatgcaattcgtggccgggatggatataattttgatgggtgtagattacgggttgagcttgcccatggtgggcgaagacattcatcaccagtggatcattatagcagttacagtggtagcagtggtagccgtgggccttccaagcgctctgactatcgtgtgttagtgactggattgccttcttctgcttcatggcaagacctaaaggatcatatgcgtcgagctggtgatgtctgcttttctcaagtctttcgtgatcgtggtggcatgacaggaattgtggactacacaaactatgatgacatgaaatatgctatcaagaagcttgatgactctgagttccggaatgcattttcaagggcatatattcgggtgagggagtatgattctagacggagttactctaggagccccagtctcagttcatatgtgtcaagaagccggagtcgaagtcgcagtggaggctatagtgacaggagctggagcaagtctcccagggcaaaacattcacggcgttctcgatctgtatctgtttcttctcgctctcgtgcaggatcatctccacgatctttttcaaggtccctttcaagatcaagatctcctcttgcttctcctcctcgcagaaaacatggccacagaaccccaagcataagccctggtcgtgtatcccgttcgccttctatcgttgatgagatcttgttcgcttggtcatggaacgtttccatgttcttggtgaacttgacgacacctataaagctagacatgactcatgtatacagttatatttggactattgaccatgagattattctcaacttatcaatctttagatcgagatttaacggcattcgcaagtgctttgtatcttttagactacaggatgtgcctgtggtacttattcccccggttttagatcacgatcacggacctgatgctgttgctgttgctgtagagcaggatgctaaacggtaa

SEQ ID NO: 1683 - protein, 381 aa, Populus balsamifera subsp. trichocarpa
  misc_feature (1)..(381): Ceres ANNOT ID no. 1469241
  misc_feature (1)..(381): Functional Homolog of  Ceres  ID no. 7559
  misc_feature (8)..(76): Pfam Name: RRM_1 Pfam Description: RNA recognition motif. (a.k.a. RRM, RBD, or RNP domain)
MSRASRTLYVGNLPGDIRLREVEDLFYKYGPIVDIDLKIPPRPPGYAFVEFEEARDAEDAIRGRDGYNFDGCRLRVELAHGGRRHSSPVDHYSSYSGSSGSRGPSKRSDYRVLVTGLPSSASWQDLKDHMRRAGDVCFSQVFRDRGGMTGIVDYTNYDDMKYAIKKLDDSEFRNAFSRAYIRVREYDSRRSYSRSPSLSSYVSRSRSRSRSGGYSDRSWSKSPRAKHSRRSRSVSVSSRSRAGSSPRSFSRSLSRSRSPLASPPRRKHGHRTPSISPGRVSRSPSIVDEILFAWSWNVSMFLVNLTTPIKLDMTHVYSYIWTIDHEIILNLSIFRSRFNGIRKCFVSFRLQDVPVVLIPPVLDHDHGPDAVAVAVEQDAKR

SEQ ID NO: 1684 - protein, 241 aa, Zea mays
  misc_feature (1)..(381): Ceres CLONE ID  no. 298172
  misc_feature (1)..(381): Functional Homolog of  Ceres  ID no. 7559
  misc_feature (9)..(77): Pfam Name: RRM_1 Pfam Description: RNA recognition motif. (a.k.a. RRM, RBD, or RNP domain)
MSRRNSRTIYVGNLPGDIREREVEDLFYKYGRILDIDLKIPPRPPGYAFVEFEDPRDADDAIYGRDGYNFDGYRLRVELAHGGRGQSYSYDRSSSYSSACRGGVSRRSDFRVMVTGLPSSASWQDLKDHMRRAGDVCFSDVYREAGETIGIVDYTNYDDMKYAIRKLDDSQFRNAFSRAYIRVREYDARSRSRSRSHSYSRSPSYSRSRSPKSVSQSPSSVDERFAFVFPRFGHAAIWGLH

SEQ ID NO: 1685 - protein, 269 aa, Triticum aestivum
  misc_feature (1)..(269): Ceres CLONE ID  no. 844350
  misc_feature (1)..(269): Functional Homolog of  Ceres  ID no. 7559
  misc_feature (10)..(78): Pfam Name: RRM_1 Pfam Description: RNA recognition motif. (a.k.a. RRM, RBD, or RNP domain)
MSRRSNGRTIYVGNLPEDIREREIEDLFYKYGPIVDIDLKIPPRPPVYAFVEFEDPRDADDAIYGRDGYDFDGHKLRVELAHGGKGPYFIRPSSYSSSGRHGAVRRSDYRVIVTGLPSSASWQDLKDHMRRAGDVCFSDVYPEAGAITGIVEYTNYEDMKHAIRKLDDSEFRNAFSRAYIRVREYNARRSRSYSRGRSRSCSYSRSRSHSYSRSKSPRSRPASRSPSPVKARSSSRSLSPAAPAHDKSASRSPVRSRSLPRSQSPVKSE

SEQ ID NO: 1686 - protein, 260 aa, Zea mays
  misc_feature (1)..(260): Public GI no. 52140009
  misc_feature (1)..(260): Functional Homolog of  Ceres  ID no. 7559
  misc_feature (9)..(77): Pfam Name: RRM_1 Pfam Description: RNA recognition motif. (a.k.a. RRM, RBD, or RNP domain)
MSRRNSRTIYVGNLPGDIREREVEDLFYKYGRILDIDLKIPPRPPGYAFVEFEDPRDADDAIYGRDGYNFDGYRLRVELAHGGRGQSYSYDRSSSYSSACRGGVSRRSDFRVMVTGLPSSASWQDLKDHMRRAGDVCFSDVYREAGETIGIVDYTNYDDMKYAIRKLDDSQFRNAFSRAYIRVREYDARSRSRSRSHSYSRSPSYSRSRSPKSVSQSPSSVDERSLSRSRSPISSPSHARYATSPRSRSASRSRSPVRSD

SEQ ID NO: 1687 - protein, 263 aa, Zea mays
  misc_feature (1)..(263): Ceres CLONE ID  no. 298172
  misc_feature (1)..(263): Functional Homolog of  Ceres  ID no. 7559
  misc_feature (12)..(80): Pfam Name: RRM_1 Pfam Description: RNA recognition motif. (a.k.a. RRM, RBD, or RNP domain)
MKTMSRRNSRTIYVGNLPGDIREREVEDLFYKYGRILDIDLKIPPRPPGYAFVEFEDPRDADDAIYGRDGYNFDGYRLRVELAHGGRGQSYSYDRSSSYSSACRGGVSRRSDFRVMVTGLPSSASWQDLKDHMRRAGDVCFSDVYREAGETIGIVDYTNYDDMKYAIRKLDDSQFRNAFSRAYIRVREYDARSRSRSRSHSYSRTPSYSRSRSPKSVSQSPSSVDERSLSRSRSPISSPSHARYATSPRSRSASRSRSPVRSD

SEQ ID NO: 1688 - protein, 253 aa, Zea mays
  misc_feature (1)..(253): Public GI no. 52140013
  misc_feature (1)..(253): Functional Homolog of  Ceres  ID no. 7559
  misc_feature (9)..(77): Pfam Name: RRM_1 Pfam Description: RNA recognition motif. (a.k.a. RRM, RBD, or RNP domain)
MTRRNGCTIYVGNLPGDIREREVDDLFYKYGRIVEIDLKIPPRPPGFAFVEFEDARDAEDAIYGRDGYNFDGHRLRVELAHGGRGTSSFDRSSSYSSAGQRGASKRSDYRVMVTGLPSSASWQDLKDHMRRAGDVCFTDVYREAGATIGIADYTNYEDMKHAIRKLDDSEFRNAFSRTYVRVREYDARRSRSRSRGRNRSKSRSRSHSHSYSRSRSCSYSKSRSPRSRSASESKSPVKARLGQCEDLGIALVG

SEQ ID NO: 1689 - protein, 310 aa, Glycine max
  misc_feature (1)..(310): Ceres CLONE ID  no. 541062
  misc_feature (1)..(310): Functional Homolog of  Ceres  ID no. 7559
  misc_feature (9)..(77): Pfam Name: RRM_1 Pfam Description: RNA recognition motif. (a.k.a. RRM, RBD, or RNP domain)
MSRRSSRTVYVGNLPGDIREREVEDLFLKYGHITHIDLKVPPRPPGYAFVEFEDAQDAEDAIRGRDGYDFDGHRLRVEPAHGGRGHSSSKDRHNSHSNGRGGRGVSRRSEYRVLVTGLPSSASWQDLKDHMRKAGDVCFSQVFHDGRGTTGIVDYTNYDDMKYAIKKLDDSEFRNAFSKGYVRVREYDSRRDSSRSPSHGPSHSRGRSYSRSRSRSHSYSRDRSQSKSPKGKSSQRSPAKSPKGKSSQRSPAKSPSRSPSRSRSRSRSRSLSGSRSRSRSPLPPRNKSPKKRSASRSPSRSRSRSKSLSR

SEQ ID NO: 1690 - protein, 264 aa, Zea mays
  misc_feature (1)..(264): Public GI no. 52140015
  misc_feature (1)..(264): Functional Homolog of  Ceres  ID no. 7559
  misc_feature (9)..(77): Pfam Name: RRM_1 Pfam Description: RNA recognition motif. (a.k.a. RRM, RBD, or RNP domain)
MTRRNGCTIYVGNLPGDIREREVDDLFYKYGRIVEIDLKIPPRPPGFAFVEFEDARDAEDAIYGRDGYNFDGHRLRVELAHGGRGTSSFDRSSSYSSAGQRGASKRSDYRVMVTGLPSSASWQDLKDHMRRAGDVCFTDVYREAGATIGIADYTNYEDMKHAIRKLDDSEFRNAFSRTYVRVREYDARRSRSRSRGRNRSKSRSRSHSHSYSRSRSCSYSKSRSPRSRSASESKSPVKASCTTETRKLWPCWTISIHVGYIFVC

SEQ ID NO: 1691 - DNA, 992 bp, Arabidopsis thaliana
  misc_feature (1)..(992): Ceres CLONE ID no. 92102
  misc_feature (1)..(992): GEMINI ID 159A3
  misc_feature (1)..(992): GEMINI ID 532F1
attcccacttccacacatacacatatacaacagagcaagagagtcaatcaagtagagtgaagatggcaactaaacaagaagctttagccatcgatttcataagccaacaccttctcacagactttgtttccatggaaactgatcacccatctctttttaccaaccaacttcacaactttcactcagaaacaggccctagaaccatcaccaaccaatcccctaaaccgaattcgactcttaaccagcgtaaaccgcccttaccgaatctatccgtctcgagaacggtttcaacaaagacagagaaagaggaagaagagaggcactacaggggagtgagacgaagaccgtggggaaaatacgcggcggagattagggatccgaacaaaaagggttgtaggatctggcttgggacttacgacactgccgtggaagctggaagagcttatgaccaagcggcgtttcaattacgtggaagaaaagcaatcttgaatttccctctcgatgttagggttacgtcagaaacttgttctggggaaggagttatcggattagggaaacgaaagcgagataagagttctccgccggaagaggagaaggcggctagggttaaagtggaggaagaagagagtaatacgtcggagacgacggaggctgaggttgagccggtggtaccattgacgccgtcaagttggatggggttttgggatgtgggagcaggagatggtattttcagtattcctccgttatctccgacgtctcccaacttttccgttatctccgtcacttaaaacttcggaaaagtcaacgtacgatgacgttttcacttgcgtcactctcatgatttcatttattcttgtataatataaaggtagcggtagtgtgcaaatatcaaataagtagtttaattagtaccaatcattttattcattattttttttagtagaatatttggatgttgaaaatataaatttaattttgtatttgttgatgtt

SEQ ID NO: 1692 - protein, 241 aa, Arabidopsis thaliana
  misc_feature (1)..(241): Ceres CLONE ID no. 92102
  misc_feature (1)..(241): GEMINI ID 159A3
  misc_feature (1)..(241): GEMINI ID 532F1
  misc_feature (86)..(138): Pfam Name: AP2 Pfam Description: AP2 domain
MATKQEALAIDFISQHLLTDFVSMETDHPSLFTNQLHNFHSETGPRTITNQSPKPNSTLNQRKPPLPNLSVSRTVSTKTEKEEEERHYRGVRRRPWGKYAAEIRDPNKKGCRIWLGTYDTAVEAGRAYDQAAFQLRGRKAILNFPLDVRVTSETCSGEGVIGLGKRKRDKSSPPEEEKAARVKVEEEESNTSETTEAEVEPVVPLTPSSWMGFWDVGAGDGIFSIPPLSPTSPNFSVISVT

SEQ ID NO: 1693 - DNA, 867 bp, Populus balsamifera subsp. trichocarpa
  misc_feature (1)..(867): Ceres ANNOT ID no. 1484557
atggcatcttttgatgaagcttcagctttggaactcattagggagcacctcttgactgactttgcttccatggacagcttaatcaccaatcttgatgatctttgcagtacttccagctcctgtattactactgactacatcaagactgaatcaacagaattcgacccctttaatcaatcagagcacccacaacctaagctgcagagtcaatctagcatcgaatccaagccccaatcctcaccaaagtctccaagcactctaagccagagaaaaccatccatgatcaagaacatcgcaattcctccaccagcaaccttgaacatgaccccacaagtagtacagccagtggtgatcaaggcagatgtttcaagtgaacaagaaaggcattacaggggcgttaggcgtaggccatggggcaaatatgcagctgagatccgtgaccctaacaaaaaaggagctcgtgtatggcttggaacatttgatacagccattgaagctgcaaaagcttatgacagtgctgctttcaggctacgtggaagtaaagcaatcttgaatttccctcttgaagctggaaagtctaattctcagcaacctgaacaattcttggaaacttcaagcaagaaaagaaagattgaagaaatagagagtagtatggaaagtactggttctgtgatcactaataaggtggcgaagagggaaagttcttcgccggaaactgaggtcaaagcagcggctacggaaccattaacgccgtcaagttggaaggggttctgggatggtgaagtcatggggatatttaatgtgccaccattgtcaccgttatctccccatccttcatttgggtattcaaggctgatggttgtttga

SEQ ID NO: 1694 - protein, 288 aa, Populus balsamifera subsp. trichocarpa
  misc_feature (1)..(288): Ceres ANNOT ID no. 1484557
  misc_feature (1)..(288): Functional Homolog of  Ceres  ID no. 92102
  misc_feature (128)..(180): Pfam Name: AP2 Pfam Description: AP2 domain
MASFDEASALELIREHLLTDFASMDSLITNLDDLCSTSSSCITTDYIKTESTEFDPFNQSEHPQPKLQSQSSIESKPQSSPKSPSTLSQRKPSMIKNIAIPPPATLNMTPQVVQPVVIKADVSSEQERHYRGVRRRPWGKYAAEIRDPNKKGARVWLGTFDTAIEAAKAYDSAAFRLRGSKAILNFPLEAGKSNSQQPEQFLETSSKKRKIEEIESSMESTGSVITNKVAKRESSSPETEVKAAATEPLTPSSWKGFWDGEVMGIFNVPPLSPLSPHPSFGYSRLMVV

SEQ ID NO: 1695 - DNA, 864 bp, Populus balsamifera subsp. trichocarpa
  misc_feature (1)..(864): Ceres ANNOT ID no. 1438401
atggcatcttttgatcatgaagcttcaacattggaactcattaggcaacacctcttgactgactttgcttccatggacagcttcatctccaatcttgatgatctttgcagcacttccaccaccagtactactgatgactactacatcaagtctgaatcaacagaatttgatccctttgatcaaccacaattcaagctgcaaactcaatctagcattgaatccaagcctcaatattcctcaccaaagtcttcaacttctctaagccagagaaaaccatccatgatcaaggacatagccatacctccaccagcaaccttgaacatgaacccacaagtagcacagccagtggtgaacaagacagatttgtctagtgaacaagataggcattacaggggtgttaggcgtaggccttggggaaaatatgcagcggagatccgtgaccctaacaaaaaaggagctcgtgtatggcttggaacatttgatactgccattgaagctgccaaagcttatgatagcgctgctttcaggttacgaggaagcaaagcgatcttgaatttccctcttgaagctggcaagtcgaattctcaacaacctgaacaattcttggaaacttcttgcaagaaaagaaagtttgaaggaataaagagtagcgtggaaggtactaattctatcactaataaggtggtgaagagggagacttcttcaccggaaagtgaggtcaaagcggttgcttcgggtccattaacgccgtcaagttggaaggggttttgggatggtgaaaccatggggatatttagtgtgccaccattatcgccgttatctccacatccttcatttggatattcaaggctcatggttgtttga

SEQ ID NO: 1696 - protein, 287 aa, Populus balsamifera subsp. trichocarpa
  misc_feature (1)..(287): Ceres ANNOT ID no. 1438401
  misc_feature (1)..(287): Functional Homolog of  Ceres  ID no. 92102
  misc_feature (128)..(180): Pfam Name: AP2 Pfam Description: AP2 domain
MASFDHEASTLELIRQHLLTDFASMDSFISNLDDLCSTSTTSTTDDYYIKSESTEFDPFDQPQFKLQTQSSIESKPQYSSPKSSTSLSQRKPSMIKDIAIPPPATLNMNPQVAQPVVNKTDLSSEQDRHYRGVRRRPWGKYAAEIRDPNKKGARVWLGTFDTAIEAAKAYDSAAFRLRGSKAILNFPLEAGKSNSQQPEQFLETSCKKRKFEGIKSSVEGTNSITNKVVKRETSSPESEVKAVASGPLTPSSWKGFWDGETMGIFSVPPLSPLSPHPSFGYSRLMVV

SEQ ID NO: 1697 - DNA, 858 bp, Brassica napus
  misc_feature (1)..(858): Ceres CLONE ID no. 968026
  misc_feature (1)..(858): GEMINI ID 553C6
atcatccaactttgagtataacatttaattttgctcttctctctattctcttaaagatccaatatatcgcatggctgaggttatgctaccgatgaaaatggagatggctaacgatccttccaagtttacatcacctgatcttcttcatgttctcgccgtcgacgacagtcacgttgatcggaaattcatagaacgcttgctcaaagtctcttcctgtaaagttaccgttgttgatagtgcgacaagagctctgcaataccttggactagacgtaaacgagaaacccatcggttgtaaggatttgaaagttaatttgatcatgacggattactctatgcccggaatgactggatatgaactcttgaagaagatcaaagaatcgtcagctttcagagatgtgcctgtggtggttatgtcatctgagaacattttgtctcgtattgatagatgtcttgaagaaggggctgaagatttcttactgaagccggtaaaactctcggatgtaagaagaataagagattctctgattaaagttgaagatttatctttcacaaagagtattaacaagagagagctagaaacagagaatgtctactccttggactcatctgttcccttgcagctcaaacgcacaaagatytgagctttcccaagcagactaccatgacatgatctttaaaaagcttaatcacctatacaattttccaccccctggtgtctttttttttgctgagtaaaaaactcagtgttgacagagaaacagggcttattcatagactatgttagcaatgtaaatggtagagataaaccmcaaaactattatattattattcattagagatgtcatgttttttttyt

SEQ ID NO: 1698 - protein, 190 aa, Brassica napus
  misc_feature (1)..(190): Ceres CLONE ID no. 968026
  misc_feature (1)..(190): GEMINI ID 553C6
  misc_feature (25)..(144): Pfam Name: Response_reg Pfam Description: Response regulator receiver domain
MAEVMLPMKMEMANDPSKFTSPDLLHVLAVDDSHVDRKFIERLLKVSSCKVTVVDSATRALQYLGLDVNEKPIGCKDLKVNLIMTDYSMPGMTGYELLKKIKESSAFRDVPVVVMSSENILSRIDRCLEEGAEDFLLKPVKLSDVRRIRDSLIKVEDLSFTKSINKRELETENVYSLDSSVPLQLKRTKI

SEQ ID NO: 1699 - DNA, 672 bp, Populus balsamifera subsp. trichocarpa
  misc_feature (1)..(672): Ceres ANNOT ID no. 1473516
atggcaacggccggcgagatcttaaggagaagtttgacggaagaagttggattttctaaagggtctgtttctggttcagaggagttgcatgttcttgctgtagatgatagctttgtagacaggaaggttatagagaggttgcttaagatatcatcttgtaaagtgactgttgtagagagtgggagtagagctttgcagtatcttggattggatggagagaagagctctgttgggttcaatgatttgaaaatcaatctcatcatgaccgattactccatgccggggatgacaggatatgagctgcttaaaaagattaaggaatcatcagctttcagagagattcctgtagtgatcatgtcatctgagaacatcttggctcgtattgataggtgtttagaagaaggggcagaagaatacatacttaagccagtgaaattgtcagatgtgaaacgaattaaagatgttataatgggaggcgatggagagcaaaagaaaaggagaagtgttaggaagagaggaagggaagattgtttctattcattatcacaaccacagcttgtacaatcatcctcgtcccctgcttttgattttctgccgtccgaacttcagtcttcatcaccattttctactttgagtttgtcaaagaggcctaaattgcaaaccagagactaa

SEQ ID NO: 1700 - protein, 223 aa, Populus balsamifera subsp. trichocarpa
  misc_feature (1)..(223): Ceres ANNOT ID no. 1473516
  misc_feature (1)..(223): Functional Homolog of  Ceres  ID no. 968026
  misc_feature (29)..(153): Pfam Name: Response_reg Pfam Description: Response regulator receiver domain
MATAGEILRRSLTEEVGFSKGSVSGSEELHVLAVDDSFVDRKVIERLLKISSCKVTVVESGSRALQYLGLDGEKSSVGFNDLKINLIMTDYSMPGMTGYELLKKIKESSAFREIPVVIMSSENILARIDRCLEEGAEEYILKPVKLSDVKRIKDVIMGGDGEQKKRRSVRKRGREDCFYSLSQPQLVQSSSSPAFDFLPSELQSSSPFSTLSLSKRPKLQTRD

SEQ ID NO: 1701 - DNA, 660 bp, Populus balsamifera subsp. trichocarpa
  misc_feature (1)..(660): Ceres ANNOT ID no. 1526929
atggcaacggccggcgagatcttaaggagaagtttgacggaagaagttggattttctaaagggtctgtttctggttcagaggagttgcatgttcttgctgtagatgatagctttgtagacaggaaggttatagagaggttgcttaagatatcatcttgtaaagagagtgggagtagagctttgcagtatcttggattggatggagagaagagctctgttgggttcaatgatttgaaaatcaatctcatcatgaccgattactccatgccggggatgacaggatatgagctgcttaaaaagattaaggaatcatcagctttcagagagattcctgtagtgatcatgtcatctgagaacatcttggctcgtattgataggtgtttagaagaaggggcagaagaatacatacttaagccagtgaaattgtcagatgtgaaacgaattaaagatgttataatgggaggcgatggagagcaaaagaaaaggagaagtgttaggaagagaggaagggaagattgtttctattcattatcacaaccacagcttgtacaatcatcctcgtcccctgcttttgattttctgccgtccgaacttcagtcttcatcaccattttctactttgagtttgtcaaagaggcctaaattgcaaaccagagactaa

SEQ ID NO: 1702 - protein, 219 aa, Populus balsamifera subsp. trichocarpa
  misc_feature (1)..(219): Ceres ANNOT ID no. 1526929
  misc_feature (1)..(219): Functional Homolog of  Ceres  ID no. 968026
  misc_feature (29)..(149): Pfam Name: Response_reg Pfam Description: Response regulator receiver domain
MATAGEILRRSLTEEVGFSKGSVSGSEELHVLAVDDSFVDRKVIERLLKISSCKESGSRALQYLGLDGEKSSVGFNDLKINLIMTDYSMPGMTGYELLKKIKESSAFREIPVVIMSSENILARIDRCLEEGAEEYILKPVKLSDVKRIKDVIMGGDGEQKKRRSVRKRGREDCFYSLSQPQLVQSSSSPAFDFLPSELQSSSPFSTLSLSKRPKLQTRD

SEQ ID NO: 1703 - DNA, 777 bp, Populus balsamifera subsp. trichocarpa
  misc_feature (1)..(777): Ceres ANNOT ID no. 1513366
atgagttcgaacagcatagcttcgaatcgttggatgtcggagaagatggacggcttcgatccctctcccaattccaattcagataacgaagaggagggagttcatgtactggcagtggatgatagtcttgttgatcgcaaagtcatcgagcgtttgctcaagatttcttcttgtaaagtgacagcagtggacagtggatggagagctctaaaattgcttggattattagacgaagaagacaagagcagcagctcctcctcctcctcatctgctggttttgatgtgttgaaggtggatctaattattactgactactgtatgcctggaatgacaggatatgagttgctcaagaaaatcaaggaatcaactactttcagagaaatcccagttgtaattatgtcatcagagaacgtggtggctcgaatcgaccgatgtttggaggaaggagctgaggatttcatagtgaagccagtgaaattatcagacgttaaacgtataagagattacatggcaagcagagaggtcagatcagttcaaaaccaggaggagagaagcagcagcaatatcaacaagagaaaattacaagagtgttttgatctatctttatcttcatcgccaccctctatttcatcatcctcatcatcctcgttatcatatccctcacggtctccgtctctgacgccatctccaccatcgttgttttcttcatcagcgccgtgttctccctcgtcgttagattctccgactagacggctcaaaatgacgggcttcgattag

SEQ ID NO: 1704 - protein, 243 aa, Populus balsamifera subsp. trichocarpa
  misc_feature (1)..(243): Ceres ANNOT ID no. 1513366
  misc_feature (1)..(243): Functional Homolog of  Ceres  ID no. 968026
  misc_feature (19)..(152): Pfam Name: Response_reg Pfam Description: Response regulator receiver domain
MDGFDPSPNSNSDNEEEGVHVLAVDDSLVDRKVIERLLKISSCKVTAVDSGWRALKLLGLLDEEDKSSSSSSSSSAGFDVLKVDLIITDYCMPGMTGYELLKKIKESTTFREIPVVIMSSENVVARIDRCLEEGAEDFIVKPVKLSDVKRIRDYMASREVRSVQNQEERSSSNINKRKLQECFDLSLSSSPPSISSSSSSSLSYPSRSPSLTPSPPSLFSSSAPCSPSSLDSPTRRLKMTGFD

SEQ ID NO: 1705 - DNA, 732 bp, Populus balsamifera subsp. trichocarpa
  misc_feature (1)..(732): Ceres ANNOT ID no. 1460097
atggacggcttcgatccctctcccaattccaattcagataacgaagaggagggagttcatgtactggcagtggatgatagtcttgttgatcgcaaagtcatcgagcgtttgctcaagatttcttcttgtaaagtgacagcagtggacagtggatggagagctctaaaattgcttggattattagacgaagaagacaagagcagcagctcctcctcctcctcatctgctggttttgatgtgttgaaggtggatctaattattactgactactgtatgcctggaatgacaggatatgagttgctcaagaaaatcaaggaatcaactactttcagagaaatcccagttgtaattatgtcatcagagaacgtggtggctcgaatcgaccgatgtttggaggaaggagctgaggatttcatagtgaagccagtgaaattatcagacgttaaacgtataagagattacatggcaagcagagaggtcagatcagttcaaaaccaggaggagagaagcagcagcaatatcaacaagagaaaattacaagagtgttttgatctatctttatcttcatcgccaccctctatttcatcatcctcatcatcctcgttatcatatccctcacggtctccgtctctgacgccatctccaccatcgttgttttcttcatcagcgccgtgttctccctcgtcgttagattctccgactagacggctcaaaatgacgggcttcgattag

SEQ ID NO: 1706 - protein, 243 aa, Populus balsamifera subsp. trichocarpa; identical to SEQ ID NO: 1704
  misc_feature (1)..(243): Ceres ANNOT ID no. 1460097
  misc_feature (1)..(243): Functional Homolog of  Ceres  ID no. 968026
  misc_feature (19)..(152): Pfam Name: Response_reg Pfam Description: Response regulator receiver domain

SEQ ID NO: 1707 - DNA, 744 bp, Populus balsamifera subsp. trichocarpa
  misc_feature (1)..(744): Ceres ANNOT ID no. 1459838
atgggttctaacagtattgtttcaaatcgttggatgtcagagaagatgaactgcctcgatctctcacccaattctaactcagataatgaagaggaagaagttcatgtactggcagtggatgatagttttgttgaccgcaaagtcatcgagcgtttgctcaaaatttcatcttgtaaagtgacagcggtggacagtggatggggagctctaaaactgcttggattattagacgacgaagaagaagacaagagcagctcctcctcctcctcctcctcatctgctggttttgaggggttgaaggtggatctaataattactgactactgtatgcctggaatgacaggatatgagttgctcaagaaaatcaaggaatcatctagtttcagagaaataccggttgtgattatgtcatcggagaacgtgatggctcgaatcgaccgatgtttggaggaaggagctgaggagttcatagcgaaaccagtgaaattgtcagacgttaaacgactgagagattactacatggcaaccagagagatcagatcagttcaaagcagcagcaatgttaacaagagaaaattacaggagagttttgatgtatctacatcttcatcgccaccctctatctcaccgtctccttcgccttcctctgcgtctccaccatcactgttctcatcatcagcgccgtgctctccctcgtctttagattctccgactagacggatcaaaatgacgagcttcgattag

SEQ ID NO: 1708 - protein, 232 aa, Populus balsamifera subsp. trichocarpa
  misc_feature (1)..(232): Ceres ANNOT ID no. 1459838
  misc_feature (1)..(232): Functional Homolog of  Ceres  ID no. 968026
  misc_feature (19)..(155): Pfam Name: Response_reg Pfam Description: Response regulator receiver domain
MNCLDLSPNSNSDNEEEEVHVLAVDDSFVDRKVIERLLKISSCKVTAVDSGWGALKLLGLLDDEEEDKSSSSSSSSSSAGFEGLKVDLIITDYCMPGMTGYELLKKIKESSSFREIPVVIMSSENVMARIDRCLEEGAEEFIAKPVKLSDVKRLRDYYMATREIRSVQSSSNVNKRKLQESFDVSTSSSPPSISPSPSPSSASPPSLFSSSAPCSPSSLDSPTRRIKMTSFD

SEQ ID NO: 1709 - DNA, 684 bp, Populus balsamifera subsp. trichocarpa
  misc_feature (1)..(684): Ceres ANNOT ID no. 1474764
atggcaataacaggggattcactctcccagtttcatgttttagctgttgatgacagcttaatagatagaaagctgattgagaggcttctcaagacatcatcctatcaagttactacagttgattctggtagcaaagccttgaaatttctgggattacaagaagatgaacaaagcaacccagacacaccttatgtttctcctaacaatcatcaggaaatggaagtgaatcttattattacagattactgtatgcctggcatgacaggctatgatttgctcaagaaagtaaaggaatcatcatctctcagaaacatacctgtagtgatcatgtcatctgaaaatgttccttcaaggatcaccagatgtttggaggagggagccgaggaatttttcttgaagccagtaagactatcagatttgaataggcttaaacctcacatgatgaaaactaagatcaagaaccaaaaacaagaagagcaagaagagcttgaaataccagctattcagtcagaagagcagaaacaaccagtgcagcagccatcatcacagccacagcctgagtcacaaccacaaccatcagcactactactacagcccaacaataacaagaggaaggctatggaagaagggctttcaccagatagaaccagacctagatacaatggcatcactactatggtctga

SEQ ID NO: 1710 - protein, 227 aa, Populus balsamifera subsp. trichocarpa
  misc_feature (1)..(227): Ceres ANNOT ID no. 1474764
  misc_feature (1)..(227): Functional Homolog of  Ceres  ID no. 968026
  misc_feature (11)..(140): Pfam Name: Response_reg Pfam Description: Response regulator receiver domain
MAITGDSLSQFHVLAVDDSLIDRKLIERLLKTSSYQVTTVDSGSKALKFLGLQEDEQSNPDTPYVSPNNHQEMEVNLIITDYCMPGMTGYDLLKKVKESSSLRNIPVVIMSSENVPSRITRCLEEGAEEFFLKPVRLSDLNRLKPHMMKTKIKNQKQEEQEELEIPAIQSEEQKQPVQQPSSQPQPESQPQPSALLLQPNNNKRKAMEEGLSPDRTRPRYNGITTMV

SEQ ID NO: 1711 - DNA, 702 bp, Populus balsamifera subsp. trichocarpa
  misc_feature (1)..(702): Ceres ANNOT ID no. 1453555
atgacaataacgggagattcacactcacagtttcatgttttagctgttgatgacagcatgatagatagaaagctgattgagaggctcctcaagacatcatcatatcaagttactgcagttgattctggtagtaaagctttaaaatttctgggattacatgaagaagatgaccatagcaacccagatacagtaccttctgtttctcctaacgatcatcgggaagtggaagtgaatcttatcattacagattactgtatgcccggcatgacaggctatgatttgctcaagaaagtaaaggaatcgtcatctctcagggacatacctgtggtcatcatgtcatctgaaaatgtcccttcaaggatcaccagatgtttagaggaaggagcagaggaatttttcttgaagccagtacgactagctgatttgaataggcttaaacctcacatgatgaaaaccaaaattaagaacgaaaaacaagaagatcaagaaaagcttgaaaattcagaaattcagtcagaacagcagccacagccaccatcacagccacagccacagccacagccacagctagagtcacaatcacaaccacaaccatcaccactactacaacaacccaacaataacaaaaggaaagctatggaagaagggctttcaccagatagaactagacctagatacaatggcattactaccatggtctga

SEQ ID NO: 1712 - protein, 233 aa, Populus balsamifera subsp. trichocarpa
  misc_feature (1)..(233): Ceres ANNOT ID no. 1453555
  misc_feature (1)..(233): Functional Homolog of  Ceres  ID no. 968026
  misc_feature (11)..(142): Pfam Name: Response_reg Pfam Description: Response regulator receiver domain
MTITGDSHSQFHVLAVDDSMIDRKLIERLLKTSSYQVTAVDSGSKALKFLGLHEEDDHSNPDTVPSVSPNDHREVEVNLIITDYCMPGMTGYDLLKKVKESSSLRDIPVVIMSSENVPSRITRCLEEGAEEFFLKPVRLADLNRLKPHMMKTKIKNEKQEDQEKLENSEIQSEQQPQPPSQPQPQPQPQLESQSQPQPSPLLQQPNNNKRKAMEEGLSPDRTRPRYNGITTMV

SEQ ID NO: 1713 - DNA, 582 bp, Populus balsamifera subsp. trichocarpa
  misc_feature (1)..(582): Ceres ANNOT ID no. 1448253
atggctactttggctactctggctaccgagactcagtttcatgttctggctgttgatgatagccttattgacagaaagttgattgaaaggctcctcaaaacctcttcttatcaggtcacagcagtggattcaggaagcaaggccttggagtttttgggtttgagcggggatgatgagcagagagattcaaacccttcctctgtttcccctgaccatcatcatcaacacattgaaattaacatgatcattacagattactgtatgccaggaatgacaggctacgatctcctaaaaaagatcaaggaatccaagtatttcaaggatatcccagttgtgatcatgtcctcagagaatgtcccctcaagaatcaatagatgcttggaagaaggagcagaagagttcttcttgaagccagttcaattatccgatgtcaacaaacttagaccccatctgatgaagggaagatgcaaggaagaagatcaacctaacaacaaaaggaaaggcatggaagaaattgtcaactctcctggcagaacaagatcaagatacagcgagggcttggaagtggtcttatcccaatag

SEQ ID NO: 1714 - protein, 193 aa, Populus balsamifera subsp. trichocarpa
  misc_feature (1)..(193): Ceres ANNOT ID no. 1448253
  misc_feature (1)..(193): Functional Homolog of  Ceres  ID no. 968026
  misc_feature (13)..(143): Pfam Name: Response_reg Pfam Description: Response regulator receiver domain
MATLATLATETQFHVLAVDDSLIDRKLIERLLKTSSYQVTAVDSGSKALEFLGLSGDDEQRDSNPSSVSPDHHHQHIEINMIITDYCMPGMTGYDLLKKIKESKYFKDIPVVIMSSENVPSRINRCLEEGAEEFFLKPVQLSDVNKLRPHLMKGRCKEEDQPNNKRKGMEEIVNSPGRTRSRYSEGLEVVLSQ

SEQ ID NO: 1715 - DNA, 600 bp, Populus balsamifera subsp. trichocarpa
  misc_feature (1)..(600): Ceres ANNOT ID no. 1437849
atggctctggctactaccatggctactgagactcagtttcatgttcttgctgttgacgactgccttattgacagaaagttgattgaaaggctccttaaaacctcttcttatcaagtcacggcagtggattcaggaagcaaggccttggagtttttgggcttgaatggagaaaatgagctgagagattcaaaacctgcctctgtttcccctgacccctatcatcagcacattgaaattaatatgatcattacagattactgtatgccaggaatgacaggctatgatcttctaaaaaagatcaaggaatctaaatatttcaaggacatcccagttgtgatcatgtcctcagagaatgtcccatcaagaatcaacagatgcctaaaagaaggagctgaagagttcttcctgaagccagttcaattatcagatgtcaacaagcttagaccccatctaatgaagggaagatgcaaggaagaagaagaagaagaagaagaagaagaagaagatcaacccaataacaagagaaagggcatggaagaaattgttaactctccagatcgaacaagaacaagatacaatgatggcttggaagttgtctga

SEQ ID NO: 1716 - protein, 193 aa, Populus balsamifera subsp. trichocarpa
  misc_feature (1)..(193): Ceres ANNOT ID no. 1437849
  misc_feature (1)..(193): Functional Homolog of  Ceres  ID no. 968026
  misc_feature (7)..(137): Pfam Name: Response_reg Pfam Description: Response regulator receiver domain
MATETQFHVLAVDDCLIDRKLIERLLKTSSYQVTAVDSGSKALEFLGLNGENELRDSKPASVSPDPYHQHIEINMIITDYCMPGMTGYDLLKKIKESKYFKDIPVVIMSSENVPSRINRCLKEGAEEFFLKPVQLSDVNKLRPHLMKGRCKEEEEEEEEEEEDQPNNKRKGMEEIVNSPDRTRTRYNDGLEVV

SEQ ID NO: 1717 - DNA, 732 bp, Populus balsamifera subsp. trichocarpa
  misc_feature (1)..(732): Ceres ANNOT ID no. 1443270
atggagatcatggaatcaggtgctgttgatacacaacatcaggaagaagagaaacatcagcaacaaaaggaagaagaaggagaagagaaacataagcaacaaagggatcaggagggggaagaagaagagaaacattttcatgtcctggcagtggatgatagttttattgacaggaagcttttagaaaggctgcttaaagtatcttcataccaagtgacatttgtggactctggggataaggctttggaatatttaggtctccttgatagcatagacaatgtcaatgcaacctcttcttcttcgtcgtcccaatcaccacaacaagaggggatgaaagtaaatttgatcatgactgattactgcatgcctggaatgagcggttatgatttactcaaacgagtcaagggatcttattggaaagatgttccagtggtggttatgtcctcagagaatataccttccagaattagaatgtgcttggaagaaggagcagaggagttcttattgaagccacttcaattatcagatgttgaaaaacttcagactcaccttctaaagtcgcttgacaagtactcttccaaaaggattgatgacaacagttttaatactgacagcagcaacattactgttagcaacaagagcaacagcaacaatattgttagcaagaggaaggcattgtctccagagattgaggacagaagacctaaaatgaaaggattggctgttgtatag

SEQ ID NO: 1718 - protein, 240 aa, Populus balsamifera subsp. trichocarpa
  misc_feature (1)..(240): Ceres ANNOT ID no. 1443270
  misc_feature (1)..(240): Functional Homolog of  Ceres  ID no. 968026
  misc_feature (43)..(182): Pfam Name: Response_reg Pfam Description: Response regulator receiver domain
MESGAVDTQHQEEEKHQQQKEEEGEEKHKQQRDQEGEEEEKHFHVLAVDDSFIDRKLLERLLKVSSYQVTFVDSGDKALEYLGLLDSIDNVNATSSSSSSQSPQQEGMKVNLIMTDYCMPGMSGYDLLKRVKGSYWKDVPVVVMSSENIPSRIRMCLEEGAEEFLLKPLQLSDVEKLQTHLLKSLDKYSSKRIDDNSFNTDSSNITVSNKSNSNNIVSKRKALSPEIEDRRPKMKGLAVV

SEQ ID NO: 1719 - DNA, 657 bp, Populus balsamifera subsp. trichocarpa
  misc_feature (1)..(657): Ceres ANNOT ID no. 1496190
atggagatcatggaatcaggtgctgttgatacacaacatcaggaagaagagaaacatcagcaacaaaaggaagaagaaggagaagagaaacataagcaacaaagggatcaggagggggaagaagaagagaaacattttcatgtcctggcagtggatgatagttttattgacaggaagcttttagaaaggctgcttaaagtatcttcataccaagtgacatttgtggactctggggataaggctttggaatatttaggtctccttgatagcatagacaatgtcaatgcaacctcttcttcttcgtcgtcccaatcaccacaacaagaggggatgaaagtaaatttgatcatgactgattactgcatgcctggaatgagcggttatgatttactcaaacgagtcaagggatcttattggaaagatgttccagtggtggttatgtcctcagagaatataccttccagaattagaatgtgcttggaagaaggagcagaggagttcttattgaagccacttcaattatcagatgttgaaaaacttcagactcaccttctaaagtcgcttgacaagtgcaagtgcttgcgctgcaatggaaactctaaagccattgccttctggactgctgaaagtaaaaaaaaaaaagaacaacaaaagtga

SEQ ID NO: 1720 - protein, 215 aa, Populus balsamifera subsp. trichocarpa
  misc_feature (1)..(215): Ceres ANNOT ID no. 1496190
  misc_feature (1)..(215): Functional Homolog of  Ceres  ID no. 968026
  misc_feature (43)..(182): Pfam Name: Response_reg Pfam Description: Response regulator receiver domain
MESGAVDTQHQEEEKHQQQKEEEGEEKHKQQRDQEGEEEEKHFHVLAVDDSFIDRKLLERLLKVSSYQVTFVDSGDKALEYLGLLDSIDNVNATSSSSSSQSPQQEGMKVNLIMTDYCMPGMSGYDLLKRVKGSYWKDVPVVVMSSENIPSRIRMCLEEGAEEFLLKPLQLSDVEKLQTHLLKSLDKCKCLRCNGNSKAIAFWTAESKKKKEQQK

SEQ ID NO: 1721 - DNA, 519 bp, Arabidopsis thaliana
  misc_feature (1)..(519): Ceres ANNOT ID no. 552542
atgcgaattttgtgtgatgcttgtgagagcgccgccgctatcgtcttttgcgccgccgacgaagctgccctctgttgctcctgcgacgaaaaagttcataagtgcaacaagctggctagtcggcatcttcgtgtaggcttagctgatccgagtaatgcaccaagctgtgacatatgcgaaaatgcacccgcattcttttactgtgagatagatggtagttccctttgtctacaatgtgatatggtggtacatgttggtgggaagagaacacataggcggtttctattactgagacagagaattgagtttccaggcgataagcctaatcatgctgaccaactgggactacggtgtcaaaaggcttcctctggtcgtggtcaagaatcaaatgggaatggtgatcatgatcataatatgatcgatcttaactccaatcctcaaagagtacacgagcctggatcacataaccaagaggagggtattgatgtaaataacgcaaacaatcacgagcatgaatag

SEQ ID NO: 1722 - protein, 172 aa, Arabidopsis thaliana
  misc_feature (1)..(172): Ceres Annot ID no. 552542
  misc_feature: Bit Score of  374.4 for HMM based on sequences of FIGURE 119
  misc_feature (51)..(96): Pfam Name: zf-B_box Pfam Description: B-box zinc finger
MRILCDACESAAAIVFCAADEAALCCSCDEKVHKCNKLASRHLRVGLADPSNAPSCDICENAPAFFYCEIDGSSLCLQCDMVVHVGGKRTHRRFLLLRQRIEFPGDKPNHADQLGLRCQKASSGRGQESNGNGDHDHNMIDLNSNPQRVHEPGSHNQEEGIDVNNANNHEHE

SEQ ID NO: 1723 - DNA, 705 bp, Populus balsamifera subsp. trichocarpa
  misc_feature (1)..(705): Ceres ANNOT ID no. 1514007
atgcgaacgatttgtgacgtgtgtgagagcgcagccgcgattcttttttgtgcagctgatgaagccgctctttgccgttcctgtgacgagaaggttcatttgtgcaacaagctagctagtcggcacgtgcgagtaggacttgcagatcctagcgctgttccacagtgtgacatatgtgaaaatgcaccagctttcttttactgtgagatagatggtagttcgctctgcttgcaatgcgatatgatagtacatgttggtggtaaaagaacccatggtagatatctcctgttgaggcagagggttgagtttccaggggataaacctggccggatggaggagcaaggacaacaacctcttgatcataatgaaacaaggagggaccaaaaccagccacttaaactcacagctagagaaaataaacaaaaccacagagcctctccagttccaatggtagagaataacacagatagcgacggaaaaatggacaacaatttgattgatcttaatgccaggcctcagcggatacatggacaaaattcaactaaccaggaaaatcacgaatcttctagtgcggttcctgttggatccttcaaaagagagcctcaaaaattaagttttacaaatatatccaaccagagttctgtttttcatctcaatttcttttcaagtaaaaaacaaaagagacagaaaatactctgctgttag

SEQ ID NO: 1724 - protein, 234 aa, Populus balsamifera subsp. trichocarpa
  misc_feature (1)..(234): Ceres ANNOT ID no. 1514007
  misc_feature: Bit Score of  416.5 for HMM based on sequences of FIGURE 119
  misc_feature (1)..(234): Functional Homolog of  Ceres  ID no. 552542
  misc_feature (51)..(96): Pfam Name: zf-B_box Pfam Description: B-box zinc finger
MRTICDVCESAAAILFCAADEAALCRSCDEKVHLCNKLASRHVRVGLADPSAVPQCDICENAPAFFYCEIDGSSLCLQCDMIVHVGGKRTHGRYLLLRQRVEFPGDKPGRMEEQGQQPLDHNETRRDQNQPLKLTARENKQNHRASPVPMVENNTDSDGKMDNNLIDLNARPQRIHGQNSTNQENHESSSAVPVGSFKREPQKLSFTNISNQSSVFHLNFFSSKKQKRQKILCC

SEQ ID NO: 1725 - DNA, 666 bp, Populus balsamifera subsp. trichocarpa
  misc_feature (1)..(666): Ceres ANNOT ID no. 1460742
atgcgaacgatttgtgacgtgtgtgagagcgcagccgcgattcttttttgtgcagctgatgaagccgctctttgccgttcctgtgacgagaaggttcatttgtgcaacaagctagctagtcggcacgtgcgagtaggacttgcagatcctagcgctgttccacagtgtgacatatgtgaaaatgcaccagctttcttttactgtgagatagatggtagttcgctctgcttgcaatgcgatatgatagtacatgttggtggtaaaagaacccatggtagatatctcctgttgaggcagagggttgagtttccaggggataaacctggccggatggaggagcaaggacaacaacctcttgatcataatgaaacaaggagggaccaaaaccagccacttaaactcacagctagagaaaataaacaaaaccacagagcctctccagttccaatggtagagaataacacagatagcgacggaaaaatggacaacaatttgattgatcttaatgccaggcctcagcggatacatggacaaaattcaactaaccaggaaaatcacgaatcttctagtgcggttcctgttggatccttcaaaagagagcctcaaaatgtggaaaagcttcaagtttccattgaagtcagtcctcttaaaccaacagttgtatga

SEQ ID NO: 1726 - protein, 221 aa, Populus balsamifera subsp. trichocarpa
  misc_feature (1)..(221): Ceres ANNOT ID no. 1460742
  misc_feature: Bit Score of  414.2 for HMM based on sequences of FIGURE 119
  misc_feature (1)..(221): Functional Homolog of  Ceres  ID no. 552542
  misc_feature (51)..(96): Pfam Name: zf-B_box Pfam Description: B-box zinc finger
MRTICDVCESAAAILFCAADEAALCRSCDEKVHLCNKLASRHVRVGLADPSAVPQCDICENAPAFFYCEIDGSSLCLQCDMIVHVGGKRTHGRYLLLRQRVEFPGDKPGRMEEQGQQPLDHNETRRDQNQPLKLTARENKQNHRASPVPMVENNTDSDGKMDNNLIDLNARPQRIHGQNSTNQENHESSSAVPVGSFKREPQNVEKLQVSIEVSPLKPTVV

SEQ ID NO: 1727 - DNA, 1491 bp, Arabidopsis thaliana
  misc_feature (1)..(1491): Ceres ANNOT ID no. 574705
atggcgggtttctcactgtactgttttaaaaaccctcgaattctctttactcttccgtcggaatcacctctctttgttttgggttctgataaatgttcaccggcgacgagacggccgagtagaaagactcgtgggtttgtcgtgacgtacgcgcactctaatccgaagataatcaatccgaagaagaagtcgaggtatgggcaaacgttatctccatatgacagtgatgaagatgatgatgatgatgatgatgatgatgatgatgactggttacttaatgatgatttcgctgaggttacagagtatgagaagaagaagcctaagtcacataagcaaaccattgctaagaaaagtgtgaagaaagggattgtcaagcctgaagaaagtgagactgatgaagatgatcttgatttaggcattagtcctaatgccacttctgagaagaagaaggagtcttggcgtttagatggtcgaggaaagatgagttcgaggaagtatgtggagaaactataccctcggctcgcagaagagattgatatagatccgaaatgtgtaccacttctggattacttaagcacatttggtttgaaagagtcacactttgttcaaatgtacgagagacacatgccatcccttcagattaatgtgttctcagctcaagagagactcgattacttgttgagtgtcggtgttaaacacagagatatcaagagaatgctcttgagacaaccacagatacttcaatacactgttgagaacaatctcaaagctcacatttcctttctaatgggtcttggcattcctaattccaaaataggacagattgttgctgctaccccttctctcttctcttacagtgtagagaattcattgagacctacgataaggtatctgatcgaagaggttgggataaaggaaaccgatgttggaaaggttgtgcaacttagccctcagattctggttcagcggctcgacataacatggaacactcgctacatgttcctctccaaggagttaggagcacctagagacagcgtagtgaagatggtaaagaagcatccgcagcttcttcactacagtatcgatgacgggttcttgcctcgaatcaatttccttaggagcattgggatgtgcaattctgatatactgaaagtcttgactagccttacacaggttttgtctctttcactagaagataatctaaaacctaagtacatgtatttggtcaatgagctcaataatgaagttcacattctgaccaaatacccaatgtacttgagcttgtccttggatcaaaggatacgtccgcgccaccgcttcttggttgagttaaagaaagtgcggaaagggccattccctcttagttcattagttccaaatgatgaaagcttttgtcagcaatgggctggaaccagtgtagatacgtatctcgcctttcgccagaggctgttactcaaggagtttgcaaacaagtatgacaagagaggatga

SEQ ID NO: 1728 - protein, 496 aa, Arabidopsis thaliana
  misc_feature (1)..(496): Ceres Annot ID  no. 574705
  misc_feature (221)..(362): Pfam Name: mTERF Pfam Description: mTERF
MAGFSLYCFKNPRILFTLPSESPLFVLGSDKCSPATRRPSRKTRGFVVTYAHSNPKIINPKKKSRYGQTLSPYDSDEDDDDDDDDDDDDWLLNDDFAEVTEYEKKKPKSHKQTIAKKSVKKGIVKPEESETDEDDLDLGISPNATSEKKKESWRLDGRGKMSSRKYVEKLYPRLAEEIDIDPKCVPLLDYLSTFGLKESHFVQMYERHMPSLQINVFSAQERLDYLLSVGVKHRDIKRMLLRQPQILQYTVENNLKAHISFLMGLGIPNSKIGQIVAATPSLFSYSVENSLRPTIRYLIEEVGIKETDVGKVVQLSPQILVQRLDITWNTRYMFLSKELGAPRDSVVKMVKKHPQLLHYSIDDGFLPRINFLRSIGMCNSDILKVLTSLTQVLSLSLEDNLKPKYMYLVNELNNEVHILTKYPMYLSLSLDQRIRPRHRFLVELKKVRKGPFPLSSLVPNDESFCQQWAGTSVDTYLAFRQRLLLKEFANKYDKRG

SEQ ID NO: 1729 - protein, 503 aa, Oryza sativa
  misc_feature (1)..(503): Public GI no. 50938747
  misc_feature (1)..(503): Functional Homolog of  Ceres  ID no. 574705
  misc_feature (367)..(468): Pfam Name: mTERF Pfam Description: mTERF
MAPPPPLAALRPAPFPLPRLLPCPASAAARRGAVAFSLQTNVRLLKPNRRSRRSRYPYYDHDEDEDDDEAEFEFEEGEEEEEDGYETDDDLSGLEYPGVLYSNNPRAPIKKPGREKPALKQNWEGRQPKTRDRCDTSKKVDALHAKSKASRSTGLVDIDNEVELKNESISRSLFQKLQEEYDFDDKWLPLIDYLCTFGLKESHFTNMYERHMACFQISQASAEERLEFLLSVGVKSKDMKRMLVRQPQILEYTLSNLKSHVAFLVGIGVPSARIGQIISAAPSFFSYSVEQSLKPTIRYLIEEVGIEESDVGKVVQLSPQILVQRIDSAWKSRFLFLSKELGAPKDNIVKMVTKHPQLLHYSIEDGILPRINFLRSIGMRDTDVLKVLTSLTQVLSLSLEENLKPKYLYLVNDLKNDVQSLTKYPMYLSLSLDQRIRPRHRFLVSLKKAPKGPFPLSSFVPTDERFCKRWAGTSLEKYHTFRQSMLLKGFSEKTGRKTLTSRR

SEQ ID NO: 1730 - protein, 508 aa, Zea mays
  misc_feature (1)..(508): Ceres CLONE ID  no. 458156
  misc_feature (1)..(508): Functional Homolog of  Ceres  ID no. 574705
  misc_feature (272)..(473): Pfam Name: mTERF Pfam Description: mTERF
MALQLQLPRPLAAARPSILLPSPAHGASASATPLHARAGGVAFSLQTNVRLLKPNRRVRRSRDPYYDLDEDDEEEAEFDEDDEDDEEGYESDDDLSGLEYPGVLYSNSPRASSKKPGLQTPMVKENWEGRQTKTHDKYGSPGRSKSMHPRSKVGRSSTDLKNMDREVELKNASISRSLFQKLQEEYDFDDKWLPLIDYLCTFGLKESHFTYIYERHMACFQISQASAEERLDFLLNAGVKSKDMKRILVRQPQILEYTLGNLKSHVDFLVSIGVPNRRIGQIISAAPSMFSYSVEQSLKPTVRYLIEEVGIEESDVGKVVQLSPQILVQKIDSAWKSRSLFLSKELDAPKHSIVKMVTKHPQLLHYSIEDGILPRLNFLRSIGMRNSDILKVLTSLTQVLSLSLEDNLKPKYLYLVNDLKNEVQSLTKYPMYLSLSLDQRIRPRHRFLVSLKKAPKGPFPLSSFVPTDERFCQRWAGTSLEAYHTFRQRLLLTSFTEKSGRKTLVSRR

SEQ ID NO: 1731 - protein, 499 aa, Triticum aestivum
  misc_feature (1)..(499): Ceres CLONE ID  no. 918824
  misc_feature (1)..(499): Functional Homolog of  Ceres  ID no. 574705
  misc_feature (145)..(464): Pfam Name: mTERF Pfam Description: mTERF
MALLQLHPPPLAALGRSVLPCRPFPSATATARRSLASVAFSLQTNVRLLKPNRRSRRSRYPYYDLDDDEEEEDEEYDEDDESEDDLSGLEYLGVLYTNNPRAPNKRAGRKTQLVKENWEGRRPKTRDKHASPGRSNSLQPRSKINRTLLNLTSMNSEVELKNESISRILFEKLQEEYDFDDKWLPLIDYLCSFGLRESHFTYIYERHMACLQINRASAEERLEFLLSVGVKSKDLKRMLVRQPQILEYTLSNLKSHVAFLAGIGVPDARMGQIISSAPSFLSYSIEQSLKPTISYLIEEVGIEERDVGKVVQLSPQILVQRIDNAWKSRFLFLSKELGAPKDSIVKMVTKHPQLLHYSIEEGILPRINFLRSIGMRNSDILKILTSLTQVLSLSVEKNLKPKYLYLVNDLKNEAQSLTKYPMYLSLSLEQRIRPRHRFLVSLKKAPKGPFPLSSFVLTDERFCQRLAGTSLEKYHTFRQSLLLTGFEDKTGRKPLASRR

SEQ ID NO: 1732 - DNA, 1485 bp, Populus balsamifera subsp. trichocarpa
  misc_feature (1)..(1485): Ceres ANNOT ID no. 1441536
atggcagtttgttctgtttatccattaaaccctaatctcctctctcactctcttgctctttctctttcccatcattctcatgcttactggagtgtagaatcagtgagcagaataagaagaaatggcagaaaaggcagtatgactgttagggttttatccacccattcaaatgccaagattctcaaccctaaacgaaaatcacgctacggccacaccttcagtctctatgatactgatatcggtctcgatgattggttgctggatgatgaatttgcagagcctgtggattttgaagtcgatggaaagaaaagagttaattcacagaagaaaacaagtaccagagaaggtggccagagattattcaattcgagaactagcaagaacactcgggaaaagagtatggttggaaacttctatggtactaaaactagaacaaaagaagcggattcctctgacattaatggacaaggaaagctaatgacagggaaatctacggaggacagatatccaaagctatctgaagaaatagatttggatgaaaagtggctcccccttttggattacctaagcacgtttgggctgaaggaatcacactttatccaaatctatgagaggcacatgccatcactccaaataaatgtatgttctgcacgggagaggttggagtacctgcagagtattggcgtcaaacacagagatataaaaagaatacttttgaggcaaccgcaaattctagaatatacagtggagagtaatttgaagtctcatactgctttcttgattggtttaggtattccaaattccagaatagggcagataattgctgctgctccatctctattttcttatagtgttgagaattctctaaaacccacagttagatatatggttgaggaggttggaattgatgaaaaaaatataggaaaagttgtgcagctgagccctcaaatcctggttcagcggattgatgtatcatggaatactcgctatctttttctatccagggagctgggagcatccagggatagcgtagtaaagatggtaacaaaacatcctcagctccttcattacagcattgatgatggatttatcccaaggatcaatttcctgaggagtatcggaatgcataatggtgacatcttgaaagtcttgaccagccttacacaggtattgtctctgtcactggaagacaatctaaagccaaagtacaagtatttgatcaatgaacttcgtaatgaggtgcaatccttgaccaaataccctacgtacttaagcttgtctttagaccagagaattcgccctcgccataggttcttggttgccttaaagaaagctccgaaggggccgtttcctcttagttcatttgttccaactgatgaaagcttttgtcagcagtgggctggaactagtgtagataaatatttggcttttcggcaacaattgctactaaaagagttcgctaagaaatatgaaaaacgagggtaa

SEQ ID NO: 1733 - protein, 494 aa, Populus balsamifera subsp. trichocarpa
  misc_feature (1)..(494): Ceres ANNOT ID no. 1441536
  misc_feature (1)..(494): Functional Homolog of  Ceres  ID no. 574705
  misc_feature (219)..(360): Pfam Name: mTERF Pfam Description: mTERF
MAVCSVYPLNPNLLSHSLALSLSHHSHAYWSVESVSRIRRNGRKGSMTVRVLSTHSNAKILNPKRKSRYGHTFSLYDTDIGLDDWLLDDEFAEPVDFEVDGKKRVNSQKKTSTREGGQRLFNSRTSKNTREKSMVGNFYGTKTRTKEADSSDINGQGKLMTGKSTEDRYPKLSEEIDLDEKWLPLLDYLSTFGLKESHFIQIYERHMPSLQINVCSARERLEYLQSIGVKHRDIKRILLRQPQILEYTVESNLKSHTAFLIGLGIPNSRIGQIIAAAPSLFSYSVENSLKPTVRYMVEEVGIDEKNIGKVVQLSPQILVQRIDVSWNTRYLFLSRELGASRDSVVKMVTKHPQLLHYSIDDGFIPRINFLRSIGMHNGDILKVLTSLTQVLSLSLEDNLKPKYKYLINELRNEVQSLTKYPTYLSLSLDQRIRPRHRFLVALKKAPKGPFPLSSFVPTDESFCQQWAGTSVDKYLAFRQQLLLKEFAKKYEKRG

SEQ ID NO: 1734 - DNA, 1164 bp, Arabidopsis thaliana
  misc_feature (1)..(1164): Ceres ANNOT ID no. 834509
atgggtagcagtgagatggaaaaatcaggtaaagagaaagaacctaagactacaccgccttcgacttcttcatctgctcctgctactgttgtttcacaggaaccttcttctgctgtgagtgctggagtggctgttactcaagattggtctggcttccaggcttattctcctatgccgcctcatggttatgtagcatcaagtcctcaacctcatccttatatgtggggcgttcagcatatgatgccgccttatggaacaccgcctcatccgtatgttacgatgtatcctccaggtggcatgtatgctcatccttcattacctccggggtcttatccatatagtccctatgcaatgccttctcctaatggaatggctgaagcttctggtaatactggaagtgttattgagggtgatggtaaaccatctgatgggaaggaaaaattgccaatcaaaagatcaaaaggaagcttgggaagtttgaatatgattataggaaagaacaatgaagctggaaaaaactcaggagcatcagctaatggagcttgttctaaaagtgctgagagcggttctgatggatcaagtgacggaagtgatgcaaattcacaaaacgactctggctctagacacaacgggaaggatggtgaaacagcttcagagagtggtggttctgctcatggaccaccccgtaatggaagtaatctaccagtgaaccagaccgtcgctatcatgccagtgtcggctacaggtgttccaggcccaccaacaaatctaaatatcggaatggattattggagcggtcatgggaatgtttctggagcagttcctggagttgtagtagatggttcccaatcacagccatggttacaggatgagagagagattaagcgacagagacggaagcaatccaatagggaatctgctcgtagatccaggttgcgtaaacaggcggagtgtgatgagctagcacaacgagcagaggttttgaatggagagaactcaagtcttagagcagaaattaacaagcttaaaagccaatatgaagagcttcttgctgaaaatagctctctcaagaataagttctcgtcagccccgtcactggaaggtggagacttggacaagaacgagcaagaaccacagagaagtacacgtcaggatgttgcgtag

SEQ ID NO: 1735 - protein, 387 aa, Arabidopsis thaliana
  misc_feature (1)..(387): Ceres ANNOT ID no. 834509
  misc_feature (1)..(205): Pfam Name: MFMR Pfam Description: G-box binding protein MFMR
  misc_feature (291)..(354): Pfam Name: bZIP_1 Pfam Description: bZIP transcription factor
MGSSEMEKSGKEKEPKTTPPSTSSSAPATVVSQEPSSAVSAGVAVTQDWSGFQAYSPMPPHGYVASSPQPHPYMWGVQHMMPPYGTPPHPYVTMYPPGGMYAHPSLPPGSYPYSPYAMPSPNGMAEASGNTGSVIEGDGKPSDGKEKLPIKRSKGSLGSLNMIIGKNNEAGKNSGASANGACSKSAESGSDGSSDGSDANSQNDSGSRHNGKDGETASESGGSAHGPPRNGSNLPVNQTVAIMPVSATGVPGPPTNLNIGMDYWSGHGNVSGAVPGVVVDGSQSQPWLQDEREIKRQRRKQSNRESARRSRLRKQAECDELAQRAEVLNGENSSLRAEINKLKSQYEELLAENSSLKNKFSSAPSLEGGDLDKNEQEPQRSTRQDVA

SEQ ID NO: 1736 - protein, 368 aa, Arabidopsis thaliana
  misc_feature (1)..(368): Public GI no. 3608135
  misc_feature (1)..(368): Functional Homolog of  Ceres  ID no. 834509
  misc_feature (1)..(198): Pfam Name: MFMR Pfam Description: G-box binding protein MFMR
  misc_feature (298)..(361): Pfam Name: bZIP_1 Pfam Description: bZIP transcription factor
MASNEMEKSSKEKEPKTPPPSSTAPPSSQEPSSAVSAGMATPDWSGFQAYSPMPPPHGYVASSPQPHPYMWGVQHMMPPYGTPPHPYVAMYPPGGMYAHPSMPPGSYPYSPYAMPSPNGMTEVSVSGTDGDAKQSEVKEKLPIKRSRGSLGSLNMITGKNNEPGKNSGASANGAYSKSGESASDGSSEGSDGNSQNSSLLFFHSAEAASENGGSANGPQNGSAGTPILPVSQTVPIMPMTAAGVPGPPTNLNIGMDYWGAPTSAGIPGMHGKVSTPVPGVVAPGSRDGGHSQPWLQDDRELKRQRRKQSNRESARRSRLRKQAECDELAQRAEVLNEENTNLRAEINKLKSQCEELTTENTSLKVKKK

SEQ ID NO: 1737 - protein, 409 aa, Arabidopsis thaliana
  misc_feature (1)..(409): Ceres CLONE ID no. 1188156
  misc_feature (1)..(409): Functional Homolog of  Ceres  ID no. 834509
  misc_feature (1)..(201): Pfam Name: MFMR Pfam Description: G-box binding protein MFMR
  misc_feature (303)..(366): Pfam Name: bZIP_1 Pfam Description: bZIP transcription factor
MASNEMEKSSKEKEPKTPPPSSTAPPSSQEPSSAVSAGMATPDWSGFQAYSPMPPPHGYVASSPQPHPYMWGVQHMMPPYGTPPHPYVAMYPPGGMYAHPSMPPGSYPYSPYAMPSPNGMTEVSGNTTGGTDGDAKQSEVKEKLPIKRSRGSLGSLNMITGKNNEPGKNSGASANGAYSKSGESASDGSSEGSDGNSQNDSGSGLDGKDAEAASENGGSANGPQNGSAGTPILPVSQTVPIMPMTAAGVPGPPTNLNIGMDYWGAPTSAGIPGMHGKVSTPVPGVVAPGSRDGGHSQPWLQDDRELKRQRRKQSNRESARRSRLRKQAECDELAQRAEVLNEENTNLRAEINKLKSQCEELTTENTSLKDQLSLLPPLEGISMDNDHQEPDTNQTGAAERKVDSYKDST

SEQ ID NO: 1738 - protein, 407 aa, Petroselinum crispum
  misc_feature (1)..(407): Public GI no. 3336903
  misc_feature (1)..(407): Functional Homolog of  Ceres  ID no. 834509
  misc_feature (1)..(199): Pfam Name: MFMR Pfam Description: G-box binding protein MFMR
  misc_feature (307)..(370): Pfam Name: bZIP_1 Pfam Description: bZIP transcription factor
MGSSEMEKSSKETKEPKTPTSQEQVSPVVAGPAGPVTPDWSGFQAYSPMPPHGYMASSPQAPHPYMWGVQHMMPPYGTPPHPYVMYPHGGIYAHPSMPPGSYPFSPFAMPSPNGVAAEASGNTPGSMEADGGKVSEGKEKLPIKRSKGSLGSLNMITGKTNEASKPSGAATNGGYSKSGESASEGSSEEGSDANSQNDSQIKSGSRQDSLEAGASHNGNAHGLQNGQYANNSMVNQPISVVPLSTAGPTAVLPGPATNLNIGMDYWGGATSSAIPAMRGQVSPPITGGTVSAGARDNVQSQLWLQDERELKRQKRKQSNRESARRSRLRKQAECDELAQRAEALKEENASLRAELSRFRTEYEKIVAQNEVLKEKIREVPGQEDQWPGRNDQHNGNGSRETGHTEPA

SEQ ID NO: 1739 - protein, 414 aa, Glycine max
  misc_feature (1)..(414): Ceres CLONE ID no. 545441
  misc_feature (1)..(414): Functional Homolog of  Ceres  ID no. 834509
  misc_feature (1)..(197): Pfam Name: MFMR Pfam Description: G-box binding protein MFMR
  misc_feature (308)..(371): Pfam Name: bZIP_1 Pfam Description: bZIP transcription factor
MGSSEMDKTTKEKESKTPPPPTSQEQSSTTGTGTINPEWPGFQAYSPIPPHGFLASSPQAHPYMWGVQQFMPPYGTPPHPYVAMYPPGGIYAHPSMPPGSYPFNPFAMPSPNGIAEASGNTPGSMEADGKPSEVKEKLPIKRSKGSLGSLNMITGKNNEHGKTLGTSANGIHSKSGESASEGEGTSEGSDANSQNDSQLKSGGRQDSFEDEPSQNGSSAYTPQNGGLNIPHTVVNQTMSIIPISAGGAPGAVPGPTTNLNIGMDYWGTPGSSNIPGLGRKVPSTAVAGGMVTVGSRDSAQSQLWLQDERELKRQRRKQSNRESARRSRLRKQAECDELAQRAEALKEENASLRSEVNRIRSDYEQLLSENAALKERLGELPPNDDHHHRSGRNDQHVGNDTQQSGQTEAVQGGH

SEQ ID NO: 1740 - protein, 394 aa, Catharanthus roseus
  misc_feature (1)..(394): Public GI no. 5381313
  misc_feature (1)..(394): Functional Homolog of  Ceres  ID no. 834509
  misc_feature (1)..(196): Pfam Name: MFMR Pfam Description: G-box binding protein MFMR
  misc_feature (296)..(359): Pfam Name: bZIP_1 Pfam Description: bZIP transcription factor
MGSSEIDKSSKEAKEAKEAKETPPSSQEQPAATSAGTPDWTGFQAYSPIPPHGFLASSPQAHPYMWGVQHLMPPYGTPPHPYVAMYPHGGIYAHPSIPPGSYPFSPFAMPSPNGIAEPSVNTPGNMEVDGKASEGKEKLPIKRSRGSLGSLNMITGKNNDAGKTSGASANGACSKSAESASEGSSEGSDANSQNESQMKSGNRQDSGETSQNGSGAHGSQNGGTNTPHSMVAMVPLSASGGVTGPATNLNIGMDYWGTAASPTVPVVRGKVPSTPVGGGMVPARDPVQAQLWIQDERELKRQRRKQSNRESARRSRLRKQAECDELAQRAEALKEENNSLRAEVSLIRSEYEQLLAQNAALKERLGEASGQDDPRSSRNEQQHSVQRETAARSQ

SEQ ID NO: 1741 - protein, 420 aa, Petroselinum crispum
  misc_feature (1)..(420): Public GI no. 3336906
  misc_feature (1)..(420): Functional Homolog of  Ceres  ID no. 834509
  misc_feature (1)..(208): Pfam Name: MFMR Pfam Description: G-box binding protein MFMR
  misc_feature (316)..(379): Pfam Name: bZIP_1 Pfam Description: bZIP transcription factor
MGSSGMDKSPKDIKEAKEPKIPTSQEQPSPAAAAAAAAAAAAAAGPVTPDWSGFQAYSPMPPHGYMASSPQAPHPYMWGVQHMMPPYGTPPHPYVMYPHGGIYAHPSMPPGSYPFSPFAIPSPNGVAEAFGNTPGSTEADGKVSEGKEKLPIKRSKGSLGSLNMITGKNNEASKTLGAAANGGYSKSGDSASDGSSEEGSDANSQNDSQIKSGSRQDSLEGESQNGNAHGLQNGQNANHSMVNQQISIVPITAAGTAGAIPGPMTNLNIGMDYWGGVTSSAVPAMRGKVTSPPITGGIVTAGARDNVQSQLWLQDERELKRQRRKQSNRESARRSRLRKQAECDELAQRAEVLQEENASLRAELGRARSEYEKALAQNAILKEKVGDVAGQEDQWPGRNDQHTGDEGQETGHIEPGQSGH

SEQ ID NO: 1742 - protein, 397 aa, Phaseolus vulgaris
  misc_feature (1)..(397): Public GI no. 13775109
  misc_feature (1)..(397): Functional Homolog of  Ceres  ID no. 834509
  misc_feature (1)..(196): Pfam Name: MFMR Pfam Description: G-box binding protein MFMR
  misc_feature (301)..(364): Pfam Name: bZIP_1 Pfam Description: bZIP transcription factor
MGSSEMDKTPKEKESKTPPPTSQEQSSTTATGTINPDWPGFQAYSPIPPHGFLASSPQAHPYMWGVQQFMPPYGTPPHPYVAMYPPGGIYAHPSMPPGSYPFSPFAMPSPNGIAEASGNTPGSMEADGKPPEVKEKLPIKRSKGSLGSLNMITGKNNEHGKTRGTSANGIHSKSGDSASEGEGTSEGSDANSQNDSQMKSGGRQDSFEDEPSQNGTSAYTSQNGGISTPATVVNQNVPIIPISAGGAPGAVPGPTTNLNIGMDYWGTPAPSNIPALGRKVPSTAVAGSRDSVQSQLWLQDEREIKRQRRKQSNRESARRSRLRKQAECDELAQRAEALKEENASLRSEVSRIRSDYEQLLSENTALKERLGELPANDQHVGNEAQQNGQTEGVQGGH

SEQ ID NO: 1743 - protein, 390 aa, Oryza sativa
  misc_feature (1)..(390): Public GI no. 435942
  misc_feature (1)..(390): Functional Homolog of  Ceres  ID no. 834509
  misc_feature (1)..(202): Pfam Name: MFMR Pfam Description: G-box binding protein MFMR
  misc_feature (293)..(356): Pfam Name: bZIP_1 Pfam Description: bZIP transcription factor
MGSSGADAPTKTSKASAPQEQQPPASSSTATPAVYPDWANFQGYPPIPPHGFFPSPVASSPQGHPYMWGAQPMIPPYGTPPPPYVMYPPGVYAHPSMPPGAHPFTPYAMASPNGNADPTGTTTTAAAAAAGETDGKSSEGKEKSPIKRSKGSLGSLNMITGKNSTEHGKTSGASANGAISQSGESGSESSSEGSEANSQNDSHHKESGQEQDGEVRSSQNGVSRSPSQAKLNQTMAIMPMTSSGPVPAPTTNLNIGMDYWANTASSTPAIHGKATPTAAPGSMVPGEQWVQDERELKRQRRKQSNRESARRSRLRKQAECEELAQRAEVLKQENTSLRDEVNRIRKEYDELLSKNSSLKEKLEDKQHKTDEAGVDNKLQHSGDDSQKKGN

SEQ ID NO: 1744 - protein, 417 aa, Glycine max
  misc_feature (1)..(417): Ceres CLONE ID no. 523155
  misc_feature (1)..(417): Functional Homolog of  Ceres  ID no. 834509
  misc_feature (1)..(197): Pfam Name: MFMR Pfam Description: G-box binding protein MFMR
  misc_feature (308)..(371): Pfam Name: bZIP_1 Pfam Description: bZIP transcription factor
MGSSDMDKTPKEKESKTPPATSQEQSSTTAMPTTNPDWSNFQTYSPIPPHGFLASSPQAHPYMWGVQHYMPPYGTPPHPYVAMYPHGGIYAHPSIPPGSYPFSPFAMASPNGIADASGNAPGRIEVGGKPPEVKEKLPIKRSKGSASGGNLNMWITGKNNEPGKIPGESANGIHSKSGESASDGTSEGSDENSQNDSQLKSRERQDSFEDEPSQNGSSVHAPQNGVHNRPQTVVNQTMSILPISTTSAPGAVPGPTTNLNIGMDYWGTPTSSTIPALHGKVPSTAVAGGMIAAGSRDGVQSQVWLQDERELKRQRRKQSNRESARRSRLRKQAECDELAQRAEALKEENATLRSEVSQIRSEYEQLRSENAALKERLGDIPGVATPGKEDLRSGQNDQHVSNDTQQSGQTEVVQGVH

SEQ ID NO: 1745 - protein, 417 aa, Phaseolus vulgaris
  misc_feature (1)..(417): Public GI no. 13775107
  misc_feature (1)..(417): Functional Homolog of  Ceres  ID no. 834509
  misc_feature (1)..(198): Pfam Name: MFMR Pfam Description: G-box binding protein MFMR
  misc_feature (308)..(371): Pfam Name: bZIP_1 Pfam Description: bZIP transcription factor
MGSSDMDKTPKEKESKTPPATSQEQSPPTTGMATINPDWSNFQAYSPMPPHGFLASSPQAHPYMWGVQHIMPPYGTPAHPYVAMYPHGGIYAHPSIPPGSYPFSPFAMASPNGIADTSGNNPGSIEVGAKPPEVKEKLPVKRSKGSASGGSLNMWITGKNNDLGKTTGESANGIHSKSGDSASDGTSEGSDENSQNDSQLKSGERQDSFEDEPSQNGSSAHAPQNGVHSRPQTVVNQTMPIPISTASAPGAVPGPTTNLNIGMDYWGTPTSSAIPALHGKVSSTAVAGGMITAGSRDGVQSQIWLQDERELKRQRRKQSNRESARRSRLRKQAECDELAQRADVLKEENATLRAEVSRIRSEFEQLRSENASLKERLGEIPGVATPGNEDVRSGQNDQHVSNDTQQSRQKEAVQGVH

SEQ ID NO: 1746 - protein, 376 aa, Zea mays
  misc_feature (1)..(376): Ceres CLONE ID no. 287677
  misc_feature (1)..(376): Functional Homolog of  Ceres  ID no. 834509
  misc_feature (1)..(188): Pfam Name: MFMR Pfam Description: G-box binding protein MFMR
  misc_feature (279)..(342): Pfam Name: bZIP_1 Pfam Description: bZIP transcription factor
MGSSGADTPSKEQQPPATSGAAIPPVYPDWSSFQAYPPIPPHGFFPSPVASSPQGHPFMWGAQAMIPPYGTPPPYVMYPPGVYAHPSMPPGAHPFTPYAITSPNGNADATGTTAAAGNTDGKPSEGKDKSPTKRSKGSLGSLNMLTGKNPSEHGKSSGASGNGVTSQSGESGSDSSSEGSEGNSHNDSHHKESGQEHDGDVRSSRNGVSRLQSEGKLNQAMAILPIPSSGPATDPTTNLNIGMDYWANTASSAPAIHGKATSTTVPGAVVPAEQWTQDEHELKKQRRKQSNRESARRSRLRKQAECEELAQRADVLKQENASLRDEVNRIRKEYEELLSRNNSLKEKLEGKQHKTDEAGLNNKLQHSADDSQKKGN

SEQ ID NO: 1747 - protein, 384 aa, Populus balsamifera subsp. trichocarpa
  misc_feature (1)..(384): Ceres ANNOT ID no. 1538994
  misc_feature (1)..(384): Functional Homolog of  Ceres  ID no. 834509
  misc_feature (1)..(194): Pfam Name: MFMR Pfam Description: G-box binding protein MFMR
  misc_feature (296)..(359): Pfam Name: bZIP_1 Pfam Description: bZIP transcription factor
MVSSDMDKTGKEKEAKPPSAAPTQEQPSTASATTVNPDWSGFQAYSPIPPPGFLASSPQAHPYMWGVQHIMPPYGTPPHPYVAMYPHGVYAHPSIPPGSYPFSPFAMPSPNGIAEASGNTPGSMEADGRPSDAKEKLPIKRSKGSLGSLNMITGKNNEHGKTTGVSANGAYSKSAESGSEGSSEGSDANSQSDSQMKSGGRQDSLEAHGAQNGGQGASNTIMNQTMAIMPISAASAPGAIPGPTTNLNIGMDYWGAPASSTVPAIRGKVPSTPVAGGVVSTGSRDGVQSQIWLQDERELKRQRRKQSNRESARRSRLRKQAECDELAQRAEALKEENANLRSEVNQIKSEYEQLLAENASLKEDFRAGRNDQHMSNDTQQTGQT

SEQ ID NO: 1748 - DNA, 1254 bp, Populus balsamifera subsp. trichocarpa
  misc_feature (1)..(1254): Ceres ANNOT ID no. 1447080
  misc_feature: Encodes the peptide sequence at SEQ ID NO. 1749
atgggtagcagtgatatggataaaacaggaaaggagaaggaggccaagacaccatctgctgcttctacacaggaacagccttcaactgccggtgctgccactgtaaatccagactggtctgggtttcaggcctattctcatatacctccaccagggttcttggcatcaagtccccaagctcacccatatatgtggggggttcagcacattatgcctccctatggtaccccaccacatccatatgttgcaatgtatcctcacggtgtatatgctcatccgtccattcccccgggttcttatccttttagtccttttgcaatgccttctccaaatggtatcgctgaggtttctggaaacactcctggcagcatggaagccgaaggaagaccatctgatgccaaggaaaaattacctattaaaaggtccaaaggaagcttgggcagtttaaacatgattactgggaagaataatgagcatgggagaacaacaggagcatctgctaatggagcttattcgaaaagtgctgagagtggaagtgaaggcacaagtgaaggaagtgatgcggattctcagagtgactcacaaatgaagtcaggtggcagacaagattctctggaagaaacatctcagaatggtggttctgcacatgctgctcagaatggaggacagggtgcatctacaatcatgaatcaaacaatgggtgtcctgccaatatctgctgccagtgcccctggagttatacctggtcccacaaccaacttaaatattggaatggactattggggagcccctgttgcttctagtgttcctgcaattcgtgggaaggttccttctactccagttgctggagggattgctactgctggatcacgggatggtgttcaatcgcagcattggttacaggatgaaagagagcttaagagacagagaaggaagcagtcaaacagagaatctgctcgccggtccaggttgcgtaaacagctacgtgctcctatatcaattcattggcttgcatgcatgcttttgagtcaggctgaatgcgatgagctggcccaacgtgctgaagttttaaaagaagaaaatgccaatcttagatcagaagtaaatcggatcaagagcgagtatgagcagcttcttgcagagaacgcctctctcaaggagaggctcggggaagttcatggacaagaagattccagggctggcaggaatgaccaacatacgagcaatgatacacaacagactggacaaacatag

SEQ ID NO: 1749 - protein, 417 aa, Populus balsamifera subsp. trichocarpa
  misc_feature (1)..(417): Ceres ANNOT ID no. 1447080
  misc_feature (1)..(417): Functional Homolog of  Ceres  ID no. 834509
  misc_feature (1)..(194): Pfam Name: MFMR Pfam Description: G-box binding protein MFMR
  misc_feature (303)..(383): Pfam Name: bZIP_1 Pfam Description: bZIP transcription factor
MGSSDMDKTGKEKEAKTPSAASTQEQPSTAGAATVNPDWSGFQAYSHIPPPGFLASSPQAHPYMWGVQHIMPPYGTPPHPYVAMYPHGVYAHPSIPPGSYPFSPFAMPSPNGIAEVSGNTPGSMEAEGRPSDAKEKLPIKRSKGSLGSLNMITGKNNEHGRTTGASANGAYSKSAESGSEGTSEGSDADSQSDSQMKSGGRQDSLEETSQNGGSAHAAQNGGQGASTIMNQTMGVLPISAASAPGVIPGPTTNLNIGMDYWGAPVASSVPAIRGKVPSTPVAGGIATAGSRDGVQSQHWLQDERELKRQRRKQSNRESARRSRLRKQLRAPISIHWLACMLLSQAECDELAQRAEVLKEENANLRSEVNRIKSEYEQLLAENASLKERLGEVHGQEDSRAGRNDQHTSNDTQQTGQT

SEQ ID NO: 1750 - protein, 368 aa, Arabidopsis thaliana; identical to SEQ ID NO: 1736
  misc_feature (1)..(417): Ceres CLONE ID no. 1188156
  misc_feature (1)..(368): Functional Homolog of  Ceres  ID no. 834509
  misc_feature (1)..(198): Pfam Name: MFMR Pfam Description: G-box binding protein MFMR
  misc_feature (298)..(361): Pfam Name: bZIP_1 Pfam Description: bZIP transcription factor

SEQ ID NO: 1751 - DNA, 869 bp, Glycine max
  misc_feature (1)..(869): Ceres CLONE ID no. 603410
  misc_feature (1)..(869): GEMINI ID 531F11
acagttcaaggctcattaagttgtttcacagccagcacgcaaacttcagctcaacaccctcgttccctttcggctccaaaacatgtcatccacaaccacggattctgattgttcatatttggaacaaattcaacaatatctccttcacaatgattcaacaattctaacaccacctcaagcttttccaagccctagccatgatagtagttcggatgcaagtgtccactttgagcacccttcggaagcgcatgacgtgaacgcgccacccaaatggaggcgctaccggggtgtgaggcgtaggccatgggggaagttcgcagcagagataagagatccaaagaaaaatggttctagggtttggctcggaacttatgttaacgaggaggaagcagctttggcttacgacaaagctgctttcaacatgcgtggccaaaaggctaagctgaattttcctcacctcattggctctgctgtgcagccggaaccaccgtgtctggcggtttctaagaggagcttaccagagtcttctcccccaacatcaccatatgatagttgtgagtcaaaagggtctaagaggaggaagagcctagttgatttgctcaataacttagccaagaacaaaagccaagccaaggtggtagaaatggccttggaggcaaatgaggttgagcaatgggtgaatgaattgaatgattgcactctattctggtgctcctagtgttgttgtgttttttctttttttaatttttgtttgtgtagttccaagttctttgtttttttgctgtgccaacaatgcagttcctaaataagtttgtaataatgatttttgcccaccacggaagaaattcaagtgctgattttaatttgtt

SEQ ID NO: 1752 - protein, 211 aa, Glycine max; identical to SEQ ID NO: 1638
  misc_feature (1)..(211): Ceres CLONE ID no. 603410
  misc_feature (1)..(211): GEMINI ID 531F11
  misc_feature (65)..(117): Pfam Name: AP2 Pfam Description: AP2 domain

SEQ ID NO: 1753 - protein, 202 aa, Glycine max; identical to SEQ ID NO: 1639
  misc_feature (1)..(202): Ceres CLONE ID no. 605218
  misc_feature (1)..(202): Functional Homolog of  Ceres  ID no. 603410
  misc_feature (1)..(202): GEMINI ID 531G11
  misc_feature (75)..(127): Pfam Name: AP2 Pfam Description: AP2 domain

SEQ ID NO: 1754 - protein, 233 aa, Nicotiana tabacum; identical to SEQ ID NO: 1073
  misc_feature (1)..(233): Public GI no. 57012759
  misc_feature (1)..(233): Functional Homolog of  Ceres  ID no. 603410
  misc_feature (97)..(149): Pfam Name: AP2 Pfam Description: AP2 domain

SEQ ID NO: 1755 - protein, 226 aa, Arabidopsis thaliana; identical to SEQ ID NO: 1637
  misc_feature (1)..(226): Ceres CLONE ID no. 6397
  misc_feature (1)..(226): Functional Homolog of  Ceres  ID no. 603410
  misc_feature (1)..(226): GEMINI ID 531A4
  misc_feature (90)..(142): Pfam Name: AP2 Pfam Description: AP2 domain

SEQ ID NO: 1756 - protein, 277 aa, Zea mays; identical to SEQ ID NO: 1641
  misc_feature (1)..(277): Ceres CLONE ID no. 282666
  misc_feature (1)..(277): Functional Homolog of  Ceres  ID no. 603410
  misc_feature (135)..(187): Pfam Name: AP2 Pfam Description: AP2 domain

SEQ ID NO: 1757 - protein, 282 aa, Mesembryanthemum crystallinum; identical to SEQ ID NO: 1065
  misc_feature (1)..(282): Public GI no. 32401273
  misc_feature (1)..(282): Functional Homolog of  Ceres  ID no. 603410
  misc_feature (136)..(188): Pfam Name: AP2 Pfam Description: AP2 domain

SEQ ID NO: 1758 - protein, 223 aa, Glycine max; identical to SEQ ID NO: 1643
  misc_feature (1)..(223): Ceres CLONE ID no. 592713
  misc_feature (1)..(223): Functional Homolog of  Ceres  ID no. 603410
  misc_feature (84)..(136): Pfam Name: AP2 Pfam Description: AP2 domain

SEQ ID NO: 1759 - protein, 234 aa, Lycopersicon esculentum; identical to SEQ ID NO: 1644
  misc_feature (1)..(234): Public GI no. 3342211
  misc_feature (1)..(234): Functional Homolog of  Ceres  ID no. 603410
  misc_feature (104)..(156): Pfam Name: AP2 Pfam Description: AP2 domain

SEQ ID NO: 1760 - protein, 237 aa, Nicotiana sylvestris; identical to SEQ ID NO: 1074
  misc_feature (1)..(237): Public GI no. 57012876
  misc_feature (1)..(237): Functional Homolog of  Ceres  ID no. 603410
  misc_feature (101)..(153): Pfam Name: AP2 Pfam Description: AP2 domain

SEQ ID NO: 1761 - protein, 289 aa, Triticum aestivum; identical to SEQ ID NO: 1079
  misc_feature (1)..(289): Ceres CLONE ID no. 555364
  misc_feature (1)..(289): Functional Homolog of  Ceres  ID no. 603410
  misc_feature (138)..(190): Pfam Name: AP2 Pfam Description: AP2 domain

SEQ ID NO: 1762 - protein, 166 aa, Brassica napus; identical to SEQ ID NO: 1647
  misc_feature (1)..(166): Ceres CLONE ID no. 944101
  misc_feature (1)..(166): Functional Homolog of  Ceres  ID no. 603410
  misc_feature (48)..(100): Pfam Name: AP2 Pfam Description: AP2 domain
  misc_feature (158)..(158): Xaa is any aa, unknown, or other
  misc_feature (162)..(162): Xaa is any aa, unknown, or other

SEQ ID NO: 1763 - protein, 290 aa, Triticum aestivum; identical to SEQ ID NO: 1648
  misc_feature (1)..(290): Ceres CLONE ID no. 569593
  misc_feature (1)..(290): Functional Homolog of  Ceres  ID no. 603410
  misc_feature (139)..(191): Pfam Name: AP2 Pfam Description: AP2 domain

SEQ ID NO: 1764 - protein, 318 aa, Oryza sativa; identical to SEQ ID NO: 1649
  misc_feature (1)..(318): Public GI no. 50927517
  misc_feature (1)..(318): Functional Homolog of  Ceres  ID no. 603410
  misc_feature (151)..(203): Pfam Name: AP2 Pfam Description: AP2 domain

SEQ ID NO: 1765 - protein, 98 aa, Glycine max
  misc_feature (1)..(98): Ceres CLONE ID no. 661590
  misc_feature (1)..(98): Functional Homolog of  Ceres  ID no. 603410
  misc_feature (28)..(28): Xaa is any aa, unknown, or other
  misc_feature (35)..(35): Xaa is any aa, unknown, or other
  misc_feature (51)..(51): Xaa is any aa, unknown, or other
  misc_feature (60)..(60): Xaa is any aa, unknown, or other
  misc_feature (94)..(94): Xaa is any aa, unknown, or other
  misc_feature (95)..(95): Xaa is any aa, unknown, or other
MRGQKAKLNFPHLIGSAVQPEPPCLAVXKRSLPEXSPPTSPYDSCESKGFXRRKSLVDLXNNLAKNKSQAKVVEMALEANEVEQWVNELNDCTXXWCS

SEQ ID NO: 1766 - DNA, 1182 bp, Arabidopsis thaliana
  misc_feature (1)..(1182): Ceres CLONE ID no. 32791
  misc_feature (1)..(1182): GEMINI ID 531A5
  misc_feature (1)..(1182): GEMINI ID 86A9
actatccttcgcaagacccttcctctatataaggaagttcatttcatttggagcagaactacgggggatcccccgggctgcaggaattcgcacgagwscatgtacctagaacatcctaatcgaaagtttttgggattctcaaaaaactcaaaataaactttcctcattttttttttctttcttttgttttgttttctttataaaggagaaagaaagagaaagagagtttccgaaagctgaattgagttgggtgaagcaaattctcaggatgggaagaggaaagatagaaataaagaggatagagaactcaacaaatcgacaagtgacgttttgcaaaagaagaaatggacttctgaagaaagcctatgagctttcggtcctttgcgatgcagaagttgcgctcattgttttctccactcgtggccgtctctatgaatacgccaataacaacataagatcaaccattgagaggtacaagaaagcttgttctgatagcaccaacactagcactgtccaagaaatcaatgccgcgtactatcaacaagaatctgctaagctgagacaacagatccaaacgattcaaaactccaacaggaatctgatgggagactctttgagttccttaagtgtcaaggaactaaaacaagttgagaatcgccttgagaaagctatctctaggatcaggtccaagaagcatgagttgcttctagttgaaatcgaaaacgcgcagaaaagggagattgagcttgacaatgagaacatctatctaagaactaaggtagcagaagtggagaggtatcaacaacaccatcatcaaatggttagtggttcagagattaacgcaattgaagctttagcctcacgcaattactttgctcatagcattatgactgctggttctggatctggtaatggaggttcttactctgatcccgacaagaaaattcttcatctcggataatctcgtctgcgaaaaaccgagctgcaataactctctgcatgcatctggggattctttgctcagatttatctctacataaaatatgttttggtgcaaaataattcaaagtacaatgaaggtattggtccttcaagactcattgcaatttgtgttgtgtaatgattaagacatactctagtttttattgcttcgtatcatagtatctattctatggtatctcc

SEQ ID NO: 1767 - protein, 230 aa, Arabidopsis thaliana
  misc_feature (1)..(230): Ceres CLONE ID no. 32791
  misc_feature (1)..(230): GEMINI ID 531A5
  misc_feature (1)..(230): GEMINI ID 86A9
  misc_feature (74)..(173): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENSTNRQVTFCKRRNGLLKKAYELSVLCDAEVALIVFSTRGRLYEYANNNIRSTIERYKKACSDSTNTSTVQEINAAYYQQESAKLRQQIQTIQNSNRNLMGDSLSSLSVKELKQVENRLEKAISRIRSKKHELLLVEIENAQKREIELDNENIYLRTKVAEVERYQQHHHQMVSGSEINAIEALASRNYFAHSIMTAGSGSGNGGSYSDPDKKILHLG

SEQ ID NO: 1768 - protein, 69 aa, Oryza sativa
  misc_feature (1)..(69): Public GI no. 30313671
  misc_feature (1)..(69): Functional Homolog of  Ceres  ID no. 32791
  misc_feature (9)..(59): Pfam Name: SRF-TF Pfam Description: SRF-type transcription factor (DNA-binding and dimerisation domain)
MGRGKIEIKRIENKTSRQVTFCKRRNGLLKKAYELAILCDAEIALIVFSSRGRLYEFSNVNSTRSTIER

SEQ ID NO: 1769 - protein, 228 aa, Glycine max
  misc_feature (1)..(228): Public GI no. 1568513
  misc_feature (1)..(228): Functional Homolog of  Ceres  ID no. 32791
  misc_feature (71)..(173): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENNTNRQVTFCKRRNGLLKKAYELSVLCDAEIALIVFSTRGRVYEYANNNIKGTIERYKKATAETSNACTTQELNAQFYQQESKKLRQQIQLLQNTNRHLVGEGLSALNVRELKQLENRLERGITRIRSKKHEMILAETENLQKREIQLEQENTFLRSKIAENERLQELSMMPATGQEYNAFQQYFARNMLQLNMMEGGVPSYDPLPAHDKKSLQLE

SEQ ID NO: 1770 - protein, 223 aa, Glycine max
  misc_feature (1)..(223): Public GI no. 20385590
  misc_feature (1)..(223): Functional Homolog of  Ceres  ID no. 32791
  misc_feature (69)..(173): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENTTNRQVTFCKRRNGLLKKAYELSVLCDAEVALIVFSSRGRVYEYSNNNIKSTIDRYKKASSDSTNGGFTMEINAQYYQQESAKLRQQIQMLQNSNRHLMGDSLASLTVKELKQLENRLERGITRIRSKKHELLLAEIEYLQKREIELENESVYLRTKIAEVERLQQANMVSTHEFNAIQALVSRNFFQPNMIEGGSTGYPLHDKKVLHLG

SEQ ID NO: 1771 - protein, 227 aa, Glycine max
  misc_feature (1)..(227): Public GI no. 27763670
  misc_feature (1)..(227): Functional Homolog of  Ceres  ID no. 32791
  misc_feature (74)..(177): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENTTNRQVTFCKRRNGLLKKAYELSVLCDAEVALIVFSSRGRLYEYSNNSIKTTIGRYKKACSDSSATSSVTELNTQYYQQESAKLRQQIQMLQNSNSNLVRHLMGDSLSALTVKELKQLENRLERGITRIRSKKHEMLLAEIEYLQKREIELENENVCIRTKIAEVERLQQANMVSGQELNAIQALASRNFFTPNMMEGGAVTFSHQDKKMLHLG

SEQ ID NO: 1772 - protein, 223 aa, Arabidopsis thaliana
  misc_feature (1)..(223): Public GI no. 60100358
  misc_feature (1)..(223): Functional Homolog of  Ceres  ID no. 32791
  misc_feature (74)..(173): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENTTNRQVTFCKRRNGLLKKAYELSVLCDAEVALIVFSSRGRLYEYSNNNIRSTIERYKKACSDHSSTSTTTEINAQYYQQESAKLRQQIQMLQNSNRHLMGDALSTLTVKELKQLENRLERGITRIRSKKHEMLLAEIEYFQKREIELENENLCLRTKITDVERIQQVNMVSGQELNAIQALASRNFFNPPMIEDGTSYPQQPDKKILHLG

SEQ ID NO: 1773 - protein, 226 aa, Glycine max
  misc_feature (1)..(226): Public GI no. 42794566
  misc_feature (1)..(226): Functional Homolog of  Ceres  ID no. 32791
  misc_feature (73)..(172): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENTTNRQVTFCKRRNGLLKKAYELSVLCEAEVALIVFSSRGRLYEYANNSVRTTIDRYKKASDSSNPASVSETNSQYYQQEATKLRQQIGILQNANRHLMGESLSSMSVKELKQLETRLEKGISRIRSKKNELLFAEIEYMQKREVELQNDNIFLRGKIVENERAQQNMNMLPGGGGYEVMSQHPPYDSRNYLPVNLLEHNQHFSHQEPTALQLG

SEQ ID NO: 1774 - protein, 232 aa, Akebia trifoliata
  misc_feature (1)..(232): Public GI no. 48727598
  misc_feature (1)..(232): Functional Homolog of  Ceres  ID no. 32791
  misc_feature (16)..(66): Pfam Name: SRF-TF Pfam Description: SRF-type transcription factor (DNA-binding and dimerisation domain)
  misc_feature (81)..(182): Pfam Name: K-box Pfam Description: K-box region
MQKREGDMGRGKIEIKRIENTTNRQVTFCKRRNGLLKKAYELSVLCDAEVALIVFSSRGRLYEFSNSSIKKSTIERYKKASADSSNTTSIIEANAHYYQHEATKLRQQIQNLQIANRQLMGDSLSSLTVKELKQLENRLERRGLTRIRSKKQEIMFAEIEYMQKREVELQKENMYLRAKIAENENAQQTSMVPAQEFDAIQTFDSRNYFQMNNMLEGGAAYSHADQTALHLG

SEQ ID NO: 1775 - protein, 237 aa, Hyacinthus orientalis
  misc_feature (1)..(237): Public GI no. 21955182
  misc_feature (1)..(237): Functional Homolog of  Ceres  ID no. 32791
  misc_feature (75)..(176): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENTTNRQVTFCKRRNGLLKKAYELSVLCDAEVALIVFSTRGRLYEYSNNSIKSTIERDKKKACADSSSSSAVIEVNTQRYYQQEASKLRQQIQILQNANRHLMGESLDPLNVKELKQLETRLERGITRVRRSKKHELLFAELEYMQKREVELQTDNMYLRAKIGENERAHQASVVQAGTEFDALPTFDSRNYYQVHMLQAAASHYSHHQDQTALHLGYETKADPSA

SEQ ID NO: 1776 - DNA, 675 bp, Populus balsamifera subsp. trichocarpa
  misc_feature (1)..(675): Ceres ANNOT ID no. 1540248
atgggaagaggaaagattgagatcaagaggatcgagaacactacgaatcgtcaggttactttctgcaagagaagaaatgggctgttgaagaaagcctatgaattatctgtcctttgtgatgctgaagtttccctcatcgtcttctctagccgtggccgtctctatgagtacgccaacaacaatataagatcaactatagataggtacaagaaggtcagttcagatagttcaaatactgcctctatcacagaaatcaatgcccagtattatcaacaagaatcagcaaagatgcgtcaacaaattcagttgctacagaattctaacaggcacttaatgggagaagccgtgagtaatctgtcggtgaaggagctaaagcagctggagaataggctcgaaagaggcatgactagaatcaggtcaaagaagcatgaattgctgctagctgaaattgagtatatgcagaaaagggagattgagctggaaaatgaaagtgcctgtcttcgaaccaagatagcggaagttgagaggcttcaacaagccaacatggtcaccggagaagagctgaatgcaatccaggcattagcagcctctcgcaatttctttgctcctcattttcttgagggtggaactgcatacccgcacacttataacaagaagattctccatcttgggtaa

SEQ ID NO: 1777 - protein, 224 aa, Populus balsamifera subsp. trichocarpa
  misc_feature (1)..(224): Ceres ANNOT ID no. 1540248
  misc_feature (1)..(224): Functional Homolog of  Ceres  ID no. 32791
  misc_feature (74)..(173): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENTTNRQVTFCKRRNGLLKKAYELSVLCDAEVSLIVFSSRGRLYEYANNNIRSTIDRYKKVSSDSSNTASITEINAQYYQQESAKMRQQIQLLQNSNRHLMGEAVSNLSVKELKQLENRLERGMTRIRSKKHELLLAEIEYMQKREIELENESACLRTKIAEVERLQQANMVTGEELNAIQALAASRNFFAPHFLEGGTAYPHTYNKKILHLG

SEQ ID NO: 1778 - DNA, 1426 bp, Glycine max
  misc_feature (1)..(1426): Ceres CLONE ID no. 541719
  misc_feature (1)..(1426): GEMINI ID 540A8
aggcaaaaaggataagacagtgagtgtgtatgttgttgacaagcaaaagccatggagggtagtagttgctctaatgacacttcttatttgttggcttttggagaaaacagtggtgggctatgcccaatgacgatgatgcctttggtaacttcccatcatgcaacaaatcctagtaatcctagtaataatactaataataatgaaaacacaaactgtctcttcattcccaactgcagtaacagttctggaactccttctatcatgctccacaacaacaacaacactgatgatgataacaacaaaaccagcactaacactgggttagggtactatttcatggagagtgaccaccatcaccgcaacaacaacaacaatggaagctcctcctcctcttcctcttctgctgtcaaggccaagatcatggctcatcctcactatcaccgtctcttggcagcttacgtcaattgtcagaaggttggagccccaccggaagtggtggcaaggttagaagaagcatgtgcttctgcagcgacaatggctggtgatgcagcagcagcagctggatcaagctgcataggtgaagatccagctttggatcagttcatggaggcttactgtgagatgctcaccaagtatgagcaagaactctccaaacccttaaaggaagccatgctcttccttcaaaggattgagtgccagttcaaaaatcttacaatttcttccaccgactttgcttgcaacgagggtgctgagaggaatggatcatctgaagaggatgttgatctacacaacatgatagatccccaggcagaggacagggaattaaagggtcagcttttgcgcaagtacagcggatacctgggcagtctgaagcaagaattcatgaagaagaggaagaaaggaaagctacctaaagaagcaaggcaacaattacttgaatggtggagcagacattacaaatggccttacccatccgagtcacagaagctggcccttgcagagtcgacaggtctggatcagaagcaaatcaacaactggtttattaatcaaaggaaacggcactggaagccttcagaggacatgcagtttgtggtgatggatccaagccatccacactattacatggataatgttctgggcaatccatttcccatggatctctcccatccaatgctctagaaaagtatccatcctttgtgggctgataatagattcataagctcgttctgtcacttattaaaaccttaagcaattattaattaatatgctttctagtgctcatataagcattytaagaaatcctagattgctatatactatatttatagtacgcaggtgtatcctgctagcttaaaragacggtcctttgtgtggatcatctagttcaaggagttatgaataaataaaattccataaatttaaagcc

SEQ ID NO: 1779 - protein, 375 aa, Glycine max
  misc_feature (1)..(375): Ceres CLONE ID no. 541719
  misc_feature (1)..(375): GEMINI ID 540A8
  misc_feature (117)..(161): Pfam Name: KNOX1 Pfam Description: KNOX1 domain
  misc_feature (171)..(222): Pfam Name: KNOX2 Pfam Description: KNOX2 domain
  misc_feature (257)..(278): Pfam Name: ELK Pfam Description: ELK domain
MEGSSCSNDTSYLLAFGENSGGLCPMTMMPLVTSHHATNPSNPSNNTNNNENTNCLFIPNCSNSSGTPSIMLHNNNNTDDDNNKTSTNTGLGYYFMESDHHHRNNNNNGSSSSSSSSAVKAKIMAHPHYHRLLAAYVNCQKVGAPPEVVARLEEACASAATMAGDAAAAAGSSCIGEDPALDQFMEAYCEMLTKYEQELSKPLKEAMLFLQRIECQFKNLTISSTDFACNEGAERNGSSEEDVDLHNMIDPQAEDRELKGQLLRKYSGYLGSLKQEFMKKRKKGKLPKEARQQLLEWWSRHYKWPYPSESQKLALAESTGLDQKQINNWFINQRKRHWKPSEDMQFVVMDPSHPHYYMDNVLGNPFPMDLSHPML

SEQ ID NO: 1780 - DNA, 1122 bp, Populus balsamifera subsp. trichocarpa
  misc_feature (1)..(1122): Ceres ANNOT ID no. 1518918
atggagggtggtggtggtgatggtggttcaagtaccacttcatgtatgatggcttttggagacaacagtaatggactatgccctatgatgatgatgacgcctctcatgtcttcttcgtcttctgctcatcatcagcatcctcatcatcatcatcgggctaatgagggcgattcgtcaatatcaaataccttattccttcctctacctcctacaaacaatcaaggccataaccgtatccatagtaatgctagtggctcttcttctatgattattgacgatcacaaccgcaaccacaacaacaacactgtcactgctactgggtgttatttcatggataacaatgatggtagtagttcttctgttaaggccaaaattatggctcatcctcactaccatcgtctccttgctgcctatgctaattgtcaaaaggttggagcaccacctgaagtggtggctaggctagaagaagcttgcgcatcggctgcttctattgcccccgctaacacaggctgcatcggtgaagatccagcccttgaccaattcatggaggcttactgtgagatgctgaccaagtatgagcaagagctctctaaacccttaaaggaagccatgctttttcttcagagggttgagtgtcaattcaaagctctcactctttcctctccaatttctggttgtggtgatggcaatgataggaatgtgtcatctgaagaagaggttgatgtgaataacaacttcatagatcctcaagctgaagatcaagagctgaagggtcagctacttcgcaggtacagtggatatttaggcagtctcaagcaggagttcatgaaaaagagaaagaaagggaagttacctaaagaagccaggcaacagctgctggattggtggagcaggcattacaaatggccatatccatcggagtcacagaagctggcccttgctgaatccactggtctggatcagaagcaaataaacaactggttcattaaccaaaggaaacgacactggaaaccatcggaagacatgcagtttgtggtgatggatgccggccatcctcattactacatggataatgttttgggcaatcctttcccaatggacatctctcccacactgctttga

SEQ ID NO: 1781 - protein, 373 aa, Populus balsamifera subsp. trichocarpa
  misc_feature (1)..(373): Ceres ANNOT ID no. 1518918
  misc_feature (1)..(373): Functional Homolog of  Ceres  ID no. 541719
  misc_feature (119)..(163): Pfam Name: KNOX1 Pfam Description: KNOX1 domain
  misc_feature (168)..(219): Pfam Name: KNOX2 Pfam Description: KNOX2 domain
  misc_feature (255)..(276): Pfam Name: ELK Pfam Description: ELK domain
MEGGGGDGGSSTTSCMMAFGDNSNGLCPMMMMTPLMSSSSSAHHQHPHHHHRANEGDSSISNTLFLPLPPTNNQGHNRIHSNASGSSSMIIDDHNRNHNNNTVTATGCYFMDNNDGSSSSVKAKIMAHPHYHRLLAAYANCQKVGAPPEVVARLEEACASAASIAPANTGCIGEDPALDQFMEAYCEMLTKYEQELSKPLKEAMLFLQRVECQFKALTLSSPISGCGDGNDRNVSSEEEVDVNNNFIDPQAEDQELKGQLLRRYSGYLGSLKQEFMKKRKKGKLPKEARQQLLDWWSRHYKWPYPSESQKLALAESTGLDQKQINNWFINQRKRHWKPSEDMQFVVMDAGHPHYYMDNVLGNPFPMDISPTLL

SEQ ID NO: 1782 - DNA, 1110 bp, Populus balsamifera subsp. trichocarpa
  misc_feature (1)..(1110): Ceres ANNOT ID no. 1535677
atggagggaggtggtgctggttgttcaagtaccccttcacttatgatggcttttggagacagcagtaatggactatgccctatgatgatgatgccgctaatgtcttcttcatcttctgctcatcagcatcaccatcagcaacaacatgttaatgcgggggattcatcaatatcaaataccttattccttcctctacctcctaccaactatcaaagtcaaaaccgtattaataatagcgctagtggctcttctatgattcttgacgatcacaaccacaacaacaacactgtcactgcgactgggtgttatttcatggagaacaatgatggtggtagtagttctacttctgtaaaggctaaaattatggctcatcctcactaccatcggctcttggctgcctatgccaattgtcaaaaggttggagcaccacctgaagtcgtggctagacttgaagaagcttgtgcatctgctgcctcaatgggccctgcaaatacagacggcatcggtgaagatccagcccttgaccaattcatggaggcctactgtgagatgctgaccaagtatgagcaagaactctctaagcccttgaaggaagccatggtttttcttcagagggtcgaatgccaattcagagccctcactctttcctctccaaattctgcttggggcgagggcaatgataggaatgcatcatccgaagaagagcttgatgtgaataacaaattcatagatcctcaagcagaagatcaagaattgaaaggtcagctactacgcaagtacagtggatatttaggcagtctcaagaaggagttcatgaaaaagagaaagaaagggaagttgcccaaagaagcgaggcagcagctgctggattggtggagcaggcatcacaaatggccatatccatcggagtcacagaagctggccctcgcagagtccactggtctggatcagaagcagataaacaactggttcattaaccaaaggaaacgccactggaaaccatcagaagacatgcagtttgtggtgatggatgccggccatcctcattattacatggataatgttttgggcaatcctttcccaatggacatctctcacacactgctttga

SEQ ID NO: 1783 - protein, 369 aa, Populus balsamifera subsp. trichocarpa
  misc_feature (1)..(369): Ceres ANNOT ID no. 1535677
  misc_feature (1)..(369): Functional Homolog of  Ceres  ID no. 541719
  misc_feature (115)..(159): Pfam Name: KNOX1 Pfam Description: KNOX1 domain
  misc_feature (164)..(215): Pfam Name: KNOX2 Pfam Description: KNOX2 domain
  misc_feature (251)..(272): Pfam Name: ELK Pfam Description: ELK domain
MEGGGAGCSSTPSLMMAFGDSSNGLCPMMMMPLMSSSSSAHQHHHQQQHVNAGDSSISNTLFLPLPPTNYQSQNRINNSASGSSMILDDHNHNNNTVTATGCYFMENNDGGSSSTSVKAKIMAHPHYHRLLAAYANCQKVGAPPEVVARLEEACASAASMGPANTDGIGEDPALDQFMEAYCEMLTKYEQELSKPLKEAMVFLQRVECQFRALTLSSPNSAWGEGNDRNASSEEELDVNNKFIDPQAEDQELKGQLLRKYSGYLGSLKKEFMKKRKKGKLPKEARQQLLDWWSRHHKWPYPSESQKLALAESTGLDQKQINNWFINQRKRHWKPSEDMQFVVMDAGHPHYYMDNVLGNPFPMDISHTLL

SEQ ID NO: 1784 - DNA, 545 bp, Arabidopsis thaliana
  misc_feature (1)..(545): Ceres CLONE ID no. 8607
  misc_feature (1)..(545): GEMINI ID 531A9
ctccctttctttcgacaagcacaaacaaagccatcaagagaagaaagccttttcttggattcacatatatataagaatattttttcaaatcaaacatgtcttctagcagaaggtcgagacaagcaagctcatcatcaagaattagcgatgaccagatcactgatctcatctcaaagctccgacagtccattccggagattcgccagaaccgtcgttccaacacggtatcagcgtcgaaagtgttacaagagacttgcaactacataagaaacttgaacaaggaagccgatgacctcagtgatcgattgactcagcttctggaatccattgatcctaatagcccacaagccgcagttattaggagcttgattaatggataattaagatataaattgattagttgtgctttatatatataagcttaaaatctcgttgggaggttgatccatcagggtgttgcataattatatatctattttatgtttcttatatattatttacaatcctatctagttagggttcatattttgacccttttttggttt

SEQ ID NO: 1785 - protein, 94 aa, Arabidopsis thaliana
  misc_feature (1)..(94): Ceres CLONE ID  no. 8607
  misc_feature (1)..(94): GEMINI ID 531A9
MSSSRRSRQASSSSRISDDQITDLISKLRQSIPEIRQNRRSNTVSASKVLQETCNYIRNLNKEADDLSDRLTQLLESIDPNSPQAAVIRSLING

SEQ ID NO: 1786 - protein, 94 aa, Brassica napus
  misc_feature (1)..(94): Ceres CLONE ID  no. 1033993
  misc_feature (1)..(94): Functional Homolog of  Ceres  ID no. 8607
MSSSRRSRQASSSSRISDDQITDLISKLRQSIPEIRQNRRSSTVSASKVLQETCNYIRNLNKEADDLSDRLSQLLETIDPNSPQAAIIRSLINE

SEQ ID NO: 1787 - protein, 91 aa, Glycine max
  misc_feature (1)..(91): Ceres CLONE ID  no. 560681
  misc_feature (1)..(91): Functional Homolog of  Ceres  ID no. 8607
  misc_feature (25)..(59): Pfam Name: HLH Pfam Description: Helix-loop-helix DNA-binding domain
MSSRRSRQQSASTRISDDQIIDLVSKLRQLVPEIRDRRSDKVSASKVLQETCNYIRSLHREVDDLSERLSQLLATIDADSPEAAIIRSLIN

SEQ ID NO: 1788 - protein, 91 aa, Glycine max; identical to SEQ ID NO: 1787
  misc_feature (1)..(91): Ceres CLONE ID  no. 560681
  misc_feature (1)..(91): Functional Homolog of  Ceres  ID no. 8607
  misc_feature (25)..(59): Pfam Name: HLH Pfam Description: Helix-loop-helix DNA-binding domain

SEQ ID NO: 1789 - protein, 91 aa, Glycine max; identical to SEQ ID NO: 1787
  misc_feature (1)..(91): Ceres CLONE ID  no. 562428
  misc_feature (1)..(91): Functional Homolog of  Ceres  ID no. 8607
  misc_feature (25)..(59): Pfam Name: HLH Pfam Description: Helix-loop-helix DNA-binding domain

SEQ ID NO: 1790 - protein, 92 aa, Glycine max; identical to SEQ ID NO: 1361
  misc_feature (1)..(92): Ceres CLONE ID  no. 560948
  misc_feature (1)..(92): Functional Homolog of  Ceres  ID no. 8607
  misc_feature (1)..(92): GEMINI ID 537A3
  misc_feature (25)..(59): Pfam Name: HLH Pfam Description: Helix-loop-helix DNA-binding domain

SEQ ID NO: 1791 - protein, 92 aa, Glycine max
  misc_feature (1)..(92): Ceres CLONE ID  no. 630731
  misc_feature (25)..(59): Pfam Name: HLH Pfam Description: Helix-loop-helix DNA-binding domain
  misc_feature (1)..(92): Functional Homolog of  Ceres  ID no. 8607
  misc_feature (61)..(61): Xaa is any aa, unknown, or other
  misc_feature (70)..(70): Xaa is any aa, unknown, or other
  misc_feature (75)..(75): Xaa is any aa, unknown, or other
MSSRRSRQHSGSTRISDDQIIELVSKLRQLVPEIRNRRSDKVSASKVLQETCNYIRSLHRXVSDLSERLXQLLTXIDADSAEAGIIRSLLNQ

SEQ ID NO: 1792 - protein, 92 aa, Glycine max
  misc_feature (1)..(92): Ceres CLONE ID  no. 653656
  misc_feature (1)..(92): Functional Homolog of  Ceres  ID no. 8607
  misc_feature (20)..(61): Pfam Name: HLH Pfam Description: Helix-loop-helix DNA-binding domain
MSSRRSRSRQTSSSRNITDDQINDLVSKLQQLLPEIRDRRSDKVSASKVLQETCNYIRSLHREVDDLSERLSELLATTDTAQAAIIRNLLMQ

SEQ ID NO: 1793 - protein, 92 aa, Glycine max
  misc_feature (1)..(92): Ceres CLONE ID  no. 663844
  misc_feature (1)..(92): Functional Homolog of  Ceres  ID no. 8607
  misc_feature (20)..(61): Pfam Name: HLH Pfam Description: Helix-loop-helix DNA-binding domain
MSSRRSRSRQTSSSRNITDDQINDLVSKLQQLLPEIRDRRSDKVSASKVLQETCNYIRSLHREVGDLSERLSELLDTTDTAQAAIIRNLLMQ

SEQ ID NO: 1794 - protein, 104 aa, Oryza sativa
  misc_feature (1)..(104): Public GI no. 50929085
  misc_feature (1)..(104): Functional Homolog of  Ceres  ID no. 8607
MSSSRRSRSRRAGSSVPSSSSSSRTSISEDQIAELLSKLQALLPESQARNGAHRGSAARVLQETCSYIRSLHQEVDNLSETLAQLLASPDVTSDQAAVIRSLLM

SEQ ID NO: 1795 - protein, 88 aa, Oryza sativa; identical to SEQ ID NO: 1365
  misc_feature (1)..(88): Public GI no. 50912765
  misc_feature (1)..(88): Functional Homolog of  Ceres  ID no. 8607
  misc_feature (14)..(55): Pfam Name: HLH Pfam Description: Helix-loop-helix DNA-binding domain

SEQ ID NO: 1796 - protein, 89 aa, Zea mays; identical to SEQ ID NO: 1367
  misc_feature (1)..(89): Ceres CLONE ID  no. 503296
  misc_feature (1)..(89): Functional Homolog of  Ceres  ID no. 8607
  misc_feature (15)..(56): Pfam Name: HLH Pfam Description: Helix-loop-helix DNA-binding domain

SEQ ID NO: 1797 - protein, 90 aa, Zea mays; identical to SEQ ID NO: 1366
  misc_feature (1)..(90): Ceres CLONE ID  no. 486120
  misc_feature (1)..(90): Functional Homolog of  Ceres  ID no. 8607
  misc_feature (15)..(57): Pfam Name: HLH Pfam Description: Helix-loop-helix DNA-binding domain

SEQ ID NO: 1798 - protein, 82 aa, Zea mays
  misc_feature (1)..(82): Ceres CLONE ID  no. 237390
  misc_feature (1)..(82): Functional Homolog of  Ceres  ID no. 8607
MTAQLINSRSPAAPFFSVLKRLMRAARNVMQASTTKLLKETCSYIKSLHREVDDLSDRLSDLMATMDHNSPGAEIIRSILRS

SEQ ID NO: 1799 - protein, 92 aa, Arabidopsis thaliana; identical to SEQ ID NO: 1363
  misc_feature (1)..(92): Public GI no. 22331645
  misc_feature (1)..(92): Functional Homolog of  Ceres  ID no. 8607

SEQ ID NO: 1800 - protein, 88 aa, Oryza sativa; identical to SEQ ID NO: 1364
  misc_feature (1)..(88): Public GI no. 31431968
  misc_feature (1)..(88): Functional Homolog of  Ceres  ID no. 8607

SEQ ID NO: 1801 - protein, 88 aa, Oryza sativa; identical to SEQ ID NO: 1365
  misc_feature (1)..(88): Public GI no. 50912765
  misc_feature (1)..(88): Functional Homolog of  Ceres  ID no. 8607
  misc_feature (14)..(55): Pfam Name: HLH Pfam Description: Helix-loop-helix DNA-binding domain

SEQ ID NO: 1802 - protein, 91 aa, Oryza sativa
  misc_feature (1)..(91): Public GI no. 78708592
  misc_feature (1)..(91): Functional Homolog of  Ceres  ID no. 8607
MSRRSRSRASSAARITDEQIGDLVSKLQALLPEARLRSNDRVPSARVLQETCSYIRSLHREVDDLSERLAELLAAADVSTAQAAVIRGLLM

SEQ ID NO: 1803 - protein, 90 aa, Zea mays; identical to SEQ ID NO: 1366
  misc_feature (1)..(90): Ceres CLONE ID no. 486120
  misc_feature (1)..(90): Functional Homolog of  Ceres  ID no. 8607
  misc_feature (15)..(57): Pfam Name: HLH Pfam Description: Helix-loop-helix DNA-binding domain

SEQ ID NO: 1804 - protein, 89 aa, Zea mays; identical to SEQ ID NO: 1367
  misc_feature (1)..(89): Ceres CLONE ID no. 503296
  misc_feature (1)..(89): Functional Homolog of  Ceres  ID no. 8607
  misc_feature (15)..(56): Pfam Name: HLH Pfam Description: Helix-loop-helix DNA-binding domain

SEQ ID NO: 1805 - DNA, 557 bp, Arabidopsis thaliana
  misc_feature (1)..(557): Ceres CLONE ID no. 519
  misc_feature (1)..(557): GEMINI ID 531A7
atactatcaacttttctctatctatctctctctcttctttttccggcataacttctgtgttaccctaaactccataacctgtttcatcgataaagtgcctttgcttctatctctgtcactcttactacttgttgaacaatattctacaaaaaaatgtcgggaagaagatcacgttcgaggcaatcatcaggaacttcaaggatctcagaagatcaaatcaatgatctgattatcaagttgcaacagcttcttcctgagctcagggacagtcgtcgttccgacaaggtttcagcagcgagggtgttacaagatacgtgcaactacatacggaatctgcatagagaggttgatgatctaagtgagaggctatctgagttactagcaaactcagacactgcacaagctgctttaatcagaagcttacttacccaataattcctatctatctttttcttcttcttcttttttttgtttactataataataataatagtttgcgggtttttttttctatagatgttgatgaccttataaacgtttaatgatacgagttcgtc

SEQ ID NO: 1806 - protein, 93 aa, Arabidopsis thaliana
  misc_feature (1)..(91): Ceres CLONE ID no. 519
  misc_feature (1)..(93): GEMINI ID 531A7
  misc_feature (20)..(62): Pfam Name: HLH Pfam Description: Helix-loop-helix DNA-binding domain
MSGRRSRSRQSSGTSRISEDQINDLIIKLQQLLPELRDSRRSDKVSAARVLQDTCNYIRNLHREVDDLSERLSELLANSDTAQAALIRSLLTQ

SEQ ID NO: 1807 - protein, 243 aa, Oryza sativa
  misc_feature (1)..(243): Public GI no. 90399109
  misc_feature (1)..(243): Functional Homolog of  Ceres  ID no. 519
MAMTLRFPAGGATSVPAAMPHRVPMATAPSRLPATVAMALISTPSAAIRLTPINSATHFDVLRLRARRTDGEDDVSALPEIDGAASALPCTASTASPRSCVPGFPNTQSAFPNTRLSLLGWILKLVQERFSGDPSLLSSLLVLLIGGWQTAYFKEAVERRIKGSMRIPPCILTIFTFCAAVATLLYKAVKASEELDGIISHLIKKFEKLLESHDVKTQSEKLPEPREAEAKSQAKEVKTQDKS

SEQ ID NO: 1808 - protein, 88 aa, Oryza sativa; identical to SEQ ID NO: 1364
  misc_feature (1)..(88): Public GI no. 21671920
  misc_feature (1)..(88): Functional Homolog of  Ceres  ID no. 519

SEQ ID NO: 1809 - protein, 91 aa, Glycine max
  misc_feature (1)..(91): Ceres CLONE ID no. 609713
  misc_feature (1)..(91): Functional Homolog of  Ceres  ID no. 519
MSGQRRSSRTSKFTEIEINELVSRLQVLLLQVNQRGNSRQSASKILQETCCYIRKLQEEVEQLSERLSELMDSVDISDIDRRTLQNLLQQY

SEQ ID NO: 1810 - protein, 92 aa, Brassica napus; identical to SEQ ID NO: 1363
  misc_feature (1)..(92): Public GI no. 22331645
  misc_feature (1)..(92): Functional Homolog of  Ceres  ID no. 519

SEQ ID NO: 1811 - protein, 92 aa, Brassica napus
  misc_feature (1)..(92): Ceres CLONE ID no. 951040
  misc_feature (1)..(92): Functional Homolog of  Ceres  ID no. 519
MSNRRSRQSSSAPRISDDQIIDLVTKLRQILPEIGQRRRSDKVSASKVLQETCNYIRNLNREVDNLSERLAQLLESVDEDSPQAAVIRSLLM

SEQ ID NO: 1812 - protein, 94 aa, Glycine max
  misc_feature (1)..(94): Public GI no. 28416803
  misc_feature (1)..(94): Functional Homolog of  Ceres  ID no. 519
MSSRRSSRSRQSGSSRISDDQISDLVSKLQHLIPELRRRRSDKVSASKVLQETCNYIRNLHREVDDLSDRLSELLASTDDNSAEAAIIRSLLNY

SEQ ID NO: 1813 - protein, 94 aa, Arabidopsis thaliana
  misc_feature (1)..(94): Ceres CLONE ID no. 18200
  misc_feature (1)..(94): Functional Homolog of  Ceres  ID no. 519
MSSRRSSRSRQSGSSRISDDQISDLVSKLQHLIPELRRRRSDKVSASKVLQETCNYIRNLHREVDDLSDRLSELLASTDDNSAETAIIRSLLNY

SEQ ID NO: 1814 - protein, 91 aa, Glycine max; identical to SEQ ID NO: 1787
  misc_feature (1)..(91): Ceres CLONE ID no. 560681
  misc_feature (1)..(91): Functional Homolog of  Ceres  ID no. 519
  misc_feature (25)..(59): Pfam Name: HLH Pfam Description: Helix-loop-helix DNA-binding domain

SEQ ID NO: 1815 - protein, 91 aa, Glycine max; identical to SEQ ID NO: 1787
  misc_feature (1)..(91): Ceres CLONE ID no. 560681
  misc_feature (1)..(91): Functional Homolog of  Ceres  ID no. 519
  misc_feature (25)..(59): Pfam Name: HLH Pfam Description: Helix-loop-helix DNA-binding domain

SEQ ID NO: 1816 - protein, 91 aa, Glycine max; identical to SEQ ID NO: 1787
  misc_feature (1)..(91): Ceres CLONE ID no. 562428
  misc_feature (1)..(91): Functional Homolog of  Ceres  ID no. 519
  misc_feature (25)..(59): Pfam Name: HLH Pfam Description: Helix-loop-helix DNA-binding domain

SEQ ID NO: 1817 - protein, 92 aa, Glycine max; identical to SEQ ID NO: 1361
  misc_feature (1)..(92): Ceres CLONE ID no. 560948
  misc_feature (1)..(92): Functional Homolog of  Ceres  ID no. 519
  misc_feature (1)..(92): GEMINI ID 537A3
  misc_feature (25)..(59): Pfam Name: HLH Pfam Description: Helix-loop-helix DNA-binding domain

SEQ ID NO: 1818 - protein, 92 aa, Glycine max; identical to SEQ ID NO: 1792
  misc_feature (1)..(92): Ceres CLONE ID no. 653656
  misc_feature (1)..(92): Functional Homolog of  Ceres  ID no. 519
  misc_feature (20)..(61): Pfam Name: HLH Pfam Description: Helix-loop-helix DNA-binding domain

SEQ ID NO: 1819 - protein, 92 aa, Glycine max; identical to SEQ ID NO: 1793
  misc_feature (1)..(92): Ceres CLONE ID no. 663844
  misc_feature (1)..(92): Functional Homolog of  Ceres  ID no. 519
  misc_feature (20)..(61): Pfam Name: HLH Pfam Description: Helix-loop-helix DNA-binding domain

SEQ ID NO: 1820 - protein, 90 aa, Glycine max
  misc_feature (1)..(90): Ceres CLONE ID no. 1247092
  misc_feature (1)..(90): Functional Homolog of  Ceres  ID no. 519
  misc_feature (17)..(59): Pfam Name: HLH Pfam Description: Helix-loop-helix DNA-binding domain
MSGRRSRSRQSSGISEDQINDLIIKLQQLLPELRNSRRSDKVSASRVLQETCNYIRNLHREVDDLSERLSELLANTDTAQAALIRSLLTQ

SEQ ID NO: 1821 - DNA, 1521 bp, Arabidopsis thaliana
  misc_feature (1)..(1521): Ceres ANNOT ID no. 541941
atgacaactgaagatcagacaatttcaagtagtggaggatatgtccaaagctcatcaacaactgatcatgttgatcatcatcatcatgatcaacatgaatccctcaatcctcctcttgtcaagaagaagagaaacctccctggaaatcctgatccagaagctgaggtcatagctctatctccaaagacacttatggccacaaatcgtttcctctgcgagatatgtggaaaagggtttcaaagagaccagaatctacagcttcaccgtcgaggacacaacctcccatggaagctaaagcagaggacgagcaaagaagtaaggaaacgagtgtatgtatgtccagaaaagagttgcgtccaccaccatccgacgagggcacttggtgatcttaccggcattaagaaacatttttgtcggaaacatggcgagaaaaagtggaagtgtgagaaatgcgccaagagatatgcagtccaatctgactggaaggctcattccaagacttgtgggactagagaatatagatgcgactgtggtacaattttctccaggagagacagcttcattacacatagagcgttctgtgacgctttagcagaagaaaccgctaggctaaacgcagcctcgcatctcaaaagctttgccgcaaccgctggtagtaatctaaactatcattatctcatggggacacttatcccatcaccatcactaccacaaccaccgtcgtttccgttcggaccaccgcaaccgcaacatcatcaccaccaccaattcccaatcacaaccaacaacttcgatcatcaagacgtcatgaaaccagcgtctacgctctctttatggtcgggaggaaatattaatcatcatcagcaagtgaccatcgaggaccgtatggcgccgcagccgcattcaccgcaagaggattacaattgggttttcggaaacgcgaataatcacggcgagttaataacgacgagcgattcactcattactcatgacaataatattaatatcgtccagagtaaggaaaacgctaacggggcaacttctctttccgtgccttctctttttagcagcgttgaccaaattacccaagacgcaaacgctgcttctgtggctgttgcaaatatgtcggcgactgcgttactccaaaaagctgctcagatgggagcgacttcttctacgtcaccaacgacgacgattactaccgaccaatcagcgtatcttcagagttttgcatcgaagagtaatcagattgtagaagatggtggcagcgacaggttctttgcttcgtttggatcgaacagtgtcgagttaatgagtaataataataacggtcttcacgagatcgggaaccctagaaacggcgttacggtcgtttcggggatgggtgaattacagaattacccttggaagcgtagaagagttgatattgggaatgcgggaggaggagggcaaactcgggattttcttggggttggtgtacaaacaatatgccattcttcctctatcaatggatggatttga

SEQ ID NO: 1822 - protein, 506 aa, Arabidopsis thaliana
  misc_feature (1)..(506): Ceres ANNOT ID no. 541941
  misc_feature (70)..(92): Pfam Name: zf-C2H2 Pfam Description: Zinc finger, C2H2 type
MTTEDQTISSSGGYVQSSSTTDHVDHHHHDQHESLNPPLVKKKRNLPGNPDPEAEVIALSPKTLMATNRFLCEICGKGFQRDQNLQLHRRGHNLPWKLKQRTSKEVRKRVYVCPEKSCVHHHPTRALGDLTGIKKHFCRKHGEKKWKCEKCAKRYAVQSDWKAHSKTCGTREYRCDCGTIFSRRDSFITHRAFCDALAEETARLNAASHLKSFAATAGSNLNYHYLMGTLIPSPSLPQPPSFPFGPPQPQHHHHHQFPITTNNFDHQDVMKPASTLSLWSGGNINHHQQVTIEDRMAPQPHSPQEDYNWVFGNANNHGELITTSDSLITHDNNINIVQSKENANGATSLSVPSLFSSVDQITQDANAASVAVANMSATALLQKAAQMGATSSTSPTTTITTDQSAYLQSFASKSNQIVEDGGSDRFFASFGSNSVELMSNNNNGLHEIGNPRNGVTVVSGMGELQNYPWKRRRVDIGNAGGGGQTRDFLGVGVQTICHSSSINGWI

SEQ ID NO: 1823 - DNA, 873 bp, Arabidopsis thaliana
  misc_feature (1)..(873): Ceres ANNOT ID no. 543489
atggctatggcctctgcttctggttctgctctttgcttcactgatgcttctagctctcttgctttaagacgcgattgtggagctctttgcttgcctcctaggacagttacgtttggatttgtcgataaacctcttgtcaatctcgagcgattaagattatccactttgaagattagagcatcaaatgctactgctgtggagaatggaaagcaagaaggaagtgctgctgattctgataaagttccaactccagttgttataatcgaccaagattctgaccctgatgcaaccgttcttgaagttacattcggagatcgtcttggagctttacttgacactatgaatgcgctcaaaaacttgggattgaatgtcgtcaaggcaaatgtttaccttgattcttccggcaagcacaacaaatttgccattactagagcagatagtggaagaaaagtagaagaccctgaattgcttgaggccattcgtctcacagtcataaacaatctgcttgagtttcatcctgaatcaagttctcagttggcaatgggagcagcttttggtgttcttcctccaactgaaccgattgacgtggacatagcaacacatataaccattgaagatgatggaccagaccgcagtttactcttcatagaatcagcggatagacctggactattagttgagctggtgaagatcatttcagatatcagcgtcgctgttgaatctggagaattcgacaccgagggtttgttggctaaggtgaagtttcatgtaagctacaggaacaaagccctaatcaagcctctccagcaggtccttgctaatagtctgaggtacttcttgaggcgtccatcaactgacgagtcaagtttctga

SEQ ID NO: 1824 - protein, 290 aa, Arabidopsis thaliana
  misc_feature (1)..(290): Ceres ANNOT ID no. 543489
  misc_feature (97)..(161): Pfam Name: ACT Pfam Description: ACT domain
MAMASASGSALCFTDASSSLALRRDCGALCLPPRTVTFGFVDKPLVNLERLRLSTLKIRASNATAVENGKQEGSAADSDKVPTPVVIIDQDSDPDATVLEVTFGDRLGALLDTMNALKNLGLNVVKANVYLDSSGKHNKFAITRADSGRKVEDPELLEAIRLTVINNLLEFHPESSSQLAMGAAFGVLPPTEPIDVDIATHITIEDDGPDRSLLFIESADRPGLLVELVKIISDISVAVESGEFDTEGLLAKVKFHVSYRNKALIKPLQQVLANSLRYFLRRPSTDESSF

SEQ ID NO: 1825 - DNA, 1044 bp, Arabidopsis thaliana
  misc_feature (1)..(1044): Ceres ANNOT ID no. 566835
atggggtcgacagaaaaagagcagacgacgcaacatcacccgcctcacatcagcagtctcgtcgtacgtccctccggaagcaacgacagagaagacggccgcaacgccgccggagactatgagcccggagaagtctctcgtgaccggccttcgtttaatcgctcggatcggtataagggtgacaatggtggacatagaactcgggcaagttctagctcaccaggccgtcgtggatatgaagatcacaagcatggctctgatcttaatcattcaggcgttccacctcgtggccgtgagttaagcagcagaagggaagcacctgggagacacagagactattccccacccttagctagaggtggagctggtgctcgtccttatcgaagaggtttagatgggcctgaacctccacatggaagggatggcatgagcagaaataatatatcaaaggtgcaaccaagagaaggagattggtactgtcttgatccattatgcagaaacttgaactttgcgagacgcgagtcctgctacaaatgcaagaggcatcgttatgcaccggctaatagtcctccactgcctcgccttcttcctcctcccatgaatcattccccaagaagagactttaatggctacagatctcctccgcgtggctggcccagagactacccgccgccaaggcatgaccatcccacatggagagacagagaacgagaccgtccgcattactcagaccatgagtaccctcctagcagaaggatagcatctgactgggcccatacagagccgctcccaaaacctcattatgacagacgaccacctctcagtccacctcgtggtggcagatggggacgagttttgagagagaggagcagatccccgccattgagagatgttccaccaccgccattgagagatggtccaccaccgtcattgagaggaggcggtccaccgctgcacagagattaccgccgtgacagtcactttgacagagaaagacgagacgatgggcgtggcggcagaggcagaatgggaaactcttactga

SEQ ID NO: 1826 - protein, 347 aa, Arabidopsis thaliana
  misc_feature (1)..(347): Ceres ANNOT ID no. 566835
MGSTEKEQTTQHHPPHISSLVVRPSGSNDREDGRNAAGDYEPGEVSRDRPSFNRSDRYKGDNGGHRTRASSSSPGRRGYEDHKHGSDLNHSGVPPRGRELSSRREAPGRHRDYSPPLARGGAGARPYRRGLDGPEPPHGRDGMSRNNISKVQPREGDWYCLDPLCRNLNFARRESCYKCKRHRYAPANSPPLPRLLPPPMNHSPRRDFNGYRSPPRGWPRDYPPPRHDHPTWRDRERDRPHYSDHEYPPSRRIASDWAHTEPLPKPHYDRRPPLSPPRGGRWGRVLRERSRSPPLRDVPPPPLRDGPPPSLRGGGPPLHRDYRRDSHFDRERRDDGRGGRGRMGNSY

SEQ ID NO: 1827 - DNA, 789 bp, Arabidopsis thaliana
  misc_feature (1)..(789): Ceres ANNOT ID no. 841947
atgtggttgaagattcgtgggattccgattcagtatctttgtgatgggacggttcgtgagattgcttcgtctatgggtgaggtaatggaagttgaattagatgatggaatggttgatttgagttctgtgcgtgctcgtgtgaatgtttgtgtggatacacgtttgtgttttaagaaagtggcgaggtttgattctggagaggttaagattgtgagttttaggtatgaggatattggtatgagtaaagcgaggtttaagttttgttttaattgtggggatatgaatcatttggctaggaattgtttgatcccttgggttgatgttcctgatccttatgaacgttctctttcaccaccgcctcatgagtctaactctgatggttctgctgagggcaactgtggtgatggtggaacttcttctggtactttggagctgctcgaattggtggatgcggttcaggactttcctgttggggatggtgagcagctcgaattggcgggtgtggttcaggacttgcctgttggggatggtgagcagcagcagcaaggtcttgatggtgttgaggaagctaatgctacgcaggtggattctgaaatggttggaatttcatctgaggggtctaaaaggaagtttgatgcggtggagcagggtgatgaaaatccggaaaagcggcttagaggaatcactgatgcaactgagggaggaagcactgacgcaactcagggaggaagcactgatgcaactgaggagggtttaggggttagccttaagccacttcaaggagaatga

SEQ ID NO: 1828 - protein, 262 aa, Arabidopsis thaliana
  misc_feature (1)..(262): Ceres ANNOT ID no. 841947
  misc_feature (86)..(103): Pfam Name: zf-CCHC Pfam Description: Zinc knuckle
MWLKIRGIPIQYLCDGTVREIASSMGEVMEVELDDGMVDLSSVRARVNVCVDTRLCFKKVARFDSGEVKIVSFRYEDIGMSKARFKFCFNCGDMNHLARNCLIPWVDVPDPYERSLSPPPHESNSDGSAEGNCGDGGTSSGTLELLELVDAVQDFPVGDGEQLELAGVVQDLPVGDGEQQQQGLDGVEEANATQVDSEMVGISSEGSKRKFDAVEQGDENPEKRLRGITDATEGGSTDATQGGSTDATEEGLGVSLKPLQGE

SEQ ID NO: 1829 - DNA, 1017 bp, Arabidopsis thaliana
  misc_feature (1)..(1017): Ceres CLONE ID no. 100085
  misc_feature (1)..(1017): GEMINI ID 539F6
actactgttatttagcctgcaaagcccacaaacaaagggctacacaagtcttccttctctctctccctctccctctctttagatggaataatggatcaatgcttgtaaaggtttgaaatttgatcaagttttgaagaagcaaattgaaaaagaaaagaaaagagaagacatggaggtggagaagaggattgtagtgaatggaggaatgaaattgccaataggatacagatttcacccaaccgagcaagagcttatccttcattacttgctcccaaaggcctttgcttctcctttgccttcctccatcatccctgtctttgacctcttcttctctcatcctcttactttcccaggggaccaaaaggagaagcagaggtacttcttttgcaagaagagagaagtgtcaagtaatgagcatagaatcaagatttcctctggtgatggttattggaaacctattggtaaagagagaccaatcattgcctgtggtaaaacatttgggattagaagaacacttgctttctatgaaacaaacaagtcttcttcttattgcaacaaaactagatggagcatgacagagtattgtcttgcgggatttgcgtcggctaaggtgtctggagaatgggcagtgtacaatgtttatgagaggaaaggctcaaaaggaagaaaacagaggaaatcaagagagggagatgatgaagaattgagatgcatcgaccattttacggttgggtcaaatcatgaaaccggtccaccaccgccttctcctcctacctcagctgatgagtaatatatatatctcataggagacgttgagattgtgacaagctcctaaaccctaacctactattccacttacgtttctgtcaagctatttaaaaaatttcaacgtcttgatttatttgttagcgaaataagtaaagtaacatggttctaggggagctcattttgatctgaaactgttgaattgtatgagttgagatttgcacttttgttgggcaaaaccaaatatatgtc

SEQ ID NO: 1830 - protein, 206 aa, Arabidopsis thaliana
  misc_feature (1)..(206): Ceres CLONE ID no. 100085
  misc_feature (1)..(206): GEMINI ID 539F6
  misc_feature (15)..(141): Pfam Name: NAM Pfam Description: No apical meristem (NAM) protein
MEVEKRIVVNGGMKLPIGYRFHPTEQELILHYLLPKAFASPLPSSIIPVFDLFFSHPLTFPGDQKEKQRYFFCKKREVSSNEHRIKISSGDGYWKPIGKERPIIACGKTFGIRRTLAFYETNKSSSYCNKTRWSMTEYCLAGFASAKVSGEWAVYNVYERKGSKGRKQRKSREGDDEELRCIDHFTVGSNHETGPPPPSPPTSADE

SEQ ID NO: 1831 - DNA, 1227 bp, Arabidopsis thaliana
  misc_feature (1)..(1227): Ceres CLONE ID no. 106887
  misc_feature (1)..(1227): GEMINI ID 531F1
ctctctctctctttttttctaatcatacgaacacaatctgcttcaagaattagggttttgatcagacacaaaaaagtatctctctccgtagttttgtgtcaaggttatgcaagaagcggcgctaggtatgatgggagccagcgtaggcggagatggagacgccgcggtcgtggcggagcagaatagacagttgaaaggtgagatagcgacacatccgatgtatgagcaattattagccgcacacgtggcatgtctaagagtagctactccaatagatcaacttccgatcattgaagctcagctttctcaatctcatcatcttctccgttcttacgcttccacggccgttggataccatcatgatcgtcacgagctcgataatttcttggcacaatatgtaatggtgttgtgtagcttcaaagaacagctgcaacagcacgtgagggttcatgccgtcgaagctgttatggcttgccgtgaaattgagaacaaccttcattctcttacaggagcaactttaggagaagggtcgggtgcgactatgtcggaggatgaggatgatcttccgatggatttctcgtcagataattccggcgttgattttagcggcggccacgatatgacgggatttggtccgttgctaccgactgaatcggaaaaatcccttatggaaagagtcagacaagaactcaaactagaactcaaacagggttttaaatcgagaattgaagatgtgagagaagagataatgaggaaaagaagggctgggaagttgccaggagacacaactactgtcttgaaaaattggtggcaacaacattgcaagtggccttaccctacggaagatgacaaggcaaaattggtggaggagacaggattgcagttgaagcaaatcaacaattggttcattaaccagcgcaagaggaattggcacaacaactctcactccctcacttccttgaagtccaagcgcaaacactaatctcttcttactatattagttactacctctacatatattcatactaattacactgcttaagtcatgcatgatacatacgtaattcatgttactgataataacgaggtgtgatcattcattaatatcatgtacttacttagcttattagatccaccgactactatatgatattgtgcgttgcgtgattactgtctgttactagattgtaattcattttgttttgtattgtgcattcaaatttatct

SEQ ID NO: 1832 - protein, 291 aa, Arabidopsis thaliana
  misc_feature (1)..(291): Ceres CLONE ID no. 106887
  misc_feature (1)..(291): GEMINI ID 531F1
  misc_feature (194)..(215): Pfam Name: ELK Pfam Description: ELK domain
  misc_feature (27)..(71): Pfam Name: KNOX1 Pfam Description: KNOX1 domain
  misc_feature (80)..(135): Pfam Name: KNOX2 Pfam Description: KNOX2 domain
MQEAALGMMGASVGGDGDAAVVAEQNRQLKGEIATHPMYEQLLAAHVACLRVATPIDQLPIIEAQLSQSHHLLRSYASTAVGYHHDRHELDNFLAQYVMVLCSFKEQLQQHVRVHAVEAVMACREIENNLHSLTGATLGEGSGATMSEDEDDLPMDFSSDNSGVDFSGGHDMTGFGPLLPTESEKSLMERVRQELKLELKQGFKSRIEDVREEIMRKRRAGKLPGDTTTVLKNWWQQHCKWPYPTEDDKAKLVEETGLQLKQINNWFINQRKRNWHNNSHSLTSLKSKRKH

SEQ ID NO: 1833 - DNA, 1310 bp, Panicum virgatum
  misc_feature (1)..(1310): Ceres CLONE ID no.1796871
aaaggatcggaggagaggctgcaagggaggagaaggtcgtcgccgtcgatcgacacatatatgcagggcggtggtgatcaaggagggagcctgggcatggacgtgggcttcgccggcggcgccgagtgctcgtcgtcttcggccgcggcggcggcggccgcggcagccgcggcggaggcggaggagcggcagctgctcaagggggagatcgcggtgcacccgctgtgcgagcagctggtgacggctcacgtggggtgcctgcgcgtggcgacgcccatcgaccacctccccctcatcgacgcgcagctggcgcagtccagcggcctcctccactcctacgccgcccaccaccgccccttcctctccccgcacgacaagcacgacctcgactccttcctcgcgcagtacctgatgctgctgtgctcgttccgcgagcagctgcagcagcacgtccgggtgcacgccgtcgaggccgtcatggcgtgccgcgagatcgagcagtcactgcaggacctaaccggcgcgacactggaggaaggcacaggggcgaccatgtcggaggacgaggacgagccgccgatgctggagggggcactggacatgggctccgacgggcaggacatgatgggcttcggcccgctcctgcccaccgattccgagcgctcccttatggagagggtcaggcaggagctcaagatcgagctcaaacagggtttcaagtcaagaatagaggatgtgagggaagaaatccttcggaaaaggagggccgggaagctgcctggggacaccaccagcatcctcaagcaatggtggcagcagcactccaagtggccataccccacggaagatgataaggcgaagcttgttgaagagactagcctgcagctgaaacaaatcaacaactggttcatcaaccagaggaagaggaattggcacaacaactcccagacgtcaaccctcaaatcaaagcgtaaaaggtgatggagatcgagctgcacaatgtatacctgatacatataccaacaacgctaatcaaacggagctggaccatggtgactctcaaaaaataaaagaggatcgaccgattcaactgtatatctagtcattagtcagaggtgacagtttcatgacacacacacacactagtctgaccactggcatatttgtttgctgtgatttttatttgagctcgtatgctcaaaccatgcatattattcttgttactgtatagatatagtttgtccccactgtacgtatataatctgatctgaggattaattcattccctggaaaaaaaaaaaaaaaaaaaa

SEQ ID NO: 1834 - protein, 306 aa, Panicum virgatum
  misc_feature (1)..(306): Ceres CLONE ID no. 1796871
  misc_feature (1)..(306): Functional Homolog of  Ceres CLONE ID no. 106887
  misc_feature (210)..(231): Pfam Name: ELK Pfam Description: ELK domain
  misc_feature (44)..(88): Pfam Name: KNOX1 Pfam Description: KNOX1 domain
  misc_feature (99)..(154): Pfam Name: KNOX2 Pfam Description: KNOX2 domain
MQGGGDQGGSLGMDVGFAGGAECSSSSAAAAAAAAAAAEAEERQLLKGEIAVHPLCEQLVTAHVGCLRVATPIDHLPLIDAQLAQSSGLLHSYAAHHRPFLSPHDKHDLDSFLAQYLMLLCSFREQLQQHVRVHAVEAVMACREIEQSLQDLTGATLEEGTGATMSEDEDEPPMLEGALDMGSDGQDMMGFGPLLPTDSERSLMERVRQELKIELKQGFKSRIEDVREEILRKRRAGKLPGDTTSILKQWWQQHSKWPYPTEDDKAKLVEETSLQLKQINNWFINQRKRNWHNNSQTSTLKSKRKR

SEQ ID NO: 1835 - DNA, 1160 bp, Arabidopsis thaliana
  misc_feature (1)..(1160): Ceres CLONE ID no. 114074
  misc_feature (1)..(1160): GEMINI ID 533D3
aaaaaagtgttgtttctgcagagctctctctctctctctctcgttctctttccacacattctttgatctccactatttaagtagacaagaatcataaagaaaatagtgagatgatgatgttagagtcaagaaacagtatgagagcttcaaactcagtcccagatctgtctcttcagatcagtcttcctaactatcacgccggaaaacctcttcacggcggtgaccggagctccacaagcagtgattctggaagcagcctcagtgacctgagccatgagaacaacttcttcaacaaacctctcttgagcttaggatttgaccatcatcatcaaaggcgctcaaacatgttccaacctcaaatctacggtcgagatttcaagagaagctcatcatcaatggttggtcttaaacgaagcattcgtgctccaagaatgagatggacttctactcttcatgctcacttcgtccatgctgttcaacttcttggcggccatgaaagagcaacgcctaaatcagtgttggagctcatgaatgtgaaggatctaaccctagctcatgtcaagagtcacttgcagatgtatagaacagtgaaatgcactgataaaggatcacaggagaaggaaaggtagagaaagaggcagagcagaggataggggacaataataataatgaagaagctgatgaaggaactgacacaaattcgccaaactcatcatctgtgcaaaagacccaaagagcttcatggtcatcgacaaaggaagtatctaggagcatatctacacaagcatattctcacttgggaacaactcatcacactaaggacaatgaagagaaagaggataccaacattcatctcaatttggatttcacattggggcggcctagttgggggatggaatatgcggaaccctccagtgatttaacccttctcaagtgctaattgccttaagctacaacaaataagtcagcttaggttaccagttttaacataattttaacttgttttgatcatatgagctttggaagaatcatattatcatcacatatgaacttctttccaagaatgttctatgagttttttgatatgtataatcaagagaatcgtttgaagtagtaagtattgttgtagtgggatgagaagggagtacaagttcaagtac

SEQ ID NO: 1836 - protein, 172 aa, Arabidopsis thaliana
  misc_feature (1)..(172): Ceres CLONE ID no. 114074
  misc_feature (1)..(172): GEMINI ID 533D3
  misc_feature (107)..(158): Pfam Name: Myb_DNA-binding Pfam Description: Myb-like DNA-binding domain
MMMLESRNSMRASNSVPDLSLQISLPNYHAGKPLHGGDRSSTSSDSGSSLSDLSHENNFFNKPLLSLGFDHHHQRRSNMFQPQIYGRDFKRSSSSMVGLKRSIRAPRMRWTSTLHAHFVHAVQLLGGHERATPKSVLELMNVKDLTLAHVKSHLQMYRTVKCTDKGSQEKER

SEQ ID NO: 1837 - DNA, 508 bp, Arabidopsis thaliana
  misc_feature (1)..(508): Ceres CLONE ID no. 143475
  misc_feature (1)..(508): GEMINI ID 533B6
aaaatcaagtcctttttcatcaagtcatacatacatcttccttcttctttttttctccctcccaagaagcagatcttgtactctcgatatacaaacttattcgtgatatggcttccaactcaatgagctctagcgcttcttggacacgtaaggagaacaaattatttgaaagggcgttggctacatatgaccaggacactcctgaccgttggcataacgttgcaagagccgttggcggcaaatcagctgaagaagtaaggcgacactacgagctcctcattagggatgtcaatgacattgagtcagggcgttatccacatcccaattaccgttcaaatggaaacaatcactgaaagcattgaaggaactccaaaaggctctactgaagtggacatggttccaaaaccattcacaaagcacatctaagcaaagatatctaaatgtatttacttgtttttgtgttacgaatatgtaagaattatctaaatcaatcaatgtggtttcatat

SEQ ID NO: 1838 - protein, 81 aa, Arabidopsis thaliana; identical to SEQ ID NO: 716
  misc_feature (1)..(81): Ceres CLONE ID no. 143475
  misc_feature (1)..(81): GEMINI ID 533B6
  misc_feature (9)..(58): Pfam Name: Myb_DNA-binding Pfam Description: Myb-like DNA-binding domain

SEQ ID NO: 1839 - DNA, 777 bp, Arabidopsis thaliana
  misc_feature (1)..(777): Ceres CLONE ID no. 14432
  misc_feature (1)..(777): GEMINI ID 554H2
ccttttccccttctaatctctctcgcatctctacattttgagatcattttaaattgtcctctcttttattttccggttaagcaccatgatgtctactatttccccggttttctcaaccgaaccgggtctattaacctctgtcctcccagcttttgaaaccagtttcactccatgggacatttcacacctcttctcggtcttcgattcatcaatcgatccaaaaccggtttcgacccatgactatggttcagtaaaccagatcggttcagacatgtctccgaccgacaataccgacgagcggaaaaagaaacggaaattatcgaaccgggaatcggctaagcggtcaagagagaagaaacaaaagcacttggaggagatgagtatccagctaaaccaactcaaaattcagaaccaagaattgaagaaccagcttcggtacgttttataccattgtcaacgaacgaagatggaaaatgatcgtctacttatggagcaccgtatactgcatgataagttgttgaacatcagacaagttttgatgtttcgtcaaacctaacgaagctcatcaaactgtgccacttggccttgtaataacagtactgttgttacggtccagcaagatccgtcgatcatgttatcataagttgaggtttctgaaattgtttcgacggtaaaatgggaacaatttgtaaaaacaattattgaaaaatgcatggatatacgttatcaaattagatttcgttttttatatattaataaataaataaataattaatt

SEQ ID NO: 1840 - protein, 156 aa, Arabidopsis thaliana
  misc_feature (1)..(156): Ceres CLONE ID no. 14432
  misc_feature (1)..(156): GEMINI ID 554H2
  misc_feature (68)..(122): Pfam Name: bZIP_2 Pfam Description: Basic region leucine zipper
MMSTISPVFSTEPGLLTSVLPAFETSFTPWDISHLFSVFDSSIDPKPVSTHDYGSVNQIGSDMSPTDNTDERKKKRKLSNRESAKRSREKKQKHLEEMSIQLNQLKIQNQELKNQLRYVLYHCQRTKMENDRLLMEHRILHDKLLNIRQVLMFRQT

SEQ ID NO: 1841 - DNA, 1172 bp, Arabidopsis thaliana
  misc_feature (1)..(1172): Ceres CLONE ID no. 152630
  misc_feature (1)..(1172): GEMINI ID 162G10
  misc_feature (1)..(1172): GEMINI ID 532A5
gtgacatttgtcaatgtctgtggtttataacatgtttctcaatgtcaggatcacacacaccacttctcatgtataaatacacataaaagcaattggatttggtaagagggaatctcaaaagtgtgtgtctgtgagagaggagagagagaatatgggcaaaggaagagcaccatgttgtgacaaaaccaaagtgaagagaggaccatggagccatgatgaagacttgaaactcatctctttcattcacaagaatggtcatgagaattggagatctctcccaaagcaagctggattgttgaggtgtggcaagagttgtcgtctgcgatggattaattacctcagacctgatgtgaaacgtggcaatttcagtgcagaggaagaagacaccatcatcaaacttcaccagagctttggtaacaagtggtcgaagattgcttctaagctgcctggaagaacagacaatgagatcaagaatgtgtggcatacacatctcaagaaaagattgagctcggaaactaaccttaatgccgatgaggcgggttcaaaaggttctttgaacgaagaagagaactctcaagagtcatctccaaatgcttcaatgtcttttgctggttccaacatttcaagcaaagacgatgatgcacagataagtcaaatgtttgagcacattctaacttatagcgagtttacggggatgttacaagaggtagacaaaccagagctgctggagatgccttttgatttagatcctgacatttggagtttcatagatggttcagactcattccaacaaccagagaacagagctcttcaagagtctgaagacgatgaagttgataaatggtttaagcacctggaaagcgaactcgggttagaagaaaacgataaccaacaacaacagcataaacagggaacagaagatgaacattcatcatcactcttggagagttacgagctcctcatacattaatgaagccataaagcaagtcattttcaccttgaaaatggaattattagctaacttattggcattattagtatataagcaagatcagataggcgcatgtagtagcaacaacgaagaaacgtcgaattgtagacaaaatgtagatattacagagttgaaagattgtattttgcaaatgattgctttgtagtgaaatcaagttatc

SEQ ID NO: 1842 - protein, 272 aa, Arabidopsis thaliana
  misc_feature (1)..(272): Ceres CLONE ID no. 152630
  misc_feature (1)..(272): GEMINI ID 162G10
  misc_feature (1)..(272): GEMINI ID 532A5
  misc_feature (16)..(63): Pfam Name: Myb_DNA-binding Pfam Description: Myb-like DNA-binding domain
MGKGRAPCCDKTKVKRGPWSHDEDLKLISFIHKNGHENWRSLPKQAGLLRCGKSCRLRWINYLRPDVKRGNFSAEEEDTIIKLHQSFGNKWSKIASKLPGRTDNEIKNVWHTHLKKRLSSETNLNADEAGSKGSLNEEENSQESSPNASMSFAGSNISSKDDDAQISQMFEHILTYSEFTGMLQEVDKPELLEMPFDLDPDIWSFIDGSDSFQQPENRALQESEDDEVDKWFKHLESELGLEENDNQQQQHKQGTEDEHSSSLLESYELLIH

SEQ ID NO: 1843 - DNA, 1311 bp, Arabidopsis thaliana
  misc_feature (1)..(1311): Ceres CLONE ID no. 19561
  misc_feature (1)..(1311): GEMINI ID 534G10
  misc_feature: Encodes the peptide sequence at SEQ ID NO. 1286
  misc_feature: Encodes the peptide sequence at SEQ ID NO. 1844
  misc_feature: Encodes the peptide sequence at SEQ ID NO. 1957
gtaacaacgtcacctaaatctctctcacccaatttgtgtttcttctttctgctaaaaggttataatttttgtttcttggtttggtgagaatcttcaagaaactgaaacaaagaaaatggattctagttgcatagacgagataagttcctccacttcagaatctttctccgccaccaccgccaagaagctctctcctcctcccgcggcggcgttacgcctctaccggatgggaagcggcgggagcagcgtcgtgttggatcccgagaacggcctagagacggagtcacgaaagctaccatcttcaaaatacaaaggtgttgttcctcagcctaacggaagatggggagctcagatctacgagaagcaccaacgagtatggctcgggactttcaacgagcaagaagaagctgctcgttcctacgacatcgcagcttgtagattccgtggccgcgacgccgtcgtcaacttcaagaacgttctggaagacggcgatttagcttttcttgaagctcactcaaaggccgagatcgtcgacatgttgagaaaacacacttacgccgacgagcttgaacagaacaataaacggcagttgtttctctccgtcgacgctaacggaaaacgtaacggatcgagtactactcaaaacgacaaagttttaaagacgcgtgaagttcttttcgagaaggctgttacacctagcgacgttgggaagctaaaccgtctcgtgatacctaaacaacacgccgagaaacactttccgttaccgtcaccgtcaccggcagtgactaaaggagttttgatcaacttcgaagacgttaacggtaaagtgtggaggttccgttactcatactggaacagtagtcaaagttacgtgttgaccaagggatggagtcgattcgtcaaggagaagaatcttcgagccggtgatgttgttactttcgagagatcgaccggactagagcggcagttatatattgattggaaagttcggtctggtccgagagaaaacccggttcaggtggtggttcggcttttcggagttgatatctttaatgtgaccaccgtgaagccaaacgacgtcgtggccgtttgcggtggaaagagatctcgagatgttgatgatatgtttgcgttacggtgttccaataagcaggcgataatcaatgctttgtgacatttttccttttccgattttttgctttcgttttttaatttttttttttgtcaagttgtgtaggttgtgattcatgctaggttgtatttaggaaaagagataagaccaaaaaataaattggaacaatggttttgtgt

SEQ ID NO: 1844 - protein, 352 aa, Arabidopsis thaliana
  misc_feature (1)..(352): Ceres CLONE ID no. 19561
  misc_feature (1)..(352): GEMINI ID 534G10
  misc_feature (187)..(295): Pfam Name: B3 Pfam Description: B3 DNA binding domain
  misc_feature (63)..(112): Pfam Name: AP2 Pfam Description: AP2 domain
MDSSCIDEISSSTSESFSATTAKKLSPPPAAALRLYRMGSGGSSVVLDPENGLETESRKLPSSKYKGVVPQPNGRWGAQIYEKHQRVWLGTFNEQEEAARSYDIAACRFRGRDAVVNFKNVLEDGDLAFLEAHSKAEIVDMLRKHTYADELEQNNKRQLFLSVDANGKRNGSSTTQNDKVLKTREVLFEKAVTPSDVGKLNRLVIPKQHAEKHFPLPSPSPAVTKGVLINFEDVNGKVWRFRYSYWNSSQSYVLTKGWSRFVKEKNLRAGDVVTFERSTGLERQLYIDWKVRSGPRENPVQVVVRLFGVDIFNVTTVKPNDVVAVCGGKRSRDVDDMFALRCSNKQAIINAL

SEQ ID NO: 1845 - DNA, 589 bp, Arabidopsis thaliana
  misc_feature (1)..(589): Ceres CLONE ID no. 207629
  misc_feature (1)..(589): GEMINI ID 83D4
  misc_feature: Encodes the peptide sequence at SEQ ID NO. 1192
  misc_feature: Encodes the peptide sequence at SEQ ID NO. 1846
atcacttacttaacatactaagagagttattagaacttgcaaaaaatggcttccaaggctttgattctgttaggtctcttctcagttcttctcgtcgtctccgaagtgtctgccgcaaggcaatcgggcatggtgaagccagagagtgaggaaactgtgcaacctgaaggttatggcggtggccacggaggacatggtggtcacggagggggaggaggccacggacatggaggacacaacggaggagggggccacggacttgacggatacggaggacactacggaggtggtggaggaggatacggaggtggaggaggacaccacggaggaggaggccacgggctaaacgaacctgttcagactaagccgggtgtttaaaactatataatatcttcactaccatgcatgattgcatatatatatatacgcttatgtattatctatatgcctataaataaaccatggtgagtttgtaacgcagtgccttcagaaatgttcggaataaatttccataatattagtataatgtctctctgtttgaattataaactgcgctgtttgcataataaaatctcttgtagctaggtcg

SEQ ID NO: 1846 - protein, 110 aa, Arabidopsis thaliana; identical to SEQ ID NO: 1192
  misc_feature (1)..(110): Ceres CLONE ID no. 207629
  misc_feature (1)..(110): GEMINI ID 83D4
  misc_feature (1)..(96): Pfam Name: GRP Pfam Description: Glycine rich protein family

SEQ ID NO: 1847 - DNA, 848 bp, Arabidopsis thaliana
  misc_feature (1)..(848): Ceres CLONE ID no. 21674
  misc_feature (1)..(848): GEMINI ID 555G5
ataccacatattacactttttctccaatggcttctctgaagctttcaccttcttctccaatctccatttctaaggttggtgtgattccttcctctaagaaaggactttcatttcttgtaaaagcagagcaccattcctcgtcttcttcttctcatcttcaagataaatgtcagagacgtctgattgtaacatttggtgttgttgctccttggatctcattgcttagtagagctccattatcataaagcaaaaaaggattccttgctgtctctgacaataaagatgcttatgcgtttctctatccatttggttggcaggaagttgtgattgaaggtcaagataaggtatacaaagatgtgattgagcctttagaaagtgttaagtgtgaatttggtcccaactagcaaacagactattaaagaatttggccctcccaagcagatagctgaaacactgataaagaaagttttggcacctccaaatcagaaaacaacccttattgatgcatcagagcatgatgtcgatgggaagacttattatcagtttgagttcactgttcaagctagaaactacactcgtcatgctctgggtaccatcacggttttcaacggaaacttctacacactgacgacgggagcgaatgaaaggaggtgggagaagatgaaagataggcttcacactgtggtagattccttcaagatcactgtttgaaaatactgtaatcaagtttgctttggttgtctcttgttttgcccatttcttgtatttttgtccattcttcttctctctttcccttaacaatattcttttcctgtaagagagattcaataactcttgacttgcctccc

SEQ ID NO: 1848 - protein, 72 aa, Arabidopsis thaliana
  misc_feature (1)..(72): Ceres CLONE ID no. 21674
  misc_feature (1)..(72): GEMINI ID 555G5
MASLKLSPSSPISISKVGVIPSSKKGLSFLVKAEHHSSSSSSHLQDKCQRRLIVTFGVVAPWISLLSRAPLS

SEQ ID NO: 1849 - DNA, 1048 bp, Arabidopsis thaliana
  misc_feature (1)..(1048): Ceres CLONE ID no. 231890
  misc_feature (1)..(1048): GEMINI ID 534D12
agaatacttttatctcatattcccaacacttgttcaagcatatctaagtcaataacaacattacaacataacatggtgaaacaagaactcaagatccaagttactacttcctcatcatcactctctcattcttcatcttcttcttcttcttcaacgtcggcactacgtcatcaatcttgtaagaacaagataaagaagtataaaggtgtgaggatgcgaagttggggatcatgggttactgaaattagggcaccaaatcaaaagacaagaatctggttaggttcttactccaccgcagaagcagctgsttaggggcttacagaccgctgyttctctttggtgtcttaagggaccctaaaggcttaatctccaactttcccctaacatcmcccacttactttctccttttcttatgaacatcgacgaaaagaccctttttgtccccaaaatcaatccaaaaggtcgccgctcaagccgctaactcctcttctgaccattttacccctccgtccgatgaaaatgatcatgatcatgaagacggactcgatcaccatccatctgcttcttcttcagctgcatcttcaccaccagatgatgatcatcataatggatgacgatgggtgatttggtatcgktgatggaatctttcgkgggattaccaacgaacaccgtgkctytggatgggatccatcgctgkatggaaatttggacataatgagatcttcttcaccaacggagatccgtttgattattctccacagttacatagctcaaaggcaacgatggatgacttctacgacgatgttgatattccgctgtggagtttcagttaatccaacggtccatattattatactacgaaacacttttaattcacattatttcatttaatttattctttcaattcatattattcgtccttgttgtttcgttatgtattaaatatacacacactaatttaagaagatcacatggactagaggtttttttgtcaaaaaaaaaaaaaaaaaatatcgataccgcgacctcgaggggggccggacacaag

SEQ ID NO: 1850 - protein, 79 aa, Arabidopsis thaliana
  misc_feature (1)..(79): Ceres CLONE ID no. 231890
  misc_feature (41)..(78): Pfam Name: AP2 Pfam Description: AP2 domain
  misc_feature (1)..(79): GEMINI ID 534D12
  misc_feature (79)..(79): Xaa is any aa, unknown, or other
MVKQELKIQVTTSSSSLSHSSSSSSSSTSALRHQSCKNKIKKYKGVRMRSWGSWVTEIRAPNQKTRIWLGSYSTAEAAX

SEQ ID NO: 1851 - DNA, 682 bp, Arabidopsis thaliana
  misc_feature (1)..(682): Ceres CLONE ID no. 250028
  misc_feature (1)..(682): GEMINI ID 539C4
ctagagaaatctcttcttctagttctagtctcctgcttcttcgagatcgtgtgtcgtaactcgtaagctagggaagccctttttgtcttcgaatttcggctagattcaaaccatggttggaagacgagtatcacctgctctaactaaggatgatgcgcattcatacatcattgctgtgaaggaaacatttcatgatgaacctacgaaatatcaagagtttatcaagctcttgaatggtgtttgtgatcatagagtcgataaatatagtgtcattgcaagggtggaggaactgatgaaagatcatcaggatcttcttcttggtttcagtgtcttccttccacctgtttctgtagaggattttataaacaagctcaagacacggtttcagagccttgatactcatgtagtgggggcaattcgcgggttaatgaagatgtttaaagagggaaagatgtcggtaaaggaggtgcaagaggaggtcattgatgtcctcttctatcatgaagatttgattgaagactttctcagatttttcacaaagaaccctgtatcaacagcatcactactactacaattataacgagtgatgtattttttatgaatgagaatggagtgtatagtttcttttgtagaggttttaaatctttgcttttcaccatgaagaggatgagatttgaatttg

SEQ ID NO: 1852 - protein, 155 aa, Arabidopsis thaliana
  misc_feature (1)..(155): Ceres CLONE ID no. 250028
  misc_feature (1)..(155): GEMINI ID 539C4
  misc_feature (30)..(76): Pfam Name: PAH Pfam Description: Paired amphipathic helix repeat
MVGRRVSPALTKDDAHSYIIAVKETFHDEPTKYQEFIKLLNGVCDHRVDKYSVIARVEELMKDHQDLLLGFSVFLPPVSVEDFINKLKTRFQSLDTHVVGAIRGLMKMFKEGKMSVKEVQEEVIDVLFYHEDLIEDFLRFFTKNPVSTASLLLQL

SEQ ID NO: 1853 - DNA, 786 bp, Arabidopsis thaliana
  misc_feature (1)..(786): Ceres CLONE ID no. 25793
  misc_feature (1)..(786): GEMINI ID 535H2
gagttggaccagtcggaggattagggtttcaacggagactcactagtcgatctcctatcctttcttctacccgcccgaaatccgtcgaaacttctcttctttaccattgatttgcctcgtctcagctcaattctcttccgttgctgcttcgtttagttgttgcttcgcttcagtactctggtggtcggagagatgaatcacggccaacaatctggtgaggcaaagcatgaagatgatgctgctcttacagagttccttgcttctctgatggattatactcctactattcctgatgatttagtggagcactacttggctaagagtggatttcagtgccccgacgtacgattgataaggctagttgctgtggctacacaaaagtttgttgcagatgttgccagtgacgcccttcagcattgcaaggctagaccagcaccagttgtgaaagacaaaaaacagcaaaaggataagcgtttggtattgacaatggaagatctttcaaaagctttgcgtgagtatggtgtgaacgtgaagcatccagaatattttgctgatagcccttcgactggaatggaccctgcaacaagggacgaatagaaaccaggaattcctcaaaatctttgcctagtaaggacggtcatgtgtctcagatccctgattctctgttgtgtttcagttaaaaacaaaactcacttgtcttgctagtcctcaattactacattacatgtatattcgtttgttgtttgttctctggtgatttttggggttctacatcacttatccacc

SEQ ID NO: 1854 - protein, 134 aa, Arabidopsis thaliana
  misc_feature (1)..(134): Ceres CLONE ID no. 25793
  misc_feature (1)..(134): GEMINI ID 535H2
  misc_feature (30)..(80): Pfam Name: TFIID_30kDa Pfam Description: Transcription initiation factor TFIID 23-30kDa subunit
MNHGQQSGEAKHEDDAALTEFLASLMDYTPTIPDDLVEHYLAKSGFQCPDVRLIRLVAVATQKFVADVASDALQHCKARPAPVVKDKKQQKDKRLVLTMEDLSKALREYGVNVKHPEYFADSPSTGMDPATRDE

SEQ ID NO: 1855 - DNA, 692 bp, Panicum virgatum
  misc_feature (1)..(692): Ceres CLONE ID no.1881639
acagccccctcacctcttgtgtcgaagcggctgctgccgtcgtcgctgacacctatcgccgcttccagagtcgccgccggcgggtgttctcccacgctgctcctgcggtgagggcagcggggcgtgaggatgatgggcagtaacagcggcggagggggcggaggccctggcgggggcatgggtccgggcatgggcgggcccacaggtggaggcggggacgggcggcacgacgacgaggctgcgctcaccgagttcctctccttgctcatggactacacccccacgattcccgatgagctggtggagcactacctcggacgcagcggattccactgccctgatctccgcttaacgagattggttgctgtagccacccagaagttcctttcggacattgcaagcgattctcttcagcactgcaaggccagggtagcagcaccaatcaaagataataagagcaaacaaccaaaggatagacgtcttgtactaactatggatgatctttctaaagccttgcgtgagcatggtgtgaacttgaaacacgctgagtacttcgcagacagcccttcagcaggaatggctccttcaacaagggaggagtagattggattgaggcaacctgtaccaagtgtctaagtggaactgggaattatacagggatcatgtcaatgaatagcctgtccgcattattg

SEQ ID NO: 1856 - protein, 157 aa, Panicum virgatum
  misc_feature (1)..(157): Ceres CLONE ID no. 1881639
  misc_feature (1)..(157): Functional Homolog of  Ceres CLONE ID no. 25793
  misc_feature (51)..(101): Pfam Name: TFIID_30kDa Pfam Description: Transcription initiation factor TFIID 23-30kDa subunit
MMGSNSGGGGGGPGGGMGPGMGGPTGGGGDGRHDDEAALTEFLSLLMDYTPTIPDELVEHYLGRSGFHCPDLRLTRLVAVATQKFLSDIASDSLQHCKARVAAPIKDNKSKQPKDRRLVLTMDDLSKALREHGVNLKHAEYFADSPSAGMAPSTREE

SEQ ID NO: 1857 - DNA, 1428 bp, Arabidopsis thaliana
  misc_feature (1)..(1428): Ceres CLONE ID no. 261272
  misc_feature (1)..(1428): GEMINI ID 539C3
attatacaaaaactgtatcatcatcatcatcaagcttgaaatcactctctttcatccttccccgcgcactgtgtctcgctctctctctcccacatttccattatctcctttctttctttctttgagaatgtcttctacaacaatcggcgagcacatcagactccgacgagctagaaaccaaacaatccgtcatctccacgccgccgacgatgatccgccgctaagccacgtcgttcttccgatttcacaacctaatcgcttctgtaactccgctaatgtcttccttctttcccctcccgacttcctcctccaacgaaagcacgaggaagaaaccgtaccaaacgtcgtcgtttcgagggatgggttgctatgccgcagcagcagcagcagctcaagaggtttctgttccctccgtcattcgctactccgcggatttggatgccagaattagaaaagataagaagaagaagaagcataagcataagaaaaagaaaaagaagaataaaggaagctacgaagatggttcgattaggattttaagcgaagaagctagagacgttattgatgtttggtgcagacctggattaggcttctccacggatgctgtaattggtcgatcggttgatcctcctcggggaaggaatattccgtcgtctcgtcgcaaaattgatgtggataacaacaattataatcacacactgggttcttctgttcttcccattcggtttctcaatcaagaaactcattctcatgatatcttcaactctgattctacttttgtgacatcatcacgcgctgaaccaacgatgttgtcaagtagatgtcgtggccatcttccacgctcttaccctgatgatcttaccgagatgaggatgctccagaatggttttgtaatgggaagaataacagattcccgtgataactaccacgaattgaggctcgatgttgatagcatgtcatacgagcaacttcttgagcttggtgatagaattggttatgtgaatactggactaaaagaaagcgagatacatcgttgtcttgggaaaatcaaaccatccgtatcacatactcttgttgatagaaaatgtagcatctgtcaggatgagtatgagagagaggatgaggttggggaattgaactgtggacacagctttcatgtccattgcgtgaaacaatggctttcgaggaagaatgcttgtccggtctgtaagaaggcagcatatggcaagccttaaaagacttttgtatctcgtcgggtttctgatagctcaagatctttcaagccaccttgctgtatagagatctgtatcatctgatacttgattcatatttgttgtttttgcatttagcaatcacaattttttttttttaagatcttatattctttgttgggtctatttatgtgattgaaatcaagagtttgaaatc

SEQ ID NO: 1858 - protein, 319 aa, Arabidopsis thaliana
  misc_feature (1)..(319): Ceres CLONE ID no. 261272
  misc_feature (1)..(319): GEMINI ID 539C3
  misc_feature (271)..(311): Pfam Name: zf-C3HC4 Pfam Description: Zinc finger, C3HC4 type (RING finger)
MSSFFPLPTSSSNESTRKKPYQTSSFRGMGCYAAAAAAAQEVSVPSVIRYSADLDARIRKDKKKKKHKHKKKKKKNKGSYEDGSIRILSEEARDVIDVWCRPGLGFSTDAVIGRSVDPPRGRNIPSSRRKIDVDNNNYNHTLGSSVLPIRFLNQETHSHDIFNSDSTFVTSSRAEPTMLSSRCRGHLPRSYPDDLTEMRMLQNGFVMGRITDSRDNYHELRLDVDSMSYEQLLELGDRIGYVNTGLKESEIHRCLGKIKPSVSHTLVDRKCSICQDEYEREDEVGELNCGHSFHVHCVKQWLSRKNACPVCKKAAYGKP

SEQ ID NO: 1859 - DNA, 546 bp, Arabidopsis thaliana
  misc_feature (1)..(546): Ceres CLONE ID no. 266712
  misc_feature (1)..(546): GEMINI ID 531F2
acataagtctctctcttacattttgaaaccctaatttctcaaaataaatgtctgaagttgagtaccggtgctttgtcggcggccttgcctgggccaccaatgatgaagatcttcaaaggacgttctcacagttcggcgacgttatcgattctaagatcattaacgaccgcgagagtggaagatcaaggggattcggattcgtcaccttcaaggacgagaaagccatgagggatgcgattgaagagatgaacggtaaagagctcgatggacgtgtcatcaccgtgaacgaggctcagtcgagaggtagcggcggtgatggtgaaagttacggaggcggtggtggcggctggtaatcaaagatagagttgtttgcgtgctgctgctctgtttttggtttagatttggatttgtgtcaccacttctggtttggttatcgttcgtttggtttacttttttgatgaaacagtttcgtttaagtcttctttgtctggatcgaaatgttaattcgcgtgttgtttactaaatttataacgtttccttttaacc

SEQ ID NO: 1860 - protein, 101 aa, Arabidopsis thaliana
  misc_feature (1)..(101): Ceres CLONE ID no. 266712
  misc_feature (1)..(101): GEMINI ID 531F2
  misc_feature (8)..(79): Pfam Name: RRM_1 Pfam Description: RNA recognition motif. (a.k.a. RRM, RBD, or RNP domain)
MSEVEYRCFVGGLAWATNDEDLQRTFSQFGDVIDSKIINDRESGRSRGFGFVTFKDEKAMRDAIEEMNGKELDGRVITVNEAQSRGSGGDGESYGGGGGGW

SEQ ID NO: 1861 - DNA, 678 bp, Arabidopsis thaliana
  misc_feature (1)..(678): Ceres CLONE ID no. 2767
  misc_feature (1)..(678): GEMINI ID 532E10
gaagctagaagaagaaaggagaagaagaaacaaagagagaagatgaagaatgttatgctgattattgacgagagcaacgcaagttatgatttactcatttgggcacttgaaaaccaaaaagataccattgagagctccaaagtttatatctttgcaaaacagccacaaaattcctttactcctcctaccgtactttcttcatcagtcggctttgctcaaattttctatccattttcacctaattcagaactcataagattggctcaagaaaagaatatgaaaattgctttgggtatattagagaaagccaagaagatatgtttaaatcatgggatcaaggcagagacatttactaatgttggagaccctaaagatctaatccgcaagataattcaagaacgaaatatcaatttaatagttacgagcgatcaacaaagtctcaaaaagtgtacacaaaatacagattgttctcttcttgtcgtgaagaaaagacttcgcaaagattaaagattaaggaagttacaaaattcaccaatatatataattttctatgtggttaattgagattgtgtaatgatttggggttgtagtttcaggtgttgatttggggttgtagtttgaacttataattgtgttatgtgtataaatatttgtgtttatatatatcaagttagtatg

SEQ ID NO: 1862 - protein, 154 aa, Arabidopsis thaliana
  misc_feature (1)..(154): Ceres CLONE ID no. 2767
  misc_feature (1)..(154): GEMINI ID 532E10
  misc_feature (1)..(148): Pfam Name: Usp Pfam Description: Universal stress protein family
MKNVMLIIDESNASYDLLIWALENQKDTIESSKVYIFAKQPQNSFTPPTVLSSSVGFAQIFYPFSPNSELIRLAQEKNMKIALGILEKAKKICLNHGIKAETFTNVGDPKDLIRKIIQERNINLIVTSDQQSLKKCTQNTDCSLLVVKKRLRKD

SEQ ID NO: 1863 - DNA, 1482 bp, Zea mays; identical to SEQ ID NO: 611
  misc_feature (1)..(1482): Ceres CLONE ID no. 280261
  misc_feature (1)..(1482): GEMINI ID 552C6

SEQ ID NO: 1864 - protein, 336 aa, Zea mays; identical to SEQ ID NO: 612
  misc_feature (1)..(336): Ceres CLONE ID no. 280261
  misc_feature (1)..(336): GEMINI ID 552C6
  misc_feature (33)..(108): Pfam Name: FHA Pfam Description: FHA domain

SEQ ID NO: 1865 - DNA, 1113 bp, Zea mays
  misc_feature (1)..(1113): Ceres CLONE ID no. 280814
  misc_feature (1)..(1113): GEMINI ID 538H1
gtactagtcgtcgagtctgcttccattctgttcaagttagcgccgctaatccgctccctattcaccatccaatccaatcggcttcccccaggcacccatggcgacggcggtggaggttcccgtggaggcgccggtgaggacagtgaaggtcaccaatgtctctcttagtgcaactgtgcaagacattaaggagttcttttccttttcaggagatattgatcatgtggagatgcagagtggtgatgagtggtcccaagttgcatatgtcactttcaaagatgcacaaggcgcagaaacagcacttcttctttcgggtgccacaatagttgatctttctgtcatcattgcacctgctccagagcatcagccacctcctactgcctctgctccaccaatgagtggaaccagagttccagttggtggtggagacaacaacgttgttcacaaagccgaggacgttgtgagcactatgcttgccaagggtttcgtgctaggcaaagacgcggttggcaaggccaaagcattcgatgagaagcatggcttcacatccacagccggtgctacagtggcctcaattgacaagaagattgggctgactgataagatcacgacaggcacttccttggttagcgggaaggtgaaggagatggaccagaagttccaggtctccgacaagaccaagtctgcactcgctgccgccgagcagaaggtgagcagtgccgggtctgccatcatgaagaacaggtacgtcttcaccggcgcgtcatgggtcaccagcgcgttcaacaaggtcgccaagaccgccacggacgtcgggacgatgaccaaggagaagatggccgccgaggagcatcacaagggctctggcccgtcttctggcggccactcgtacacgcccatccgatgattcatgcattggcttgctgttacgtgcctcactcaaacggtgttgtactgcatattggtggatgtaaaacatggtcttttagtcccaactcttattatgttgtggttagctagagttgaaacctaatagaaaccacaagttaaggttcaagcacatgaatacctattttccatacacatatatttaaagttaaattttgtactctc

SEQ ID NO: 1866 - protein, 269 aa, Zea mays
  misc_feature (1)..(269): Ceres CLONE ID no. 280814
  misc_feature (1)..(269): GEMINI ID 538H1
  misc_feature (124)..(150): Pfam Name: Galanin Pfam Description: Galanin
  misc_feature (16)..(84): Pfam Name: RRM_1 Pfam Description: RNA recognition motif. (a.k.a. RRM, RBD, or RNP domain)
MATAVEVPVEAPVRTVKVTNVSLSATVQDIKEFFSFSGDIDHVEMQSGDEWSQVAYVTFKDAQGAETALLLSGATIVDLSVIIAPAPEHQPPPTASAPPMSGTRVPVGGGDNNVVHKAEDVVSTMLAKGFVLGKDAVGKAKAFDEKHGFTSTAGATVASIDKKIGLTDKITTGTSLVSGKVKEMDQKFQVSDKTKSALAAAEQKVSSAGSAIMKNRYVFTGASWVTSAFNKVAKTATDVGTMTKEKMAAEEHHKGSGPSSGGHSYTPIR

SEQ ID NO: 1867 - DNA, 892 bp, Zea mays
  misc_feature (1)..(892): Ceres CLONE ID no. 284030
  misc_feature (1)..(892): GEMINI ID 552H9
  misc_feature (558)..(558): n is a, c, t, g, unknown, or other
atccccatccactctactttacaccgcagcagtgagccagccactgagccaccaagttaactctgagcgacgtcaagcaccaacgcacgacgaccaccaccaccacctcgagctacaagctatggcgaacgttctcctccgctcttcgtcccttcctctggccctggtgccgccgccgctgctgcttctcctggtagcgggatcgctcgcaggggcaaccgcgcttggcagcttccctggggaacgtcgtggtcgaagcctgcagcagctgccaaacccgatgcctcagcctgtcccgcagccgcagccagacccaaacgtacggccgcaaccggggtcgccgaacccactgccaccacagcccctgccgcaaccaaatccaaaccctcagccgcagccccttccgcaaccacagccaggcccgcagcctgacccaaacccacaacctcaacctcagcctcagcctctcccgcagccacagcctggcccaatcccgccgcagcctgacccgaaccggaaccbacagccacaacytcaacccttgccacagcytctccngcaaccacagcctggcccgatcccacagcctaacccaaacccaaacccacagcccgtgccgatgccagacccaaatgtgcagcagccacaaccacaacctgctcccaaccaaaatccacagccgcagtctgatcagctctccgggggtccacagccacttcccaacagcgaaccaaggatgttgaacccgcaatacgccatgcttttaagctttgctgctttgctactataatagctctataccatacagtagtttttttcgttgttttcttttacgcttgtataaatataataatatatatgcggagtagtattattattgtgattttttctt

SEQ ID NO: 1868 - protein, 222 aa, Zea mays
  misc_feature (1)..(222): Ceres CLONE ID no. 284030
  misc_feature (1)..(222): GEMINI ID 552H9
  misc_feature (134)..(134): Xaa is any aa, unknown, or other
  misc_feature (138)..(138): Xaa is any aa, unknown, or other
  misc_feature (144)..(144): Xaa is any aa, unknown, or other
  misc_feature (146)..(146): Xaa is any aa, unknown, or other
MANVLLRSSSLPLALVPPPLLLLLVAGSLAGATALGSFPGERRGRSLQQLPNPMPQPVPQPQPDPNVRPQPGSPNPLPPQPLPQPNPNPQPQPLPQPQPGPQPDPNPQPQPQPQPLPQPQPGPIPPQPDPNRNXQPQXQPLPQXLXQPQPGPIPQPNPNPNPQPVPMPDPNVQQPQPQPAPNQNPQPQSDQLSGGPQPLPNSEPRMLNPQYAMLLSFAALLL

SEQ ID NO: 1869 - DNA, 1559 bp, Zea mays
  misc_feature (1)..(1559): Ceres CLONE ID no. 306139
  misc_feature (1)..(1559): GEMINI ID 555G3
attctccggcgccgtcaaccccgcgacgcgcaaaggtgagcttcgacccgaagccgaaccgatcgagaggcccagccgccgcaaccggaggagagagagaggcggatacacaaacacgaaaccctagcaagcaagccctccacgcacagtcaagaagggagggggaggcgatggagtacccggcgacggccgccggatcggggagccacaagtactactacccgcagcagcactcgcactcacagccgcaggcgcttcgccgcccgccgcgccccgccgctcggtgggtcaagcaatggatcccgcaggatctcgcgtcctccggcggcaaatgctcgctcttcaagtgggtcagagaggatgggtacagaaactccaaggacaaccccagagtgttagatgtagaagcccccaagcctgaacccaccacggagatcctcttcctctgcagctacgagaactgcggcaagacctttgttgatgtcagcgcgctccgcaagcatgctagcgtgcacaacgagaagcagtatatatgcaacgagcccaactgtgggaagaaatttgttgatagctccaagttgaagaggcattatcttacccacacaggacaaaaggattttgtctgtccacatccaggctgtggtaaggccttctcattggattttaacctacggtcacacttaaaaacacatgcattggagaattatcacatatgccctttcccagcatgtggcaaaagatttacaagtgacttcaaactaggagcacatgtcaagtcacatgaaaagactggaactcctattgcagtgcagcatgcgccagcgccaccagcagaaaaaccgcgtgtcgccccaaagcctccgactccagcaaccacaagctatgctgatcggccatatgtctgcccctatgaaggttgtgacaaagcatacattcacagttacaaattgaaccttcatctaaaaactcagcaccctgaacacggtcaagaggaaaacggtaaggtcggtgcttctggtgggcagcatgctgcgaacgaacacacttaccagtataactatgccgaggttggcgagattgcaccaaaccccaaaaaggagcaagacgaatcatgggcacaaggtccactcatccaaagcctacaatgccaaggtttcgagagcaatgccttctgacattggcgtcaggaaccagtggccaggtaaagctacgtaccaagatgatagtgaagagacggaagaagatggaggcaacaacattgaagatggctggagatatggcaacaatgatgacgatgaggaaacaccagatgaagattgacctttatttaggtttggatatgtagatatatgagggtgatctgttgtcctttagtttcaatgcagtcatggggaagttcaagctttaaccttaggtagtagttcattcagatggtgcatggatatattgtactcagttacctgctcctaaatgctttcactcccctatcttccagagccacatgtattttagatagtttggatatgtttgccttggaataaattttcatttgaaatgtc

SEQ ID NO: 1870 - protein, 334 aa, Zea mays
  misc_feature (1)..(334): Ceres CLONE ID no. 306139
  misc_feature (1)..(334): GEMINI ID 555G3
  misc_feature (150)..(174): Pfam Name: zf-C2H2 Pfam Description: Zinc finger, C2H2 type
MEYPATAAGSGSHKYYYPQQHSHSQPQALRRPPRPAARWVKQWIPQDLASSGGKCSLFKWVREDGYRNSKDNPRVLDVEAPKPEPTTEILFLCSYENCGKTFVDVSALRKHASVHNEKQYICNEPNCGKKFVDSSKLKRHYLTHTGQKDFVCPHPGCGKAFSLDFNLRSHLKTHALENYHICPFPACGKRFTSDFKLGAHVKSHEKTGTPIAVQHAPAPPAEKPRVAPKPPTPATTSYADRPYVCPYEGCDKAYIHSYKLNLHLKTQHPEHGQEENGKVGASGGQHAANEHTYQYNYAEVGEIAPNPKKEQDESWAQGPLIQSLQCQGFESNAF

SEQ ID NO: 1871 - DNA, 1062 bp, Arabidopsis thaliana
  misc_feature (1)..(1062): Ceres CLONE ID no. 35890
  misc_feature (1)..(1062): GEMINI ID 535A8
aaggaataaacttcgtgaagagaaatgactctagaagctttatcatcaaacggtcttttaaactttttgctctctgaaactctttcaccaactccattcaagtctctcgtcgatctcgagccattgccggaaaatgatgtcatcatatcgaagaacacaatttcggagatatctcatcaagaaccgccaccacagcgacaaccaccagctacgaatcaagggaagaagcggcggaggaggaagcctagggtttgcaaaaacgaggaagaagctgagaatcaacgaatgactcacattgccgtcgaaagaaatcgaagaagacaaatgaatcaacatctctctgtcttgcgatctctcatgcctcaaccttttgctcacaagggtgatcaagcttcaatagttggtggagccatagatttcatcaaagaacttgaacacaaattactatctcttgaagctcaaaaacatcataatgctaaattaaaccagtcggttacttcttcaacaagtcaagacacaaatggtgaacaagagaatcctcatcaaccatcttcactatctctatcgcagttctttcttcattcatacgatccgagccaagagaataggaacggctcaacaagctcggtgaaaacccctatggaagatcttgaggtgactctaatcgaaactcatgctaacatcagaatcttgtcgagaagaagaggtttccggtggagcacgttggccaccaccaaaccgccgcagctttcgaagctggtggcttctctacaatcgctgtccctctccattcttcaccttagtgtcacaacattggacaattatgctatttactccatcagcgctaaggtggaagagagttgccagctaagttcagtagatgacattgcaggagcagttcaccacatgctaagtatcattgaagaggagcctttttgttgctcatcaatgtcagaattaccatttgacttctctttgaatcactcaaatgtcactcattctctctgagaaatctcttttttgttattgttgttccttcttttaattttatcacatagcacc

SEQ ID NO: 1872 - protein, 327 aa, Arabidopsis thaliana
  misc_feature (1)..(327): Ceres CLONE ID no. 35890
  misc_feature (1)..(327): GEMINI ID 535A8
  misc_feature (86)..(137): Pfam Name: HLH Pfam Description: Helix-loop-helix DNA-binding domain
MTLEALSSNGLLNFLLSETLSPTPFKSLVDLEPLPENDVIISKNTISEISHQEPPPQRQPPATNQGKKRRRRKPRVCKNEEEAENQRMTHIAVERNRRRQMNQHLSVLRSLMPQPFAHKGDQASIVGGAIDFIKELEHKLLSLEAQKHHNAKLNQSVTSSTSQDTNGEQENPHQPSSLSLSQFFLHSYDPSQENRNGSTSSVKTPMEDLEVTLIETHANIRILSRRRGFRWSTLATTKPPQLSKLVASLQSLSLSILHLSVTTLDNYAIYSISAKVEESCQLSSVDDIAGAVHHMLSIIEEEPFCCSSMSELPFDFSLNHSNVTHSL

SEQ ID NO: 1873 - DNA, 746 bp, Glycine max
  misc_feature (1)..(746): Ceres CLONE ID no. 474636
  misc_feature (1)..(746): GEMINI ID 540E6
aaatccttttctgtttgctccatccaaatacagaaatatcattttccgagacaatcccatcttccatttccatcttcaatatttcttctcatcgagaagcttcgcgaacgaaaacaaagaaccctagacagatccattccatagccatgtcaggtgttggccctctatctcaggattgggaacccgtcgtcctccgcaagaaggctcccaccgccgccgccaagaaggacgagaaagccgtcaacgccgcccggcgctccggcgcggaaattgaaaccctaaaaaagtataatgctgggacaaataaagcagcatctagcagcacttcattgaacactaagaggctggatgatgatactgagaatctagctcatgagaaggtaccaactgaacttaagaaggctataatgcaagctaggatggacaagaaactcactcaggctcagcttgctcaactgatcaatgagaagcctcaagtgatccaggagtacgagtcagggaaggccattccaaaccagcagataattgggaagttggaaagggctcttggagcaaaattgcgtggcaagaaataaattaaactaatgctatggttttgcatgtagcttggtttacatatcactaactcactatgggagtgttatgtgtttgctcgctaattgtgtaatatgtaagacaattaaatggttgtgaggacctgtggctttcacctgtcacctgttcgactaaataaagttgcaattagt

SEQ ID NO: 1874 - protein, 142 aa, Glycine max
  misc_feature (1)..(142): Ceres CLONE ID no. 474636
  misc_feature (1)..(142): GEMINI ID 540E6
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
MSGVGPLSQDWEPVVLRKKAPTAAAKKDEKAVNAARRSGAEIETLKKYNAGTNKAASSSTSLNTKRLDDDTENLAHEKVPTELKKAIMQARMDKKLTQAQLAQLINEKPQVIQEYESGKAIPNQQIIGKLERALGAKLRGKK

SEQ ID NO: 1875 - DNA, 1436 bp, Glycine max
  misc_feature (1)..(1436): Ceres CLONE ID no. 520515
  misc_feature (1)..(1436): GEMINI ID 552A4
ttacacactcacttgtcctgtgtcctctagtatctctcatagtctgcacaacactttcctttacttcattccatcatcaaccaatcattgatcacacacaacacaacccccaatccacttaaccttaaccttaaccttaaaaaaatggcggcggggtgcatcagcttcactgccacgcgcgaccgctgctttcgcttctccttctccaacgcgggcctcaaatccgtgacgacggacctcggcgatggcaccatcatgcactgctgggcccccaaggcccacaaggactccaagctcaacctcctcctcatccacggcttcggggccaacgcaatgtggcagtggaacgacttcctctcgcccctcacgcgccgcttcaacgtctacgtcccggacctcctcttcttcggagactcccacacgacccgccccgaccgctctgaagccttccaggcccagtgcgtcgcggccctcctccaggcccacggactccagagaaccagcgttgtgggtataagctacggcggcttcgtggcgtacagtctcgcggcgcagttcccggagcgcgtggagaaggtggtgctatgctgcgccggggtgtgcttggaagataaagacttggacgaagggatgttccaggtgaagactgtggatgaggctgcggatattttgctgccgcagacgccggaaaagttgaggcagctcgtgcagctcgcgtttgccaagcctgtcaaaaccatgcccacttgctttctcaatgattacattaacgtgatgtgtactgataaccgccaagagaggaaagaactaatcgaaacattacataaggatagaaaattatctaatcttcctaagataacccagcctacgttaataatctggggagaaaaggacctggtcttccctatggaattagctcataggctacaaagacatttgggagagaacgctcaactagtggtcattaagaatgcagggcatgctctcaatgtagagaagcccaaggagatgtacaagaatttaaaatccttcctcattgatcccgctactccaactccaactgcgcaaaaaaaccacagtaacggtagctaagtggattagcagagaaatggaagagatttatttttcggcattgtttgtgaatatgcttgtgtatctgtttgtttatacgctgctatcagccacgcggtagttttcggcacggataggacgagaagggatagtcgtgaaactggttctttatagagtaaaagaagagcgtatctgctgccaatttaaagtatgcggatgagcatctgaaaataaattttacagatcatccactgtaaactcatatatcaggaaacttggctacggatagaatctgattcagaggaatttgttgctaaggatacaggaattgcatatgaaatatcatgagctggtgtgggtatttc

SEQ ID NO: 1876 - protein, 315 aa, Glycine max
  misc_feature (1)..(315): Ceres CLONE ID no. 520515
  misc_feature (1)..(315): GEMINI ID 552A4
  misc_feature (78)..(295): Pfam Name: Abhydrolase_1 Pfam Description: alpha/beta hydrolase fold
MAAGCISFTATRDRCFRFSFSNAGLKSVTTDLGDGTIMHCWAPKAHKDSKLNLLLIHGFGANAMWQWNDFLSPLTRRFNVYVPDLLFFGDSHTTRPDRSEAFQAQCVAALLQAHGLQRTSVVGISYGGFVAYSLAAQFPERVEKVVLCCAGVCLEDKDLDEGMFQVKTVDEAADILLPQTPEKLRQLVQLAFAKPVKTMPTCFLNDYINVMCTDNRQERKELIETLHKDRKLSNLPKITQPTLIIWGEKDLVFPMELAHRLQRHLGENAQLVVIKNAGHALNVEKPKEMYKNLKSFLIDPATPTPTAQKNHSNGS

SEQ ID NO: 1877 - DNA, 1470 bp, Glycine max
  misc_feature (1)..(1470): Ceres CLONE ID no. 558431
  misc_feature (1)..(1470): GEMINI ID 540C4
ttttatatatggggtccaacaaattgaatatggtctaatgcatttactgatctgtctaaagtctgagtttcattgatttttttatgcaggttattccagagagaatgccagattgttcttacttcttgcaaggcttatgctcaaatagaaattgtccatatagacatgtcaatgtgaaccccaaggcatctatttgtgaaggatttctcaagggttattgtgctgatgggaatgaggtattaaccaatcttgtttaatttactatcaagttactggatagtttgaatacttaaactttttccctttttttaccataatttaagtaaatcaatttgtgtgcatgagtgttcatcacattttcataatccaagaaaggggtgtacaatcagatgtttcatcgtacttgtggtgattgaaaattctgatgtaccgtaatatttcactgtatcttttatttgtcaaattataatcccatgtctgttattttcactaaaagtttcttcctctttggaaaacattttgctttgtttataactcctcatctacttgctttcgttgtctgtttccttgtgatctaaccctaaaaaagacttgacataccccagtgctcaaaggctcctcactgaaatttagaaggggagtgtaattgtatgcagccttatcccttgcataagcaagtaggctgtttttcagatttgaacccatgaccaaccggtcaccaaggaacaactttactgctgtgccagggctctcccccacattcttccttatgatctaaccctaatgcttgccaacttatgttgtttcagtgtcggaagaagcacagctatgtctgtcctacttttgaagaaacaggaacctgtactcaaggaaccaaatgtaaacttcatcaccccaaaaaacaaagcaagggaaagaaaaggaagagaactgcatatcaaaacaacagtagagggcgttattttggttctattcctgctaatgtttctgaatctgggatgatgttggctccaaagcgacatagacagagtggtgaacttgaagaggaactttctgactacatcagcctagatgatgtgaatgaagaagttttagacacggtcgatcaatcatttgagccagcaactttctgtgacaatgactccttggatttacagttggacgattttgatgaacttattaaaccagttcttctgttgaaaacaaagttcacaatgcaatcacctcagtttagtagcctccaagcttttaggcaagtggcggagagttaggtgtttgtaaatgaggtaatttaggtagtgcgaaacccttccccccacccccaatcctttttttttactcgtttattttgaatgcatagcttaaatgtaaacaggtcatcctccccctccccttcatttttttttttttttgtggatttacaattgtacattgacatctggaataataattaagaaaaaagtttcttct

SEQ ID NO: 1878 - protein, 157 aa, Glycine max
  misc_feature (1)..(157): Ceres CLONE ID no. 558431
  misc_feature (1)..(157): GEMINI ID 540C4
  misc_feature (13)..(34): Pfam Name: zf-CCCH Pfam Description: Zinc finger C-x8-C-x5-C-x3-H type (and similar)
MLFQCRKKHSYVCPTFEETGTCTQGTKCKLHHPKKQSKGKKRKRTAYQNNSRGRYFGSIPANVSESGMMLAPKRHRQSGELEEELSDYISLDDVNEEVLDTVDQSFEPATFCDNDSLDLQLDDFDELIKPVLLLKTKFTMQSPQFSSLQAFRQVAES

SEQ ID NO: 1879 - DNA, 949 bp, Glycine max
  misc_feature (1)..(949): Ceres CLONE ID no. 560898
  misc_feature (1)..(949): GEMINI ID 552H7
atactttccactttcactttcaaacatcacaaacactttttaacgttgtttgattttggtgcaatctttacttcacaacttcctcgtacttctgagaatcatcatcaaaaaccccaaactcatgatcatgatgatgatgaataggttccttccactctttgtgttcgcattgttattcatgtggtcggttcacgcagacaatgctcctgccccttcacccaagtcatcaccctcgtcgccgacggccaaaccaccctctccggcgacccatccggcgcctcctgcaaagtctccgactttatcaccgccttcacaatctccggcagtttctccatctgggtccaccccgccgccggcgactgcccctccggcgaagtctccggccactcagctaccatcttcggttcctccagcttccagcccttccaacaatgtctcttcgccaccggctccatccccagcgactcctccgccgacggttgctccggtgaagttctccggtcggtactccgccggtggcagaggcgcctacgccagattctcctgccggaattccttcatcggccgtgccggcaggttcaccaatcacactaccatccagcagtgcctcgccgggaactgcgccggcgagttcgccggaaagttcacggggttcggttggtgatgaatcgggttcaagttccaaatgcagggctccgatgattttgggtggcgtggcactttgggtcgctttggctatgatctgaggcatcataggattatttttgagtatatttttttaatatttgccacattgatcgacgaataattgattgttattgatcaattttgtagttgggttggttcaattctattcattattttgtaattgattttctttaatgttagaagttagaacaaatttcattttgttaactgtttgtttcaatttgagaagggttttgcttcc

SEQ ID NO: 1880 - protein, 180 aa, Glycine max
  misc_feature (1)..(180): Ceres CLONE ID no. 560898
  misc_feature (1)..(180): GEMINI ID 552H7
MIMMMMNRFLPLFVFALLFMWSVHADNAPAPSPKSSPSSPTAKPPSPATHPAPPAKSPTLSPPSQSPAVSPSGSTPPPATAPPAKSPATQLPSSVPPASSPSNNVSSPPAPSPATPPPTVAPVKFSGRYSAGGRGAYARFSCRNSFIGRAGRFTNHTTIQQCLAGNCAGEFAGKFTGFGW

SEQ ID NO: 1881 - DNA, 777 bp, Glycine max
  misc_feature (1)..(777): Ceres CLONE ID no. 605218
  misc_feature (1)..(777): GEMINI ID 531G11
  misc_feature: Encodes the peptide sequence at SEQ ID NO. 1639
aacacacacattggtgtttccaccaaatacagtgagcaaagttagctgaaaattaaaacatggtttccgccaccgtggattccgattttgcattcttggaatctgttcaacaatacctacttggacatgattccatcaatctcatgtctgaaacccaccaagctgcatctcatgatccattttcagaccctaataaatgtgatggtgattcagggaacattgctttccgaagtgaggatgcaacggctgtggtagcgcgtgatcatgcgccaccaacatggaagcattacagaggggtgaggcgtagaccgtggggaaagtttgcggccgagattagggatccaaagaagaacggagctagggtttggcttggcacgtatgataccgaagagaaggccgctttggcatatgacaaagccgctttcaaaatgcgaggccaaaaggccaagctgaattttcctcatcttattgattccgacaattccgatgaattgtcggagccagtaatgatgacaacttccaagcgaagtttgttagaaatttcatcaccgtcgtcctcgtgttcagatgatagctcagaatcacaagggacaaagaggaggaagagcctggctgaactactgaataaattagccaagaatagaagccaagtcaaggtggaatgttgaagtggctagaggaatatgcatgttgtacaatttgatcaatcattaatatgagacttcaacgattgtaatgtaatctggtgttcatagaattaatgcaattttgttcacc

SEQ ID NO: 1882 - protein, 202 aa, Glycine max; identical to SEQ ID NO: 1639
  misc_feature (1)..(202): Ceres CLONE ID no. 605218
  misc_feature (1)..(202): GEMINI ID 531G11
  misc_feature (75)..(127): Pfam Name: AP2 Pfam Description: AP2 domain

SEQ ID NO: 1883 - DNA, 1484 bp, Arabidopsis thaliana
  misc_feature (1)..(1484): Ceres CLONE ID no. 6163
  misc_feature (1)..(1484): GEMINI ID 553B10
ataccacattagaaacttcccactctcgctctcgtttgcttcttcttcatcgtttcacccactcacttcattctctctctaaaaccttcactttctctatctatcttcaaaacaatgggaaacctgtttgacagtagcaagactttatggggaaacatgaaccatggatcgtcacgttactctctaaacggcaaaatcatgcttgcttccgtcatcatcctcttcgtcgccgtcattttaatcctctgtttccacagctacgctagatggttattccgccgtcaaaaccgccgtattcgccgccgtatcagtgctcacctccgatcactcgccgccgctagagaccccacccaatcatcatcctccctctctcctcttgatccgacggtgctcgagaagatccctatcttcgtctactccgttaaaacccatgaatctccgcttgaggaatgctctgtttgcttgtcggaattcgaagaagacgacgaaggacgtgtccttcccaaatgcggccacgtgttccatgtcgattgtatagacacgtggttccggtccagatcaagttgtcctctttgtagagctccggttcaacccgcacagccggttaccgaacccgaaccggttgctgctgtgtttccatcggttaaaccaattgaggataccgaagccggaagttcctcttcatcggacgaatccgaatcctcgacgccgtcttcctcctctggttcgccggtgaggtttccgatggaagcttgtgagagagaaccgattgatttagtcggtatcattgtggagattcccagggaatttcaagattctaattcggatctacccgcagataacgggtcgaatcgtcgggcttcgttgaaaaggctatggattatttgatcacataattggatagtgactgaatccgacccggtaaatgggtgggcataataattcggattctgaagatccggtaatatgacgcagcgggcagaatcgtattactggcatggaagacgacacgtggcgtttttggggatccacatggcaatcactgggacgtttgctttacaaaaagacaccgtttgggaaaaatgaacggaagtgatatctaaagtaacggagccgtttgatgacaatgtttatataccagacggcgtcgttcagtggagagtggagcaaatcgctaagcgaagctctcccaccaaaacgattttctttgttttttttccttcttcttctcttaaaatttaattaaaataagtgaatgtaatttgatcaagattttatcttacttctgtaattaaaattaaaatattattcattattattaatttaaccgaatgttagccttaaatgctagtgtatcgatttgtaaagtttaatccatctactagttttggtcaaatgttgtttcaaattgtaaaactctcagggcatgcatgtatattgtataatcgtattatgagaaaatggatacacaatgcaaatccttt

SEQ ID NO: 1884 - protein, 257 aa, Arabidopsis thaliana
  misc_feature (1)..(257): Ceres CLONE ID no. 6163
  misc_feature (1)..(257): GEMINI ID 553B10
  misc_feature (113)..(154): Pfam Name: zf-C3HC4 Pfam Description: Zinc finger, C3HC4 type (RING finger)
MGNLFDSSKTLWGNMNHGSSRYSLNGKIMLASVIILFVAVILILCFHSYARWLFRRQNRRIRRRISAHLRSLAAARDPTQSSSSLSPLDPTVLEKIPIFVYSVKTHESPLEECSVCLSEFEEDDEGRVLPKCGHVFHVDCIDTWFRSRSSCPLCRAPVQPAQPVTEPEPVAAVFPSVKPIEDTEAGSSSSSDESESSTPSSSSGSPVRFPMEACEREPIDLVGIIVEIPREFQDSNSDLPADNGSNRRASLKRLWII

SEQ ID NO: 1885 - DNA, 1074 bp, Glycine max
  misc_feature (1)..(1074): Ceres CLONE ID no. 625035
  misc_feature (1)..(1074): GEMINI ID 531H11
tccaatattcaattcaacaccttccctcattctcttcaaatgtacggacaaagttgctacgagtccgatttggcccttttggactccattcgccgccacttactcggcgactccgaggaacacagattcggagccccgaatgttaattcgggtagcactccattgtactctcggagctccagtttcggcaggttgtacccttgcctgagtaacgattggggcgaacttcctcttatggaagacgattcagaagacatgcttctttatggtgttcttcgcgacgccgtgaacgtaggctgggtcccatctctcgacgcttcctcaccggagagtttctcgtcggctttcatgccgccggtgaccgtgaaatccgaaacggatctatttccggcaccggaaccgatttgtaaccctccggtggttcagggcccggcgccggcggtagttccggcgaaagggaagcactaccggggcgtgcggcagcgaccgtggggaaaattcgcagcggagatccgcgacccggctaaaaatggggctcgggtttggcttgggacttttgagacggctgaggacgccgcgctggcttacggatcgagccgcgtatcgaatgcgcggctcgcgggctttgttgaattttccgctccggattaattcgggcgagcccgaaccggttcgagttacggcgaagcgggcttcagcagaaccgtgttcttcgtcggagagtggatcttgggtgaagaagcggaagaaggtggtgggttgagaacggggcacgtcgagagcagttgttggtgaagtaatttgtgatgctaaaaaggggtggaataaatgggttggcatgctcactcattgctcaagtgggactgtgggactgatcaaatctaaagctaaaaaagaaaacaaaccacatttggaaaaactgattagggtcgaggttctgtttggctttgtgaatacagttacaagatttcttattttttggttcaattctataataatatctgtaacatagttgggtagggcacccacccttgtgctaaactaagtgatttcaataaaatatattttgccttt

SEQ ID NO: 1886 - protein, 203 aa, Glycine max
  misc_feature (1)..(203): Ceres CLONE ID no. 625035
  misc_feature (1)..(203): GEMINI ID 531H11
  misc_feature (141)..(183): Pfam Name: AP2 Pfam Description: AP2 domain
MYGQSCYESDLALLDSIRRHLLGDSEEHRFGAPNVNSGSTPLYSRSSSFGRLYPCLSNDWGELPLMEDDSEDMLLYGVLRDAVNVGWVPSLDASSPESFSSAFMPPVTVKSETDLFPAPEPICNPPVVQGPAPAVVPAKGKHYRGVRQRPWGKFAAEIRDPAKNGARVWLGTFETAEDAALAYGSSRVSNARLAGFVEFSAPD

SEQ ID NO: 1887 - DNA, 1210 bp, Arabidopsis thaliana
  misc_feature (1)..(1210): Ceres CLONE ID no. 6827
  misc_feature (1)..(1210): GEMINI ID 539D2
agaaggcgttgaatcctttcgttttccgattccatttttgggatctcttgtttcgttttcttctctttggatccattccattcccatgttccccaatttctttaatcggtgttgcttccacaaggcttcatgagcttgtataacaagtttctctaggaggtgttaaagagccagatcaagctttcagaagagattttcttagggtggttgagagctgaaagttttgatatttagtcaactttgttccactgaaccttctaggaagctacctcaagtagacagctttgttgacgggcttcaagccagtggtaaagatatgcttctgtagaagggttaatcttgagcattaaaggacatggctttctactctgaagacgacaagagcgaagactacctctttaagattgttctaatcggtgattctgctgtcgggaaatcaaatttacttgccagatttgcgagggatgagttctatcccaattcaaagtcgacgattggagtggagtttcagacacagaagatggatataaacgggaaggagatcaaagcacagatatgggacacagcaggtcaagaacgttttagagcagtcacttctgcatattaccgaggtgcagttggagctcttctggtttacgatatcagcagacggcagacttttcacagcattggtagatggctcaacgagctacacacacactctgatatgaatgttgtgacgatcctggtgggcaacaagtcggatctgaaggacttgagagaagtgtcaacagcggaagggaaggcattggctgaagcacaaggtcttttcttcatggagacatcggctttggactcatcaaacgtggcagctgcatttgagacggttgtgaaggagatatacaacatactgagcaggaaagtgatgagctcacaggagctaaacaagcaagaccctgcttcactgagcaatggcaagaaagttgtgataccatcagacgggcagggcgagtccaagaaaggtggatgttgttcttcttgatagaaaactgaaattgtagagagcttaaaaaggaagactattgatcatctgtttgattgtttatgttgtccacgttgccatgaatgttgaaatttgagatgggcttgtgttgtggtgtggaagtgtttaggtgtagtagcaatctgtaaattttctattgcagaagcttttatgagactcacactaccc

SEQ ID NO: 1888 - protein, 221 aa, Arabidopsis thaliana
  misc_feature (1)..(221): Ceres CLONE ID no. 6827
  misc_feature (1)..(221): GEMINI ID 539D2
  misc_feature (16)..(177): Pfam Name: Ras Pfam Description: Ras family
MAFYSEDDKSEDYLFKIVLIGDSAVGKSNLLARFARDEFYPNSKSTIGVEFQTQKMDINGKEIKAQIWDTAGQERFRAVTSAYYRGAVGALLVYDISRRQTFHSIGRWLNELHTHSDMNVVTILVGNKSDLKDLREVSTAEGKALAEAQGLFFMETSALDSSNVAAAFETVVKEIYNILSRKVMSSQELNKQDPASLSNGKKVVIPSDGQGESKKGGCCSS

SEQ ID NO: 1889 - DNA, 812 bp, Brassica napus
  misc_feature (1)..(812): Ceres CLONE ID no. 969682
  misc_feature (1)..(812): GEMINI ID 552C2
  misc_feature: Encodes the peptide sequence at SEQ ID NO. 1890
atcccacgataccaccacccacccagacccagatcgataagcaagcaacctcccaaaactaaaatttacatcttttcccgattcagatcaaaccgcgcatcgccgttgcctccgccacttgctaaatccagtcagaagagagatgggagcattcgcatcgaggttttggttcatgatgttccctgcgaaagagtacaagatcgttgtcgttggtttggataacgccggtaaaacgacgacgctttataagcttcacttgggtgaagttgtcaccactcatcctaccgttggaagcaatgtcgaagagctcgtttacaagaacatccgcttcgaggtttgggatcttggtgggcaagataggctcagaacatcatgggcaacttactacagaggaacgaacgctgtaattgtggttatcgatagcacagacagagccagaatctctttaatgaaagatgagctatccagattactcgggcatgaggatcttcacaactcggtcatactcgtctttgcaaacaaacaggacctcaaggatgctatgagcccagctgagatcacggacgcgcttaaccttcmcagcatcaagaaccatgattggcacattcaagcaagctgtgcagtcactggagaaggcttgcatgatgggcttggttggattgcccagaaagttactgagaaacctccaagttaagagcaagtgtcataaactgaatcacataacgttgaaccttcacatgttctyttcatggttaattgttttttctttttawacagtgtattaattccactyttcatgtgatgagtttcat

SEQ ID NO: 1890 - protein, 183 aa, Brassica napus
  misc_feature (1)..(183): Ceres CLONE ID no. 969682
  misc_feature (5)..(177): Pfam Name: Arf Pfam Description: ADP-ribosylation factor family
  misc_feature (1)..(183): GEMINI ID 552C2
  misc_feature (146)..(146): Xaa is any aa, unknown, or other
MGAFASRFWFMMFPAKEYKIVVVGLDNAGKTTTLYKLHLGEVVTTHPTVGSNVEELVYKNIRFEVWDLGGQDRLRTSWATYYRGTNAVIVVIDSTDRARISLMKDELSRLLGHEDLHNSVILVFANKQDLKDAMSPAEITDALNLXSIKNHDWHIQASCAVTGEGLHDGLGWIAQKVTEKPPS

SEQ ID NO: 1891 - DNA, 2220 bp, Populus balsamifera subsp. trichocarpa
  misc_feature (1)..(2220): Ceres GEMINI ID 5217H1
  misc_feature: Encodes the peptide sequence at SEQ ID NO. 1892
atgaggaagccggatctaatggccagagatagagtgccaatcaataataatatgaacagggccaaacttagaaagggcttatggtcaccagaggaagatgagaagctcatccagtatatgttaactaatggacaagggtgttggagtgaaattgctaggaatgctggcttgcaaaggtgtggcaagagttgccgactgcgatggattaactatttgagacctgacctcaagcgtggcgcattttctcctcaagaagaagagcttatcattcatttacactccattcttggcaacaggtattttttttttctccggtcaaccgaataatgctatatacttaatgctaatgaagtacaaagcttagcctgatcaatttaattatgttaatatataatctatgtcatctttcccagctgcctggcatcattaagtactggcgctgttccattttgtacttacataaagatactcttggatcgatcatggataagaaaacaaagaataattgaagctagcaattacttaaataatttacttaatttatacctagttaaattgtaaattcacaagatggagtagtataccagctgtaacaaacgtgtagacgaggtggaataatgttaattaatcattggtttcatgatgcacctgcataaaaacctcccccagacatatgtggaaattaattaagtgaatataatgtatagtaacattgaacatttttgccttctctttatattattttcacctagcagaggctttaaggaattgtctatatgttaaactacgtattgatctctttatatatttactggaatcggacgccactgctcctagctccagtgggtaaatttgatgcctcctcttccctcacattgtgctcgggctggcctaacagccttgtgacgatatatatatagttcagggctttaggctacacatggcttttcttacatttggttgatttatacggatgaaatagttgaacaaaaccattaacaaattacgatatcctcttatttggaatttccagcttcatttaatttgatcacccataaatcataatgtctacccaattatggctgattatttctcacagcacttatatatttcgtgttcgggatttttgctgggggcggaggggggttggggattttggcttatgtctaagtcaatgcaaactggtcccatggctataaacatttttaccaacggaaaaattcaaatgaactgttccgaaaaaaccctccccgcacaccaaaaataaaaagaaacccattgatcacaatttgcttccttttttagggctttcctttctgcctggtagaattagttcagaaacaacagggaaaaaaggaagaaaatattctgacaagtaggaattagaaataagcgtgtgttctacattccacttttcacccctatatatcaacatgcatgcgttctatgcaagaagcttacttatgtatatagtttgtaattatataagtggattatgtgttcgttataatcatgtattttgaacaatgcaggtggtctcaaattgcggcgcgtcttccagggaggacagacaacgaaataaagaatttttggaattctacattaaagaaaagattcaagatcaacagcacttccacatcctcaccaaacgatagttctgattcatcagaacctagagatcatgtcgtaggaaatatcatgcccatgcatgatcatgacgttatgactctgtgcaaagactcatcttcctcaccatccatatccatgcatggtgtggtcacaggcaaccaatttgatcctttcaccgtgctcagtaaccgctatgatgtgagtggtgcagcaagtttatttgacatgtccacatgcttaacacaggtgggtatgggagatggattttatggtgatcattatgggattttggagggtaataataaaatagggctagaaagtgatctttctcttccgccactcgagagtagaagcattgaagagaataatgcagtgagtaataacagaattggcgtgaaaagcagcagcaacgacaaccaccactttgatagtacctgcttcaataatactgatcagagatttaaagtagaggacatgttggggcttgaaaatcattggcaaggagaaaacgtgagaatgggagaatgggatctggaaggtttaatggaaaacatatcttcctttcctttccttgatttccaagttttataa

SEQ ID NO: 1892 - protein, 327 aa, Populus balsamifera subsp. trichocarpa
  misc_feature (1)..(327): Ceres GEMINI ID 5217H1
  misc_feature (78)..(123): Pfam Name: Myb_DNA-binding Pfam Description: Myb-like DNA-binding domain
MRKPDLMARDRVPINNNMNRAKLRKGLWSPEEDEKLIQYMLTNGQGCWSEIARNAGLQRCGKSCRLRWINYLRPDLKRGAFSPQEEELIIHLHSILGNRWSQIAARLPGRTDNEIKNFWNSTLKKRFKINSTSTSSPNDSSDSSEPRDHVVGNIMPMHDHDVMTLCKDSSSSPSISMHGVVTGNQFDPFTVLSNRYDVSGAASLFDMSTCLTQVGMGDGFYGDHYGILEGNNKIGLESDLSLPPLESRSIEENNAVSNNRIGVKSSSNDNHHFDSTCFNNTDQRFKVEDMLGLENHWQGENVRMGEWDLEGLMENISSFPFLDFQVL

SEQ ID NO: 1893 - protein, 333 aa, Populus balsamifera subsp. trichocarpa
  misc_feature (1)..(333): Ceres ANNOT ID no. 1461478
  misc_feature (1)..(333): Functional Homolog of  Ceres GEMINI ID 5217H1
  misc_feature (78)..(123): Pfam Name: Myb_DNA-binding Pfam Description: Myb-like DNA-binding domain
MRKPDLVGKDRVPSNSSINKAKLRKGLWSPEEDEKLIKYMLTNGQGCWSDIARNAGLQRCGKSCRLRWINYLRPDLKRGAFSPQEEELIIHLHTILGNRWSQIAARLPGRTDNEIKNFWNSTLKKRLKINNTSTSSPNDSDSSEPRDHAIGNIMPTHDPDTMTLCMDSSSSSSISMQGMITSNRFDSFSMLNNRYDVTGAASLFDMSTCLTQVGMGDGFYGDHYGILEANNKTGLESDLSLPPLESRSFEENNTVSNNRIGMKSSSNNNNNCFDNTCFDNTCFNNNTDQRFKVEDMLGLENHWQGENLRMGEWDFEGLMENITSFPLLDFHVE

SEQ ID NO: 1894 - protein, 321 aa, Eucalyptus gunnii
  misc_feature (1)..(321): Public GI no. 39725413
  misc_feature (1)..(321): Functional Homolog of  Ceres GEMINI ID 5217H1
  misc_feature (75)..(120): Pfam Name: Myb_DNA-binding Pfam Description: Myb-like DNA-binding domain
MGMAMGIKEKASSNPHNHKLRKGLWSPEEDEKLMRYMLTNGQGCWSDIARNAGLQRCGKSCRLRWINYLRPDLKRGAFSPQEEELIVHLHNILGNRWSQIAARLPGRTDNEIKNFWNSTLKKRLKMNSATSSSNESDLSNPQDIAAGIMPSFHAQYDVLATCMDSSPAPFPPMDNISAPNQFDPFPTLNNRCDTWEGVGFFTFPSGIAPVSMGDDSSYLNLEHAKVGLLGSEFSVPPLASSTTTTEENNYRSIGCGMDGKGENSFSNNNDSCFSNTTTASFKAEDDMSGFGNNLQAANLRIGEWDLEGLMDDLPSFPFLDF

SEQ ID NO: 1895 - protein, 343 aa, Malus x domestica
  misc_feature (1)..(343): Public GI no. 71041096
  misc_feature (1)..(343): Functional Homolog of  Ceres GEMINI ID 5217H1
  misc_feature (79)..(124): Pfam Name: Myb_DNA-binding Pfam Description: Myb-like DNA-binding domain
MRKPEPSSAAAGKNNKENNSNSKLRKGLWSPEEDDKLMRYMINNGQGCWSDVARNAGLQRCGKSCRLRWINYLRPDLKRGAFLPQEEELIIHLHSLLGNRWSQIAARLPGRTDNEIKNFWNSTIKKRLKNLSSSNGSPNTSDSSPEAKDHRVVAASRFIIPGQEHGMVPIYMDSTSSFMQSAVLSHMFDPFPALDIDQGGLTLPGAGGYYNANPCITQREIGVGGGDDCYNFGGNGGFGSGDVDIGVEGEIFVPPLESVSIEDQNIKTETTYGDSKNNNIYYNNINSILTCNKTNKNIKGESIIGVGNYFDDDQEELTMGDWDLEDLMKDVSSSSFPFLDYQS

SEQ ID NO: 1896 - DNA, 761 bp, Arabidopsis thaliana
  misc_feature: Ceres GEMINI ID 531H8
  misc_feature: Ceres CLONE ID no. 5398
agaagaagaagaagaaagatggggctacaaggtcagctaagtgacgtctcttccgattcaatccctcttatgctcctctctctcctcgccgtcttcatcaaccatctccgatctttcctcctccgtctcacctctaaatcaaatcctaatctccccgtagacgatgtctctatagcatcgggactagccaacataatcgttctcgccgatcagcttagtttgaatcggttattctcgtaccggtgcggtgacggaggtggtggcggctccgattgtgttgtgtgtttgtcgaagttaaaggaaggtgaagaggtgaggaagctggaatgtcgacacgtgttccacaagaagtgtttggaaggatggcttcatcaattcaatttcacttgtcctctttgtagatctgctttggtttccgatgattgcgtctctaaaacgcagcgtagcgttgggagggatttgatctcgtgtttctctctccactgagtaaaagatcggaagatgaagaagatccgatggtatctgagagatctacggtggctggctggttcggtttgaccacgcgcgtgcgccccttcttttctcggattttttttgaggtctctttcttctgtgagaggagaaccttttgtttgtttggtttttttttttacttttcgatttggaatatgtaaattttgaatatacaaattttcaccgtttgtatctttgttgttccttgctgttgagtatatataaatggagaagatatcaattccagt

SEQ ID NO: 1897 - protein, 155 aa, Arabidopsis thaliana
  misc_feature: Ceres GEMINI ID 531H8
  misc_feature: Ceres CLONE ID no. 5398
  misc_feature (86)..(127): Pfam Name: zf-C3HC4 Pfam Description: Zinc finger, C3HC4 type (RING finger)
MGLQGQLSDVSSDSIPLMLLSLLAVFINHLRSFLLRLTSKSNPNLPVDDVSIASGLANIIVLADQLSLNRLFSYRCGDGGGGGSDCVVCLSKLKEGEEVRKLECRHVFHKKCLEGWLHQFNFTCPLCRSALVSDDCVSKTQRSVGRDLISCFSLH

SEQ ID NO: 1898 - DNA, 952 bp, Gossypium hirsutum
  misc_feature (1)..(952): Ceres CLONE ID no. 1836567
acttataaatatatatacacgcacacatattacatattactactctttttctacaaattcacttccacattttctgaaacttaaaaaagaaagatgggattacaaagccagctgaacgacgtgtcctcagattcgatcccgcttcttctcgtagcaataatcgctaactgcgtcggttatctccgaagactcctctttgcttccctccatttgattggccttctcccttgcccagaccagcccactaccatcgacgatgttggagtccttggctccggtctcgccagtctcatcgtactcgccgagcagctcaacttaaacaaggctttctcctacaaatactgtggcggcggggtaggaaagggctctgattgtgttgtgtgcttgtgcagcctaagagatggggagcaggtgaggaaactcgattgctgccatgtatttcataaggattgctttgatggttggcttgatcaactaaaatttaactgcccggtttgtcgatcccctctcaaaatcgatcagcgcgtgggtttcacgcggagacgcgtcggtcaagatttgcttgcctggttttctttgggttaattagattccgaccaagattttagaattttagtgtttttgccccccttttctcaggttccggctggattgggtattattttgttttcaactatttgttttgagggggttgtcattcaactttctttcttaccactattttttcttttgctttttagaaccctttttctccgttgtagggttttttttttctttagaaattttttttgaagaattttctttttcactgctgtaaatagtcttttttttatttactttatgtattttttttagtccaataagaaaatagttatctttgtgtacaaattgtcaagaccagattgctatttatttacatgaagtagtgagggtgaagatgctttatgatttt

SEQ ID NO: 1899 - protein, 163 aa, Gossypium hirsutum
  misc_feature (1)..(163): Ceres CLONE ID no. 1836567
  misc_feature (1)..(163): Functional Homolog of  Ceres CLONE ID no. 5398
  misc_feature (94)..(135): Pfam Name: zf-C3HC4 Pfam Description: Zinc finger, C3HC4 type (RING finger)
MGLQSQLNDVSSDSIPLLLVAIIANCVGYLRRLLFASLHLIGLLPCPDQPTTIDDVGVLGSGLASLIVLAEQLNLNKAFSYKYCGGGVGKGSDCVVCLCSLRDGEQVRKLDCCHVFHKDCFDGWLDQLKFNCPVCRSPLKIDQRVGFTRRRVGQDLLAWFSLG

SEQ ID NO: 1900 - DNA, 507 bp, Populus balsamifera subsp. trichocarpa
  misc_feature (1)..(507): Ceres ANNOT ID no. 1458988
atggggttacaaaaccagctgaacgatgtgtcttctgaatcgatcccgttactccttatagcattcatagccaactgtgttgcctgccttcgctctttctttttcagcgttttccactccgtgggcgttcaccgattggaccaagcccacgttatggatgataggctgatgggctcaatgggctctggtcttgccggcctgatcgtgcttgccgagcagcgtaaactcaaccgggtatttgcttacaagtattgttgcggtcgtgatgatggaaatgacaagggaggatcggattgtgtggtgtgcttgtgcacgctaagggatggggaccaggtgaggaagctcgattgccgccacgtgtttcacaaggaatgttttgatggatggcttgatcatctcaattttaactgccctctttgtcggtggccgcttgtttccgatgagcgcgttgaagaaacgcgaaggcgcgtgggggagaacttagtggagtggttctccctgagatga

SEQ ID NO: 1901 - protein, 168 aa, Populus balsamifera subsp. trichocarpa
  misc_feature (1)..(168): Ceres ANNOT ID no. 1458988
  misc_feature (1)..(168): Functional Homolog of  Ceres CLONE ID no. 5398
  misc_feature (99)..(140): Pfam Name: zf-C3HC4 Pfam Description: Zinc finger, C3HC4 type (RING finger)
MGLQNQLNDVSSESIPLLLIAFIANCVACLRSFFFSVFHSVGVHRLDQAHVMDDRLMGSMGSGLAGLIVLAEQRKLNRVFAYKYCCGRDDGNDKGGSDCVVCLCTLRDGDQVRKLDCRHVFHKECFDGWLDHLNFNCPLCRWPLVSDERVEETRRRVGENLVEWFSLR

SEQ ID NO: 1902 - protein, 157 aa, Medicago truncatula
  misc_feature (1)..(157): Public GI no. 92899044
  misc_feature (1)..(157): Functional Homolog of  Ceres CLONE ID no. 5398
  misc_feature (68)..(111): Pfam Name: zf-C3HC4 Pfam Description: Zinc finger, C3HC4 type (RING finger)
MTILSELLYQLYVKTIVLFTYMLIELILVICYLKSTKNPITTTQYLNFIEEKNPTTRLKKLAAEHIDCRVCLSEFEEGDIVRSLNCEHTFHKDCLDKWFLQEQYCATCPLCRNKVLSDDVVSKYCLLQNQVEFDVIDDEFMTLLSSLRGGSIWYRYL

SEQ ID NO: 1903 - DNA, 1456 bp, Arabidopsis thaliana
  misc_feature (1)..(1456): Ceres GEMINI ID 553D4
  misc_feature (1)..(1456): Ceres CLONE ID no. 33016
aaagtttttcttcatttctctcttctctcttgtggtcaccgtttgatcggaatattccttttagaatgccaagattcattcttcatctctcgagctcctcatgaatttcttctctgcttatcaatggagatgatgagctcttcttcttctactactcaagttgtatcattcagagacatggggatgtatgaaccatttcaacagttatctggttgggagagtcctttcaaatcagatatcaacaatattactagtaatcagaataacaatcagagttcttcaacaacacttgagtttgatgctagaccagaagcagatgataacaatagagtgaattatacgtctgtgtataataactctcttgaagcagaaccgtcgagtaataatgatcaggacgaagaccggatcaatgataagatgaaacggcgtttggctcagaaccgagaagctgctcgcaaaagtcgtttgagaaagaaggcccatgttcaacagttagaagaaagccggttgaagttgtcacagctcgagcaggaacttgtaagagctaggcagcagggattatgcgtacgcaattcttcagatactagttatctaggaccagctgggaatatgaactcaggtattgctgcatttgagatggaatacacacactggctagaagagcaaaacaggagagttagtgagattcgaacagcgctccaagctcatataggtgacattgagctcaaaatgttggtagatagttgcttgaaccactacgcaaatctcttccgcatgaaagctgatgctgcaaaggctgatgtgttcttcttgatgtcgggaatgtggcgaacttcaactgaacgcttcttccaatggattggaggtttccgcccatccgagcttttaaatgttgtgatgccatacgttgagcccttaaccgatcagcaactgttggaggtgcgtaacctgcaacagtcgtctcagcaagcagaggaggctctctctcaaggcttagataaacttcagcagggtttggtcgaaagcatagcaattcagataaaagttgttgagtctgtgaatcacggggctccaatggcttcagccatggagaatcttcaagcattggagagttttgtgaaccaggcggatcatctgagacaacagactctgcagcaaatgagtaagatattgacgacaagacaggctgctcgagggttgctcgctctaggagaatacttccacaggctgcgtgctcttagttctctctgggcagctcgtccacgagaacacacttgacaagttaggaggcaaacaaaacaaagagaaagaagcacaaggcagatgatgttagctatagggacttgctttatctctcagaaagtgttggctgatattttctccattagagagcatcatcttcctcattgatgattttgtttacttgaaaggaataagagatgtgtaaatttgggtg

SEQ ID NO: 1904 - protein, 384 aa, Arabidopsis thaliana
  misc_feature (1)..(384): Ceres GEMINI ID 553D4
  misc_feature (1)..(384): Ceres CLONE ID no. 33016
  misc_feature (94)..(126): Pfam Name: bZIP_1 Pfam Description: bZIP transcription factor
MEMMSSSSSTTQVVSFRDMGMYEPFQQLSGWESPFKSDINNITSNQNNNQSSSTTLEFDARPEADDNNRVNYTSVYNNSLEAEPSSNNDQDEDRINDKMKRRLAQNREAARKSRLRKKAHVQQLEESRLKLSQLEQELVRARQQGLCVRNSSDTSYLGPAGNMNSGIAAFEMEYTHWLEEQNRRVSEIRTALQAHIGDIELKMLVDSCLNHYANLFRMKADAAKADVFFLMSGMWRTSTERFFQWIGGFRPSELLNVVMPYVEPLTDQQLLEVRNLQQSSQQAEEALSQGLDKLQQGLVESIAIQIKVVESVNHGAPMASAMENLQALESFVNQADHLRQQTLQQMSKILTTRQAARGLLALGEYFHRLRALSSLWAARPREHT

SEQ ID NO: 1905 - DNA, 932 bp, Arabidopsis thaliana
  misc_feature (1)..(932): Ceres GEMINI ID 534H5
  misc_feature (1)..(932): Ceres CLONE ID no. 9325
ataacttaatcacacacaaggagagaaagagagaaagagagacagagataatggcgtacagtgcgtgtttcctacaccagagcgcattggcttcatcagccgcacgatcatcatcttcctcctcatcccagcgtcacgtgtcgctctccaaacctgttcagatcatctgtaaagctcaacagtctcatgaagacgataactccgccgtctcccgccgtcttgctctcactctcctcgtcggcgccgctgctgttggttccaaagtatctcctgctgatgccgcctacggtgaagctgcaaacgtgtttgggaagccaaagacgaacacagacttcttgccatacaatggagatgggttcaaagtgcaggttccagcaaaatggaacccaagcaaagagattgagtatccaggacaagtccttaggttcgaagacaacttcgatgctactagcaatctcaatgtcatggtcactcctaccgacaagaagtccatcactgattacggttctcccggagagttcctctctcaggttaattacctcctagggaaacaagcttacttcggtgagactgcctctgagggaggctttgacaacaatgcagtggcaacagcaaacattctggagtcatcatctcaggaagttggtgggaaaccctactattacttgtctgtgttgacaagaacggctgatggagacgaaggtgggaagcatcagctgatcacagcaacggtgaatggagggaagctttacatctgcaaagcacaagctggagacaagaggtggttcaagggagccaggaaatttgtcgagagcgcagccacttctttcagtgttgcttgagtgaaagcaacacaacgtaacaatgctctgcttgctttcttcatttgtctcttgtaaaaaatggaaaatgaaactgagcttttgagaacc

SEQ ID NO: 1906 - protein, 263 aa, Arabidopsis thaliana
  misc_feature (1)..(263): Ceres GEMINI ID 534H5
  misc_feature (1)..(263): Ceres CLONE ID no. 9325
  misc_feature (61)..(263): Pfam Name: PsbP Pfam Description: PsbP
MAYSACFLHQSALASSAARSSSSSSSQRHVSLSKPVQIICKAQQSHEDDNSAVSRRLALTLLVGAAAVGSKVSPADAAYGEAANVFGKPKTNTDFLPYNGDGFKVQVPAKWNPSKEIEYPGQVLRFEDNFDATSNLNVMVTPTDKKSITDYGSPGEFLSQVNYLLGKQAYFGETASEGGFDNNAVATANILESSSQEVGGKPYYYLSVLTRTADGDEGGKHQLITATVNGGKLYICKAQAGDKRWFKGARKFVESAATSFSVA

SEQ ID NO: 1907 - DNA, 2113 bp, Populus balsamifera subsp. trichocarpa
  misc_feature (1)..(2113): Ceres ANNOT ID no. 1461478
atgaggaagccggatctagtgggcaaagatagagtaccgagcaatagtagtattaacaaggccaaacttagaaagggtttatggtcaccagaggaagatgagaaactcatcaagtatatgttaactaatggacaagggtgttggagtgatattgctaggaatgctggcttgcaaaggtgtggcaagagttgccgtcttcgttggattaactatttgagacctgacctcaagcgtggcgccttttctcctcaagaagaagagcttatcatccatttgcacaccattcttggcaacaggtacttctttttttctttattcttctcttttatatataacggtcaaccaaataatgttttatatatttatatatataacattttaattatgtcaacaatcccagttgctggcgctgtttcgttttgtaaatacatcaagatactcttggatcgatcgatcatgcatggataagaaaaaaagaaaaagaaaaaggaagctcgcaattacttaaacaaattggtaatcagacctagtttaattacttgtaaattcacaagatatagtagtaccagctgtaacaaatgtgtagcgtagacaagttgcaataatgttaattattcatcagtttcgtgacgagaaaagtataaaaacctcccagacatttgtagatattaagtggatataatgtatagaaacattgaatgccagtaataatcatgcacattttgccttctctttatattattttcacctagaggcttcgaggagtttgtcagtgtgtgtgtagtgtgtgtgtgtgtgtgtgtgtgtgtatgctaaactacgtattaacttctcttaatttactggagtatgccattgctgccagctccagtgggtcatcaatttgatatgccttgtgagaatatatgtagtttacagttggttttataagtttgttatatggaccgaatagtttaccaacagtttacaaattctgatatgcctcttatttggactttccagcttcatttaatttgatcacccataaatcattaacgttctgcacaattttcgctgaatattctcatcatgttttaatccaaattggtccagtgcatgctataaaaaatcttaacaatagaaaagttaaaatgaacagttctgaaaaaacctcccacgcacacaaaaaaagagcactaatcaacttttgtcgccctttttttagaggtttcctttatgcctagtagaatctgttcagaaacaacaggggagataagaaaggaaatatatattctgcctaatagggagagaaataagcgtgtgctcatcccttccttttcagctttcagcataactaagatgcatgctttgaatatatatggatacgtgtttgttacagactcacagttatgtatttaaacaaagcaggtggtctcagattgcggcacgtcttccaggaaggacagacaacgaaataaagaatttctggaactccacattaaagaaaagattgaagatcaataacacttccacatcctcaccaaatgacagtgattcatcggagcctagagatcatgccataggaaatatcatgcccacgcatgatcctgacactatgactctatgcatggactcatcttcctcatcatccatatccatgcaaggtatgatcacaagcaaccgatttgattctttctccatgctcaacaaccgctatgatgtgactggtgcagcgagtttatttgacatgtctacatgcttgacacaagtgggtatgggagatggattttatggtgatcattatgggattttggaggccaataataaaacggggctagaaagtgatctttctcttccaccactagagagtagaagctttgaagagaataatacagtgagtaataacagaattggcatgaaaagcagcagcaacaacaacaacaactgctttgataatacttgcttcgataatacttgcttcaacaataatactgatcagagatttaaagtagaggacatgttggggcttgaaaatcattggcaaggagaaaacttaagaatgggagaatgggattttgaaggtttaatggaaaacataacttcctttcctttacttgatttccacgtagaataa

SEQ ID NO: 1908 - protein, 333 aa, Populus balsamifera subsp. trichocarpa; identical to SEQ ID NO: 1893
  misc_feature (1)..(333): Ceres ANNOT ID no. 1461478
  misc_feature (78)..(123): Pfam Name: Myb_DNA-binding Pfam Description: Myb-like DNA-binding domain

SEQ ID NO: 1909 - DNA, 1424 bp, Populus balsamifera subsp. trichocarpa
  misc_feature (1)..(1424): Ceres PROMOTER Pt4CL1
ggtagttgtgattgagatatgtccagcactagttttttgttggtgtgatttctcatgatgacgggaaaattatatatataaatgaataatatttgtcggaatgatttgtttataaaataggttttgtagattcatgttagatatacatactttgtcaataagatatagctttaaatattgttcttttctttgaaaaaataaattagggtcttgaactcgaacccttttgcggaaaaaatatattaatgtaaaatttaattttattgtttttttaataatttgaatgatgaaataaaaatttacttgacccgttcatattatggtaaaatccatttaatcaaggtaacttttgtgtttagcccttggctccaaatattttacactctcatatgtgagtaaattataaattattctctctaattttgtaaaataaattaaatagttcatctagattcaaaaactaattaattattctctttaattttgtaaattaaattaaaaagatcagagtgaggtgaccagttgtcaaattactactcgacttggaagcatcacaactcaatttaaaaactagatttaaaaagatttagattattaaattatcaagttaattcacgggttgtctaatcaattgttgttaattaaaatgatagtatttttgataatttaatcaaatttttattggatttaaacaagtcaattaaatcacaaaatatcttattaaattaatatcttatttgatataactagaaatataacatgattaacctctaaaaatctcaaatttctcttataaacttgtataattgggctagatttaacggctattattccaactcgccaagacaactattaaaattaattaaaaaaaattctaataaagcacttcctaattgttaaaatacatgtctaaacactaaattagtaattttttttttagtttaacgtggatgtccgagtcagtttacgcgtacctcaactaaatttgtattttaatttttaggcagtaggtgagagaggagaggcacaagtgctgacaaataaattagtgcataaaatataatggatcggtggtctgtgaaaggacaggtggaggacaagccaccctctctcaagtcaaaaggccactttcataaccaacccaaatgggaacccaccaccgttcctcgccattaaaaccctaatctcaccaacccaactccacagattcttcaccaaacgcaacccatttttcaatcaatgttttccctatattaccccccaacaactccataatacccaatttgtcctttcaccaacccccgccctccatgccaaccaagtctatatcagcatgagtgctctgcactctgctttctcaggtctcctaccataaaaaaacagagagcacctaaaactcaccatctctccctctgcatctttag

SEQ ID NO: 1910 - DNA, 1413 bp, Populus balsamifera subsp. trichocarpa
  misc_feature (1)..(1413): Ceres PROMOTER PtPAL4
tgatggaacgtccaagagataggctacagatgtaaaggtatgcacaaaaaaaaccaaaatggctttcaaattgtcaagtaatcaatggagtctgggaaaaagaaatggctaaagagctccacattacaagtgaagaacggccggccatgagttgaatacttcctgttaatggttaccttgagttcatcaaaaagtgatattattttaattttatttttttaaaattaaatttagtttcgattgagttatgaaataattcaccatgttatttgtatttgactagattatctccagcctgatttttttgcacccggtccgagatagttctaaatttagccaggaagcacactgttcaggccgttttaacacgcaagtagcaaaaagaagcacatgattacaattaataaattttgctcgagttttcttctataatatttttgcctggcattgatccagccgacatgattcttggatttaccatgcactcgcaatgaaaaatcacaacttgatataattaattaatataaaaaaagaaatacctaacactaaggccgagttagaataatgcccaagtccaatagcttgcatgcatcaacttgaaagctaggatgacgggaaattttataagaaataaaagagaaactgtagaaattcaaaacaatccggaaatatctcatgatatataattatcactatttattttttaaagggaaaataactaacaaaatcaatcgagttacatagcatttccgcgtgtagataaataaagaaaaaaaatggatttttttctattttcaagtaaagatatgcatggatgtgttcgttgtaattccctctgccttttaggtagatatggtgatttaaatttcatggcagaaaaatcattgattaaataataagaattagagccatgacgtagtgctgatgtgccacttctcaacaacccccatttctccccaaccttctatctttttgacaagaacaggaaatcctccgaattatgggacccaacttaagtgcatgctacttaccacaatatcccaagtgtcacaatcccacccattgaatcccatgataatccaacggccacgtacacttctcaactaacacatcggccaacccaccccaccctctacctgcctgcccctccttccttctctatttaaagcacctaaattttggtgaacaaactcaggatttttgggtaacctgaaaattcctacatacatttagagcctcgcaacttcaattttttcttactatacaaccctcatataattttttacgccagaaaattctttgtgctcacacatccgttcttctctctcattttctctttgatcataccaatcgatccatcactctttttttgtctctcccccattttggcatagaggatcatcgctttacagg

SEQ ID NO: 1911 - DNA, 1075 bp, Populus balsamifera subsp. trichocarpa
  misc_feature (1)..(1075): Ceres PROMOTER PtHCT
aagtgctacctgcatgtctatgatgttgctaaagttattctgactcacggaaggacagataaattttataaaattcgctagtgatttatatattattttaagaaaaaagaaacttgaaattaaattaaattttgattaagttgtgaatttacttgttgagtggattaaatctaataagataaatttgcttgcgcgatgaaatctcaccagcttgatctgcttccaaaaataccaaacagttttcttagctaataaagataaagttggtgtgatgctttggttatcgtgagagtgatgaaaagtcaatgtcataaggctggggttggtgagcaccaataaaaaattgaaaaaactaaattgctcctcacagattcactataaggtgtccctccaacatccttcttggaaggtggcgactccattgacctttgttcaccctctctcgaaccctccttttgtcttcgatattctctctacttctctgctctaggctcacaggtatgctacctcttcatgtgtttgttcttgatttaattcttgcgtccttttttttctcttctttgggtttttaagcaaacaaggtcgtttaaaaccgaagttagactaataaatgcatgagttaaagggttgatttttatggtttttaagttattaaatacttctgtgccattgtactggggaagatatggatacattgattttgtgttttaagtgatagtgataaagatgcatccagttccttttcttttggtttagaagttatggttgatggagtcattttcagattgtaagatttaagagggaaaaaggaaggccttttctttttttggtgtttcaaatcggttctacaacagaaagatttcatttttcactatttattaatgccagccactgcatttaaatgtgcaaccaccaagaactttttggcacataaacaggctggggctggaaagggtaacgatcacaatttaaaggatatccattatcaatttgtgacaatttgtctttgaaactgcagagaacttggggtggaagagggatagaatcgataaatagagcattagcacggggaaag

SEQ ID NO: 1912 - DNA, 1555 bp, Populus balsamifera subsp. trichocarpa
  misc_feature (1)..(1555): Ceres PROMOTER PtF5H1
ggagagatatgaggacaattcttcaacctgtccggatctcgatctgaatttgtgattgaaggcaggttcgtccgatggacccgatagaaatcaggtgtacggtctctttaacactacggccaaggacttgcggacagcctgcaatgtttcagttgttggatgctagtaatcgatttggagcactcaaactccagagttcaaggtgattttagaccaacaagttcaaacttgaacgacctaacttgttttttataatgagcaactcaatgttgagatggccgaacttagctgatttataatgaagatgagatcacagatgggtggtatatgtgccctcttttattgggctcacggtccttgtgaagaccctcctcatcctccagcgcctctattctaaattaattgtatttgaacttataaatgtttaaatttataataaatattttattgttatattaatttattttattttaattattatgtacttatttttaatatatatatatattattgacggtgttaccgaaggattaagtttgttggtatattctagagagttgaaaaataattactgcaaatgtcactcccgctatttaatcaccgacagaattgcatatggtctttctgttggttatatgttagattcaccaatgaaaataccgacgatgaaaaaaaatcatcgatggaattatatacagtttttttgttggtaatatattatattcatcgatgaaaatatcaacaaaatgaagcaggtaaaatgaaaatatcaacaaaataaaaaaaaatttaacgggcttttgtggtccgtaaatccatcaataaacgtattactaataaactcatcgacaaaccacaaatgatcaatgagaggtttttttatagaacatttttatccattaatgtcgatatactaaaagtataaataatgacagaaaatttggtcggtagtggttattttgacctcaacatgtgagctggttcactatatatataggtgaaattgttctgtcttgttttcgtttcatctccgtccagattttgtatgagagcttatattaaatcatagttgctattttgtaagaaaatcatacatgttttttgtgaatttggcaattagaactatgctgattcaaatatattcgataggaggtatatttggatggcctccatgtgcctgatccaaaaatatcgaaaaaaagaataggaaagtcattaattaatgggcctaccttctctccttatttatagaaagtctacacttgttttcaacctttcacaagagaaaatataaacttatttgatttcagcattgaataagtaaacaaattcttttacaaattggagacgaaaccttccaagataatttaagataattaaataaataaaaagtggccaacttgtgaaatgttcgagacaggccacgaaaaaaatctatataaagcccatgatatccctctcaacttagcagcatcggaaagttgcgaggagtaaagtcttgtggattacacaaaatacagactgaaaacatccataggcaccaacacataaacca

SEQ ID NO: 1913 - DNA, 1481 bp, Populus balsamifera subsp. trichocarpa
  misc_feature (1)..(1481): Ceres PROMOTER PtCOMT
ccacccatgtcattaatttaccaaactcctaacacaatcatgtttaataacccttcaattttcaaaaataatttcagttcttatatttatttttatttgcaaattagtccttgtttgaattttctttttagttcttatactttacaaaaattatagtttatttttttattgtgattctttttattataattaaggtccctacatgcttttttttttatgtaatgctttttaatgtaataaatcattctgattgtaatcatcaattatataattattttgacaattacataattaaatatagaaatataataaattattacgttacatgatctattactaagtacccaagtctctacgtcaatgttcaattttcagcaggtggttctgttagaatgtcccatccaaaatatggattcattgatacgatttttaagtccaaacaaccctcatattaagcaaaaccctcatattaagcaaaagttattattattatttattattattattattgtttttgttgttgtgcttcttctttttctcaatcaacaaaatttttaccaacttcaagatttttttttttatggttaaaggtatactaatatgacctaataacttagaagtgtggattatagataaaattagcaattcgtgctatatagtgggttggatatttatttatataaaaaaattatatatataagtttttttttatgcatacttgtacaaaaaaaaaatataaatacaaatcaaatatttattcaatcaaatgataatagaaccagatatatatgaaattgattaaaaaaaatatatcatgttaggtcaacatattagaaatactatacaaaaataaatatttatatgtatataacacatacaaagattttctatagcgtgtgtttattcagtgagtttcatttatattaactttaaaatcattagttttataggatgtaaatttatcttttattaattttaaatgtgttcaataaatacaatcgggtgaatgtatcattatgtgattgaatatcttaatctgcatttatcttttaattttttcagttttttttttgttattgttaatgaatttttttttatttatataaatgattattgatttatttaattagatgctttatactttaattttttttatataaaaaaacatattaaaacaatctatatacctgatatttttatttttaaaaattataacctatgataaagaagttttataaacctacctgcttgacataacacatcatgttccaatagtctcccctgaaacaggttaaaaaaaaaaaagtttggcaaataagacgaggaaaaatatatagaagaaaaggtagggagtcagttctaggaagaagacatttgtgcatcaagtagagagtagggaccaaccacaaggtggttgagcacttcaccatatatagcaccactttgcaacctctttttcagtattctcatatcctcttcac

SEQ ID NO: 1914 - DNA, 1458 bp, Populus balsamifera subsp. trichocarpa
  misc_feature (1)..(1458): Ceres PROMOTER PtCCoAOMT
tgctcttttcttattcacgatagaagtctgttcagttaaagaaaacatggcctgttttcctagaaatttatctataaaaaaggaaattcttgttaaaataaagaaaaaaattcaattgaaatacacttcccagctttcgaatgtttctattatattttggaaaacatgtgaaaaatattttattaatgttcacttgaaaaaatggttatggttgcttttcaaagtgttttttacttggaaatgctttaaaataatatttttttattttttaaaaatcatttgtgatatcagcgcatcaaaatgatttgaaaacattaaaaaatattaatttaaaacaaaaaaataaaataaaataatttaaatttttttaaatacttttaaaacataaaaaaaaaaacagaatagaatttagacataaaaagtgttattctcgtcgtttaatagcgggaggtggtaagaaacatgctaagcattcacagttttggatattgattatccatgtgttaccctaaaaactgcctttttccatttcatgaaatcctcatttaatagcaattctttaaaggaggagactagagacagaggtggctgctgtcaacctagtcggtgaatttaaacttcaaccggcacatatatgcataccaagtataccctttacatctgccctaattaagactgtaaaacggatttggatttttgccgacaaaggctagtttgtggagaaaaaacaacgaagataaatttttagatgacaaagtcaacaatagttcgagagattctttaaaggactcatccgttgacggaggtggccatatgctaccaactcttggacgtggagtccctttggtaatttcacctatccctcacccaatttctattagcagttagcacatgtaatttatgattggtgagcccagcacaaatcttttccagttaaacacatatattaatttatgattaattatttaattctctccactcttaacaaattaatcatacatggcataacattttagcttttgatctcgagaatctctacctaaccattgacttctttactgttcaggaatcttagaaaaaaggaggacaaaaaaaaatatgcccaataaattatttaagaatttgaaccgagatttggtgtcatagatcccaaaaatgacgtcagcgatgcctcagggaaggagtaccactagcccacagcacgatacgatcaccaacaaggtgggtcccatatttggtgggccaaaaacccacattatccttcgtcctaactacaggaacctcaccaaccccctcccggttggtagccggtccagcctccccgctactccaattcaaaccgggctctcatttccaataaataccacccgccctttaccattttcgatcaggttaggcatcactaccatcatcaacaacaaaaataaaaattccaaggccaagaaagagatcgtagtt

SEQ ID NO: 1915 - DNA, 1212 bp, Populus balsamifera subsp. trichocarpa
  misc_feature (1)..(1212): Ceres PROMOTER PtCAD6
ggttttgagttgatttaggttttgaggcattttttttgtggtttttagaggccattgattagtctaataaggttcttctccataatttttcttgcttatttatcattttttaaatattaattttttattattatatttggtgtgtttaattcatctataattttttatatatatattttacatatattaaacttactttaaaaattaaaaatgtttatttttttataatatttttaatatgtgcaaccttacaatatctttccttttattatattcaataaattttccacgtgaatcgatttttattataaaaatattttaataaacaaattcattatacataatcggataaattacccatattacgatattaaatattttgatttatatttgtttcttgttttgtttttatcataaatttattttttttattgaattatcttgaattgatgacgtaggaaacatgataaacatgtaatctagatatatctcatgtctaggtcatgggtttcacgtgttagttcagctttacccaaaataatttttttatttgttattattgttaccttattttttcatcatattattaaattaattaaaatttaatcaaaacattaattttttcttacttttttttaaaatataatcttctcttaaatttcttttttcatgtttaaaaaaatttcagtcgacggcacaacaatccagtaaataccaagggtatattgtcgccactcaccaccaactacgtcaattaagcaaataatataattaggcaactgtgtaaccaccatggaaattaagatattcctttcatgaaatacttaattagtgacgtatacatgatgctccaaacctcatcacagattcagtgttcttaactattatgttcccttttgtttcccaagaaccatgagttaatcaggaccatcgatactactgaggccccaccaatgttttgatcatgtggacaatgttcacttgattttcaactttgaagaaatgacccatggttgtggaagcagaggatggcgccactccatcacatttcacctaccaccacccgtaaaatatgcggagctgtccttgtcttttttgttgccaagtaacctttgccattctttatttgtgcttttgtatatatactcatccatagtggcttctaattcttcaactctccacagaaactccatctctctctcttagcctcat

SEQ ID NO: 1916 - DNA, 1479 bp, Populus balsamifera subsp. trichocarpa
  misc_feature (1)..(1479): Ceres PROMOTER PtC4H
caaagtaacggtaaagtctagtcggctgtttaatggttgacttttctttcttttcagttatttcaattgaggattgatttcttccaaatttcgactttttcctcaaaacatgtttaacatttgcaatttgcacctccgcaaaacgttgatgacattcacagcatagcatgacaccagtcctttgaactaggatgataagcttgttccttaattaatttattcaaactagttagattttgtagcattgaaaataaataaattattttcttaattaatcggtattcctcaatttaataatttattttattaaaaaaacccatttcgccgttaacctttttttatttactctattctcttaataaaacaaaatacaaaatgaaatgaaaaacgggaaagtatttttaaatgctaaatgtatatatacccaataaaaatgtaagttaccaagtatatctaaaataataaattaaattaattaatttaatcataaacattaacccattaattgtattgatattagccatttaaattttatacactacaattaaaatttaattggctatatcaataaaatttattaattataaaaacacctataattaattataatttgagatcaatattctaacatgagggagtattgacgaagccccgattaatgaatattcttgaagtgtgtgtatatatacatatatgtatgtgtaaaacctgttggcataaaataaaacccgagttatgtatgaagaggaattctttgatttttgttaaaggatcaaaataatattgatttgaaaaaaaattaaaaagaatagtgaatggaataagtggagatcattttggattcttgaatgtgttagttagttttttttattttttaacttaaatcaagtgttttaaattaatcctaaaaaatataatttaattggccagattctgaatttagttcttagagatcattaatttaaatgctataaaattcaagattattaaaaatttacataaaaattaactttaaaattttaaaaaattaatcaagaaatataaaaattaactcagaaactacggtaaaaaaaaataaaaataataaggtcttgtattgagatgaagagagtcgcgcttgtatgcgtgtatatatataaggaatttgtgacatcatgtgcctcacctactacctctacaacgatcaatgctgtgttgtccctctcctatcacacctcagaactaacgccgttaactctgtttcagaaacctaactggaagccacacgtccacctaactcatgaactatctttatctccaaccttccagttgctctttaattcttctactgcttataaaaccccctcccaacccccactcactccccaccaaccacctagtctctcctcctcttaattatattttcttcaatctaccactccttcttctccccagaaatctctttcagtactcctttggataaagaagatcatattccag

SEQ ID NO: 1917 - DNA, 1541 bp, Populus balsamifera subsp. trichocarpa
  misc_feature (1)..(1541): Ceres PROMOTER PtC3H
ccttgacactttaccatcctcacccattttttaccaaattcaccatccaaatatcatatatataaaatcttgtgttgttgttttttacttggtggatttgagaccacgttagagcccgatcttgctgagggtttagattatcgagttaatctgtggattaattttaaaataatattttttagatagtttttttttaataacattattttaaatataaattaaaaaaaattaaaactgattcaattaagtttcttttgagatttcttgattgagtttgacttatcaagttacctaaatttaatatacaaattgacttgaaagcaaatctaatctaagttaggttttaagagtccatttagaaacatgtatccttaaattttgaaaaacaaattattaaaaattattatttttatgtactgatctcaaaaataatttttaaaaaataaaaaatattattttgatgtatttctaagctaaaaacacgttgaaccgcaatcaccattacaatttcaagcttaaaatacattaaaatgtgtgattgtgggagtttgggagtgtgattatggttacttttcaaagtatttttcacttggaaatacattaaaataatattttttaaaaaaaattatttttaatatcagcacattaaaaatatctaaaaatactaaaaaaatattgtttttatacaaaaaaataaaaaataaaaatatataatttaaatcgcattctcgaacattacatatctcccggtccagccgtcaaaagcaacttttaaattatataatagtagtagataacattatgtgccccgtaattataaatttctatagcaatttccctctcaattattacaaaccttttaacttatcttattttcttaattacaaatatgtgggctgcgagaaatgaatagaatggtctcccccttcaccaacttttgattcctccttctttgcttgttaaaaagtctcacttcaccaaccaccaaatactaaaaaaaacaaaaaaacaaaaaacccgctctactatcttttcaccgagagtgaagtcacgcgccaccgttcttgagcacgtgggacattgtaattggtcaatgtttccccacaatgggcattgacaagtgacacttttttcccctccctctcctatgacagcgactataagcagaagcaaagagtcgcacatcgtccctcaacttcttaaatttattcatgttagaccctcttctttaagtttgatcaaactcactactttattctcaatgaaatgcattcttacctcgtgaaaaaactcaattattaattaaatgacttgaatgaacatctgaaattggatttgtatgaaagtaaaaagggtttatttgacccaatttaaagtgagggattgagttggtaatttgtggaaattagagggaccatgaatgatttttaacaagaaacaaaatccactcaccaactccctccctcgcagagaccaactccattcctacaatttatattctgccaaggcccttcagaaaaattagaccctttctctccctt

SEQ ID NO: 1918 - DNA, 1232 bp, Populus balsamifera subsp. trichocarpa
  misc_feature (1)..(1232): Ceres PROMOTER PtCCR1
agatcatgtccttcatcactcctttgatgaaaatgctggtctaaataaaaaacacacgttcaataaaaaagaaaaagagaccaggtcaatcagtgggaagagaagagaactggacgtaagaaattgtcaaagattcatatctttgaagttactaggaagggaaggactctcaggtctttctttatacatgcaagaaacaagaaacatgtggatatatagattataaactctctctctctctctctctctctctctctctctatatatatatatatatatatatatatatatgatttgaccaaaaggtaaacgttgttggtcatgagcattcttgaatagagaaattaaaaaagaaagaaaaaaacatggatggtgatttacttattcttgtacatatatagattcaactatgcatttccataatcaattattgtattttgttttgtaattatccgagaaaaactatgttgactgtacataaatatgtttgatgaaccaatttttttatcgtatccaaataataataaaaataataataataataaaggtaaggtaaaaaaatatatagtaatatccttggagatttcattattttcgatacattcatatattaatagaacaaaaattggttgttcggaaattaattacaaatatatgttttgaataataccaaagtaaatgccaaagaagaacaagagaacaacatgcacttttggtccaaaaaatacatacataaaacaataagttttccatgtaagatttattagtagcttattctttaacatgaacacttgtcatccatgagatcctttccctctctccttccaaaacaaattaaattaagtactgctctctacttgtgatcaacaaccatttaatgggtcgttgtgtataatatattttcatttcttaatttattagtagcttataattacattttggtcaaaaacagcatgcacgtttggtaaaaaaaacacatgtacaaaacaatcaggattccacacatggtgctgacgattcatatcacaaaaactcagtcacaaacctcaaggaaagaaaaataatggaaagagagaaactctctttggtaaatatttaccggtagtgggtgaggaaggtaactctaaaccttaattataaatacatccactccaccacttctttccttgtagcagccacctcctaaatcaagagaaaaggaaaacacctccctctctctgtctctcttcctt

SEQ ID NO: 1919 - DNA, 1359 bp, Populus balsamifera subsp. trichocarpa
  misc_feature (1)..(1359): Ceres ANNOT ID no. 1452324
atgtgcgtattgaaggtggcgaacccaagaggcaactcaggggagtacagcaggtacccttacacagatagcgatgataaccaagaagagagatcgtacacagcacaacaaatattttctgaattgaatcaaccaatacagcggcatgtggaggtaactcaatcaccacatatgttcatggggtatagcagttcagcagagatgtctgcaatggtatcagcacttacacatgtggtctcaggccacagaggaagtactagcgattggggatcatatggggcctcaggtctaggaggtgcaacaataacgtcgactattgttcaggcagcacctggttctaacacttctcccgcttctccatctttgtctgcatattcttctacttctggttctggttcttggattggccagaagagagggagagaaaaggaagccggtgcagcagctcaattgaaggagtctttgccaagggttcatagagggtttgatgattttagaagttcactgggcgattcgccgtcatctggtgcaactgcaactgaagaagtgtctgcttcaactctagtattctccaccacagccacaccctccaccacagcaacaccatcaagtgaaacagcatctttgggagaaacaggagagcgaaaaagaagatacagaggagttaggcaaaggccatggggcaaatgggcagcagagatacgtgatccacacaaagcagcaagagtctggctaggcacatttgaaactgcggaagctgcagctagagcctatgatgaggctgctttaagattcagaggaagtagagctaaacttaacttccctgaaaatgctaggctactgccagctcaaatgcaaaatgttactgcttctcaagttcccatttctcgttcacaattaccttctcatcaccagttacagtcaatctcatctccaaggcaacaagcacagcggccgcaggtgccagcacctgcattgtttcagtctcaacctgatattataagagactactgggagtactcccagttgttgcagagttctggggactttcatggacaacaacaaccaccaccttcaaatttgttagagcagatgttttataatccccagctggcctctctacaatcatcaactttgtcttcattaccttcatctacttcaggttcttcatttgcagcaataccctctggttcgatatcatcaacactatctccatctgcttcttcatttcctctgctttttgctggtcaacagttaggttattttcggccaccagaaaatcagaatccagctgctggttccgattttccggtgcccccatggacagattgtagtcgccgtccttcctccactggttaa

SEQ ID NO: 1920 - DNA, 1374 bp, Populus balsamifera subsp. trichocarpa
  misc_feature (1)..(1374): Ceres ANNOT ID no. 1443093
atgtacatattgaaggtggcgaaccaaagaggagacccgggggagtacaccaggtaccctgcaacagataactatgataaccaagaagagagatcatacacagcaccacagatactttctcaattgaatcaaccagtagagcatcatgtggaggtaacacaatcaccgcatatgttcatggggtacagcagttcaacagagatgtcaatggtatcagaacttacacatgttgtatcaggccaaagagggagtactagtgattggggatcatatggggctgtgggtctaggaggtgcaacaataacatcaaattttggtcaggcagcacctggttctaatacgagtactcctgcttctcctcctttatctgcctattcttctacttctggttctggtttgtggattggccagaagagagggagagaagaagaggctggtgcagcagcgcaattgatggagtctttgccaagggtttatagagggtttaatgattttagaagttcacaaggagattcatcatcatccggtgcaactgccaccgaagaagtgtctgcttcaactatagtaatccccaccacaactacaccctccactacagcaacaccatcaagtgaaatagcatccctggaagaaactggagagcaaagaagaagatacagaggagttaggcagagaccatggggcaaatgggcagcagagatacgtgatccacacaaagcggcaagagtctggctaggcacatttgatactgcagaggctgcagctagagcctatgacgatgctgctttaagattcagaggaaatagagctaaacttaacttccctgaaaatgttaggctgctgccagctcaaacgcaaaatgttactgcttctcaagttcccatatctcattcacagctatcttctcatcttcagttacagccaatctcatctccaaggcaacaagcacagcggccgcaggcgccagcacctgcattgtttcagtctcaagctgatattataagggactactgggagtactcccagttgttgcagagttcaggggagtttcatcatcatcaacaacaacaacaacaacaacaacaaccttcaagtttgttacagcctatgttttataatccccaggtggcttctctacaatcatcagctttgacttcattgtcttcatctacttcagtttcttcacttgcagcaatatcttccggttcatcaccatcaacattttctccctctgcttcttccttccctctgcttttcgctggtcaacagttgggttattttcggccaccacaaaatcagaatccagctagtggttctgattttccggtgcccccatggacagattctagtcacaatccttcctctagtggttag

SEQ ID NO: 1921 - protein, 364 aa, Arabidopsis thaliana; identical to SEQ ID NO: 1581
  misc_feature: Public GI no. 30794130
  misc_feature: Functional Homolog of  Ceres CLONE ID no. 17402
  misc_feature (91)..(263): Pfam Name: DEAD Pfam Description: DEAD/DEAH box helicase

SEQ ID NO: 1922 - protein, 276 aa, Glycine max
  misc_feature (1)..(276): Ceres CLONE ID no. 477003
  misc_feature (1)..(276): Functional Homolog of Ceres CLONE ID no. 115924
  misc_feature (51)..(102): Pfam Name: Myb_DNA-binding Pfam Description: Myb-like DNA-binding domain
  misc_feature (269)..(269): Xaa is any aa, unknown, or other
MYHSKNVPSASLIGGNSLSHGQHIDCGGSTMDPGSGGNGLSNNSNLTSKQRLRWTHELHERFVDAVAQLGGPDRATPKGVLRVMGVQGLTIYHVKSHLQKYRLAKYLPDSSSDEGKKADKKETGDMLSNLDGSSGMQITEALKLQMEVQKRLHEQLEVQRQLQLRIEAQGKYLKKIIEEQQRLSGVLSEAPGSGAVAVVPGDACQEPDNKTDPSTPDPEKAAKDRAPAKSLSIESFSSHPEPMTPDSGCHVGSPAESPKGERSAKKQRXNHGWCVF

SEQ ID NO: 1923 - protein, 312 aa, Zea mays
  misc_feature (1)..(312): Ceres CLONE ID no. 894637
  misc_feature (1)..(312): Functional Homolog of Ceres CLONE ID no. 115924
  misc_feature (47)..(98): Pfam Name: Myb_DNA-binding Pfam Description: Myb-like DNA-binding domain
MYSPKPESSFGPNPNSGTHQQQMELTGANMGPGNGANNNTNMAGRQRLRWTNELHERFVEAVTQLGGPDRATPKGVLRIMGVQGLTIYHVKSHLQKYRLAKYIPDASTDGNKTDNKDPGDLLAGLEGSSGLQISEALKLQMEVQKRLHEQLEVQRQLQLRIEAQGKYLQKIIEEQQRLTGVKSETPAGGASVTVSSDQFPDSERTEPSTPAPASESPTQVGASNRDTGDRTEATKSTCHGDSLSRNEPLTPDSNCQNGSPVASPNHERAAKRQRGSGTEFLDSEAEFSLPRHIFESSSGSEFQQYSMSYSGQ

SEQ ID NO: 1924 - protein, 288 aa, Oryza sativa subsp. japonica
  misc_feature (1)..(288): Public GI No. 50725048
  misc_feature (1)..(288): Functional Homolog of Ceres CLONE ID no. 115924
  misc_feature (25)..(76): Pfam Name: Myb_DNA-binding Pfam Description: Myb-like DNA-binding domain
MELGGNNMGPDNGANNNSNLAARQRLRWTNELHERFVEAVTQLGGPDRATPKGVLRIMGVQGLTIYHVKSHLQKYRLAKYIPDSSADGNKAENKDPGDLLAGLEGSSGLQISEALKLQMEVQKRLHEQLEVQRQLQLRIEAQGKYLKKIIEEQQRLGGVKSETPAAGASVTLPSDQFPDSERTDPSTPAPTSESPTQGVPSNRDNGGQNEATKSPQRDDSLSRHEPLTPDSNCQPGSPTASPKHERAAKRQRGNGAEFSETDFALPHSIFESSSGSEFQQCSMSYSGH

SEQ ID NO: 1925 - protein, 314 aa, Glycine max; identical to SEQ ID NO: 1426
  misc_feature (1)..(314): Ceres CLONE ID no. 511197
  misc_feature (1)..(314): Functional Homolog of Ceres CLONE ID no. 14246
  misc_feature (107)..(178): Pfam Name: RRM_1 Pfam Description: RNA recognition motif. (a.k.a. RRM, RBD, or RNP domain)

SEQ ID NO: 1926 - protein, 319 aa, Nicotiana sylvestris; identical to SEQ ID NO: 1428
  misc_feature (1)..(319): Public GI No. 311952
  misc_feature (1)..(319): Functional Homolog of Ceres CLONE ID no. 14246
  misc_feature (111)..(182): Pfam Name: RRM_1 Pfam Description: RNA recognition motif. (a.k.a. RRM, RBD, or RNP domain)

SEQ ID NO: 1927 - protein, 324 aa, Nicotiana tabacum; identical to SEQ ID NO: 1427
  misc_feature (1)..(324): Public GI No. 20005
  misc_feature (1)..(324): Functional Homolog of Ceres CLONE ID no. 14246
  misc_feature (116)..(187): Pfam Name: RRM_1 Pfam Description: RNA recognition motif. (a.k.a. RRM, RBD, or RNP domain)

SEQ ID NO: 1928 - protein, 341 aa, Zea mays; identical to SEQ ID NO: 1425
  misc_feature (1)..(341): Ceres CLONE ID no. 1537388
  misc_feature (1)..(341): Functional Homolog of Ceres CLONE ID no. 14246
  misc_feature (114)..(185): Pfam Name: RRM_1 Pfam Description: RNA recognition motif. (a.k.a. RRM, RBD, or RNP domain)

SEQ ID NO: 1929 - protein, 348 aa, Oryza sativa subsp. japonica; identical to SEQ ID NO: 1429
  misc_feature (1)..(348): Public GI No. 50934311
  misc_feature (1)..(348): Functional Homolog of Ceres CLONE ID no. 14246
  misc_feature (120)..(191): Pfam Name: RRM_1 Pfam Description: RNA recognition motif. (a.k.a. RRM, RBD, or RNP domain)

SEQ ID NO: 1930 - protein, 344 aa, Hordeum vulgare subsp. vulgare; identical to SEQ ID NO: 1424
  misc_feature (1)..(344): Public GI No. 3550485
  misc_feature (1)..(344): Functional Homolog of Ceres CLONE ID no. 14246
  misc_feature (110)..(181): Pfam Name: RRM_1 Pfam Description: RNA recognition motif. (a.k.a. RRM, RBD, or RNP domain)

SEQ ID NO: 1931 - protein, 304 aa, Glycine max; identical to SEQ ID NO: 818
  misc_feature (1)..(304): Ceres CLONE ID no. 573293
  misc_feature (1)..(304): Functional Homolog of Ceres CLONE ID no. 19340
  misc_feature (115)..(179): Pfam Name: zf-DHHC Pfam Description: DHHC zinc finger domain

SEQ ID NO: 1932 - protein, 307 aa, Glycine max
  misc_feature (1)..(307): Ceres CLONE ID no. 537080
  misc_feature (1)..(307): Functional Homolog of Ceres CLONE ID no. 19340
  misc_feature (116)..(180): Pfam Name: zf-DHHC Pfam Description: DHHC zinc finger domain
MYRSGAGMAWNVFRFCTALRGLGSIMILMVLGVVGVTYYAVVLTNFGPALFLGGLDTLISFVVLILFHCLLVMLLWCYFAVVFMDPGTVPPNWKPAADEERGEVDPLNGVELSNLQSDPANQRFRYCRKCSQPKPPRCHHCSVCGRCVLKMDHHCVWVVNCVGALNYKYFLLFLVYTFLETTLVTISLLPHFKTYFSDGEIPGTPGTLATTFLTFVLNLAFSLSVLGFLVLHVSLVASNTTTIEAYEKKTTSKWRYDLGRRKNFEQVFGMDKRYWFIPAYSEEDIRRMPVLQGLEYPSTPDFNAQEF

SEQ ID NO: 1933 - protein, 316 aa, Oryza sativa subsp. japonica; identical to SEQ ID NO: 825
  misc_feature (1)..(316): Public GI No. 50919203
  misc_feature (1)..(316): Functional Homolog of Ceres CLONE ID no. 19340
  misc_feature (125)..(189): Pfam Name: zf-DHHC Pfam Description: DHHC zinc finger domain

SEQ ID NO: 1934 - protein, 180 aa, Zea mays
  misc_feature (1)..(180): Ceres CLONE ID no. 230342
  misc_feature (1)..(180): Functional Homolog of Ceres CLONE ID no. 19340
  misc_feature (125)..(180): Pfam Name: zf-DHHC Pfam Description: DHHC zinc finger domain
MYRSAGVAMAWNVFRFCTALRGLGSIMILLVLAIVGVTYYAVVLCNYGPALFTGGGTTLAALAVLLSFHFLLAMLLWSYFSVVFTDPGSVPPNWNLDFDVEMGETAPLASSELCSQMNSQQSVALGNMTNPRVRYCRKCNQLKPPRCHHCSVCGRCVLKMDHHCVWVVNCVGALNYKYFL

SEQ ID NO: 1935 - protein, 310 aa, Arabidopsis thaliana
  misc_feature (1)..(310): Public GI No. 12597770
  misc_feature (1)..(310): Functional Homolog of Ceres CLONE ID no. 207419
  misc_feature (233)..(259): Pfam Name: zf-CCCH Pfam Description: Zinc finger C-x8-C-x5-C-x3-H type (and similar)
MEKLAASTVTDLACVTAINSSPPPLSPISEQSFNNKHQEEFAASFASLYNSIFSPESLSPSPPSSSSPPSRVDTTTEHRLLQAKLILEYDELNEHYELCLNRLQSLMTELDSLRHENDSLRFENSDLLKLIRISTSSSSSVSPPAPIHNRQFRHQISDSRSAKRNNQERNSLPKSISVRSQGYLKINHGFEASDLQTSQLSSNSVSSSQKVCVVQTKGEREALELEVYRQGMMKTELCNKWQETGACCYGDNCQFAHGIDELRPVIRHPRYKTEVCRMMVTGAMCPYGHRCHFRHSLTDQERMMMMMLTR

SEQ ID NO: 1936 - protein, 318 aa, Zea mays
  misc_feature (1)..(318): Ceres CLONE ID no. 212775
  misc_feature (1)..(318): Functional Homolog of Ceres CLONE ID no. 207419
  misc_feature (244)..(270): Pfam Name: zf-CCCH Pfam Description: Zinc finger C-x8-C-x5-C-x3-H type (and similar)
MEVVLAPAQHDGLHAAFGPNPFDIGVGGDGRISSSLSSLGGDRFCGYSTTASLFVNSPGLSSPSPRADSLSRGSSDSGSVVDDGDDAAATAPSVAERRLRLARLALQYQEVVNRFELCLSYLADAINEAAALRQENDELRVANEYLARRINVVGGRLADEFSGLRLAEEHTTPPPLSPLPAAPVMPKSISVRSPGYLKMIQNGKHRASKPTKGSRVLVGMEGGVKEEEKLNGGLQFEVYNQGMLKTELCNKWEETGTCPYGNQCQFAHGIAELRPVIRHPRYKTEVCRMVLAGVVCPYGHRCHFRHSITPADLFLPRP

SEQ ID NO: 1937 - protein, 310 aa, Glycine max
  misc_feature (1)..(310): Ceres CLONE ID no. 477718
  misc_feature (1)..(310): Functional Homolog of Ceres CLONE ID no. 20769
  misc_feature (142)..(186): Pfam Name: CCT Pfam Description: CCT motif
  misc_feature (210)..(247): Pfam Name: GATA Pfam Description: GATA zinc finger
  misc_feature (74)..(109): Pfam Name: tify Pfam Description:
MEPSAMYGPSQPLNIPSRIGAGERDDGSGNEPAVDGHHHHIQYETHALDDGAAGGAVVVEDVTSDAVYVSGGGGPEESSQLTLSFRGQVYVFDAVTPDKVQAVLLLLGGCELSSGGSPCVDPGAQQNQRGSMEFPKCSLPQRAASLDRFRQKRKERCFDKKVRYSVRQEVALRMHRNKGQFTSSKKQDGANSYGTDQDSGQDDSQSETSCKHCGTSSKSTPMMRRGPSGPRSLCNACGLFWANRGALRDLSKRNQEHSLPPVEQVDGGNDPDCRTAAADPAQNNLAAFSEPVNPALVADRKVFQSQKMLE

SEQ ID NO: 1938 - protein, 307 aa, Glycine max
  misc_feature (1)..(307): Ceres CLONE ID no. 518521
  misc_feature (1)..(307): Functional Homolog of Ceres CLONE ID no. 20769
  misc_feature (139)..(183): Pfam Name: CCT Pfam Description: CCT motif
  misc_feature (207)..(244): Pfam Name: GATA Pfam Description: GATA zinc finger
  misc_feature (71)..(106): Pfam Name: tify Pfam Description:
MEPSAMYGHSQPLSMPSQIGGGESDDGSGNEHAVDGHHHHIQYETHALEDGAAVVVEDVTSDAVYVSGGGGPVESSQLTLSFRGQVYVFDAVTPDKVQAVLLLLGGCELSSGGSPCVDPGAQHNQRGSMEFPKCSLPHRAASLHRFRQKRKERCFDKKVRYSVRQEVALRMHRNKGQFTSSKKQDGANSYGTDQDSGQDDSQSETSCTHCGISSKSTPMMRRGPSGPRSLCNACGLFWANRGALRDLSKRNQEHSLPPVEQVDEGNDSDCRTATADPAHNNLPAFSEHDNPALVADHKVFQSQKMLK

SEQ ID NO: 1939 - protein, 106 aa, Zea mays
  misc_feature (1)..(106): Ceres CLONE ID no. 1541168
  misc_feature: Bit Score of 289.3 for HMM based on sequences of FIGURE 81
  misc_feature (1)..(106): Functional Homolog of Ceres CLONE ID no. 225321
  misc_feature (2)..(50): Pfam Name: TFIIA_gamma_N Pfam Description: Transcription initiation factor IIA, gamma subunit, helical domain
  misc_feature (52)..(101): Pfam Name: TFIIA_gamma_C Pfam Description: Transcription initiation factor IIA, gamma subunit, beta-barrel domain
MATFELYRRSTIGMCLTETLDEMVSNGTLSPELAIQVLVQFDKSMTDALENQVKSKVTVKGHLHTYRFCDNVWTFILTDASFKNEEATEQVGKVKIVACDSKGRGQ

SEQ ID NO: 1940 - protein, 106 aa, Triticum aestivum
  misc_feature (1)..(106): Ceres CLONE ID no. 699465
  misc_feature: Bit Score of 294.9 for HMM based on sequences of FIGURE 81
  misc_feature (1)..(106): Functional Homolog of Ceres CLONE ID no. 225321
  misc_feature (2)..(50): Pfam Name: TFIIA_gamma_N Pfam Description: Transcription initiation factor IIA, gamma subunit, helical domain
  misc_feature (52)..(101): Pfam Name: TFIIA_gamma_C Pfam Description: Transcription initiation factor IIA, gamma subunit, beta-barrel domain
MATFELYRRSTIGMCLTETLDEMVSSGTLSPELAIQVLVQFDKSMTEALENQVKSKVTVKGHLHTYRFCDNVWTFILTDAQFKNEETTEQVGKVKIVACDSKLLSQ

SEQ ID NO: 1941 - protein, 106 aa, Oryza sativa subsp. indica
  misc_feature (1)..(106): Public GI No. 55585039
  misc_feature: Bit Score of 291.7 for HMM based on sequences of FIGURE 81
  misc_feature (1)..(106): Functional Homolog of Ceres CLONE ID no. 225321
  misc_feature (2)..(50): Pfam Name: TFIIA_gamma_N Pfam Description: Transcription initiation factor IIA, gamma subunit, helical domain
  misc_feature (52)..(101): Pfam Name: TFIIA_gamma_C Pfam Description: Transcription initiation factor IIA, gamma subunit, beta-barrel domain
MATFELYRRSTIGMCLTETLDEMVSSGTLSPELAIQVLEQFDKSMTEALENQVKSKVSIKGHLHTYRFCDNVWTFILTEASFKNEETTEQVGKVKIVACDSKLLSQ

SEQ ID NO: 1942 - protein, 109 aa, Oryza sativa subsp. japonica
  misc_feature (1)..(109): Public GI No. 57899877
  misc_feature: Bit Score of 285.0 for HMM based on sequences of FIGURE 81
  misc_feature (1)..(109): Functional Homolog of Ceres CLONE ID no. 225321
  misc_feature (2)..(50): Pfam Name: TFIIA_gamma_N Pfam Description: Transcription initiation factor IIA, gamma subunit, helical domain
  misc_feature (52)..(101): Pfam Name: TFIIA_gamma_C Pfam Description: Transcription initiation factor IIA, gamma subunit, beta-barrel domain
MATFELYRRSTIGMCLTDTLDDMVSSGALSPELAIQVLVQFDKSMTSALEHQVKSKVTVKGHLHTYRFCDNVWTFILTDAIFKNEEITETINKVKIVACDSKLLETKEE

SEQ ID NO: 1943 - protein, 106 aa, Glycine max
  misc_feature (1)..(106): Ceres CLONE ID no. 530235
  misc_feature: Bit Score of 292.9 for HMM based on sequences of FIGURE 81
  misc_feature (1)..(106): Functional Homolog of Ceres CLONE ID no. 225321
  misc_feature (2)..(50): Pfam Name: TFIIA_gamma_N Pfam Description: Transcription initiation factor IIA, gamma subunit, helical domain
  misc_feature (52)..(101): Pfam Name: TFIIA_gamma_C Pfam Description: Transcription initiation factor IIA, gamma subunit, beta-barrel domain
MATFELYRRSTIGMCLTETLDEMVQNGTLSPELAIQVLVQFDKSMTEALETQVKSKVSIKGHLHTYRFCDNVWTFILQDALFKSEDSQEIVGRVKIVACDSKLLTQ

SEQ ID NO: 1944 - protein, 106 aa, Arabidopsis thaliana
  misc_feature (1)..(106): Ceres CLONE ID no. 8364
  misc_feature: Bit Score of 294.7 for HMM based on sequences of FIGURE 81
  misc_feature (1)..(106): Functional Homolog of Ceres CLONE ID no. 225321
  misc_feature (2)..(50): Pfam Name: TFIIA_gamma_N Pfam Description: Transcription initiation factor IIA, gamma subunit, helical domain
  misc_feature (52)..(101): Pfam Name: TFIIA_gamma_C Pfam Description: Transcription initiation factor IIA, gamma subunit, beta-barrel domain
MATFELYRRSTIGMCLTETLDEMVQSGTLSPELAIQVLVQFDKSMTEALESQVKTKVSIKGHLHTYRFCDNVWTFILQDAMFKSDDRQENVSRVKIVACDSKLLTQ

SEQ ID NO: 1945 - protein, 106 aa, Arabidopsis thaliana
  misc_feature (1)..(106): Public GI No. 1429228
  misc_feature: Bit Score of 278.2 for HMM based on sequences of FIGURE 81
  misc_feature (1)..(106): Functional Homolog of Ceres CLONE ID no. 225321
  misc_feature (2)..(50): Pfam Name: TFIIA_gamma_N Pfam Description: Transcription initiation factor IIA, gamma subunit, helical domain
  misc_feature (52)..(101): Pfam Name: TFIIA_gamma_C Pfam Description: Transcription initiation factor IIA, gamma subunit, beta-barrel domain
MATFELYRRSTIGMCLTETLDEMVQSGTVSPELAIQVLVQFDKSMTEALESQVKTKVSIKGHLHHLQVRDNVWTFILQDAMFKSYDRQENVSPVKIVASDSKLLTQ

SEQ ID NO: 1946 - protein, 171 aa, Oryza sativa subsp. japonica
  misc_feature (1)..(171): Public GI No. 34896798
  misc_feature (1)..(171): Functional Homolog of Ceres CLONE ID no. 29637
  misc_feature (10)..(81): Pfam Name: RRM_1 Pfam Description: RNA recognition motif. (a.k.a. RRM, RBD, or RNP domain)
MNQPVQKNTLYVGGLAEEVDEKILHAAFVPFGEIKDVKTPLDQATQKHRSFGFVTFLEREDAAAAMDNMDGAELFGRVLTVNYAFPERIKGGEQGWAAQPIWADADTWFERQQQEEEMQRLQAEQRAAMQAAEKLHREKLAAEKEGEKEEETDTNADPMAAAEAQALKQSS

SEQ ID NO: 1947 - protein, 301 aa, Arabidopsis thaliana; identical to SEQ ID NO: 1377
  misc_feature (1)..(301): Ceres CLONE ID no. 108509
  misc_feature (1)..(301): Also Known As Ceres CDNA ID no. 23365210
  misc_feature (1)..(301): Also Known As Ceres GEMINI ID no. 539G6
  misc_feature (1)..(301): Functional Homolog of Ceres CLONE ID no. 333416
  misc_feature (66)..(109): Pfam Name: G-patch Pfam Description: G-patch domain

SEQ ID NO: 1948 - protein, 306 aa, Triticum aestivum
  misc_feature (1)..(306): Ceres CLONE ID no. 764678
  misc_feature (1)..(306): Functional Homolog of Ceres CLONE ID no. 333416
  misc_feature (67)..(111): Pfam Name: G-patch Pfam Description: G-patch domain
MERPGHGGIGSGGGSKNPPPSGKDEYGGGYDRLDEEVEFRLPRGHRPVENLDTEGLEQASVDTRLASSNVGFRLLQKMGWKSGKGLGKNEQGILEPIKAGIRDAKLGVGKQEEDDFFTAEDNVQRKRLNVELEETEEHIKKREVTAEREQKIRSEVKEIQKTFFCSLCNKQYKLAYEFESHLSSYDHNHRKRFKEMKEMQSGGSGNRDDRQKREQQREEKELAKFAQLADAHRKQQKEKQEQPDISGEQATSKNLPTPGNQDQRRTLKFGFSKMTPSKAPVGSMSKKPKIATKVPSVFGNDSDEEA

SEQ ID NO: 1949 - protein, 126 aa, Zea mays
  misc_feature (1)..(126): Public GI No. 17017392
  misc_feature (1)..(126): Functional Homolog of Ceres CLONE ID no. 333753
  misc_feature (28)..(97): Pfam Name: HMG_box Pfam Description: HMG (high mobility group) box
MKSRARSTAGDSRLSVRKTKAEKDPNKPKRPPSAFFVFMEEFRKDYKEKHPNVKQVSLIGKAGGDKWKSLSDAEKAPYVSKAEKLKAEYTKKIDAYNNKQSGDPTASGDSDKSKSEVNDEDEEGDE

SEQ ID NO: 1950 - protein, 127 aa, Oryza sativa subsp. japonica; identical to SEQ ID NO: 1459
  misc_feature (1)..(127): Public GI No. 50726318
  misc_feature (1)..(127): Functional Homolog of Ceres CLONE ID no. 333753
  misc_feature (28)..(97): Pfam Name: HMG_box Pfam Description: HMG (high mobility group) box

SEQ ID NO: 1951 - protein, 231 aa, Arabidopsis thaliana
  misc_feature (1)..(231): Ceres CLONE ID no. 1911
  misc_feature (1)..(231): Functional Homolog of Ceres CLONE ID no. 36272
  misc_feature (79)..(143): Pfam Name: CBFD_NFYB_HMF Pfam Description: Histone-like transcription factor (CBF/NF-Y) and archaeal histone
MDQQDHGQSGAMNYGTNPYQTNPMSTTAATVAGGAAQPGQLAFHQIHQQQQQQQLAQQLQAFWENQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGSIPRGTVPEAAAAGYPYGYLPAGTAPIGNPGMVMGNPGGAYPPNPYMGQPMWQQQAPDQPDQEN

SEQ ID NO: 1952 - protein, 231 aa, Arabidopsis thaliana; identical to SEQ ID NO: 1951
  misc_feature (1)..(231): Public GI No. 23505813
  misc_feature (1)..(231): Functional Homolog of Ceres CLONE ID no. 36272
  misc_feature (79)..(143): Pfam Name: CBFD_NFYB_HMF Pfam Description: Histone-like transcription factor (CBF/NF-Y) and archaeal histone

SEQ ID NO: 1953 - protein, 231 aa, Arabidopsis thaliana
  misc_feature (1)..(231): Public GI No. 6289057
  misc_feature (1)..(231): Functional Homolog of Ceres CLONE ID no. 36272
  misc_feature (79)..(143): Pfam Name: CBFD_NFYB_HMF Pfam Description: Histone-like transcription factor (CBF/NF-Y) and archaeal histone
MDQQDHGQSGAMNYGTNPYQTNPMSTTAATVAGGAAQPGQLAFHQIHQQQQQQQLAQQLQAFWENQFKEIEKTTDFKKHSLPLARIKKIMKADEDVRMISAEAPVVFARACEMFILELTLRSWNHTEENKRRTLQKNDIAAAVTRTDIFDFLVDIVPREDLRDEVLGSIPRGTVPEAAAAGYPYGYLPAGTAPIGNPGMVMGNPGGAYPPNPYMGQPMWQQQAPDQPDQEN

SEQ ID NO: 1954 - protein, 208 aa, Arabidopsis thaliana
  misc_feature (1)..(208): Public GI No. 1922964
  misc_feature (1)..(208): Functional Homolog of Ceres CLONE ID no. 36272
  misc_feature (56)..(120): Pfam Name: CBFD_NFYB_HMF Pfam Description: Histone-like transcription factor (CBF/NF-Y) and archaeal histone
MSTTAATVAGGAAQPGQLAFHQIHQQQQQQQLAQQLQAFWENQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGSIPRGTVPEAAAAGYPYGYLPAGTAPIGNPGMVMGNPGGAYPPNPYMGQPMWQQQAPDQPDQEN

SEQ ID NO: 1955 - protein, 247 aa, Glycine max
  misc_feature (1)..(247): Ceres CLONE ID no. 573215
  misc_feature (1)..(247): Functional Homolog of Ceres CLONE ID no. 36272
  misc_feature (87)..(151): Pfam Name: CBFD_NFYB_HMF Pfam Description: Histone-like transcription factor (CBF/NF-Y) and archaeal histone
MGVVGSGAQLAYGSNPYQPGQITGPPGSVVTSVGTIQSTPAGAQLGQHQLAYQHIHQQQQHQLQQQLQQFWSNQYQEIEKVTDFKNHSLPLARIKKIMKADEDVRMISAEAPVIFARACEMFILELTLRSWNHTEENKRRTLQKNDIAAAITRTDIFDFLVDIVPREDLKDEVLASIPRGTMPVAGPADALPYCYMPPQHASQVGAAGVIMGKPVMDPNMYAQQSHPYMAPQMWPQPPDQRQSSPEH

SEQ ID NO: 1956 - protein, 260 aa, Glycine max
  misc_feature (1)..(260): Ceres CLONE ID no. 474481
  misc_feature (1)..(260): Functional Homolog of Ceres CLONE ID no. 36272
  misc_feature (100)..(164): Pfam Name: CBFD_NFYB_HMF Pfam Description: Histone-like transcription factor (CBF/NF-Y) and archaeal histone
MDHQGHSQNPSMGVVGSGAQLAYGSNPYQPGQITGPPGSVVTSVGTIQSTGQPAGAQLGQHQLAYQHIHQQQQHQLQQQLQQFWSSQYQEIEKVTDFKNHSLPLARIKKIMKADEDVRMISAEAPVIFARACEMFILELTLRSWNHTEENKRRTLQKNDIAAAITRTDIFDFLVDIVPREDLKDEVLASIPRGTMPVAGPADALPYCYMPPQHPSQVGAAGVIMGKPVMDPNMYAQQSHPYMAPQMWPQPPDQRQSSPEH

SEQ ID NO: 1957 - protein, 352 aa, Arabidopsis thaliana; identical to SEQ ID NO: 1844
  misc_feature (1)..(352): Ceres CLONE ID no. 19561
  misc_feature (1)..(352): Functional Homolog of Ceres CLONE ID no. 38311
  misc_feature (187)..(295): Pfam Name: B3 Pfam Description: B3 DNA binding domain
  misc_feature (63)..(112): Pfam Name: AP2 Pfam Description: AP2 domain

SEQ ID NO: 1958 - protein, 384 aa, Glycine max; identical to SEQ ID NO: 1371
  misc_feature (1)..(384): Ceres CLONE ID no. 597624
  misc_feature (1)..(384): Also Known As Ceres CDNA ID no. 23402435
  misc_feature (1)..(384): Also Known As Ceres GEMINI ID no. 531B11
  misc_feature (1)..(384): Functional Homolog of Ceres CLONE ID no. 38311
  misc_feature (204)..(318): Pfam Name: B3 Pfam Description: B3 DNA binding domain
  misc_feature (75)..(124): Pfam Name: AP2 Pfam Description: AP2 domain

SEQ ID NO: 1959 - protein, 386 aa, Capsicum annuum; identical to SEQ ID NO: 1288
  misc_feature (1)..(386): Public GI No. 33320073
  misc_feature (1)..(386): Functional Homolog of Ceres CLONE ID no. 38311
  misc_feature (199)..(305): Pfam Name: B3 Pfam Description: B3 DNA binding domain
  misc_feature (59)..(108): Pfam Name: AP2 Pfam Description: AP2 domain

SEQ ID NO: 1960 - protein, 392 aa, Triticum aestivum
  misc_feature (1)..(392): Ceres CLONE ID no. 705041
  misc_feature (1)..(392): Functional Homolog of Ceres CLONE ID no. 38311
  misc_feature (200)..(313): Pfam Name: B3 Pfam Description: B3 DNA binding domain
  misc_feature (65)..(114): Pfam Name: AP2 Pfam Description: AP2 domain
MDSARSCLVDDVSSGASTGKKASPSPAAPATKPLQRVGSGASAVMDAPEPGAEADSGRVGRLPSSKYKGVVPQPNGRWGAQIYERHQRVWLGTFTGEAEAARAYDAAAQRFRGRDAVTNFRSLTESDPEDAAELRFLAARSKAEVVDMLRKHTYPDELAQYKRAYFAAAAASSPTSSSVPPASSPSSAASPSPAARREHLFDKTVTPSDVGKLNRLVIPKQHAEKHFPLQLPSAGAAVSGECKGMLLNFDDSAGKVWRFRYSYWNSSQSYVLTKGWSRFVKEKGLHAGDAVGFYRSASGSNQLFIDCKLRSKTTTMTTTFVNAAAAPSPAPVMRTVRLFGVDLLTAPAPSHVPEHEDCSMVPKTSKRSMDANAAATPAHAVWKKRCIDFALT

SEQ ID NO: 1961 - protein, 395 aa, Zea mays
  misc_feature (1)..(395): Ceres CLONE ID no. 331400
  misc_feature (1)..(395): Functional Homolog of Ceres CLONE ID no. 38311
  misc_feature (215)..(325): Pfam Name: B3 Pfam Description: B3 DNA binding domain
  misc_feature (78)..(127): Pfam Name: AP2 Pfam Description: AP2 domain
MDSASSLVDDTSSGGGGGGGASTDKLRALAVFAAASGTPLERMGSGASAVVDAAEPGAEADSGSGAAAVSVGGKLPSSRYKGVVPQPNGRWGAQIYERHQRVWLGTFAGEADAARAYDVAAQRFRGRDAVTNFRPLADADPDAAAELRFLASRSKAEVVDMLRKHTYFDELAQNKRAFAAASAATASSLANNPSSYASLSPATATAAAAAAREHLFDKTVTPSDVGKLNRLVIPKQHAEKHFPLQLPSAGGESKGVLLNLEDAAGKVWRFRYSYWNSSQSYVLTKGWSRFVKEKGLQAGDVVGFYRSAAGADTKLFIDCKLRPNSVVAASTAGPSPRAPVAKAVRLFGVDLLTAPATAAAAPAEAVAVAGCKRARDLGSPPQAAFKKQLVELALV

SEQ ID NO: 1962 - protein, 394 aa, Oryza sativa subsp. japonica
  misc_feature (1)..(394): Public GI No. 50932645
  misc_feature (1)..(394): Functional Homolog of Ceres CLONE ID no. 38311
  misc_feature (192)..(298): Pfam Name: B3 Pfam Description: B3 DNA binding domain
  misc_feature (67)..(116): Pfam Name: AP2 Pfam Description: AP2 domain
MDSTSCLLDDASSGASTGKKAAAAAASKALQRVGSGASAVMDAAEPGAEADSGGERRGGGGGKLPSSKYKGVVPQPNGRWGAQIYERHQRVWLGTFTGEAEAARAYDVAAQRFRGRDAVTNFRPLAESDPEAAVELRFLASRSKAEVVDMLRKHTYLEELTQNKRAFAAISPPPPKHPASSPTSSSAAREHLFDKTVTPSDVGKLNRLVIPKQHAEKHFPLQLPPPTTTSSVAAAADAAAGGGDCKGVLLNFEDAAGKVWKFRYSYWNSSQSYVLTKGWSRFVKEKGLHAGDAVGFYRAAGKNAQLFIDCKVRAKPTTAAAAAAFLSAVAAAAAPPPAVKAIRLFGVDLLTAAAPELQDAGGAAMTKSKRAMDAMAESQAHVVFKKQCIELALT

SEQ ID NO: 1963 - protein, 345 aa, Gossypium hirsutum
  misc_feature (1)..(345): Public GI No. 22324807
  misc_feature (1)..(345): Functional Homolog of Ceres CLONE ID no. 475689
  misc_feature (258)..(297): Pfam Name: WD40 Pfam Description: WD domain, G-beta repeat
MENSTQESHLRSDNSVTYESAYTVYAMALSSTPSSTNINHQRIALGSFLEDYTNRVDIISFDPETLSFKTHPKLAFDHPYPPTKLMFQPNRKSASSSSSCSDLLASTGDFLRLWEVRESSIEPVTVLNNSKTSEFCAPLTSFDWNDVEPKRIGTSSIDTTCTIWDIEKCVVETQLIAHDKEVYDIAWGEARVFASVSADGSVRIFDLRDKEHSTIIYESPQPDTPLLRLAWNKQDLKYMATIQMDSNKVVILDIRSPTTPVAELERHHASVNAIAWAPQSCKHICSAGDDTQALIWELPTVAGPNGIDPLCVYSAGYEINQLQWSAAQPDWIAIAFSNKLQLLKV

SEQ ID NO: 1964 - protein, 341 aa, Arabidopsis thaliana
  misc_feature (1)..(341): Ceres CLONE ID no. 1151902
  misc_feature (1)..(341): Functional Homolog of Ceres CLONE ID no. 475689
  misc_feature (254)..(293): Pfam Name: WD40 Pfam Description: WD domain, G-beta repeat
MDNSAPDSLSRSETAVTYDSPYPLYAMAFSSLRSSSGHRIAVGSFLEDYNNRIDILSFDSDSMTVKPLPNLSFEHPYPPTKLMFSPPSLRRPSSGDLLASSGDFLRLWEINEDSSTVEPISVLNNSKTSEFCAPLTSFDWNDVEPKRLGTCSIDTTCTIWDIEKSVVETQLIAHDKEVHDIAWGEARVFASVSADGSVRIFDLRDKEHSTIIYESPQPDTPLLRLAWNKQDLRYMATILMDSNKVVILDIRSPTMPVAELERHQASVNAIAWAPQSCKHICSGGDDTQALIWELPTVAGPNGIDPMSVYSAGSEINQLQWSSSQPDWIGIAFANKMQLLRV

SEQ ID NO: 1965 - protein, 341 aa, Arabidopsis thaliana
  misc_feature (1)..(341): Public GI No. 10636051
  misc_feature (1)..(341): Functional Homolog of Ceres CLONE ID no. 475689
  misc_feature (254)..(293): Pfam Name: WD40 Pfam Description: WD domain, G-beta repeat
MDNSAPDSLSRSETAVTYDSPYPLYAMAFSSLRSSSGHRIAVGSFLEDYNNRIDILSFDSDSMTVKPLPNLSFEHPYPPTKLMFSPPSLRRPSSGDLLASFGDFLRLWEINEDSSTVEPISVLNNSKTSEFCAPLTSFDWNDVEPKRLGTCSIDTTCTIWDIEKSVVETQLIAHDKEVHDIAWGEARVFASVSADGSVRIFDLRDKEHSTIIYESPQPDTPLLRLAWNKQDLRYMATILMDSNKVVILDIRSPTMPVAELERHQASVNAIAWAPQSCKHICSGGDDTQALIWELPTVAGPNGIDPMSVYSAGSEINQLQWSSSQPDWIGIAFANKMQLLRV

SEQ ID NO: 1966 - protein, 342 aa, Malus x domestica
  misc_feature (1)..(342): Public GI No. 6752886
  misc_feature (1)..(342): Functional Homolog of Ceres CLONE ID no. 475689
  misc_feature (255)..(294): Pfam Name: WD40 Pfam Description: WD domain, G-beta repeat
MENSTQESHLRAENSVTYESPYPLYAMAFASPQTRTRHQHHRIAVGSFIEEYSNRVDILSFDPDTLSIKPNPTLSFDHPYPPTKLMFHPNPNALHKTNDVLASSGDYLRLWEVGDSTVEPIQVLNNSKTSEFCAPLTSFDWNDIEPRRIGTSSIDTTCTIWDIEKGVVETQLIAHDKEVYDIAWGEARVFASVSADGSVRIFDLRDKEHSTIIYESPQPDTPLLRLAWNKQDLRYMATILMDSNKVVILDIRSPTMPVAELERHRGSVNAIAWAPQSCRHICSAGDDTQALIWDLPTVAGPNGIDPMSMYSAGAEINQLQWSAAQPDWISIAFSNKMQLLKV

SEQ ID NO: 1967 - protein, 337 aa, Petunia x hybrida
  misc_feature (1)..(337): Public GI No. 2290532
  misc_feature (1)..(337): Functional Homolog of Ceres CLONE ID no. 475689
  misc_feature (250)..(289): Pfam Name: WD40 Pfam Description: WD domain, G-beta repeat
MENSSQESQHLRSENSVTYDSTYPIYSMAFSSFPTPRRRIAVGSFIEELNNRVELLSFNEETLTLNPIPNLSFDHPYPPTKLMFHPNPIKSNNDILASSGDYLRLWEVKESSIEPLFTLNNSKTSEYCAPLTSFDWNEVEPKRIGTSSIDTTCTIWDVEKGVVETQLIAHDKEVYDIAWGEAGVFASVSADGSVRIFDLRDKEHSTIIYESPTPDTPLLRLAWNKQDLRYMATILMDSNKVVILDIRSPAMPVAELERHQASVNAIAWAPQSCRHICSGGDDGQALIWELPTVAGPNGIDPMSMYSAGAEINQLQWSPAQRDWIAIAFSNKLQLLKV

SEQ ID NO: 1968 - protein, 356 aa, Triticum aestivum
  misc_feature (1)..(356): Ceres CLONE ID no. 783774
  misc_feature (1)..(356): Functional Homolog of Ceres CLONE ID no. 475689
  misc_feature (266)..(305): Pfam Name: WD40 Pfam Description: WD domain, G-beta repeat
MDQPKPTPSAAASPAGADAAPNPYAFTCELPHSIYALAFSPSAPVLAAGSFLEDLHNRVSLLCFDSVHPTAASFRAVPSLSFDHPYPPTKLQFNPRAASTPLLASSSDALRLWHAPLDDLSASAPAPELRSVLDNRKASASDFCAPLTSFDWNEIEPRRIGTASIDTTCTVWDIERGVVETQLIAHDKAVHDIAWGEAGVFASVSADGSVRVFDLRDKEHSTIVYESPRPDTPLLRLAWNRYDLRYMAALLMDSNAVVVLDIRAPGVPVAELHRHGGCVNAVAWAPQAARHLCSAGDDGQALIWELPEAPAAVPPEGIDPVLVYDAGAEINQLQWVAGHPDWMGISIENKVQLLRV

SEQ ID NO: 1969 - protein, 353 aa, Zea mays
  misc_feature (1)..(353): Public GI No. 37544703
  misc_feature (1)..(353): Functional Homolog of Ceres CLONE ID no. 475689
  misc_feature (174)..(211): Pfam Name: WD40 Pfam Description: WD domain, G-beta repeat
MDPPKPPSSVASSSGPETPNPHAFTCELPHSIYALAFSPVAPVLASGSFLEDLHNRVSLLSFDPVRPSAASFRALPALSFDHPYPPTKLQFNPRAAAPSLLASSADTLRIWHTPLDDLSDTAPAPELRSVLDNRKASSEFCAPLTSFDWNEVEPRRIGTASIDTTCTVWDIDRGVVETQLIAHDKAVHDIAWGEAGVFASVSADGSVRVFDLRDKEHSTIVYESPRPDTPLLRLAWNRSDLRYMAALLMDSSAVVVLDIRAPGVPVAELHRHRACANAVAWAPQATRHLCSAGDDGQALIWELPETAAAVPAEGIDPVLVYDAGAEINQLQWAAAHPDWMAIAFENKVQLLRV

SEQ ID NO: 1970 - protein, 355 aa, Oryza sativa subsp. japonica
  misc_feature (1)..(355): Public GI No. 50251896
  misc_feature (1)..(355): Functional Homolog of Ceres CLONE ID no. 475689
  misc_feature (176)..(213): Pfam Name: WD40 Pfam Description: WD domain, G-beta repeat
MEQPKPPSVAASAAEAQNPNAFTCELPHSIYALAFSPSAPVLAAGSFLEDLHNRVSLLSFDPVHPTAASFRALPALSFDHPYPPTKLQFHPRAASAPHLLASSSDALRLWLAPLDDLAATATAAAPELRSVLDNRKTSASEFCAPLTSFDWNEAEPRRIGTASIDTTCTIWDIERGVVETQLIAHDKAVHDIAWGENGIFASVSADGSVRVFDLRDKEHSTIFYESPRPDTPLLRLAWNRYDFHYMATLLMDSSAVVVLDMRAPGVPVAELHRHRACANAVAWAPQATRHLCSAGDDGQALIWELPATPGAVPAEGIDPVMVYDAGAEINQLQWAAAYPEWISIAFENKVQLLRV

SEQ ID NO: 1971 - protein, 333 aa, Perilla frutescens
  misc_feature (1)..(333): Public GI No. 14270085
  misc_feature (1)..(333): Functional Homolog of Ceres CLONE ID no. 475689
  misc_feature (246)..(285): Pfam Name: WD40 Pfam Description: WD domain, G-beta repeat
MENSTQESHPRPENVVTYDSPYPIYAMAISAVNRRRVAVGSFVEELKNHVDILSFSEDSSSLKPVPSLSFDHPYPPTKLLFHPSVSAPSNLLASSGDFLRLWEVKDSSIVAVSTLNNSKTSEYSAPLTSFDWNEVEPRRIGTSSIDTTCTIWDIEKGAVETQLIAHDKEVYDIAWGEAGVFASVSADGSVRIFDLRDKEHSTIIYESPMPDTPLLRLAWNKQDLRYMATILMDSNKIVILDIRSPTMPVAELERHSASVNAIAWAPQSCKHICSAGDDGQSLLWELPTVAGPNGIDPMTMYSAGAEINQLQWSAAQPDWIAIAFANKMQMLKV

SEQ ID NO: 1972 - protein, 163 aa, Arabidopsis thaliana; identical to SEQ ID NO: 1634
  misc_feature (1)..(163): Ceres CLONE ID no. 4267
  misc_feature (1)..(163): Functional Homolog of Ceres CLONE ID no. 560731
  misc_feature (104)..(145): Pfam Name: zf-C3HC4 Pfam Description: Zinc finger, C3HC4 type (RING finger)

SEQ ID NO: 1973 - protein, 165 aa, Zea mays; identical to SEQ ID NO: 1635
  misc_feature (1)..(165): Ceres CLONE ID no. 1377336
  misc_feature (1)..(165): Functional Homolog of Ceres CLONE ID no. 560731
  misc_feature (106)..(147): Pfam Name: zf-C3HC4 Pfam Description: Zinc finger, C3HC4 type (RING finger)

SEQ ID NO: 1974 - protein, 186 aa, Arabidopsis thaliana
  misc_feature (1)..(186): Public GI No. 28466913
  misc_feature (1)..(186): Functional Homolog of Ceres CLONE ID no. 968026
  misc_feature (25)..(149): Pfam Name: Response_reg Pfam Description: Response regulator receiver domain
MAEVMLPRKMEILNHSSKFGSPDPLHVLAVDDSHVDRKFIERLLRVSSCKVTVVDSATRALQYLGLDVEEKSVGFEDLKVNLIMTDYSMPGMTGYELLKKIKESSAFREVPVVIMSSENILPRIDRCLEEGAEDFLLKPVKLSDVKRLRDSLMKVEDLSFTKSIQKRELETENVYPVHSQLKRAKI

SEQ ID NO: 1975 - protein, 184 aa, Arabidopsis thaliana
  misc_feature (1)..(184): Public GI No. 4678318
  misc_feature (1)..(184): Functional Homolog of Ceres CLONE ID no. 968026
  misc_feature (25)..(150): Pfam Name: Response_reg Pfam Description: Response regulator receiver domain
MAEVLRPEMLDISNDTSSLASPKLLHVLAVDDSMVDRKFIERLLRVSSCKVTVVDSATRALQYLGLDGENNSSVGFEDLKINLIMTDYSMPGMTGYELLKKIKESSAFREIPVVIMSSENILPRIDRCLEEGAEDFLLKPVKLADVKRLRDSLMKAEERAFKNIMHKRELEANDIYSQLKRAKI

SEQ ID NO: 1976 - protein, 541 aa, Glycine max
  misc_feature (1)..(541): Ceres CLONE ID no. 475016
  misc_feature (1)..(541): Functional Homolog of  Ceres CLONE ID no. 109490
  misc_feature (145)..(451): Pfam Name: GRAS Pfam Description: GRAS family transcription factor
  misc_feature (145)..(451): Pfam Name: GRAS Pfam Description: GRAS family transcription factor
MQASEQHRNSSMYYQPLQQIEAYCLPQYRTLNPQLYYHDGGHGTQFSTPSSSELYCTLESSSVALYNSPSTVSFSPNGSPISQQDSQSYPPDQYHSPENTYGSPMSGSCITDDLSSFNLKHKLRELESVMLGPDSDNLDSYDSAISNGNNFVPLEMDGWKQTMVAISSKNLKHILIACAKAISDDDLLMAQWLMDELRQMVSVSGDPFQRLGAYMLEGLVARLAASGSSIYKSLRCKEPESAELLSYMHILYEVCPYFKFGYMSANGAIAEAMKDEDRVHIIDFQIGQGSQWITLIQAFAARPGGPPHIRITGIDDSTSAYARGGGLHIVGRRLSKLAEHFKVPFEFHAAAISGCDVQLHNLGVRPGEALAVNFAFMLHHMPDESVSTQNHRDRLLRLVRSLSPKVVTLVEQESNTNTAAFFPRFLETLDYYTAMFESIDVTLSREHKERINVEQHCLARDLVNIIACEGVERVERHEVLGKWRSRFAMAGFTPYPLSSLVNGTIKKLLENYSDRYRLQERDGALYLGWMNRDLVASCAWK

SEQ ID NO: 1977 - protein, 554 aa, Zea mays
  misc_feature (1)..(554): Ceres CLONE ID no. 1571937
  misc_feature (1)..(554): Functional Homolog of  Ceres CLONE ID no. 109490
  misc_feature (154)..(464): Pfam Name: GRAS Pfam Description: GRAS family transcription factor
  misc_feature (184)..(464): Pfam Name: GRAS Pfam Description: GRAS family transcription factor
MADTPTSRMVHPFGDVPRQTPKQFLYSGNPQHLCHPYQSAPDAHVVPQRRYTVRSQSHSPNNAGSQDHETHKQYTLESSAASGCSRHGSPSSQSVHAGSGSPVSHDDSHSGSTNGHGSPVSASCVTGEDPTDLKQKLKDLEAVMLGTSETDPEIVNSLEISAANQLSLEPEEWEHMVSMPRGNLKELLIACARAVERYNTYAIDLMITELRKMVSVSGEPLERLGAYMVEGLVARLAASGSSIYKALKCKEPRSSDLLSYMHFLYEACPYFKFGYMSANGAIAEAIKGEDRIHIIDFHIAQGAQWVSLLQALAARPGGPPFVRVTGIDDSVSAYARGGGLELVGRRLTHIAGLYKVPFQFDALAISGSEVEEEHLGVVPGEAVAVNFTLELHHIPDETVSTANHRDRILRLVKGLSPKVLTLVEQESNTNTAPFAQRFAETLDYYTAIFESIDLALPRDDRERINIEQHCLAREIVNLVACEGEERVERHEVFGKWKARLMMAGFSPSPLSALVNATIKTLLQSYSPDYKLAERDGVLYLGWKNRPLIVSSAWH

SEQ ID NO: 1978 - protein, 553 aa, Oryza sativa subsp. japonica
  misc_feature (1)..(553): Public GI no. 34907424
  misc_feature (1)..(553): Functional Homolog of  Ceres CLONE ID no. 109490
  misc_feature (159)..(463): Pfam Name: GRAS Pfam Description: GRAS family transcription factor
MSFIRRADPSTTYADNLYIHKFGTPNSNFAARRYASDTQLFRYGPEPYNPENSFYNQQASPMPYMVTADGHSPSSADNSCSDVAKDSPLVSNVSQQNSQSISDNQSSELEVEFDEDDIRMKLQELEHALLDDSDDILYEISQAGSINDEWADPMKNVILPNSPKESESSISCAGSNNGEPRTPKQLLFDCAMALSDYNVDEAQAIITDLRQMVSIQGDPSQRIAAYLVEGLAARIVASGKGIYKALSCKEPPTLYQLSAMQILFEICPCFRFGFMAANYAILEACKGEDRVHIIDFDINQGSQYITLIQFLKNNANKPRHLRITGVDDPETVQRTVGGLKVIGQRLEKLAEDCGISFEFRAVGANIGDVTPAMLDCCPGEALVVNFAFQLHHLPDESVSIMNERDQLLRMVKGLQPKLVTLVEQDANTNTAPFQTRFREVYDYYAALFDSLDATLPRESPDRMNVERQCLAREIVNILACEGPDRVERYEVAGKWRARMTMAGFTPCPFSSNVISGIRSLLKSYCDRYKFEEDHGGLHFGWGEKTLIVSSAWQ

SEQ ID NO: 1979 - protein, 267 aa, Brassica napus
  misc_feature (1)..(267): Ceres CLONE ID no. 975220
  misc_feature (1)..(267): Functional Homolog of  Ceres CLONE ID no. 34589
  misc_feature (80)..(125): Pfam Name: Myb_DNA-binding Pfam Description: Myb-like DNA-binding domain
  misc_feature (175)..(175): Xaa is any aa, unknown, or other
  misc_feature (185)..(185): Xaa is any aa, unknown, or other
  misc_feature (217)..(217): Xaa is any aa, unknown, or other
  misc_feature (218)..(218): Xaa is any aa, unknown, or other
  misc_feature (255)..(255): Xaa is any aa, unknown, or other
MNVAVIGLVGLRKMGRKTWVDGDGMKKGEWTAEEDQNLVAYINEHGVSDWRSLPKRAGLQRCGKSCRLRWLNYLRPGIKRGKFTPQEEEEIIKLHAVLGNRWAAIAKEMDNRTDNDIKNHWNSCLKKRLSRKGIDPMTHEPIINNLTVTITNEECGSSSITTFSPTSSPSGSACXLNKLATGISXRQHDLDKIKSILLEPRIASSDQDEKEEVKRDXXIGGGEEGDDFLIWDDEEVRRFMESDEMEYGTTPYVSXFYESTHVLDDLL

SEQ ID NO: 1980 - protein, 203 aa, Oryza sativa subsp. japonica
  misc_feature (1)..(203): Public GI no. 50940237
  misc_feature (1)..(203): Functional Homolog of Ceres Clone ID  no. 208429
  misc_feature (93)..(154): Pfam Name: HMG_box Pfam Description: HMG (high mobility group) box
MAGKSGARTRKRVEATDSAVLKRARDGSAFTRCEACGKSVSVVLIDMHNCSLDDKIRISLEAQVVEQAVEVAASKKKSGKNNNNNGEGAKKGKRPPTAFFLFMSDFRKEYKAEHPDNKSVSAVAKEGGERWKSMSDEDKKPYLDKAAELKAEYHNGERSDENNVGGNAGEQEVDQPPKKGTDEDDQEDEDGAEEEKNELDDDI

SEQ ID NO: 1981 - protein, 216 aa, Triticum aestivum
  misc_feature (1)..(216): Ceres CLONE ID  no. 617111
  misc_feature (1)..(216): Functional Homolog of Ceres Clone ID  no. 208429
  misc_feature (101)..(162): Pfam Name: HMG_box Pfam Description: HMG (high mobility group) box
MATAGNAPRSRKRVEATVLKRARDGSAFTRCEACNKDVAIVLIDLHSCSLDSKIRLSLESQVVEKAVEIQEKKRKTPSAAAGGKGKKKSKADGDGAKKPKAKRPPTAFFLFMKDFRVEFKASHPDEKGVAAVGKAAGEKWKSMTEEEKKPYNDQAKELKAQFANGEGSAENNVGDEEKADADAEEVEDAEQEVDKPEDAPEDEEEEEEKNELDDDI

SEQ ID NO: 1982 - protein, 241 aa, Arabidopsis thaliana; identical to SEQ ID NO: 1132
  misc_feature (1)..(241): Ceres CLONE ID  no. 207075
  misc_feature (1)..(241): Functional Homolog of Ceres Clone ID  no. 208429
  misc_feature (115)..(183): Pfam Name: HMG_box Pfam Description: HMG (high mobility group) box

SEQ ID NO: 1983 - protein, 241 aa, Arabidopsis thaliana; identical to SEQ ID NO: 1132
  misc_feature (1)..(241): Public GI no. 21554154
  misc_feature (1)..(241): Functional Homolog of Ceres Clone ID  no. 208429
  misc_feature (115)..(183): Pfam Name: HMG_box Pfam Description: HMG (high mobility group) box

SEQ ID NO: 1984 - protein, 226 aa, Arabidopsis thaliana
  misc_feature (1)..(226): Public GI no. 9759080
  misc_feature (1)..(226): Functional Homolog of Ceres Clone ID  no. 208429
  misc_feature (100)..(168): Pfam Name: HMG_box Pfam Description: HMG (high mobility group) box
MAGPSTTSNAPKQRKRVEAETSSNTSTTLRRAKDGSAFALCLCVFGCCCCCCSEAQVVETQAEAKKKPAEKKKTTSDGPKPKRLKKTNDEKKSSSTSNKPKRPLTAFFIFMSDFRKTFKSEHNGSLAKDAAKIGGEKWKSLTEEEKKVYLDKAAELKAEYNKSLESNDADEEEEDEEKQSDDVDDAEEKQVDDDDEVEEKEVENTDDDKKEAEGKEEEEEEILDDY

SEQ ID NO: 1985 - protein, 209 aa, Glycine max
  misc_feature (1)..(209): Ceres CLONE ID  no. 471377
  misc_feature (1)..(209): Functional Homolog of Ceres Clone ID  no. 208429
  misc_feature (103)..(172): Pfam Name: HMG_box Pfam Description: HMG (high mobility group) box
  misc_feature (9)..(9): Xaa is any aa, unknown, or other
  misc_feature (13)..(13): Xaa is any aa, unknown, or other
MASSQSRKXVDAXDSRAASVLVRAKDGSAFARCDDCKKNVPVALIDMHSCSLEAKIKMNLDAQVVEQAAEAKKPERKKPKSKEPMAKKAKVGKGKKVKDPNMPKRPPTAFFVFLDDFRKSFKEANPDSKDVKRVGKEAGEKWRSMTDEEKKPYLDKVAELKEEYEKAMESYEAGQDEEDQTVSDKETSDKEAAAKEVAIEVEEELTDED

SEQ ID NO: 1986 - protein, 181 aa, Arabidopsis thaliana
  misc_feature (1)..(181): Ceres CLONE ID  no. 14909
  misc_feature (1)..(181): Functional Homolog of Ceres Clone ID  no. 34414
  misc_feature (5)..(177): Pfam Name: Arf Pfam Description: ADP-ribosylation factor family
MGLSFGKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 1987 - protein, 181 aa, Arabidopsis thaliana
  misc_feature (1)..(181): Ceres CLONE ID  no. 33126
  misc_feature (1)..(181): Functional Homolog of Ceres Clone ID  no. 34414
  misc_feature (1)..(177): Pfam Name: Arf Pfam Description: ADP-ribosylation factor family
MGLSFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIAGKA

SEQ ID NO: 1988 - protein, 181 aa, Arabidopsis thaliana; identical to SEQ ID NO: 1987
  misc_feature (1)..(181): Ceres CLONE ID  no. 1338585
  misc_feature (1)..(181): Functional Homolog of Ceres Clone ID  no. 34414
  misc_feature (1)..(177): Pfam Name: Arf Pfam Description: ADP-ribosylation factor family

SEQ ID NO: 1989 - protein, 181 aa, Medicago sativa
  misc_feature (1)..(181): Public GI no. 39653273
  misc_feature (1)..(181): Functional Homolog of Ceres Clone ID  no. 34414
  misc_feature (5)..(177): Pfam Name: Arf Pfam Description: ADP-ribosylation factor family
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 1990 - protein, 181 aa, Zea mays
  misc_feature (1)..(181): Ceres CLONE ID  no. 276776
  misc_feature (1)..(181): Functional Homolog of Ceres Clone ID  no. 34414
  misc_feature (1)..(177): Pfam Name: Arf Pfam Description: ADP-ribosylation factor family
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKS

SEQ ID NO: 1991 - protein, 181 aa, Zea mays; identical to SEQ ID NO: 1231
  misc_feature (1)..(181): Ceres CLONE ID  no. 1535974
  misc_feature (1)..(181): Functional Homolog of Ceres Clone ID  no. 34414
  misc_feature (5)..(177): Pfam Name: Arf Pfam Description: ADP-ribosylation factor family

SEQ ID NO: 1992 - protein, 181 aa, Zea mays; identical to SEQ ID NO: 1990
  misc_feature (1)..(181): Ceres CLONE ID  no. 240510
  misc_feature (1)..(181): Functional Homolog of Ceres Clone ID  no. 34414
  misc_feature (1)..(177): Pfam Name: Arf Pfam Description: ADP-ribosylation factor family

SEQ ID NO: 1993 - protein, 211 aa, Oryza sativa subsp. japonica
  misc_feature (1)..(211): Public GI no. 52077327
  misc_feature: Bit Score of  519.0 for HMM based on sequences of FIGURE 119
  misc_feature (1)..(211): Functional Homolog of Ceres Clone ID  no. 552542
  misc_feature (51)..(96): Pfam Name: zf-B_box Pfam Description: B-box zinc finger
MRTICDVCESAPAVLFCVADEAALCRSCDEKVHMCNKLARRHVRVGLADPNKVQRCDICENAPAFFYCEIDGTSLCLSCDMTVHVGGKRTHGRYLLLRQRVEFPGDKPGHMDDVAMQQKDPENRTDQKKAPHSVTKEQMANHHNVSDDPASDGNCDDQGNIDSKMIDLNMRPVRTHGQGSNSQTQGVDVSVNNHDSPGVVPTCNFEREANK

SEQ ID NO: 1994 - protein, 212 aa, Glycine max
  misc_feature (1)..(212): Ceres CLONE ID  no. 1044645
  misc_feature: Bit Score of 496.7 for HMM based on sequences of FIGURE 119
  misc_feature (1)..(212): Functional Homolog of Ceres Clone ID  no. 552542
  misc_feature (51)..(96): Pfam Name: zf-B_box Pfam Description: B-box zinc finger
MRTLCDVCESAAAILFCAADEAALCSACDHKIHMCNKLASRHVRVGLADPTDVPRCDICENAPAFFYCEIDGSSLCLQCDMIVHVGGKRTHGRYLLLRQRAQFPGDKPAQMEELELQPMDQNESRRDESQSLKLKTRDSQQNHSVSPFPRQENNIDGHGKMDKKLIDLNTRPLRLNGSAPNNQEQCMDILRGNNHESASVPPVESFKQESEK

SEQ ID NO: 1995 - protein, 206 aa, Zea mays
  misc_feature (1)..(206): Ceres CLONE ID  no. 1548279
  misc_feature: Bit Score of  495.6 for HMM based on sequences of FIGURE 119
  misc_feature (1)..(206): Functional Homolog of Ceres Clone ID  no. 552542
  misc_feature (51)..(96): Pfam Name: zf-B_box Pfam Description: B-box zinc finger
MRTICDVCESAPAVLFCAADEAALCRPCDEKVHMCNKLASRHVRVGLADPNKLVRCDICENSPAFFYCEIDGTSLCLSCDMTVHVGGKRTHGRYLLLRQRVEFPGDKPGHMDDVPMEIQDPENQRDQKKPPKEQTANHHNGDDPATDGNCDDQGNIDSKMIDLNMRPVRTHGQESNSQTQGVGLSVNNHDSPGVVPTSNSERDTSK

SEQ ID NO: 1996 - protein, 211 aa, Triticum aestivum
  misc_feature (1)..(211): Ceres CLONE ID  no. 727056
  misc_feature: Bit Score of 505.7 for HMM based on sequences of FIGURE 119
  misc_feature (1)..(211): Functional Homolog of Ceres Clone ID  no. 552542
  misc_feature (51)..(96): Pfam Name: zf-B_box Pfam Description: B-box zinc finger
MRTICDVCESAVAVLFCAADEAALCRPCDEKVHMCNKLASRHVRVGLADPNKLVRCDICESSPAFFYCDIDGTSLCLSCDMAVHVGGKRTHGRYLLLRQRVEFPGDKPGHMDDVAMQQMESENPRDQNNAHSVEKEQMVNHHHNAYDPASDGNCNGQGAIDSKMFDLNMRPARNNGQGSSSQTHGVDHSHNNNHDSSGVVPTCNYDGATDK

SEQ ID NO: 1997 - protein, 223 aa, Gossypium hirsutum
  misc_feature (1)..(223): Public GI no. 23194453
  misc_feature (1)..(223): Functional Homolog of Ceres Clone ID  no. 32791
  misc_feature (74)..(173): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENTTNRQVTFCKRRNGLLKKAYELSVLCDAEVALIVFSSRGRLYEYSNNNIRSTIDRYKKACSDTSNTNTVTEINAQYYQQESAKLRQQIQMLQNSNRHLMGDSLSSLTVKELKQVENRLERGITRIRSKKHEMLLAEIEFLQKREIELENESVCLRTKIAEIERLQQANMVTGPELNAIQALASRNFFSPNVIEHPSAYSHPSDKKILHLG

SEQ ID NO: 1998 - protein, 207 aa, Malus x domestica
  misc_feature (1)..(207): Public GI no. 3646326
  misc_feature (1)..(207): Functional Homolog of Ceres Clone ID  no. 32791
  misc_feature (89)..(157): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENTTNRQVTFCKRRNGLLKKAYELSILCDAEVALIVFSTRGRLYEYSNNNSIRNTIERYKKACSDSTGSSSVTEINAQNSNRHLMGDALSTLTVKELKQVENRLERGITRIRSKKHELLLAEIEYFQKKEIELENENVYFRTKVSEVERLQQANMVSGSEMNAIQALASRHFFSQNMIEGGEATFPQQDKKNLHLG

SEQ ID NO: 1999 - protein, 222 aa, Glycine max
  misc_feature (1)..(222): Ceres CLONE ID  no. 1044034
  misc_feature (1)..(222): Functional Homolog of Ceres Clone ID  no. 32791
  misc_feature (74)..(173): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENTTNRQVTFCKRRNGLLKKAYELSVLCDAEVALIVFSSRGRLYEYSNNNIRSTIERYKKACSDHSSASTTTEINAQYYQQESAKLRQQIQMLQNSNRHLMGDALSTLTVKELKQLENRLERGITRIRSKKHEMLLAEIEYFQKREIELENENLCLRTKITDVERIQQVNMVSGPELNAIQALASRNFFNPNMLEGGTVYPHSDKKILHLG

SEQ ID NO: 2000 - protein, 225 aa, Cucumis sativus
  misc_feature (1)..(225): Public GI no. 4103342
  misc_feature (1)..(225): Functional Homolog of Ceres Clone ID  no. 32791
  misc_feature (74)..(173): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENTTNRQVTFCKRRNGLLKKAYELSVLCDAEVALIVFSSRGRLYEYSNNSIKTTIERYKKACSDSSATSSVTELNTQYYQQESAKLRQQIQMLQNSNRHLMGDSLSALTVKELKQLENRLERGITRIRSKKHEMLLAEIEYLQKREIELENENVCIRTKIAEVERVQQANMVSGQELNAIQALANSRNFFSPNIMEPAGPVSYSHQDKKMLHLG

SEQ ID NO: 2001 - protein, 229 aa, Cucumis sativus
  misc_feature (1)..(229): Public GI no. 2997615
  misc_feature (1)..(229): Functional Homolog of Ceres Clone ID  no. 32791
  misc_feature (74)..(177): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENTTNRQVTFCKRRNGLLKKAYELSVLCDAEVALIVFSSRGRLYEYSNNSIKTTIERYKKACSDSSATSSVTELNTQYYQQESAKLRQQIQMLQNSNSNLVRHLMGDSLSALTVKELKQLENRLERGITRIRSKKHEMLLAEIEYLQKREIELENENVCIRTKIAEVERVQQANMVSGQELNAIQALANSRNFFSPNIMEPAGPVSYSHQDKKMLHLG

SEQ ID NO: 2002 - protein, 234 aa, Asparagus virgatus
  misc_feature (1)..(234): Public GI no. 57157565
  misc_feature (1)..(234): Functional Homolog of Ceres Clone ID  no. 32791
  misc_feature (74)..(174): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENTTNRQVTFCKRRNGLLKKAYELSVLCDAEVALIVFSSRGRLYEYANNSIKSTIERYKKACADSSNSNAVIEVNSQQYYQQEAAKLRHQIQILQNANRHLMGDSLSSLTVKELKQLENRLERGITRIRSKKHELLFAEIEYMQKREAELQNDNMYLRAKISENERAHQVSVVQPGPEFDTLPTFDSRNYYNVHMLEAAPHYSHHQDQTALHLGYENKADPAA

SEQ ID NO: 2003 - protein, 225 aa, Meliosma dilleniifolia
  misc_feature (1)..(225): Public GI no. 42794560
  misc_feature (1)..(225): Functional Homolog of Ceres Clone ID  no. 32791
  misc_feature (74)..(173): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENTTNRQVTFCKRRNGLLKKAYELSVLCDAEVALIVFSTRGRLYEYANNSVKATIDRYKKACADTSNTGSVSEANAQFYQQESSKLRQQIVILQNSNRHLMGEALSAMTVKELKQLEGRLEKGISRIRSKKNEMLFAEIEYMQKREIDMQNDNMYLRAKIAENERAQQHMSMMPTSEYEAMPPQQFDSRNFLQVNLLEPNHHYSRQEQTALQLG

SEQ ID NO: 2004 - protein, 235 aa, Agapanthus praecox
  misc_feature (1)..(235): Public GI no. 29467048
  misc_feature (1)..(235): Functional Homolog of Ceres Clone ID  no. 32791
  misc_feature (74)..(174): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENTTNRQVTFCKRRNGLLKKAYELSVLCDAEVALIVFSTRGRLYEYSNNSIKSTIERYKKACADSSNSTAVVEVNTQQYYQQEAAKLRHQIQSLQNSNRHLMGDSLSSLSIKELKQLENRLERGITRIRSKKHELLFAEIEYMQKREAELQNDNMYLRAKITDNERAHQVSVVQSGTEYDTLPTFDSRNYYTHVTMLEAAPHFSHHQDHTALHLGYETKADPTE

SEQ ID NO: 2005 - protein, 225 aa, Petunia x hybra
  misc_feature (1)..(225): Public GI no. 1067169
  misc_feature (1)..(225): Functional Homolog of Ceres Clone ID  no. 32791
  misc_feature (71)..(173): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENNTNRQVTFCKRRNGLLKKAYELSVLCEAEIALIVFSTRGRVYEYSNNNIRAIIDRYKKATVETSNAFTTQELNAQFYQQESKKLRQQIQLIQNSNRHLVGEGLSSLNVRELKQLENRLERGIARIRSKKHEMILAESEDLQKREIQLEQENAFLRSKIAENERLQELSMMPAGGQEYNAIQQYLARNMLQLNMMEGVPSYPLPSDKKSLDLE

SEQ ID NO: 2006 - protein, 241 aa, Zea mays; identical to SEQ ID NO: 1684
  misc_feature (1)..(241): Public GI no. 52140010
  misc_feature (1)..(241): Functional Homolog of Ceres Clone ID  no. 7559
  misc_feature (9)..(77): Pfam Name: RRM_1 Pfam Description: RNA recognition motif. (a.k.a. RRM, RBD, or RNP domain)

SEQ ID NO: 2007 - protein, 313 aa, Arabidopsis thaliana
  misc_feature (1)..(313): Public GI no. 25405956
  misc_feature (1)..(313): Functional Homolog of Ceres Clone ID  no. 108109
  misc_feature (10)..(57): Pfam Name: zf-B_box Pfam Description: B-box zinc finger
  misc_feature (265)..(309): Pfam Name: CCT Pfam Description: CCT motif
MISKYQEDVKQPRACELCLNKHAVWYCASDDAFLCHVCDESVHSANHVATKHERVCLRTNEISNDVRGGTTLTSVWHSGFRRKARTPRSRYEKKPQQKIDDERRREDPRVPEIGGEVMFFIPEANDDDMTSLVPEFEGFTEMGFFLSNHNGTEETTKQFNFEEEADTMEDLYYNGEEEDKTDGAEACPGQYLMSCKKDYDNVITVSEKTEEIEDCYENNARHRLNYENVIAAWDKQESPRDVKNNTSSFQLVPPGIEEKRVRSEREARVWRYRDKRKNRLFEKKIRYEVRKVNADKRPRMKGRFVRRSLAIDS

SEQ ID NO: 2008 - protein, 326 aa, Arabidopsis thaliana
  misc_feature (1)..(326): Public GI no. 30694486
  misc_feature (1)..(326): Functional Homolog of Ceres Clone ID  no. 108109
  misc_feature (23)..(70): Pfam Name: zf-B_box Pfam Description: B-box zinc finger
  misc_feature (278)..(322): Pfam Name: CCT Pfam Description: CCT motif
MTSHQNIKISEKIMISKYQEDVKQPRACELCLNKHAVWYCASDDAFLCHVCDESVHSANHVATKHERVCLRTNEISNDVRGGTTLTSVWHSGFRRKARTPRSRYEKKPQQKIDDERRREDPRVPEIGGEVMFFIPEANDDDMTSLVPEFEGFTEMGFFLSNHNGTEETTKQFNFEEEADTMEDLYYNGEEEDKTDGAEACPGQYLMSCKKDYDNVITVSEKTEEIEDCYENNARHRLNYENVIAAWDKQESPRDVKNNTSSFQLVPPGIEEKRVRSEREARVWRYRDKRKNRLFEKKIRYEVRKVNADKRPRMKGRFVRRSLAIDS

SEQ ID NO: 2009 - protein, 267 aa, Zea mays
  misc_feature (1)..(267): Ceres CLONE ID  no. 354956
  misc_feature (1)..(267): Functional Homolog of Ceres Clone ID  no. 108109
  misc_feature (213)..(259): Pfam Name: CCT Pfam Description: CCT motif
MASAGGRRRSKAKPRARAGGKAKKRTKYLSLTELLVKAHAQVGASPRSPWEDEEAVAAEVKPEDDACGDDDDDHHHHHHEASTLFEAVPAPSLSDILGPSPPESPAGSGSGALPGAEEEDLPRRALRGRARERWVYCTGGPSPPPPATATGTATATASPCSSAASTGASPRSLLLKLDYDEILAAWAGCGPLYIGAAVSPRPVLADAEVAVGRAERVRRYREKRRRRRLFFARRVRYEVRRLNAVKRPRFKGRFIKEEERELRPAPA

SEQ ID NO: 2010 - protein, 342 aa, Brassica nigra
  misc_feature (1)..(342): Public GI no. 22854970
  misc_feature (1)..(342): Functional Homolog of Ceres Clone ID  no. 108109
  misc_feature (274)..(318): Pfam Name: CCT Pfam Description: CCT motif
  misc_feature (50)..(97): Pfam Name: zf-B_box Pfam Description: B-box zinc finger
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 2011 - protein, 342 aa, Brassica nigra
  misc_feature (1)..(342): Public GI no. 22854950
  misc_feature (1)..(342): Functional Homolog of Ceres Clone ID  no. 108109
  misc_feature (274)..(318): Pfam Name: CCT Pfam Description: CCT motif
  misc_feature (50)..(97): Pfam Name: zf-B_box Pfam Description: B-box zinc finger
  misc_feature (177)..(177): Xaa is any aa, unknown, or other
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFXGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 2012 - protein, 225 aa, Glycine max
  misc_feature (1)..(225): Ceres CLONE ID  no. 659723
  misc_feature: Bit Score of 530.2 for HMM based on sequences of FIGURE 74
  misc_feature (1)..(225): Functional Homolog of Ceres Clone ID  no. 21604
  misc_feature (70)..(134): Pfam Name: CBFD_NFYB_HMF Pfam Description: Histone-like transcription factor (CBF/NF-Y) and archaeal histone
  misc_feature (156)..(156): Xaa is any aa, unknown, or other
  misc_feature (157)..(157): Xaa is any aa, unknown, or other
  misc_feature (162)..(162): Xaa is any aa, unknown, or other
  misc_feature (205)..(205): Xaa is any aa, unknown, or other
METNNQQQQQQGAQAQSGPYPVAGAGGSAGAGAGAPPPFQHLLQQQQQQLQMFWSYQRQEIEHVNDFKNHQLPLARIKKIMKADEDVRMISAEAPILFAKACELFILELTIRSWLHAEENKRRTLQKNDIAAAITRTDIFDFLVDIVPRDEIKDDXXSCGGXRQWGALLLPAHWTACRDDDWPPRRRSRHRGLCPAALPGMAVRXAVRCRGRFLWHRRGRCPAEP

SEQ ID NO: 2013 - protein, 246 aa, Brassica napus
  misc_feature (1)..(246): Ceres CLONE ID  no. 953644
  misc_feature: Bit Score of 604.8 for HMM based on sequences of FIGURE 74
  misc_feature (1)..(246): Functional Homolog of Ceres Clone ID  no. 21604
  misc_feature (76)..(140): Pfam Name: CBFD_NFYB_HMF Pfam Description: Histone-like transcription factor (CBF/NF-Y) and archaeal histone
  misc_feature (212)..(212): Xaa is any aa, unknown, or other
MDNNNQQPPPPPTSVYPPASAATAIPPPPPSGSTPIIPGGGGASYHHLLQQQLQQLQMFWSYQRKEIEQVNDFKNHQLPLARIKKIMKADEDVRMISAEAPILFAKACELFILELTIRSWLHAEENKRRTLQKNDIAAAITRTDIFDFLVDIVPREEIKEEEEAALGSMVAAPAVSGVPYYYPPMGQPAVPGGMMIGRPAMDPSGVYAQPPXQAWQSVWQNSAAGDDVSYGSGGSSGGHGNLDNQG

SEQ ID NO: 2014 - protein, 245 aa, Zea mays
  misc_feature (1)..(245): Ceres CLONE ID  no. 1585988
  misc_feature: Bit Score of 561.5 for HMM based on sequences of FIGURE 74
  misc_feature (1)..(245): Functional Homolog of Ceres Clone ID  no. 21604
  misc_feature (68)..(132): Pfam Name: CBFD_NFYB_HMF Pfam Description: Histone-like transcription factor (CBF/NF-Y) and archaeal histone
MDNQPLPYSTGQPPAPGGAPVAGMPGAAGLPPVPHHHLLQQQQAQLQAFWAYQRQEAERASASDFKNHQLPLARIKKIMKADEDVRMISAEAPVLFAKACELFILELTIRSWLHAEENKRRTLQRNDVAAAIARTDVFDFLVDIVPREEAKEEPGSALGFAAPGTGVVGAGAPGGAPAAGMPYYYPPMGQPAPMMPAWHVPAWDPAWQQGAADVDQSGSFSEEGQGFGAGHGGAASFPPAPPTSE

SEQ ID NO: 2015 - protein, 200 aa, Zea mays
  misc_feature (1)..(200): Ceres CLONE ID  no. 245683
  misc_feature: Bit Score of 469.5 for HMM based on sequences of FIGURE 74
  misc_feature (1)..(200): Functional Homolog of Ceres Clone ID  no. 21604
  misc_feature (81)..(145): Pfam Name: CBFD_NFYB_HMF Pfam Description: Histone-like transcription factor (CBF/NF-Y) and archaeal histone
MDPNKSSTPPPPPVMGAPVAYPPPAYPPGVAAGAGAYPPQLYAPPAAAAAQQAAAAQQQQLQIFWAEQYREIEATTDFKNHNLPLARIKKIMKADEDVRMIAAEAPVVFARACEMFILELTHRGWAHAEENKRRTLQKSDIAAAIARTEVFDFLVDIVPRDDGKDADAAAAAAAAAAGIPRPAAGVPATDPLAYYYVPQQ

SEQ ID NO: 2016 - protein, 200 aa, Zea mays; identical to SEQ ID NO: 2015
  misc_feature (1)..(200): Ceres CLONE ID  no. 1283552
  misc_feature: Bit Score of 469.5 for HMM based on sequences of FIGURE 74
  misc_feature (1)..(200): Functional Homolog of Ceres Clone ID  no. 21604
  misc_feature (81)..(145): Pfam Name: CBFD_NFYB_HMF Pfam Description: Histone-like transcription factor (CBF/NF-Y) and archaeal histone

SEQ ID NO: 2017 - protein, 200 aa, Zea mays
  misc_feature (1)..(200): Ceres CLONE ID  no. 272426
  misc_feature: Bit Score of 440.5 for HMM based on sequences of FIGURE 74
  misc_feature (1)..(200): Functional Homolog of Ceres Clone ID  no. 21604
  misc_feature (84)..(148): Pfam Name: CBFD_NFYB_HMF Pfam Description: Histone-like transcription factor (CBF/NF-Y) and archaeal histone
MEPKSTTPPPPPVMGAPIAYPPPPGAAYPAGPYVHAPAAALYPPPPLPPAPPSSQQGAAAAHQQQLFWAEQYREIEATTDFKNHNLPLARIKKIMKADEDVRMIAAEAPVVFSRACEMFILELTHRGWAHAEENKRRTLQKSDIAAAVARTEVFDFLVDIVPRDEAKDADSAAMGAAGIPHPAAGLPAADPMGYYYVQPQ

SEQ ID NO: 2018 - protein, 256 aa, Triticum aestivum
  misc_feature (1)..(256): Ceres CLONE ID  no. 824827
  misc_feature: Bit Score of 531.5 for HMM based on sequences of FIGURE 74
  misc_feature (1)..(256): Functional Homolog of Ceres Clone ID  no. 21604
  misc_feature (99)..(163): Pfam Name: CBFD_NFYB_HMF Pfam Description: Histone-like transcription factor (CBF/NF-Y) and archaeal histone
MEPSSQPEPVVGVATAGSQAYPPPAAYPAPAMPAAIPPGSQPAVPFPANPAQLSAQHQLVYQQAQQFHQQLQQQQQQQLREFWATQMEEIEQATDFKNHTLPLARIKKIMKADEDVRMISAEAPVVFAKACEVFILELTLRSWMHTEENKRRTLQKNDIAAAITRTDIYDFLVDIIPRDDMKEEGLGLPRVGLPPAALGAPADAYPPYYYVPAQQVPGVGMMYGGQQGHPVAYAWQQPQGQQAEEAPEEQQQSPSN

SEQ ID NO: 2019 - protein, 282 aa, Arabidopsis thaliana
  misc_feature (1)..(282): Public GI no. 56749359
  misc_feature (1)..(282): Functional Homolog of Ceres Clone ID  no. 120302
  misc_feature (67)..(112): Pfam Name: Myb_DNA-binding Pfam Description: Myb-like DNA-binding domain
MGRSPCCEKAHTNKGAWTKEEDERLVAYIKAHGEGCWRSLPKAAGLLRCGKSCRLRWINYLRPDLKRGNFTEEEDELIIKLHSLLGNKWSLIAGRLPGRTDNEIKNYWNTHIRRKLINRGIDPTSHRPIQESSASQDSKPTQLEPVTSNTINISFTSAPKVETFHESISFPGKSEKISMLTFKEEKDECPVQEKFPDLNLELRISLPDDVDRLQGHGKSTTPRCFKCSLGMINGMECRCGRMRCDVVGGSSKGSDMSNGFDFLGLAKKETTSLLGFRSLEMK

SEQ ID NO: 2020 - protein, 282 aa, Arabidopsis thaliana
  misc_feature (1)..(282): Public GI no. 3941412
  misc_feature (1)..(282): Functional Homolog of Ceres Clone ID  no. 120302
  misc_feature (67)..(112): Pfam Name: Myb_DNA-binding Pfam Description: Myb-like DNA-binding domain
MGRSPCCEKAHTNKGAWTKEEDERLVAYIKAHGEGCWRSLPKAAGLLRCGKSCRLRWINYLRPDLKRGNFTEEEDELIIKLHSLLGNKWSLIAGRLPGRTDNEIKNYWNTHIRRKLINRGIDPTSHRPIQESSASQDSKPIQLEPVTSNTINISFTSAPKVETFHESISFPGKSEKISMLTFKEEKDECPVQEKFPDLNLELRISLPDDVDRLQGHGKSTTPRCFKCSLGMINGMECRCGRMRCDVVGGSSKGSDMSNGFDFLGLAKKETTSLLGFRSLEMK

SEQ ID NO: 2021 - protein, 220 aa, Dendrobium sp. XMW-2002-10
  misc_feature (1)..(220): Public GI no. 28628965
  misc_feature (1)..(220): Functional Homolog of Ceres Clone ID  no. 120302
  misc_feature (67)..(112): Pfam Name: Myb_DNA-binding Pfam Description: Myb-like DNA-binding domain
MGRSACCEKAHTNKGAWTKEEDERLIAHIRTHGEGCWRSLPKAAGLLRCGKSCRLRWINYLRPDLKRGNFTDEEDELIIKLHSLLGNKWSLIAGRLPGRTDNEIKNYWNTHIRRKLLNRGIDPATHRPVSTATASNLTMSFSSGSSVKDKRTSSSSSSSRVGRISALLPRCPDLNLDLCISPSLEEQMPQDLLVEESNCGGEFLRLGSSFLLDYRSLEMK

SEQ ID NO: 2022 - protein, 232 aa, Antirrhinum majus
  misc_feature (1)..(232): Public GI no. 82308
  misc_feature (1)..(232): Functional Homolog of Ceres Clone ID  no. 120302
  misc_feature (67)..(112): Pfam Name: Myb_DNA-binding Pfam Description: Myb-like DNA-binding domain
MGRSPCCEKAHTNKGAWTKEEDDRLVAYIRAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPTTHRSINDGTASQDQVTTISFSNANSKEEDTKHKVAVDIMIKEENSPVQERCPDLNLDLKISPPCQQQINYHQENLKTGGRNGSSTLCFVCRLGIQNSKDCSCSDGVGN

SEQ ID NO: 2023 - protein, 264 aa, Gossypium hirsutum
  misc_feature (1)..(264): Public GI no. 13346194
  misc_feature (1)..(264): Functional Homolog of Ceres Clone ID  no. 120302
  misc_feature (67)..(112): Pfam Name: Myb_DNA-binding Pfam Description: Myb-like DNA-binding domain
MGRSPCCEKAHTNKGAWTKEEDDRLIAYIRAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPATHRPLNEASQDVTTISFSGAKEEKEKINTNSNNNPIGFITKDEKKIPVQERCPDLNLDLRISPPYYQQTQPESFKTGGRTLCFICSLGVKNSKDCTCSTITTAAGSSSSSSSHSNSNNSSGYDFLGLKSGILEYRSLEMK

SEQ ID NO: 2024 - protein, 270 aa, Tradescantia fluminensis
  misc_feature (1)..(270): Public GI no. 42541167
  misc_feature (1)..(270): Functional Homolog of Ceres Clone ID  no. 120302
  misc_feature (67)..(112): Pfam Name: Myb_DNA-binding Pfam Description: Myb-like DNA-binding domain
MGRSPCCEKAHTNKGAWTKEEDQRLIAYIKVHGEGCWRSLPKSAGLLRCGKSCRLRWINYLRPDLKRGNFTEEEDEVIIKLHALLGNKWSLIAGRLPGRTDNEIKNYWNTHIKRKLISRGIDPQTHRPVNSGAQFTISSANNQANSTKIPVNEALKQSTDSSSSQDMQSSNSVLDVVERCPDLNLDLSINIAYSTDRKPFSSSTEMQITPAATEATTPTSVSPYFQPICLCYRLGFSRTEACSCKAISNSNSQNVFRYYRPLKEEGHQTN

SEQ ID NO: 2025 - protein, 255 aa, Eucalyptus gunnii
  misc_feature (1)..(255): Public GI no. 39725415
  misc_feature (1)..(255): Functional Homolog of Ceres Clone ID  no. 120302
  misc_feature (67)..(112): Pfam Name: Myb_DNA-binding Pfam Description: Myb-like DNA-binding domain
  misc_feature (214)..(214): Xaa is any aa, unknown, or other
MGRSPCCEKAHTNKGAWTKEEDDKLIAYIRAHGEGCWRSLPKAAGLLRCGKSCRLRWINYLRPDLKRGNFTEEEDEIIIKLHSLLGNKWSLIAGRLPGRTDNEIKNYWNTHIRRKLLNRGIDPATHRLINEPAQDHHDEPTISFAANSKEIKEMKNNAELNFMCNLEESADVASSARERCPDLNLELGISPPSHQLHQPEPLLRFTGRKSDLCXECNLGLKNSQNCRCSVGVIESETSVGYDFLGLKASVLDYRS

SEQ ID NO: 2026 - protein, 270 aa, Populus tremula x Populus tremuloes
  misc_feature (1)..(270): Public GI no. 31980095
  misc_feature (1)..(270): Functional Homolog of Ceres Clone ID  no. 120302
  misc_feature (67)..(113): Pfam Name: Myb_DNA-binding Pfam Description: Myb-like DNA-binding domain
MGRSPCCEKAHTNKGAWTKEEDDRLVAYIRAHGEGCWRSLPKAAGLLRCGKSCRLRWINYLRPDLKRGNFTEAEDELIIKLHSLLGNSRWSLIAGRLPGRTDNEIKNYWNTHIRRKLLNRGIDPATHRPLNEPVQEATTTISFTTTTTSVEEESRGSIIKEEIKEKLISATAFVCTEAKTQVQERCPDLNLELGISLPSQNQPDHHQPFKTGGSRSLCFACSLGLQNSKDCSCNVIVSTVGSSGSTSTKNGYDFLGMKSGVLDYRSLEMK

SEQ ID NO: 2027 - protein, 273 aa, Lycopersicon esculentum
  misc_feature (1)..(273): Public GI no. 1167484
  misc_feature (1)..(273): Functional Homolog of Ceres Clone ID  no. 120302
  misc_feature (67)..(112): Pfam Name: Myb_DNA-binding Pfam Description: Myb-like DNA-binding domain
MGRSPCCEKAHTNKGAWTKEEDERLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPTTHRSINDPTTIPKVTTITFAAAHENIKDIDQQDEMINIKAEFVETSKESDNNEIIQEKSSSCLPDLNLELRISPPHHQQLDHHRHHQRSSSLCFTCSLGIQNSKDCSCGSESNGNGWSNNMVSMNIMAGYDFLGLKTNGLLDYRTLETK

SEQ ID NO: 2028 - protein, 251 aa, Oryza sativa subsp. japonica
  misc_feature (1)..(251): Public GI no. 50726662
  misc_feature (1)..(251): Functional Homolog of Ceres Clone ID  no. 120302
  misc_feature (67)..(112): Pfam Name: Myb_DNA-binding Pfam Description: Myb-like DNA-binding domain
MGRSPCCEKAHTNKGAWTKEEDDRLIAYIKAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPVTHRPINDSASNITISFEAAAAAARDDKAAVFRREDHPHQPKAVTVAQEQQAAADWGHGKPLKCPDLNLDLCISLPSQEEPMMMKPVKRETGVCFSCSLGLPKSTDCKCSSFLGLRTAMLDFRSLEMK

SEQ ID NO: 2029 - protein, 267 aa, Hordeum vulgare subsp. vulgare
  misc_feature (1)..(267): Public GI no. 19053
  misc_feature (1)..(267): Functional Homolog of Ceres Clone ID  no. 120302
  misc_feature (67)..(112): Pfam Name: Myb_DNA-binding Pfam Description: Myb-like DNA-binding domain
MGRSPCCEKAHTNKGAWTKEEDDRLTAYIKAHGEGCWRSLPKAAGLLRCGKSCRLRWINYLRPDLKRGNFSHEEDELIIKLHSLLGNKWSLIAGRLPGRTDNEIKNYWNTHIRRKLTSRGIDPVTHRAINSDHAASNITISFESAQRDDKGAVFRRDAEPAKAAAAAAAISHHVDHHHRSNPQLDWGQGKPLKCPDLNLDLCISPPIHEDPMVDTKPVVKREAGVGVGVVGLCFSCSMGLPRSSDCKCSSFMGLRTAMLDFRSIEMK

SEQ ID NO: 2030 - protein, 229 aa, Oryza sativa subsp. japonica
  misc_feature (1)..(229): Public GI no. 19072766
  misc_feature (1)..(229): Functional Homolog of Ceres Clone ID  no. 120302
  misc_feature (67)..(112): Pfam Name: Myb_DNA-binding Pfam Description: Myb-like DNA-binding domain
MGRSPCCEKEHTNKGAWTKEEDERLVAYIRAHGEGCWRSLPKAAGLLRCGKSCRLRWINYLRPDLKRGNFTADEDDLIIKLHSLLGNKWSLIAARLPGRTDNEIKNYWNTHIRRKLLGRGIDPVTHRPVNAAAATISFHPQPPPTTKEEQLILSKPPKCPDLNLDLCISPPSCQEEDDDYEAKPAMIVRAPELQRRRGGLCFGCSLGLQKECKCSGGGAGAGAGNNFLG

SEQ ID NO: 2031 - protein, 243 aa, Oryza sativa subsp. japonica
  misc_feature (1)..(243): Public GI no. 50948275
  misc_feature (1)..(243): Functional Homolog of Ceres Clone ID  no. 120302
  misc_feature (67)..(112): Pfam Name: Myb_DNA-binding Pfam Description: Myb-like DNA-binding domain
MGRSPCCEKEHTNKGAWTKEEDERLVAYIRAHGEGCWRSLPKAAGLLRCGKSCRLRWINYLRPDLKRGNFTADEDDLIIKLHSLLGNKWSLIAARLPGRTDNEIKNYWNTHIRRKLLGRGIDPVTHRPVNAAAATISFHPQPPPTTKEEQLILSKPPKCPDLNLDLCISPPSCQEEDDDYEAKPAMIVRAPELQRRRGGLCFGCSLGLQKECKCSGGGAGAGAGNNFLGLRAGMLDFRSLPMK

SEQ ID NO: 2032 - protein, 271 aa, Zea mays
  misc_feature (1)..(271): Ceres CLONE ID  no. 1459729
  misc_feature (1)..(271): Functional Homolog of Ceres Clone ID  no. 120302
  misc_feature (67)..(112): Pfam Name: Myb_DNA-binding Pfam Description: Myb-like DNA-binding domain
MGRSPCCEKDHTNKGAWTKEEDQKLISYIKSHGEGCWRSLPASAGLLRCGKSCRLRWINYLRPDLKRGNFTLEEDDLIIKLHSLLGNKWSLIATRLPGRTDNEIKNYWNTHMKRKLLRGGIDPATHRPIKARRDASEARETEDSLVKVISFGPQLEKEESSREEGRFKKSLTCKTKSLDLNLELRISPPWQDQHRRDERKLLFRKEKYLCSACRFGLGNGKECSCENVRCHIDDSSSSSYSSSDISSSVVGFDFLGLNTSSVLDYTSLEMN

SEQ ID NO: 2033 - protein, 265 aa, Triticum aestivum
  misc_feature (1)..(265): Public GI no. 47680445
  misc_feature (1)..(265): Functional Homolog of Ceres Clone ID  no. 120302
  misc_feature (67)..(112): Pfam Name: Myb_DNA-binding Pfam Description: Myb-like DNA-binding domain
MGRSPCCEKAHTNKGAWTKEEDDRLTAYIKAHGEGCWRSLPKAAGLLRCGKSCRLRWINYLRPDLKRGNFSDEEDELIIKLHSLLGNKWSLIAGRLPGRTDNEIKNYWNTHIRRKLTSRGIDPVTHRAINSDHAASNITISFETAQRDDKGAVFRRDAEPTKVAAAAAAITHVDHHHHHRSNPLHQMEWGQGKPLKCPDLNLDLCISPPSHEDPMVDTKPVVKREAVVGLCFSCSMGLPRSADCKCSSFMGLRTAMLDFRSIEMK

SEQ ID NO: 2034 - protein, 340 aa, Boea crassifolia
  misc_feature (1)..(340): Public GI no. 30575840
  misc_feature (1)..(340): Functional Homolog of Ceres Clone ID  no. 33333
  misc_feature (69)..(114): Pfam Name: Myb_DNA-binding Pfam Description: Myb-like DNA-binding domain
MGRAPCCDKTGLLMKKGPWSQEEDQKLLDYIQKYGYGNWRTLPTNAGLQRCGKSCRLRWTNYLRPDIKRGRFSFEEEETIIRLHSILGNKWSLIAARLPGRTDNEIKNYWNTNIRKRLLRMGIDPVTHSPRLQLLDLSTILNSSLCNNSPTQMNFSRLQPRFNPELLRFAASLFSSNCQSQDFPMQNQITSNNQIPPPFMQTSVQDVAVLPDLCADTNLGTSFSVHDEVQEFQQNPAGYGMPSALTGEYVPVLNDGYYGSGDQPFVDPTPSSVTSNFQSYCSNSLGFQSIFSTPPSSPTPLNSNSTYVNSCSSTEDETESYYNSMWKFEIPDNLRINDFM

SEQ ID NO: 2035 - protein, 375 aa, Populus x canescens
  misc_feature (1)..(375): Public GI no. 22795039
  misc_feature (1)..(375): Functional Homolog of Ceres Clone ID  no. 33333
  misc_feature (67)..(112): Pfam Name: Myb_DNA-binding Pfam Description: Myb-like DNA-binding domain
MGRAPCCEKNGLKRGPWTPDEDQKLIGYIQKHGYGNWRTLPKNAELQRCGKSCRLRWTNYLRPDIKRGRFSFEEEETIIQLHGILGNKWSAIAARLPGRTDNEIKNYWNTHIRKRLLRMGIDPVTHSPRLDLLDLSSILNSPLYDSSRMNMSRILGVQPLGDPELLRLATSLLSSQRDQTQDFAIPNGHQENHLSSPQVHQNQNQSIIHQANQFQPAGQEMPACTALTTTPCVTFSNEAQQMDPNGDQYHLSTITTFSSPNSQVSTHDQWQSNRMGSNLSEDYYVPAVSSYNSADNCRGTDLVDPSSEASTFISNNSNQTFGFASVLSTPSSSPAPLNSNSTYINCSSTEDERDSYCSNFLKFEIPDILDVSNFM

SEQ ID NO: 2036 - protein, 380 aa, Glycine max
  misc_feature (1)..(380): Ceres CLONE ID  no. 543289
  misc_feature (1)..(380): Functional Homolog of Ceres Clone ID  no. 33333
  misc_feature (13)..(60): Pfam Name: Myb_DNA-binding Pfam Description: Myb-like DNA-binding domain
  misc_feature (324)..(324): Xaa is any aa, unknown, or other
MAKSSTEKNGLKKGPWTPEEDQKLIDYIQKHGHGKWRTLPKNAGLKRCGKSCRLRWANYLRPDIKRGRFSFEEEEAIIQLHSVLGNKWSTIAANLPGRTDNEIKNYWNTHIKKKLLKMGIDPVTHTPRLDVIQLASILNTSLYNSAPQFNYPSLSGIGRSVINPSHMLGLLTTLLSCQNRNYNPDVLNNNQLSGGSTLLQNQHQCSRMQLDSTQAFQPNQPQVSLQENHIAKSNSNPLNMEPQVMKTTLENQITPIATPFSQQNTLPNLWHYNTEGHISDLPTMAQSSSAMQCFSSPKFNSIYNNLLENQNLCNNNEGMPNFNXSSLLSSTPSSSSPISTLNSSSSTTFVNGTTEDERDTYGSSMLMYNISNGLNDSGLL

SEQ ID NO: 2037 - protein, 270 aa, Arabidopsis thaliana
  misc_feature (1)..(270): Ceres CLONE ID  no. 142681
  misc_feature (1)..(270): Functional Homolog of Ceres Clone ID  no. 9325
  misc_feature (61)..(263): Pfam Name: PsbP Pfam Description: PsbP
  misc_feature (227)..(227): Xaa is any aa, unknown, or other
  misc_feature (229)..(229): Xaa is any aa, unknown, or other
  misc_feature (233)..(233): Xaa is any aa, unknown, or other
  misc_feature (264)..(264): Xaa is any aa, unknown, or other
  misc_feature (265)..(265): Xaa is any aa, unknown, or other
MAYSACFLHQSALASSAARSSSSSSSQRHVSLSKPVQIICKAQQSHEDDNSAVSRRLALTLLVGAAAVGSKVSPADAAYGEAANVFGKPKTNTDFLPYNGDGFKVQVPAKWNPSKEIEYPGQVLRFEDNFDATSNLNVMVTPTDKKSITDYGSPEEFLSQVNYLLGKQAYFGETASEGGFDNNAVATANILESSSQEVGGKPYYYLSVLTRTADGDEGGKHQLITAXVXGGKXYICKAQAGDKRWFKGARKFVESAATSFSVAXXESNTT

SEQ ID NO: 2038 - protein, 263 aa, Zea mays
  misc_feature (1)..(263): Ceres CLONE ID  no. 1063835
  misc_feature (1)..(263): Functional Homolog of Ceres Clone ID  no. 9325
  misc_feature (61)..(263): Pfam Name: PsbP Pfam Description: PsbP
  misc_feature (61)..(263): Pfam Name: PsbP Pfam Description: PsbP
MAYSACFLHQSALASSAARSSSSSSSQRYVSLSKPVQVVCKAQQSHEDDNPAVSRRLALTLLVGAAAVGSKVSPADAAYGEAANVFGKPKKNTDFTPYNGDGFQVQVPAKWNPSREVEYPGQVLRYEDNFDATSNLNVMVTPTDKKSITDYGSPEEFLSQVNYLLGKQAYFGETASEGGFDNNAVATANILETNVQDVGGKPYYYLSVLTRTADGDEGGKHQLITATVNGGKLYICKAQAGDKRWFKGANKFVEKAATSFSVA

SEQ ID NO: 2039 - protein, 263 aa, Glycine max
  misc_feature (1)..(263): Ceres CLONE ID  no. 1027529
  misc_feature (1)..(263): Functional Homolog of Ceres Clone ID  no. 9325
  misc_feature (61)..(263): Pfam Name: PsbP Pfam Description: PsbP
MAYSACFLHQSALASSAARSSSSSSSQRYVSLSKPVQVVCKAQQSHEDDNPAVSRRLALTLLVGAAAVDSKVSPADAAYGEAANVFGKPKKNTDFTPYNGDGFQVQVPAKWNPSREVEYPGQVLRYEDNFDATSNLNVMVTPTDKKSITDYGSPEEFLSQVNYLLGKQAYFGETASEGGFDNNAVATANILETNVQDVGGKPYYYLSVLTRTADGDEGGKHQLITATVNGGKLYICKAQAGDKRWFKGANKFVEKAATSFSVA

SEQ ID NO: 2040 - protein, 260 aa, Sinapis alba
  misc_feature (1)..(260): Public GI no. 21133
  misc_feature (1)..(260): Functional Homolog of Ceres Clone ID  no. 9325
  misc_feature (58)..(260): Pfam Name: PsbP Pfam Description: PsbP
  misc_feature (58)..(260): Pfam Name: PsbP Pfam Description: PsbP
MAYSACFLHQSALASSTARSSPSSSSQRYVSISKLVCKAQQTHEEDNSTVSRRLALTLLVGAAAVGSKVSPADAAYGEAANVFGKPKKNTDFTAYSGDGFQVQVPAKWNPSREVEYPGQVLRYEDNFDATSNLNVMVTPTDKKSITDYGSPEEFLSQVNYLLGKQAYFGETASEGGFDNNAVATANILETNIQDVGGKPYYYLSVLTRTADGDEGGKHQLITATVNGGKLYICKAQAGDKRWFKGANKFVEKAATSFSVA

SEQ ID NO: 2041 - protein, 265 aa, Arabidopsis thaliana
  misc_feature (1)..(265): Public GI no. 11133887
  misc_feature (1)..(265): Functional Homolog of Ceres Clone ID  no. 9325
  misc_feature (62)..(265): Pfam Name: PsbP Pfam Description: PsbP
  misc_feature (78)..(78): Xaa is any aa, unknown, or other
MAYSPSFLHQSALASSAGRSSSSSSSSFRHVSLSRPVHLVCRAQQSQENNNSAVFRRLALTLLVGAAAIGSKVSPAPXAAYGEAANVFGKPKKNTDFLPYTGEGFKIQIPSKWNPSKEIEYPGQVLRFEDNFDATSNVSVMITPTDKKSITDYGSPEQFLSQVNYLLGKQAYVGETASEGGFDANAVATANILETSTQEIGGKEYYYLSVLTRTADGDEGGKHQLITATVNGGKLYICKAQAGDKRWFKGARKFVENAATSFSVA

SEQ ID NO: 2042 - protein, 257 aa, Arabidopsis thaliana
  misc_feature (1)..(257): Ceres CLONE ID  no. 1139782
  misc_feature (1)..(257): Functional Homolog of Ceres Clone ID  no. 9325
  misc_feature (62)..(257): Pfam Name: PsbP Pfam Description: PsbP
MAYSPSFLHQSALASSAGRSSSSSSSSFRHVSLSRPVHLVCRAQQSQENNNSAVFRRLALTLLVGAAAIGSKVSPAPPMVKPPKKNTDFLPYTGEGFKIQIPSKWNPSKEIEYPGQVLRFEDNFDATSNVSVMITPTDKKSITDYGSPEQFLSQVNYLLGKQAYVGETASEGGFDANAVATANILETSTQEIGGKEYYYLSVLTRTADGDEGGKHQLITATVNGGKLYICKAQAGDKRWFKGARKFVENAATSFSVA

SEQ ID NO: 2043 - protein, 257 aa, Arabidopsis thaliana; identical to SEQ ID NO: 2042
  misc_feature (1)..(257): Public GI no. 2880056
  misc_feature (1)..(257): Functional Homolog of Ceres Clone ID  no. 9325
  misc_feature (62)..(257): Pfam Name: PsbP Pfam Description: PsbP

SEQ ID NO: 2044 - protein, 261 aa, Arabidopsis thaliana
  misc_feature (1)..(261): Public GI no. 42569485
  misc_feature (1)..(261): Functional Homolog of Ceres Clone ID  no. 9325
  misc_feature (62)..(261): Pfam Name: PsbP Pfam Description: PsbP
MAYSPSFLHQSALASSAGRSSSSSSSSFRHVSLSRPVHLVCRAQQSQENNNSAVFRRLALTLLVGAAAIGSKVSPAPPMVKPLMCLPKKNTDFLPYTGEGFKIQIPSKWNPSKEIEYPGQVLRFEDNFDATSNVSVMITPTDKKSITDYGSPEQFLSQVNYLLGKQAYVGETASEGGFDANAVATANILETSTQEIGGKEYYYLSVLTRTADGDEGGKHQLITATVNGGKLYICKAQAGDKRWFKGARKFVENAATSFSVA

SEQ ID NO: 2045 - protein, 263 aa, Brassica napus
  misc_feature (1)..(263): Ceres CLONE ID  no. 982579
  misc_feature (1)..(263): Functional Homolog of Ceres Clone ID  no. 9325
  misc_feature (61)..(263): Pfam Name: PsbP Pfam Description: PsbP
  misc_feature (191)..(191): Xaa is any aa, unknown, or other
  misc_feature (197)..(197): Xaa is any aa, unknown, or other
  misc_feature (225)..(225): Xaa is any aa, unknown, or other
  misc_feature (227)..(227): Xaa is any aa, unknown, or other
  misc_feature (238)..(238): Xaa is any aa, unknown, or other
MAYSACFLHPSTLTSSTARSSSFPSSLHHVSFSRPVHLVCRAQQAQEEANSAISRRLALTFLVGAAALGSKVSPADAAYGEAANVFGKPKKNTDFMPYNGEGFKIEIPSKWNPSKEVEYPGQVLRYEDNFDATSNVSVMITPTDKKTIADYGSPEQFLSQVSYLLGKQAYFGETAFEGGFDANAVATANIXETSTQXVGGKKYYYLSVLTRTADGDEGGKHQLIXAXVNGGKLYICKXQAGDKRWFKGARKFVENAATSFSVA

SEQ ID NO: 2046 - protein, 114 aa, Arabidopsis thaliana
  misc_feature (1)..(114): Ceres CLONE ID  no. 1349
  misc_feature: Bit Score of 259.6 for HMM based on sequences of FIGURE 107
  misc_feature (1)..(114): Functional Homolog of Ceres Clone ID  no. 397320
  misc_feature (12)..(100): Pfam Name: DUF1313 Pfam Description: Protein of unknown function (DUF1313)
MEGDVLSGFGDRHNMDGKLLQSFQKSFVDVQDILDQNRLLINEINQNHESKQPDNLGRNVGLIKELNNNIRRVASLYGDLSHSFARSVDASSEGESSGTLKSDGKANQKRFRSG

SEQ ID NO: 2047 - protein, 114 aa, Arabidopsis thaliana; identical to SEQ ID NO: 2046
  misc_feature (1)..(114): Public GI no. 62318582
  misc_feature: Bit Score of 259.6 for HMM based on sequences of FIGURE 107
  misc_feature (1)..(114): Functional Homolog of Ceres Clone ID  no. 397320
  misc_feature (12)..(100): Pfam Name: DUF1313 Pfam Description: Protein of unknown function (DUF1313)

SEQ ID NO: 2048 - protein, 141 aa, Arabidopsis thaliana
  misc_feature (1)..(141): Public GI no. 8778455
  misc_feature: Bit Score of 256.8 for HMM based on sequences of FIGURE 107
  misc_feature (1)..(141): Functional Homolog of Ceres Clone ID  no. 397320
  misc_feature (12)..(100): Pfam Name: DUF1313 Pfam Description: Protein of unknown function (DUF1313)
MEGDVLSGFGDRHNMDGKLLQSFQKSFVDVQDILDQNRLLINEINQNHESKQPDNLGRNVGLIKELNNNIRRVASLYGDLSHSFARSVDASSEGESSGTLKSDGKANQKRFRSDISLFADVATSRSFPHNYTDPNWHSEIE

SEQ ID NO: 2049 - protein, 119 aa, Arabidopsis thaliana
  misc_feature (1)..(119): Ceres CLONE ID  no. 19640
  misc_feature: Bit Score of 251.6 for HMM based on sequences of FIGURE 107
  misc_feature (1)..(119): Functional Homolog of Ceres Clone ID  no. 397320
  misc_feature (16)..(104): Pfam Name: DUF1313 Pfam Description: Protein of unknown function (DUF1313)
MESRMEGDVYSGFGERYQMDGKLLQNFQKSFVQVQDILDQNRLLINEINQNHESKQADHLGRNVGLIRELNNNIRTVASLYGDLSHSFARSVDASSEGESTGTLKSDGKANNQKRFRSG

SEQ ID NO: 2050 - protein, 119 aa, Arabidopsis thaliana; identical to SEQ ID NO: 2049
  misc_feature (1)..(119): Public GI no. 19310623
  misc_feature: Bit Score of 251.6 for HMM based on sequences of FIGURE 107
  misc_feature (1)..(119): Functional Homolog of Ceres Clone ID  no. 397320
  misc_feature (16)..(104): Pfam Name: DUF1313 Pfam Description: Protein of unknown function (DUF1313)

SEQ ID NO: 2051 - protein, 114 aa, Brassica napus
  misc_feature (1)..(114): Ceres CLONE ID  no. 1099781
  misc_feature: Bit Score of 252.5 for HMM based on sequences of FIGURE 107
  misc_feature (1)..(114): Functional Homolog of Ceres Clone ID  no. 397320
  misc_feature (12)..(100): Pfam Name: DUF1313 Pfam Description: Protein of unknown function (DUF1313)
  misc_feature (17)..(17): Xaa is any aa, unknown, or other
  misc_feature (36)..(36): Xaa is any aa, unknown, or other
  misc_feature (40)..(40): Xaa is any aa, unknown, or other
  misc_feature (89)..(89): Xaa is any aa, unknown, or other
  misc_feature (106)..(106): Xaa is any aa, unknown, or other
  misc_feature (107)..(107): Xaa is any aa, unknown, or other
MEGDVFSGFGERHNMDXKLLQSFQKSFVDVQDILDXNRLXINEINQNHESKQPDNLGRNVGLIKELNNNIRRVASLYGDLSHSFARSMXASSEGESSGTLKSDGKXXQKRFRSG

SEQ ID NO: 2052 - protein, 112 aa, Brassica napus
  misc_feature (1)..(112): Ceres CLONE ID  no. 1066463
  misc_feature: Bit Score of 239.2 for HMM based on sequences of FIGURE 107
  misc_feature (1)..(112): Functional Homolog of Ceres Clone ID  no. 397320
  misc_feature (16)..(104): Pfam Name: DUF1313 Pfam Description: Protein of unknown function (DUF1313)
MESRMEGDVFSGFGERYQMDGKVLQNFQKSFVQVQDILDQNRLLINEINQNHESKQADHLGRNVGLIRELNNNIRTVASLYGDLSHSFAKSIDASSEGESTGTNNQKRFRSG

SEQ ID NO: 2053 - protein, 114 aa, Glycine max
  misc_feature (1)..(114): Ceres CLONE ID  no. 476445
  misc_feature: Bit Score of 247.5 for HMM based on sequences of FIGURE 107
  misc_feature (1)..(114): Functional Homolog of Ceres Clone ID  no. 397320
  misc_feature (12)..(100): Pfam Name: DUF1313 Pfam Description: Protein of unknown function (DUF1313)
MDGDIFGELGNSTQVDSRLLQVFQKSLLQAQDILNQNRLLINEINQNHESKMPDNLSRNVGLIRELNSNIRRVVDLYADLSNSFTKSREASSEGDSSGTLKSDGKVNQKRIRSS

SEQ ID NO: 2054 - protein, 118 aa, Zea mays
  misc_feature (1)..(118): Ceres CLONE ID  no. 327449
  misc_feature: Bit Score of 234.2 for HMM based on sequences of FIGURE 107
  misc_feature (1)..(118): Functional Homolog of Ceres Clone ID  no. 397320
  misc_feature (15)..(102): Pfam Name: DUF1313 Pfam Description: Protein of unknown function (DUF1313)
MEGGDGETTLSGFGVGGVDTKVLHAFQTSFVQVQTLLDQNRLLISEINHNHESKVPGDLSRNVGLIRELNNNIRRVVDLYADLSSLFAASDGASEGGSVGTVRQAGAAGHKRIRSGLD

SEQ ID NO: 2055 - protein, 114 aa, Oryza sativa subsp. japonica
  misc_feature (1)..(114): Public GI no. 37991859
  misc_feature: Bit Score of 228.7 for HMM based on sequences of FIGURE 107
  misc_feature (1)..(114): Functional Homolog of Ceres Clone ID  no. 397320
  misc_feature (9)..(99): Pfam Name: DUF1313 Pfam Description: Protein of unknown function (DUF1313)
MDGDTLSAAAAEDGKVLHAFQTSFVQVQSLLDQNRVLINEINQNHESKVPGDLSRNVGLIRELNNNIRRVVDLYADLSSLFAASSPGPAASEGASVGTAVRHAGHKRVRSTHLD

SEQ ID NO: 2056 - protein, 186 aa, Arabidopsis thaliana; identical to SEQ ID NO: 1974
  misc_feature (1)..(186): Public GI no. 28466913
  misc_feature (1)..(186): Functional Homolog of  Ceres Clone ID NO. 968026
  misc_feature (25)..(149): Pfam Name: Response_reg Pfam Description: Response regulator receiver domain

SEQ ID NO: 2057 - protein, 196 aa, Glycine max
  misc_feature (1)..(196): Ceres CLONE ID no. 596510
  misc_feature (1)..(196): Functional Homolog of  Ceres Clone ID NO. 968026
  misc_feature (21)..(146): Pfam Name: Response_reg Pfam Description: Response regulator receiver domain
MASAGYVFRQGLPEVCAAGKLHVLAVDDSHVDRKVIERLLKISSCKVTVVESGSRALQYLGLDGEKSSIGLDSVKVNLIMTDYSMPGMTGYELLKKIKESSVFREVPVVVMSSENILTRIDSCLEEGAEEFLLKPVKLSDVKRVTDFIMRGEGMKGVKISKKRSRSDDCIPSLSTAFSSVSHPCDISSPPSPTEEI

SEQ ID NO: 2058 - protein, 134 aa, Glycine max; identical to SEQ ID NO: 1409
  misc_feature (1)..(134): Public GI no. 30577630
  misc_feature (1)..(134): Functional Homolog of  Ceres CLONE ID no. 12071
  misc_feature (49)..(127): Pfam Name: SBP Pfam Description: SBP domain

SEQ ID NO: 2059 - protein, 175 aa, Glycine max
  misc_feature (1)..(175): Public GI no. 62856979
  misc_feature (1)..(175): Functional Homolog of  Ceres CLONE ID no. 12071
  misc_feature (51)..(129): Pfam Name: SBP Pfam Description: SBP domain
MNLGKVDGSCYQKMVKKEAEEDQVSDEELVESGVEEEKKKKGVVGSGGKRCCQAEKCTADLSDGKQYHKRHKVCEHHAKAQVVLVGGMRQRFCQQCSRFHELSEFDETKRSCRRRLAGHNERRRENTAESHAEGSSRKGTGTHQLKDIVCGQVDDRGRIQITIHENSTYKHFQIR

SEQ ID NO: 2060 - DNA, 834 bp, Populus balsamifera subsp. trichocarpa; identical to SEQ ID NO: 1470
  misc_feature (1)..(834): Ceres ANNOT ID no. 1443644

SEQ ID NO: 2061 - protein, 270 aa, Populus balsamifera subsp. trichocarpa; identical to SEQ ID NO: 1471
  misc_feature (1)..(270): Ceres ANNOT ID no. 1443644
  misc_feature (1)..(270): Functional Homolog of  Ceres CLONE ID no. 20769
  misc_feature (126)..(170): Pfam Name: CCT Pfam Description: CCT motif
  misc_feature (194)..(231): Pfam Name: GATA Pfam Description: GATA zinc finger
  misc_feature (62)..(97): Pfam Name: tify Pfam Description:

SEQ ID NO: 2062 - DNA, 298 bp, Panicum virgatum
  misc_feature (1)..(298): Ceres CLONE ID no.1806146
agagcagccaccgcgcccgcaccacctcgcacctggcatcaccaccagtagcagcagcagcagctagaacagcggcgatgaaccgcctgacgccggcgcaccagggggcgatgccgccgccgccgggggcggggcagctggcgcggtacggctccgcgccgggctcgctcctggcggccatcgcgaagtccgtcacccgcggcggggaccacgccccgccgcccttcacccggttctactccgccgagtcctccggcctcacctcctgcgagtccacctgccgcacggacgccggcgg

SEQ ID NO: 2063 - protein, 352 aa, Panicum virgatum
  misc_feature (1)..(352): Ceres CLONE ID no. 1806146
  misc_feature: Bit Score of 216.3 for HMM based on sequences of FIGURE 28
  misc_feature (1)..(352): Functional Homolog of  Ceres CLONE ID no. 21406
  misc_feature (283)..(331): Pfam Name: HLH Pfam Description: Helix-loop-helix DNA-binding domain
MNRLTPAHQGAMPPPPGAGQLARYGSAPGSLLAAIAKSVTRGGDHAPPPFTRFYSAESSGLTSCESTCRTDAGGGRPRALERAYGGSGEIRVPPQQHQSLAPPGPPHGLLRHSSSPAGLLSRLTADPHGMAPASGMGSYSQADTDAAMAHGHRQLSSQWSFSRQDLPRISEMGMIPADIGESIVAGGGCNSSSDGAAQSSSYLSRNFSVSSWDDTNSIMFSSSPNKKPKLDAADDMVTSFSNIDSQFGLSKSSLEMPGMDDYLQLQQDSVACRVRAKRGCATHPRSIAERERRTRISKRLKKLQDLVPNMDKQTNTSDMLDLAVEYIKELKGQVEKLKHDQANCFCSGNQNS

SEQ ID NO: 2064 - DNA, 731 bp, Panicum virgatum
  misc_feature (1)..(731): Ceres CLONE ID no.1887966
  misc_feature (709)..(709): n is a, c, t, g, unknown, or other
agcgctcccaaccactcccaccactgttcctcccctctctcgagctgggagacgatatcctaaactccaaagcagcagcggaggggaaagcaacaagccaagcgatcgatcatccggaagacgccgggagcgagaggcacaaagatacacggcgcctgccatgtcgcctctccgtgacctggactggtcggtcatcacctgagagagagtagagtccgaccgacgaggggaaggtagctgccagtttgggcaagagtggtgagtgagtcaagggggcaagaagagagcggtttgttttcttccgatggcggccgcctcgtccgcgcccttcttcgggctcggcgacacgcagatgcagccgccccagggcccctctctgcagcagaactccgcggcggccgcgcccggcgccgccgccgcgccgccgaagaagaagaggaaccagcccggcaatccaaaccccgacgcggaggtgatcgcgctgtcgccgcggacgctgctggcgacgaaccggttcgtgtgcgaggtgtgcaacaaggggttccagcgggagcagaacctgcagctccaccggcgcgggcacaacctgccgtggaagctgaagcagaagaaccccaaggaggcccggcggcgggtgtacctgtgcccggagccgacgtgcgtgcaccacgacccgtcccgggcgctgggcgacctcaccggggatcanaagcactactgccgcaagcacg

SEQ ID NO: 2065 - protein, 142 aa, Panicum virgatum
  misc_feature (1)..(142): Ceres CLONE ID no. 1887966
  misc_feature (1)..(142): Functional Homolog of  Ceres CLONE ID no. 9804
  misc_feature (71)..(93): Pfam Name: zf-C2H2 Pfam Description: Zinc finger, C2H2 type
  misc_feature (135)..(135): Xaa is any aa, unknown, or other
MAAASSAPFFGLGDTQMQPPQGPSLQQNSAAAAPGAAAAPPKKKRNQPGNPNPDAEVIALSPRTLLATNRFVCEVCNKGFQREQNLQLHRRGHNLPWKLKQKNPKEARRRVYLCPEPTCVHHDPSRALGDLTGDXKHYCRKH

SEQ ID NO: 2066 - protein, 198 aa, Arabidopsis thaliana
  misc_feature (1)..(198): Public GI no. 20259185
  misc_feature (1)..(198): Functional Homolog of  Ceres CLONE ID no. 39855
MGRCPTRKVKKRRLSHKTARRDKFEVKGDDLVYTELRKPETEIKPLQLDEDLPGMGQFYCLHCDRYFSNVSVRDDHFKTKKHKKRVNMMMGQAPHSQLDADLAGGMGMPDNGPKLMSNLVFTELRKPETEDLPGMGQFNCLLCHRNFSNASVMDYHFKTKKHKKRVKKIERPAPHSQLDADLAGGMGMPDNGPKLMSA

SEQ ID NO: 2067 - protein, 324 aa, Arabidopsis thaliana
  misc_feature (1)..(324): Public GI no. 21386951
  misc_feature (1)..(324): Functional Homolog of  Ceres CLONE ID no. 33139
  misc_feature (14)..(61): Pfam Name: Myb_DNA-binding Pfam Description: Myb-like DNA-binding domain
MVRPPCCDKGGVKKGPWTPEEDIILVTYIQEHGPGNWRAVPTNTGLLRCSKSCRLRWTNYLRPGIKRGNFTEHEEKMIVHLQALLGNRWAAIASYLPQRTDNDIKNYWNTHLKKKLNKVNQDSHQELDRSSLSSSPSSSSANSNSNISRGQWERRLQTDIHLAKKALSEALSPAVAPIITSTVTTTSSSAESRRSTSSASGFLRTQETSTTYASSTENIAKLLKGWVKNSPKTQNSADQIASTEVKEVIKSDDGKECAGAFQSFSEFDHSYQQAGVSPDHETKPDITGCCSNQSQWSLFEEKWLFEDSGGQIGDILLDENTNFF

SEQ ID NO: 2068 - protein, 412 aa, Arabidopsis thaliana
  misc_feature (1)..(412): Ceres CLONE ID  no. 30700
  misc_feature (1)..(412): Functional Homolog of  Ceres Clone ID  no. 42530
  misc_feature (297)..(373): Pfam Name: Helicase_C Pfam Description: Helicase conserved C-terminal domain
  misc_feature (63)..(229): Pfam Name: DEAD Pfam Description: DEAD/DEAH box helicase
MAGSAPEGTQFDARQFDQKLNEVLEGQDEFFTSYDDVHESFDAMGLQENLLRGIYAYGFEKPSAIQQRGIVPFCKGLDVIQQAQSGTGKTATFCSGVLQQLDFSLIQCQALVLAPTRELAQQIEKVMRALGDYLGVKVHACVGGTSVREDQRILQAGVHVVVGTPGRVFDMLKRQSLRADNIKMFVLDEADEMLSRGFKDQIYDIFQLLPPKIQVGVFSATMPPEALEITRKFMSKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTRDDERMLFDIQKFYNVVVEELPSNVADLL

SEQ ID NO: 2069 - protein, 412 aa, Arabidopsis thaliana; identical to SEQ ID NO: 2068
  misc_feature (1)..(412): Public GI no. 23397033
  misc_feature (1)..(412): Functional Homolog of  Ceres Clone ID  no. 42530
  misc_feature (297)..(373): Pfam Name: Helicase_C Pfam Description: Helicase conserved C-terminal domain
  misc_feature (63)..(229): Pfam Name: DEAD Pfam Description: DEAD/DEAH box helicase

SEQ ID NO: 2070 - protein, 412 aa, Arabidopsis thaliana
  misc_feature (1)..(412): Public GI no. 19698881
  misc_feature (1)..(412): Functional Homolog of  Ceres Clone ID  no. 42530
  misc_feature (297)..(373): Pfam Name: Helicase_C Pfam Description: Helicase conserved C-terminal domain
  misc_feature (63)..(229): Pfam Name: DEAD Pfam Description: DEAD/DEAH box helicase
MAGSAPEGTQFDARQFDQKLNEVLEGQDEFFTSYDDVHESFDAMGLQENLLRGIYAYGFEKPSAIQQRGIVPFCKGLDVIQQAQSGTGKTATFCSGVLQQLDFSLIQCQALVLAPTRELAQQIEKVMRALGDYLGVKVHACVGGTSVREDQRILQAGVHVVVGTPGRVFDMLKRQSLRADNIKMFVLDEADEMLSRGFKDQIYDIFQLLPPKIQVGVFSATMPPEALEITRKFMSKPVRILVKRDELTVEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTRDDERMLFDIQKFYNVVVEELPSNVADLL

SEQ ID NO: 2071 - protein, 413 aa, Nicotiana plumbaginifolia
  misc_feature (1)..(413): Public GI no. 19697
  misc_feature (1)..(413): Functional Homolog of  Ceres Clone ID  no. 42530
  misc_feature (298)..(374): Pfam Name: Helicase_C Pfam Description: Helicase conserved C-terminal domain
  misc_feature (64)..(230): Pfam Name: DEAD Pfam Description: DEAD/DEAH box helicase
MAGSAPEGSQFDARQFDAKMTELLGTEQEEFFTSYDEVYDSFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINSVTKDDERMLFDIQKFYNVVIEELPANVADLL

SEQ ID NO: 2072 - protein, 412 aa, Arabidopsis thaliana
  misc_feature (1)..(412): Public GI no. 21555870
  misc_feature (1)..(412): Functional Homolog of  Ceres Clone ID  no. 42530
  misc_feature (297)..(373): Pfam Name: Helicase_C Pfam Description: Helicase conserved C-terminal domain
  misc_feature (63)..(229): Pfam Name: DEAD Pfam Description: DEAD/DEAH box helicase
  misc_feature (291)..(291): Xaa is any aa, unknown, or other
MAGSAPEGTQFDARQFDQKLNEVLEGQDEFFTSYDDVHESFDAMGLQENLLRGIYAYGFEKPSAIQQRGIVPFCKGLDVIQQAQSGTGKTATFCSGVLQQLDFSLIQCQALVLAPTRELAQQIEKVMRALGDYLGVKVHACVGGTSVREDQRILQAGVHVVVGTPGRVFDMLKRQSLRADNIKMFVLDEADEMLSRGFKDQIYDIFQLLPPKIQVGVFSATMPPEALEITRKFMSKPVRILVKRDELTLEGIKQFYVNVEKEEWKLETLCDLYETLAITQSVIFVNTRRKXDWLTDKMRSRDHTVSATHGDMDQNTRDIIMREFRSGSSRVLITTDLLARGIDVQQVSLVINFDLPTQPENYLHRIGRSGRFGRKGVAINFVTRDDERMLFDIQKFYNVVVEELPSNVADLL

SEQ ID NO: 2073 - protein, 413 aa, Nicotiana tabacum
  misc_feature (1)..(413): Public GI no. 475216
  misc_feature (1)..(413): Functional Homolog of  Ceres Clone ID  no. 42530
  misc_feature (298)..(374): Pfam Name: Helicase_C Pfam Description: Helicase conserved C-terminal domain
  misc_feature (64)..(230): Pfam Name: DEAD Pfam Description: DEAD/DEAH box helicase
MAGLAPEGSQFDARQYDAKMTELLGTEQEEFFTSYDEVYDSFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMNKPVRILVKRDDVTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLSDIQKFYNVVIEELPANVADLL

SEQ ID NO: 2074 - protein, 413 aa, Nicotiana tabacum
  misc_feature (1)..(413): Public GI no. 2119938
  misc_feature (1)..(413): Functional Homolog of  Ceres Clone ID  no. 42530
  misc_feature (298)..(374): Pfam Name: Helicase_C Pfam Description: Helicase conserved C-terminal domain
  misc_feature (64)..(230): Pfam Name: DEAD Pfam Description: DEAD/DEAH box helicase
MAGLAPEGSQFDARQYDAKMTELLGTEQEEFFTSYDEVYDSFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMSKPVRILVKRDEVTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVIEELPANVADLL

SEQ ID NO: 2075 - protein, 413 aa, Nicotiana tabacum
  misc_feature (1)..(413): Public GI no. 2119934
  misc_feature (1)..(413): Functional Homolog of  Ceres Clone ID  no. 42530
  misc_feature (298)..(374): Pfam Name: Helicase_C Pfam Description: Helicase conserved C-terminal domain
  misc_feature (64)..(230): Pfam Name: DEAD Pfam Description: DEAD/DEAH box helicase
MAGLAPEGSQFDARQYDAKMTELLGTEQEEFFTSYDEVYDSFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMNKPVRILVKRDEVTLEGIKQFYVNVDKEEWKLETLCDLYETLAITQSVIFVNTRRKVDWLTDKMRTRDHTVSATHGDMDQNTRDIIMREFRSGSSRVLITTDLLARGIDVQQVSLVINYDLPTQPENYLHRIGRSGRFGRKGVAINFVIKDDERMLSDIQRFYNVVIEELPANVADLL

SEQ ID NO: 2076 - protein, 413 aa, Nicotiana tabacum
  misc_feature (1)..(413): Public GI no. 2119932
  misc_feature (1)..(413): Functional Homolog of  Ceres Clone ID  no. 42530
  misc_feature (298)..(374): Pfam Name: Helicase_C Pfam Description: Helicase conserved C-terminal domain
  misc_feature (64)..(230): Pfam Name: DEAD Pfam Description: DEAD/DEAH box helicase
MAGAAPEGSQFDARQYDSKMTELLNAEGQEFFTSYDEVYHSFDAMGLKENLLRGIYAYGFEKPSAIQQRGIVPFCKGLDVIQQAQSGTGKTATFCSGVLQQLDYELLECQALVLAPTRELAQQIEKVMRALGDYLGVKVHACVGGTSVREDQRILSSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVSINFVTSDDERMLSDIQRFYNVVIEELPANVADLL

SEQ ID NO: 2077 - protein, 413 aa, Nicotiana tabacum
  misc_feature (1)..(413): Public GI no. 485949
  misc_feature (1)..(413): Functional Homolog of  Ceres Clone ID  no. 42530
  misc_feature (298)..(374): Pfam Name: Helicase_C Pfam Description: Helicase conserved C-terminal domain
  misc_feature (64)..(230): Pfam Name: DEAD Pfam Description: DEAD/DEAH box helicase
MAGLAPEGSQFDARQYDAKMTELLGTEQEEFFTSYDEVYDSFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMNKPVRILVKRDDVTLEGIKQFYVNVDKEEWKLETLCDLYETLAITQSVIFVNTRRKVDWLTDKMRTRDHTVSATHGDMDQNTRDIIMREFRSGSSRVLITTDLLARGIDVQQVSLVINYDLPTQPENYLHRIGRSGRFGRKGVAINFVIKDDERMLSDIQRFYNVVIEELPANVADLL

SEQ ID NO: 2078 - protein, 413 aa, Nicotiana tabacum
  misc_feature (1)..(413): Public GI no. 485945
  misc_feature (1)..(413): Functional Homolog of  Ceres Clone ID  no. 42530
  misc_feature (298)..(374): Pfam Name: Helicase_C Pfam Description: Helicase conserved C-terminal domain
  misc_feature (64)..(230): Pfam Name: DEAD Pfam Description: DEAD/DEAH box helicase
MAGAAPEGSQFDARQFDTKMNELLSADGQDFFTSYDEVYDSFDAMGLQENLLRGIYAYGFEKPSAIQQRGIVPFCKGLDVIQQAQSGTGKTATFCSGILQQLAYELLECQALVLAPTRELAQQIEKVMRALGDYLGVKVTACVGGTSVREDQRILSSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTKDDERMLSDIQRFYNVVIEELPANVADLL

SEQ ID NO: 2079 - protein, 413 aa, Nicotiana tabacum
  misc_feature (1)..(413): Public GI no. 485943
  misc_feature (1)..(413): Functional Homolog of  Ceres Clone ID  no. 42530
  misc_feature (298)..(374): Pfam Name: Helicase_C Pfam Description: Helicase conserved C-terminal domain
  misc_feature (64)..(230): Pfam Name: DEAD Pfam Description: DEAD/DEAH box helicase
MAGLAPEGSQFDARQYDAKMTELLGTEQEEFFTSYDEVYDSFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMSKPVRILVKRDDVTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVIEELPANVADLL

SEQ ID NO: 2080 - protein, 413 aa, Nicotiana tabacum
  misc_feature (1)..(413): Public GI no. 2119933
  misc_feature (1)..(413): Functional Homolog of  Ceres Clone ID  no. 42530
  misc_feature (298)..(374): Pfam Name: Helicase_C Pfam Description: Helicase conserved C-terminal domain
  misc_feature (64)..(230): Pfam Name: DEAD Pfam Description: DEAD/DEAH box helicase
MAGLAPEGSQFDARQYDAKMTELLGTEQQEFFTSYDEVYDSFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILQSGVHVVVGTPGRVFDMLRRQSLRPDNIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGHSGRFGRKGVSINFVTKDDERMLFDIQKFYNVVIEELPANVADLL

SEQ ID NO: 2081 - protein, 413 aa, Nicotiana tabacum
  misc_feature (1)..(413): Public GI no. 485951
  misc_feature (1)..(413): Functional Homolog of  Ceres Clone ID  no. 42530
  misc_feature (298)..(374): Pfam Name: Helicase_C Pfam Description: Helicase conserved C-terminal domain
  misc_feature (64)..(230): Pfam Name: DEAD Pfam Description: DEAD/DEAH box helicase
MAGAAPEGSQFDARQYDSKMTELLNAEGQDFFTSYDEVYHSFDAMGLKENLLRGIYAYGFEKPSAIQQRGIVPFCKGLDVIQQAQSGTGKTATFCSGILQQLDYELLDCQALVLAPTRELAQQIEKVMRALGDYLGVKVHACVGGTSVREDQRILSSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVSINFVTSDDERMLSDIQRFYNVVIEELPANVADLL

SEQ ID NO: 2082 - protein, 413 aa, Nicotiana tabacum
  misc_feature (1)..(413): Public GI no. 485987
  misc_feature (1)..(413): Functional Homolog of  Ceres Clone ID  no. 42530
  misc_feature (298)..(374): Pfam Name: Helicase_C Pfam Description: Helicase conserved C-terminal domain
  misc_feature (64)..(230): Pfam Name: DEAD Pfam Description: DEAD/DEAH box helicase
MAGLAPEGSQFDARQYDAKMTELLGTEQQEFFTSYDEVYESFDAMGLQENLLRGIYAYGFEKPSAIQQRGIVPFCKGLDVIQQAQSGTGKTATFCSGILQQLDYSLVECQALVLAPTRELAQQIEKVMRALGDYLGVKVHACVGGTSVREDQRILQSGVHVVVGTPGRVFDMLRRQSLRPDNIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGHSGRFGRKGVSINFVTKDDERMLFDIQKFYNVVIEELPANVADLL

SEQ ID NO: 2083 - protein, 413 aa, Pisum sativum
  misc_feature (1)..(413): Public GI no. 25809054
  misc_feature (1)..(413): Functional Homolog of  Ceres Clone ID  no. 42530
  misc_feature (298)..(374): Pfam Name: Helicase_C Pfam Description: Helicase conserved C-terminal domain
  misc_feature (64)..(230): Pfam Name: DEAD Pfam Description: DEAD/DEAH box helicase
MAGVAPEGSQFDAKQFDTKMNELLTTEGQDFYTFYEEVYDSFDAMGLQENLLRGIYAYGFEKPSAIQQRGIVPFCKGLDVIQQAQSGTGKTATFCSGILQQLDYSVTECQALVLAPTRELAQQIEKVMRALGDYLGVKVHACVGGTSVREDQRILSSGVHVVVGTPGRVFDMLRRQSLRPDYIKMFVLDEADEMLSRGFKDQIYDIFQLLPSKIQVGVFSATMPPEALEITRKFMNKPVRILVKRDELTLEGIKQFYVNVDKEEWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLGDIQKFYNVLIEELPSNVAELL

SEQ ID NO: 2084 - DNA, 2887 bp, Zea mays
  misc_feature (1)..(2887): Ceres CLONE ID no. 362993
  misc_feature (1)..(2887): Ceres GEMINI ID no. 539D9
gactcacactcacacagcaaataccccacaaggccactccaaagagctagtagtggaaccgaagatgttcgggaacatcggaaagatccccatcatcggcgacctgacgggcagcaacaagaatgcgcacctcaagggcaacgtggtgctcgtgcgcaagaccgtgctcggcttggacgtcaccagcatcgccggctccctcctcgacggcgtcggcgagttcctcggccgcggcgtcacctgccagcttatcagctccaccgtcgtggaccctaacaacggcaaccgcgggaagttgggcgccgaggcgagcctggagcagtggctgctgaacccgccgccgcttctgtccagcgagaaccagttccgcgtcaccttcgactgggaggtggagaagcagggcatcccgggcgccatcatcgtcaagaacaaccacgcctccgagttcttcctcaagaccatcaccctcaacgacgtccccggccacggcaccatcgtcttcgtcgccaactcatggatctacccgcagtccaagtaccgctacaaccgcgtcttcttctccaacgacacgtacctccccagccagatgccggcggcgctgaagccctaccgcgacgacgagctccggaacctgaggggcgacgaccagcagggcccgtaccaggagcacgaccgcgtctaccgctacgacgtctacaacgacctcggcctgcctgacagcgggaacccgcgccccgtcctcggcggcaccaaggagctcccctacccgcgccgctgccgcaccgggcggaagcccaccaagagcgaccccaacagcgagagcaggctcacgctggtcgacggcgacgtctacgtgccgcgcgacgagcgcttcggccacatcaagaagtcggacttctacggctacgccatcaaggcgctggtgaacgccgtcatcccggcaatccgcacctacgtcgacctgtcgcccggcgagttcgactccttcaaggacatcatgaagctgtacgagggcgggatccagctgcccaaaataccagccctcgaggacctgcggaagcagttcccactcgagctcgtcaaggatgtcctcccggtcggcggcgactacctcctcaagctccccatgccgcagatcatcaaagaggacaagacaggttggatgacagatgaggagtttggacgggagattctcgccggcgtgaaccccttgctcgtcaagcgtctcacggagttccctccgaggagcagtcttgacccgagcaagtacggcgaccacaccagcaccatcagggaggcggacctcgagaacaagctcgagggcctgaccgtgcagcaggcgctgcacggcaaccggctctacatcctggaccaccacgacaacttcatgccgttcctggtcagggtgaacagcctggagggcaacttcatctacgccaccaggaccgtgctgttcctgcgcggcgacggcacgctggtgccggtggccatcgagctgagcctgcccgagctccgggacggcctgatcaccgccaagagctccgtgtacacgcccaagtcgaccaccggcgcggaggcgtgggtgtggcacctggccaaggcctacgccaacgtgaacgactactgctggcaccagctcatcagccactggctcaacacccacgccgtgatggagccgttcgtgatcgccaccaaccggcagctcagcgtgacgcaccccgtgcacaagctcctcctgccgcactaccgtgacaccatgaacatcaactccaacgctcgccagatgctcgtcaacgccggcggcatcttcgagaccaccgtcttcccgcgccagtacgcgttcgagatgtcctccgtcatctacaaggactggaacttcacagagcaggctctccctgacgacctaatcaagagaggcatggcggttgccgacccgtcgagcccgtacaaggtacggctgctggtggaggactacccgtacgcgtcggacgggctggccatctggcacgccatcgagcagtgggtgacggagtacctcgccgtctactaccccaacgacggcgtgctgcgggcggacgtggagctgcaggcgtggtggaaggaggcgcacgaggtcgggcacgccgacctcaaggacgcgccctggtggcccaagatgcagaccgtggccgagctggtcaaggcctgcaccaccatcatctggatcgcgtcggcgctccacgcggccgtcaacttcgggcagtacccatacgccgggtacctcccgaaccgcccgtccgtcagccggaagccgatgccggcgccgggcagcgacgagtacgcggagctggagcgcaagccggagaaggtgttcgtgcgcaccatcaccagccagttccaggccctcgtcggcatctcgctgctggagatcctgtccagccactcctccgacgaggtgtacctcggccagcgcgacaccaaggagtggacgtcggacgccaaggcgcaggaggcgttcaagcggttcggcgcgcggctgaccgagatcgagaaacgcgtcgtcaccatgaacgcggaccctcgcctcaagaaccgcaacggcccggccgagttcccctacacgctgctctaccccaacacctccgacacgaagggcgacgccgccggcatcaccgccaagggcattccaaacagcatctccatttgagttttgtctgtctgagctgaggacgtacggtcgtcgcactagttgtttgcgtttccccgttccgttccgtgaagtgtggttctcacttgcgcggtattgtgcaaatagccaagtacttactccttacggaagtcgctacgtgaggactgttgtaataaggctctattcagttcctcaataatgaagttactttgtgtttcg

SEQ ID NO: 2085 - protein, 873 aa, Zea mays
  misc_feature (1)..(873): Ceres CLONE ID no. 362993
  misc_feature (1)..(873): Ceres GEMINI ID no. 539D9
  misc_feature (176)..(851): Pfam Name: Lipoxygenase Pfam Description: Lipoxygenase
  misc_feature (58)..(164): Pfam Name: PLAT Pfam Description: PLAT/LH2 domain
MFGNIGKIPIIGDLTGSNKNAHLKGNVVLVRKTVLGLDVTSIAGSLLDGVGEFLGRGVTCQLISSTVVDPNNGNRGKLGAEASLEQWLLNPPPLLSSENQFRVTFDWEVEKQGIPGAIIVKNNHASEFFLKTITLNDVPGHGTIVFVANSWIYPQSKYRYNRVFFSNDTYLPSQMPAALKPYRDDELRNLRGDDQQGPYQEHDRVYRYDVYNDLGLPDSGNPRPVLGGTKELPYPRRCRTGRKPTKSDPNSESRLTLVDGDVYVPRDERFGHIKKSDFYGYAIKALVNAVIPAIRTYVDLSPGEFDSFKDIMKLYEGGIQLPKIPALEDLRKQFPLELVKDVLPVGGDYLLKLPMPQIIKEDKTGWMTDEEFGREILAGVNPLLVKRLTEFPPRSSLDPSKYGDHTSTIREADLENKLEGLTVQQALHGNRLYILDHHDNFMPFLVRVNSLEGNFIYATRTVLFLRGDGTLVPVAIELSLPELRDGLITAKSSVYTPKSTTGAEAWVWHLAKAYANVNDYCWHQLISHWLNTHAVMEPFVIATNRQLSVTHPVHKLLLPHYRDTMNINSNARQMLVNAGGIFETTVFPRQYAFEMSSVIYKDWNFTEQALPDDLIKRGMAVADPSSPYKVRLLVEDYPYASDGLAIWHAIEQWVTEYLAVYYPNDGVLRADVELQAWWKEAHEVGHADLKDAPWWPKMQTVAELVKACTTIIWIASALHAAVNFGQYPYAGYLPNRPSVSRKPMPAPGSDEYAELERKPEKVFVRTITSQFQALVGISLLEILSSHSSDEVYLGQRDTKEWTSDAKAQEAFKRFGARLTEIEKRVVTMNADPRLKNRNGPAEFPYTLLYPNTSDTKGDAAGITAKGIPNSISI

SEQ ID NO: 2086 - DNA, 555 bp, Arabidopsis thaliana
  misc_feature: Ceres Clone ID  no. 28026
  misc_feature: Ceres GEMINI ID 539H3
atgaagtgtgaaaacttgacgaaacaagaagagctagtcaaatctgtaattgaagaaattgatcgtaacgtttttggtttgttagtagatgaatctgctgatgtgtctgataaagaacaaatggcagtagtgtttagatttgtgataaaacttcagaaatttgacgaccgttttaatgaggtgaacactgaattgcttatttgtgctgcttctttatctcccattgatgcattttgtgagtttgatcactcaaagtttgtgaggttatctaagttctaccaagatgactttagtttaggagagttcatatctattgagcaaaaattatctatctacattgatactattcgaaatgatgagagattttctaatttaaagaatcttggagacattgttcagaagttggtggaaacacgaaaacatttgttatatccctttggttataggcttttgaaattggttttgattttgcctgttgctactgctactgttgagagatgtttttcagccatgaagatcgtaaagacacatcgacgaaattgtattggagattaa

SEQ ID NO: 2087 - protein, 206 aa, Arabidopsis thaliana
  misc_feature: Ceres Clone ID  no. 28026
  misc_feature: Ceres GEMINI ID 539H3
  misc_feature (108)..(172): Pfam Name: CBFD_NFYB_HMF Pfam Description: Histone-like transcription factor (CBF/NF-Y) and archaeal histone
MVSSKKPKEKKARSDVVVNKASGRSKRSSGSRTKKTSNKVNIVKKKPEIYEISESSSSDSVEEAIRGDEAKKSNGVVSKRGNGKSVGIPTKTSKNREEDDGGAEDAKIKFPMNRIRRIMRSDNSAPQIMQDAVFLVNKATEMFIERFSEEAYDSSVKDKKKFIHYKHLSSVVSNDQRYEFLADSVPEKLKAEAALEEWERGMTDAG

SEQ ID NO: 2088 - DNA, 789 bp, Populus balsamifera subsp. trichocarpa
  misc_feature: Ceres ANNOT ID no. 1442982
  misc_feature: Encodes the peptide sequence at SEQ ID NO. 2089
atggcctccactgcatgcttcttgcaccaccatgcactaaccactcctgccagatcaacctcatcatcacagcgccaagtggttaacctcaagcccgcccagctggtttgcagggcacagaagcaggcagtacaggaagaggatgacggtgttgtgtctcgtagattggcactcactgtgctcattggtgctgctgcccttggctcaaaggttgctcccgctgatgctgcctatggtgaatctgccaatattttcgggaagccaaagacaaacacagacttcttgccctacaatggagatggattcaagttgtcagttccagcaaaatggaatccaagcaaagagagagagttccctggtcaggttctgagatatgaggacaattttgatgccaccagcaacctttctgtcatggtcaccccaactgacacgaaatccatcgccgactacggttcccctgaggaattcctctcgaaggtggattacttgcttggaaaacaatcctccttgtttgcgacttcatctgagggtggtttcgacaccaataccgtagcaacggctaacatattggagacctcaactccggtgatcgatgggaaacaatattacttcttgtcagtgctgacaaggactgctgatggagatgaaggtggcaagcaccaacttatcacagccactgtgaaagatggtaagctttacatttgcaaggcacaagctggagacaagagatggttcaagggagcaagaaagttcgtggagagcgctgcaagttctttcagtgttgcttaa

SEQ ID NO: 2089 - protein, 262 aa, Populus balsamifera subsp. trichocarpa
  misc_feature: Ceres ANNOT ID no. 1442982
  misc_feature: Functional Homolog of  Ceres CLONE ID no. 9325 at SEQ ID NO. 1906
  misc_feature (60)..(262): Pfam Name: PsbP Pfam Description: PsbP
MASTACFLHHHALTTPARSTSSSQRQVVNLKPAQLVCRAQKQAVQEEDDGVVSRRLALTVLIGAAALGSKVAPADAAYGESANIFGKPKTNTDFLPYNGDGFKLSVPAKWNPSKEREFPGQVLRYEDNFDATSNLSVMVTPTDTKSIADYGSPEEFLSKVDYLLGKQSSLFATSSEGGFDTNTVATANILETSTPVIDGKQYYFLSVLTRTADGDEGGKHQLITATVKDGKLYICKAQAGDKRWFKGARKFVESAASSFSVA

SEQ ID NO: 2090 - DNA, 726 bp, Populus balsamifera subsp. trichocarpa; identical to SEQ ID NO: 658
  misc_feature: Ceres ANNOT ID no. 1450718
  misc_feature: Encodes the peptide sequence at SEQ ID NO. 2091

SEQ ID NO: 2091 - protein, 241 aa, Populus balsamifera subsp. trichocarpa
  misc_feature: Ceres ANNOT ID no. 1450718
  misc_feature: Functional Homolog of  Ceres CLONE ID no. 2898 at SEQ ID NO. 652
  misc_feature (47)..(209): Pfam Name: Ras Pfam Description: Ras family
MTNHHSADGEHGVASKGAPRGEVGHIVVSEELGFYSSNAPEFDYLFKLLMIGDSGVGKSSLLLSFTSDTFEDLSPTIGVDFKVKFVNIGGKNLKLAIWDTAGQERFRTLTSSYYRGAQGIIMVYDVTRRDTFTNLSEIWAKEIDLYSTNQDCIKMLVGNKVDKESDRAVTKKEGINFAREYGCLFIECSAKTRVNVQQCFEELVLKILDTPSLLAEGSKGVKKNIFSEKRPQPDASTSSCC

SEQ ID NO: 2092 - DNA, 954 bp, Populus balsamifera subsp. trichocarpa
  misc_feature: Ceres ANNOT ID no. 1450854
  misc_feature: Encodes the peptide sequence at SEQ ID NO. 2093
atggcaaagtgctttagttttgctgcaacacaggactcatgctaccgttactccttcactcgagcaggcctaaaatcatccacaaccgacctcggcgacggcacgatcatgcactgttggatcccaaagagacacaaaccatcaaaacctacgttactattaatccacggcttcggtgccaacgcaatgtggcaattcaacggtctaatcccgcagttcatgcccagattcaacgtttatgtaccggacctcctattcttcggagaatcctacacaacaagagcagaaaggtccgagtcgttccaagcgcaatgcgttatgagcctaatggaagcccaaaaagtaaccaagatggacgtgtttgggctgagctatggcgggttcgtggcgtatagcatggcggcacagtttaaagagcgcgtggggcgcgtggctctaggatgtgccggggtatgttttgaagagaaggatgtgggtggtggaggagtgtttaaggtggtgacaagtattgaggaagctgctgaggtcttgattccacaaacacctgaaaaagctagacagttggtgaggttgtctttttataaaccaccatcaagtatgccctcttgttttcttcaagattttatcgaggtaatgtgcactgatttccgtcaagagaaggaagaattaatccaggcattacacaaagatagaaagatgtcagatcttcctaagataactcagcctacactaataatctggggagaacatgaccaggttttccccctggaattggcacacagattagaaaggcatatcggagataatgcagaattagtgataataaagaatgtcggtcatgcactcaatgcagagaggcctaaggagctgtataagcacttaaagtctttcttcattgacagtcatcctttatcaaagcaagcaagccacggaaacggtactaagtcagattga

SEQ ID NO: 2093 - protein, 317 aa, Populus balsamifera subsp. trichocarpa
  misc_feature: Ceres ANNOT ID no. 1450854
  misc_feature: Functional Homolog of  Ceres CLONE ID no. 520515 at SEQ ID NO. 1876
  misc_feature (77)..(296): Pfam Name: Abhydrolase_1 Pfam Description: alpha/beta hydrolase fold
MAKCFSFAATQDSCYRYSFTRAGLKSSTTDLGDGTIMHCWIPKRHKPSKPTLLLIHGFGANAMWQFNGLIPQFMPRFNVYVPDLLFFGESYTTRAERSESFQAQCVMSLMEAQKVTKMDVFGLSYGGFVAYSMAAQFKERVGRVALGCAGVCFEEKDVGGGGVFKVVTSIEEAAEVLIPQTPEKARQLVRLSFYKPPSSMPSCFLQDFIEVMCTDFRQEKEELIQALHKDRKMSDLPKITQPTLIIWGEHDQVFPLELAHRLERHIGDNAELVIIKNVGHALNAERPKELYKHLKSFFIDSHPLSKQASHGNGTKSD

SEQ ID NO: 2094 - DNA, 1371 bp, Populus balsamifera subsp. trichocarpa
  misc_feature: Ceres ANNOT ID no. 1451365
  misc_feature: Encodes the peptide sequence at SEQ ID NO. 2095
atggagtcatgctccactgttatgacccgatccaatacatttaggtttaggccagacccggtccagcccctgaacagtgcagacgctctccactgttcactttgcagaacagtggagacgagaaaatgcagcagaagaagaaggaggaggagaaggggaaggggaaaatgcaacaaaagaagaaaaggagcgaccacccacgactgcgagaggagagatagagagctaagatttccttcttctgtttcttttgagtcttctaagagagctattctgggtattccatgggaaattgataccgagggtctgagacaatacatgagcaagtttggtgaattagaggattgtattgttatgaagcttattttctatcaatgtctgagagtgcacaatttggagcggtcatcaggtcgatctcgtggttttggatatgtgacttttgtatccgctgaagatgctaaggctgtactatcaggtgaacactttcttggtaaaagaatgctggaaattaaagtggctactccaaaggaggagatgcgagcaccaacaaaaaaagccacaaggatatttgtggccaggattccaccatctgtgacagaaactacttttcgaagtcactttgagaaatatggggagataattgacctatacatgccaaaagatcatagctcgaaagcacatcggggaattgggttcatcacatatgcaagtgcagattctgtggacagcttgatggctgaaactcatgaattgggaggctctactgtagttgaagatgactttaggcctatagcaagaacagcacctggaggatatggtgcatacaatgcttatatttctgcagctaccagatatgcagctcttggtgctcccaccttgtatgatcatcctggaccattctatggaagaggggaatcatctagaggaatgggcaaaaagatctttgttggaaggcttcctcaggaagcaagcaccgaagatttgcgccagtattttggtagatttggccacataatagatgtatatgttcctaaggatcccaagagaactggccatagaggttttggatttgtaacctttgctgaagatggtgttgcggatcgtgtatctcgaagatctcatgagatttgtggacatcaggttgcaatagattcagccacacctattgatgatgctggtccaagtggaaatttcatgatgagcgctcctgaaccttttgggggttatggtggtcccatgcgcaactttggcaggatgtatggaaccctggattatgatgatgcgggtgcatatatggttccttctaaatggggttatggtatggggagtgcaaggccttcaagagcagattggaggtacaggccttactag

SEQ ID NO: 2095 - protein, 456 aa, Populus balsamifera subsp. trichocarpa
  misc_feature: Ceres ANNOT ID no. 1451365
  misc_feature: Functional Homolog of  Ceres CLONE ID no. 362438 at SEQ ID NO. 779
  misc_feature (314)..(383): Pfam Name: RRM_1 Pfam Description: RNA recognition motif. (a.k.a. RRM, RBD, or RNP domain)
MESCSTVMTRSNTFRFRPDPVQPLNSADALHCSLCRTVETRKCSRRRRRRRRGRGKCNKRRKGATTHDCERRDRELRFPSSVSFESSKRAILGIPWEIDTEGLRQYMSKFGELEDCIVMKLIFYQCLRVHNLERSSGRSRGFGYVTFVSAEDAKAVLSGEHFLGKRMLEIKVATPKEEMRAPTKKATRIFVARIPPSVTETTFRSHFEKYGEIIDLYMPKDHSSKAHRGIGFITYASADSVDSLMAETHELGGSTVVEDDFRPIARTAPGGYGAYNAYISAATRYAALGAPTLYDHPGPFYGRGESSRGMGKKIFVGRLPQEASTEDLRQYFGRFGHIIDVYVPKDPKRTGHRGFGFVTFAEDGVADRVSRRSHEICGHQVAIDSATPIDDAGPSGNFMMSAPEPFGGYGGPMRNFGRMYGTLDYDDAGAYMVPSKWGYGMGSARPSRADWRYRPY

SEQ ID NO: 2096 - DNA, 1104 bp, Populus balsamifera subsp. trichocarpa
  misc_feature: Ceres ANNOT ID no. 1451996
  misc_feature: Encodes the peptide sequence at SEQ ID NO. 2097
atgggagtgctgtgggagaatcaatattgtgcgttacccttgaaaagttgtctgtctactctctttcctgttcctacttcctctggcaaaagcatgagctctacgtcaactcaaattgccgccctcagaggaatgggcatttatgagccctttaaccagattagctcatgggcacacgccttcagagatgatggtagcctaaacattggcccatccacaattgtgcaggtggatgctgggctagacgacaagatacaaagacgattggcacaaaatcgtgaagcagctcgcaaaagtcgcttgcggaagaaggcttatgttcaacaattagaatccagccgaatgaagttggcccagctggagcaggaacttgaaagagctaggcaccagggtgcttacttaggcagtgcatcaaattctagtcatttaggattttcaggaacagtaaatccaggaattgctgcatttgagatggaatatggacattgggttgaagaacaacataagcaaatctctgaacttaggaaagcattgcaagctcatataactgatattgagctccgaatacttgttgagaatggcttgaaccactataacaatcttttccgtatgaaagcagatgctgcgaaggctgatgtattctatctgatatctggcaaatggagaacgtcagtagaacgcttctttcagtggatcggaggattccgcccatcagaacttctaaatgttctcatgtcacaacttgagcctttgactgatcaacaactcgctgatgtctgtaaccttcgtcaatcatctcagcaagctgaagatgctctaactcaaggaattgataaactccagcagactctgtcccaaagcatagcagttgatgtaatgggtgttgggggttatggtcagatggctgatgacatggagaagttagaagctctcgagggatttgtgaaccaggccgatcaccttcggcaacaaactctgcagcatatgtctcggatattaacaatgcgccaagcagctcgtggtttacttgcattaggagagtactttcaccgtcttcgtgctctcagttctctatgggccgcttgtcctcgtgaacccacttag

SEQ ID NO: 2097 - protein, 367 aa, Populus balsamifera subsp. trichocarpa
  misc_feature: Ceres ANNOT ID no. 1451996
  misc_feature: Functional Homolog of  Ceres CLONE ID no. 33016 at SEQ ID NO. 1904
  misc_feature (80)..(111): Pfam Name: bZIP_1 Pfam Description: bZIP transcription factor
MGVLWENQYCALPLKSCLSTLFPVPTSSGKSMSSTSTQIAALRGMGIYEPFNQISSWAHAFRDDGSLNIGPSTIVQVDAGLDDKIQRRLAQNREAARKSRLRKKAYVQQLESSRMKLAQLEQELERARHQGAYLGSASNSSHLGFSGTVNPGIAAFEMEYGHWVEEQHKQISELRKALQAHITDIELRILVENGLNHYNNLFRMKADAAKADVFYLISGKWRTSVERFFQWIGGFRPSELLNVLMSQLEPLTDQQLADVCNLRQSSQQAEDALTQGIDKLQQTLSQSIAVDVMGVGGYGQMADDMEKLEALEGFVNQADHLRQQTLQHMSRILTMRQAARGLLALGEYFHRLRALSSLWAACPREPT

SEQ ID NO: 2098 - DNA, 678 bp, Populus balsamifera subsp. trichocarpa
  misc_feature: Ceres ANNOT ID no. 1453294
  misc_feature: Encodes the peptide sequence at SEQ ID NO. 2099
atggccttttactctgaggatgacaaagcagatgattacctttttaagattgttttaattggtgactcggctgttgggaaatcaaatttgcttgcaagatttgctagaaatgaattttaccctagttcaaagtcaacaataggggtagagttccaaacccaaaagatggatattaatggaaaggaaattaaagcacagatctgggacacagcaggtcaggagagatttcgggctgtaacttctgcatactacagaggtgcagttggagctctactggtttatgacatcagcaggcgccaaacatttgacagcattggcaaatggcttaacgaacttcatactcattctgacatgaatgtagtaacaattcttgtcgggaataaatctgatctcaaggatgccagagaggtatcgacagcagaaggcaaggccttggcagaggcgcagggtttgttcttcatggaaacttcagcgctcgattcctccaatgttgctgctgcctttcagacagttgttaaagagatctacaatatattaagccggaaagttatgatgtcgcaagaactcaataaaccaggtgctcccgagctgggaaatgggaagaccgtggttttaaagggagatggggatcaagaaggcaatgcagggactaaaaaaggatggtgttgttcatcttag

SEQ ID NO: 2099 - protein, 225 aa, Populus balsamifera subsp. trichocarpa
  misc_feature: Ceres ANNOT ID no. 1453294
  misc_feature: Functional Homolog of  Ceres CLONE ID no. 6827 at SEQ ID NO. 1888
  misc_feature (16)..(177): Pfam Name: Ras Pfam Description: Ras family
MAFYSEDDKADDYLFKIVLIGDSAVGKSNLLARFARNEFYPSSKSTIGVEFQTQKMDINGKEIKAQIWDTAGQERFRAVTSAYYRGAVGALLVYDISRRQTFDSIGKWLNELHTHSDMNVVTILVGNKSDLKDAREVSTAEGKALAEAQGLFFMETSALDSSNVAAAFQTVVKEIYNILSRKVMMSQELNKPGAPELGNGKTVVLKGDGDQEGNAGTKKGWCCSS

SEQ ID NO: 2100 - DNA, 837 bp, Populus balsamifera subsp. trichocarpa
  misc_feature: Ceres ANNOT ID no. 1457646
  misc_feature: Encodes the peptide sequence at SEQ ID NO. 2101
atggctgtgtccttggcttttgctaatcttcgatttcactttagtaatgttaaagtggttgaaaatcccttgtgttttggcttggctcctacacagcttccttttttatgcaaggaacgaagaagattgtcatcttccaggacaataattattgtgcaagcttcatcggctccaaccgttgaggatggaagtcaaaatgagactgatgcaattccaactccgaaagttataattgaccaagactctgatccagacgctactgtggtggagataaccttcggagatcgccttggtgctcttctggatacgatgaatgcgcttaaaaacctcgggctgaatgttgttaaggctaatgtctttttggattcttccgggaagcacaacacatttgccatcactaaatctactggtagaaaagttgatgacccagagctgctggaggccattcgtttgacaatcataaacaatttgcttcagtatcacccggaatcaagttcacagttagcaatgggaattgcctttggagtagagcaaccaaaacaggttgatgtggatatagcaacccatataaaagtcaaagatgatggtcctgaccgaagcttgtttttagtggagacagctgatcgaccaggattactggtggatcttgtaaagaatatcactgacattaacatttccgttgaatcaggagaatttgacaccgaggggttgttggccaaggcaaagtttcatgtcagctacaagggtaaagccatcagcaagcctctgcaactggttctcggtaacagtttgcgatatttcttgaggcgaccaatgaccgaggaagcaagtttttga

SEQ ID NO: 2101 - protein, 278 aa, Populus balsamifera subsp. trichocarpa
  misc_feature: Ceres ANNOT ID no. 1457646
  misc_feature: Functional Homolog of  Ceres ANNOT ID no. 543489 at SEQ ID NO. 1824
  misc_feature (87)..(150): Pfam Name: ACT Pfam Description: ACT domain
MAVSLAFANLRFHFSNVKVVENPLCFGLAPTQLPFLCKERRRLSSSRTIIIVQASSAPTVEDGSQNETDAIPTPKVIIDQDSDPDATVVEITFGDRLGALLDTMNALKNLGLNVVKANVFLDSSGKHNTFAITKSTGRKVDDPELLEAIRLTIINNLLQYHPESSSQLAMGIAFGVEQPKQVDVDIATHIKVKDDGPDRSLFLVETADRPGLLVDLVKNITDINISVESGEFDTEGLLAKAKFHVSYKGKAISKPLQLVLGNSLRYFLRRPMTEEASF

SEQ ID NO: 2102 - DNA, 801 bp, Populus balsamifera subsp. trichocarpa
  misc_feature: Ceres ANNOT ID no. 1458456
  misc_feature: Encodes the peptide sequence at SEQ ID NO. 2103
atggcggagtatggtaggagaattttactctcacatgatgcatggcatgagaggcgcttcaaaatttcttttctaattaatatccaactaattcaaggtggaaagttacaagagttttttcaaactcgtatcgatgaaaaaagacttgctagtgtcgcacttgttgataggctgtgtttaaatatgcatggattcgacctggataagttagttgtttcatggcacatgaaggctgccaccatgtgtgaattctccaagcaggaattcattggtggattacaatcactgggggtcgattctttggacaagtttcgtgaaaaaataccatatatgcgatctgagctgatggacgaacagaagtttcgtgaaatatacaactttgcttttggctgggcaaaagaaaagggacaaaaatcgttggcattggatacagcaattggtatgtggcaactgctgtttgctgaaaaacagtggcctttggtggatcactggtgccagttcttacaggctcagcataataaagcaatctcgagggacacttggtctcaacttctggagtttgccaggaccggggagttttacctttactatcttatgaaagatgcagcaatgaaaacatggcatgcttttcgtgcgtgtaggactgtatcatgggggcctggtcttacagtagaccccacattatcaaattatgatgctgaaggtgcatggccctatctgattgatgaatttgttgaatatttgaatgagaatggcataatgcaaaagggtcggtcaactgaatggagccaaaaacgatga

SEQ ID NO: 2103 - protein, 266 aa, Populus balsamifera subsp. trichocarpa
  misc_feature: Ceres ANNOT ID no. 1458456
  misc_feature: Functional Homolog of  Ceres CLONE ID no. 478453 at SEQ ID NO. 900
  misc_feature (101)..(249): Pfam Name: DUF298 Pfam Description: Domain of unknown function (DUF298)
MAEYGRRILLSHDAWHERRFKISFLINIQLIQGGKLQEFFQTRIDEKRLASVALVDRLCLNMHGFDLDKLVVSWHMKAATMCEFSKQEFIGGLQSLGVDSLDKFREKIPYMRSELMDEQKFREIYNFAFGWAKEKGQKSLALDTAIGMWQLLFAEKQWPLVDHWCQFLQAQHNKAISRDTWSQLLEFARTGEFYLYYLMKDAAMKTWHAFRACRTVSWGPGLTVDPTLSNYDAEGAWPYLIDEFVEYLNENGIMQKGRSTEWSQKR

SEQ ID NO: 2104 - DNA, 276 bp, Populus balsamifera subsp. trichocarpa
  misc_feature: Ceres ANNOT ID no. 1468218
  misc_feature: Encodes the peptide sequence at SEQ ID NO. 2105
atgtctagccgaaggtcacgatcaaggcaatcaagtagttcaagaatcagtgatgatcagatccttgatcttgttacaaagttgcaacaacttcttcctgagattcgtaacaggcgttctgacaaggtttcggctgccaagatcttgcaggagacatgcaactatattaaaagcttgcatagagaggttggtgatcttagcgagcggctgtctgagctattggaaacaactgatacagcccaagctgcaataatcaggaacttacttatgcaatag

SEQ ID NO: 2105 - protein, 91 aa, Populus balsamifera subsp. trichocarpa
  misc_feature: Ceres ANNOT ID no. 1468218
  misc_feature: Functional Homolog of  Ceres CLONE ID no. 519 at SEQ ID NO. 1806
  misc_feature (27)..(60): Pfam Name: HLH Pfam Description: Helix-loop-helix DNA-binding domain
MSSRRSRSRQSSSSRISDDQILDLVTKLQQLLPEIRNRRSDKVSAAKILQETCNYIKSLHREVGDLSERLSELLETTDTAQAAIIRNLLMQ

SEQ ID NO: 2106 - DNA, 552 bp, Populus balsamifera subsp. trichocarpa
  misc_feature: Ceres ANNOT ID no. 1474363
  misc_feature: Encodes the peptide sequence at SEQ ID NO. 2107
atgggagcatttgcatcaaggttttggttcatgttgtttccagcaaaggagtacaagattgtggtagttgggttagataatgctggaaagacaactacgctttacaaattgcatttaggggaggttgtaactactcaccctactgttggtagcaatgttgaagagcttgtctacaagaatattcgattcgaggtctgggatcttggtggacaagataggctcaggacttcatgggcaacgtattatcgtggaactcatgctgtcatagcggtgatagacagcactgatagagacaggatatccattatgaaggacgaaatttttaggctgctgggacatgatgatttacaacattctgttatactcgtcttcgcaaataaacaagacctcaaggatgccatgacaccagccgagattactgatgctctctctcttcacagcatcaagaatcatgattggcatatccaagcttgttgtgcccttacaggggacggtctacacgatggtctaggttggattgctcaaagagttactggcaaagcaccaagttga

SEQ ID NO: 2107 - protein, 183 aa, Populus balsamifera subsp. trichocarpa
  misc_feature: Ceres ANNOT ID no. 1474363
  misc_feature: Functional Homolog of  Ceres CLONE ID no. 969682 at SEQ ID NO. 1890
  misc_feature (5)..(177): Pfam Name: Arf Pfam Description: ADP-ribosylation factor family
MGAFASRFWFMLFPAKEYKIVVVGLDNAGKTTTLYKLHLGEVVTTHPTVGSNVEELVYKNIRFEVWDLGGQDRLRTSWATYYRGTHAVIAVIDSTDRDRISIMKDEIFRLLGHDDLQHSVILVFANKQDLKDAMTPAEITDALSLHSIKNHDWHIQACCALTGDGLHDGLGWIAQRVTGKAPS

SEQ ID NO: 2108 - DNA, 435 bp, Populus balsamifera subsp. trichocarpa
  misc_feature: Ceres ANNOT ID no. 1477838
  misc_feature: Encodes the peptide sequence at SEQ ID NO. 2109
atgaacaacacgagcagcagtaacagtcagcaacagcagcaatcaagtgaagcaaggcatgatgatgatgccgttctcactgaattcctcgcttctttaatggattacactcccactattcctgatgaattagtggagcattacttggctaaaagtgggtttcaatgtcctgatgtcagattggttagattagtagctgttgcgacacagaagtttgttgcagatgttgcaactgatgctcttcagcaatgcaaggcacggccggcaccagtagttaaagacaaaagggacaagcagcaaaaggaaaagcgcctaattttgacaatggaggatctgtcgaaggctctgagtgagtatggtgtaaacgtgaagcaccaggagtattttgctgatagcccatcgactgggatggatcctgcttcaagagaagagtga

SEQ ID NO: 2109 - protein, 144 aa, Populus balsamifera subsp. trichocarpa
  misc_feature: Ceres ANNOT ID no. 1477838
  misc_feature: Functional Homolog of  Ceres CLONE ID no. 25793 at SEQ ID NO. 1854
  misc_feature (38)..(88): Pfam Name: TFIID_30kDa Pfam Description: Transcription initiation factor TFIID 23-30kDa subunit
MNNTSSSNSQQQQQSSEARHDDDAVLTEFLASLMDYTPTIPDELVEHYLAKSGFQCPDVRLVRLVAVATQKFVADVATDALQQCKARPAPVVKDKRDKQQKEKRLILTMEDLSKALSEYGVNVKHQEYFADSPSTGMDPASREE

SEQ ID NO: 2110 - DNA, 876 bp, Populus balsamifera subsp. trichocarpa
  misc_feature: Ceres ANNOT ID no. 1485544
  misc_feature: Encodes the peptide sequence at SEQ ID NO. 2111
atggcctcaatgcttgcgacgaggaagtttagtggcttggtaaaaacagtaaaagtcagcaacgtttccttaggagcatctgagcgagacctcaaagaattcttttctttttctggtgatattgaatatgttgaaatgaaaagtgataatgagcgttctcaaattgcatatgttaccttcaaagattctcaaggagcagacactgctgttcttctctcgggagcaacaatagttgatctttctgtcactgtggctttggatccagattaccagcttccacctgctgctttagcagaactctctgcaacaggaaataaagctcctggtgatgaatcagctcttcggaaggcagaagatgtagtcagtggcatgcttgcaaagggtttcatcttgggcaaagatgcaatcaacaaagcaaagggttttgatgagaagcaccagttgacttcgacagcctcagctaaagttgtttctttcgacaaaaagataggtctcactgagaagattagtgctggcaccactgttgttggtgacaaagtccgggaagtggatcagaaatttcaggtttctgagaaaaccaaatcagcatttgcagttgccgagcagaaagtcagtagcgcaggatctgccataatgagtaataggtacgtgtttactggggctgcttgggtcactggtgcattcaataaggttgccaaggcagctggggatgttggccagaaggccaaagaaaaggcaggaatggctgaagaggaacaaaagaggaaaatggtggatgactttgctcaggtccacctatctgagtctcccaaagcatccggtgcaagtgaccagaagccgtccaagcctccacctgcacaaggtttgattctttga

SEQ ID NO: 2111 - protein, 291 aa, Populus balsamifera subsp. trichocarpa
  misc_feature: Ceres ANNOT ID no. 1485544
  misc_feature: Functional Homolog of  Ceres CLONE ID no. 280814 at SEQ ID NO. 1866
  misc_feature (17)..(84): Pfam Name: RRM_1 Pfam Description: RNA recognition motif. (a.k.a. RRM, RBD, or RNP domain)
MASMLATRKFSGLVKTVKVSNVSLGASERDLKEFFSFSGDIEYVEMKSDNERSQIAYVTFKDSQGADTAVLLSGATIVDLSVTVALDPDYQLPPAALAELSATGNKAPGDESALRKAEDVVSGMLAKGFILGKDAINKAKGFDEKHQLTSTASAKVVSFDKKIGLTEKISAGTTVVGDKVREVDQKFQVSEKTKSAFAVAEQKVSSAGSAIMSNRYVFTGAAWVTGAFNKVAKAAGDVGQKAKEKAGMAEEEQKRKMVDDFAQVHLSESPKASGASDQKPSKPPPAQGLIL

SEQ ID NO: 2112 - DNA, 258 bp, Populus balsamifera subsp. trichocarpa
  misc_feature: Ceres ANNOT ID no. 1487827
  misc_feature: Encodes the peptide sequence at SEQ ID NO. 2113
atggcatccaattctctcaactcttcacgtaactgtagttcctcttggacccccaagcaaaacaaactattcgaaaaggccctggctttgtatgacaaggacacccctgaccgctggcataatgttgccaaagctgtgggtgggaaatctgcagaggaagtggagaggcactatgaaattctcatcaaggatgtcagggaaattgagtctggtcgggttccattccctaattacaggtcaagtggaaacagcaactaa

SEQ ID NO: 2113 - protein, 85 aa, Populus balsamifera subsp. trichocarpa
  misc_feature: Ceres ANNOT ID no. 1487827
  misc_feature: Functional Homolog of  Ceres CLONE ID no. 143475 at SEQ ID NO. 1838
  misc_feature (13)..(58): Pfam Name: Myb_DNA-binding Pfam Description: Myb-like DNA-binding domain
MASNSLNSSRNCSSSWTPKQNKLFEKALALYDKDTPDRWHNVAKAVGGKSAEEVERHYEILIKDVREIESGRVPFPNYRSSGNSN

SEQ ID NO: 2114 - DNA, 999 bp, Populus balsamifera subsp. trichocarpa
  misc_feature: Ceres ANNOT ID no. 1491629
  misc_feature: Encodes the peptide sequence at SEQ ID NO. 2115
atgcaagaaccaaacttgggcatgatgggaagtggaagtgggggtgcacttggtggtttaagcagtggagagatgtctgtgtctttatcaggtgatcagtctcgccaactcaaggcagaaatagctacacaccctttatatgagcagctattatcagctcacgtgtcttgccttcgtgtagctacaccaattgatcaattacctcttatagatgctcagttatcacaatctcatcatcttcttaggtcttatgcttcacagcacaaccaacatggtcattctctttctccccatgaaaggcaagacctagacaacttcctggcacagtatttgataatattgtgtactttcaaagaccagcttcaacaacatgtcagagtgcacgccgttgaagctgttatggcctgccgtgaaattgagaccaccttacaggctctcactggtgtgactctaggagaaggtacgggtgcaaccatgtctgacgatgaggatgacctgcaaatggatttctctttagatcaatcaagtgctgatgggcatgacatgatgggatttggccctctgcttcctacagaatctgaaaggtctttgatggagagagttcggcaggaactgaagattgaattaaagcagggcttcaaatcaagaattgaagatgtcagggaggagatattgagaaaaagaagggctggaaaactaccgggtgacactacttcagtgctgaagaattggtggcagcaacactccaagtggccttacccaactgaagatgacaaagcaaaacttgtggaggagacagggttacagctaaagcagattaacaattggttcatcaaccaaaggaagaggaactggcacagcaactctcaatcggtgacatccttgaagtccaagcgcaaaagtactttctacttgctaacaaccagttgggaagtaaagaggctgagaccaagagctgccaacgttgaagaagttgcctttggcggtctcgtactttaa

SEQ ID NO: 2115 - protein, 332 aa, Populus balsamifera subsp. trichocarpa
  misc_feature: Ceres ANNOT ID no. 1491629
  misc_feature: Functional Homolog of  Ceres CLONE ID no. 106887 at SEQ ID NO. 1832
  misc_feature (204)..(225): Pfam Name: ELK Pfam Description: ELK domain
  misc_feature (35)..(79): Pfam Name: KNOX1 Pfam Description: KNOX1 domain
  misc_feature (93)..(148): Pfam Name: KNOX2 Pfam Description: KNOX2 domain
MQEPNLGMMGSGSGGALGGLSSGEMSVSLSGDQSRQLKAEIATHPLYEQLLSAHVSCLRVATPIDQLPLIDAQLSQSHHLLRSYASQHNQHGHSLSPHERQDLDNFLAQYLIILCTFKDQLQQHVRVHAVEAVMACREIETTLQALTGVTLGEGTGATMSDDEDDLQMDFSLDQSSADGHDMMGFGPLLPTESERSLMERVRQELKIELKQGFKSRIEDVREEILRKRRAGKLPGDTTSVLKNWWQQHSKWPYPTEDDKAKLVEETGLQLKQINNWFINQRKRNWHSNSQSVTSLKSKRKSTFYLLTTSWEVKRLRPRAANVEEVAFGGLVL

SEQ ID NO: 2116 - DNA, 618 bp, Populus balsamifera subsp. trichocarpa
  misc_feature: Ceres ANNOT ID no. 1539674
  misc_feature: Encodes the peptide sequence at SEQ ID NO. 2117
atggcgggccttgattacttgttcaagctccttctcattggcgattctggtgttggcaaatcttgtctccttctgagatttgatgattcatatattgagagttatataagcaccattggggttgactttaaaatacgtactgtggagcaagatgggaagaccataaaactccaaatttgggatactgctgggcaagaacgatttagaacgattaccagcagctactaccgtggggcacatggtatcatagtgggtgatcatgttgtttatgatgtgacagaccaagagagcttcaacaatgtcaagcagtggctcaatgaaattgatcgatatgctagtgataatgtgaacaaacttctggttggaaacaagtctgatctcacttcaaataaagttgtgtcatatgagcaggcaaaggcttttgctgatgagattggtatacctttcatggaaactagtgcaaaagatgccactaatgtggaacaagctttcatggccatgtctgctgcaatcaaggatagaatggcgagccaaccagccatgaacaatgcaaaaccttcaacagtgcagttcaaaggacagcctgttgaacagaagggcggctgctgctcatcttga

SEQ ID NO: 2117 - protein, 205 aa, Populus balsamifera subsp. trichocarpa
  misc_feature: Ceres ANNOT ID no. 1539674
  misc_feature: Functional Homolog of  Ceres CLONE ID no. 1492 at SEQ ID NO. 465
  misc_feature (9)..(173): Pfam Name: Ras Pfam Description: Ras family
MAGLDYLFKLLLIGDSGVGKSCLLLRFDDSYIESYISTIGVDFKIRTVEQDGKTIKLQIWDTAGQERFRTITSSYYRGAHGIIVGDHVVYDVTDQESFNNVKQWLNEIDRYASDNVNKLLVGNKSDLTSNKVVSYEQAKAFADEIGIPFMETSAKDATNVEQAFMAMSAAIKDRMASQPAMNNAKPSTVQFKGQPVEQKGGCCSS

SEQ ID NO: 2118 - DNA, 1030 bp, Panicum virgatum
  misc_feature: Ceres CLONE ID no. 1756586
  misc_feature: Encodes the peptide sequence at SEQ ID NO. 2119
gtctagactctagaggagacagtcgcaggaggccaggagaagcagccggcgagcagcaagccatggcgtccaccacctgcttcctccaccagtccaccgcccgcttcggcgccgccgccgcctcggcgcgcccccaggcgccgcgggcccagcagctcgtgtgcagggcgcagaagccgcaggacgccgccgccgagggcgacgccgcggtcacccgccgcgccgcgctcacgctcctcgcgggcgccgccgccgtcggcgccaaggtgaaccccgccgccgccgcctacggagaagcagccaacgtgttcgggaagcccaagacgaacacggaattcatcgcctacagcggcgacggcttcaagctgctgatcccgtccaagtggaaccccagcaaggagcgcgagttccccggccaggtgctccgctacgaggacaacttcgacgccaacagcaacgtctccgtcatcgtccagcccaccaccaagaagaccatcaccgactacggctcgcccgaggagttcctcgcccaggtcgactacctcctcggcaagcaggcctacgccggcaagacggactccgagggcgggttcgagaccgacgcggtggccacggccaacatcctggagagctcggcgccagtggtggacgggaagcagtactacagcgtgtccgtgctgaccaggacggcggacggcgacgagggcggcaagcaccagctcatcacggccaccgtctcggacggcaagctctacatctgcaaggcgcaggccggcgacaagaggtggttcaagggcgccaggaagggcgtcgagaaggcagccagctccttcagcgtcgcataagcagtgcacgcatcatctgtgtgccggaatttgtttcttttggttcagggatgcttacgtagatagaggttgggcatgcgtgtgcgctccggcctttgattgtacatgagaacaaagaccaaggagagctccatttcgtccctgcaaggattgatttctgctctcaaaaaaaaaaaaaaaaaaaa

SEQ ID NO: 2119 - protein, 260 aa, Panicum virgatum
  misc_feature: Ceres CLONE ID no. 1756586
  misc_feature: Functional Homolog of  Ceres CLONE ID no. 9325 at SEQ ID NO. 1906
  misc_feature (58)..(260): Pfam Name: PsbP Pfam Description: PsbP
MASTTCFLHQSTARFGAAAASARPQAPRAQQLVCRAQKPQDAAAEGDAAVTRRAALTLLAGAAAVGAKVNPAAAAYGEAANVFGKPKTNTEFIAYSGDGFKLLIPSKWNPSKEREFPGQVLRYEDNFDANSNVSVIVQPTTKKTITDYGSPEEFLAQVDYLLGKQAYAGKTDSEGGFETDAVATANILESSAPVVDGKQYYSVSVLTRTADGDEGGKHQLITATVSDGKLYICKAQAGDKRWFKGARKGVEKAASSFSVA

SEQ ID NO: 2120 - DNA, 1616 bp, Panicum virgatum
  misc_feature: Ceres CLONE ID no. 1768915
  misc_feature: Encodes the peptide sequence at SEQ ID NO. 2121
aaccacagcccaccacggattaaacaaagcgcgcacccaatcaacgcggcggcgcattcgcacctcgcagccatatctaccctcgcttaaaagctcgcgcgagccgtgtctggggaggaggatccactgatccagtcccatccggccgaatcccctcgccgccgccgccctctccttcctctaactaaaaccctagcgtgcgtgcgcggggatgaagatccagtgcaacgcgtgcggggccgcggaggcgcgggtgctgtgctgcgcggacgaggcggcgctctgcggggcctgcgacgaggaggtgcacgccgccaacaagctcgcggggaagcaccagcgggtgccgctgctctcggacgccggcgccgccgcggcggcggcggcgcccgccgtgcccaagtgcgacatctgccaggaggcttctggatacttcttctgcctagaggaccgtgcactactttgtagagattgtgatgttgctatacacacggtaaattcatttgtttcggtgcatcagagattcctgctaactggagttcaggtgggccttgatcctgccgatccagttccgcccattgctgaaaaccgtgttaatgacgctggtggctcggtatatcaaccagcaaaacatctgccaaggagaaacccaacagttcaattttcaggtgaaggcactgcttctgttcccagcaaaaatttaataaatggagactattcaagacagaattctgttccaacagtcaggacgggagtagttgattggacaatgcacaatgctgcaattcaatccgtagaatctccgactaagtacatgtcagaggaaagtccaacacttctgcaatctagccagaccacagcggccttttccaatcaaattaacagcaatagtgatcgggcctacaacttgccgttctcaggtggtaatgggtcagacagcctaccagactggcctgtggatgagttcttcactaactcagaatatggcacaaatttcagcttttcggagcatggtacttctaagagtgacaatgctaagctggggagtgctggggggtctccacaatgccgtttagccgaaggcttcgttgctgaggaactattaggccaggtgcctggattggtaaccgatgaatatatgagccgagtacctgagaattcatgggcagtccctgaggttccctcaccaccaacagcatcggggctcaattggcatgggaatttgcatttcgctgcatatgacagcaccatgttcgttcctgaaatctcctccctccagagctctcaagatcaatttgctgtaccttccagtttcaagcgccagaggcgacagtattgagtgacaacaaagagcactagacaccactgtctattttagacactcttgagaaaggcctcttgctgggccaaacgtcgagaaaggatcagaacttgatgatcattccaacttcaactgaattatctggtagccaggttttaagtgtgttgtccattttccaaatattcgagcttcaacagtgaatcgttgtggtgtttgagtttgtatatatagagaaataaagaggagcaccagtaacatcataattagtggcacagaaaaaaaaaaaaaaaaaaaa

SEQ ID NO: 2121 - protein, 375 aa, Panicum virgatum
  misc_feature: Ceres CLONE ID no. 1768915
  misc_feature: Functional Homolog of  Ceres CLONE ID no. 112194 at SEQ ID NO. 370
  misc_feature (60)..(107): Pfam Name: zf-B_box Pfam Description: B-box zinc finger
MKIQCNACGAAEARVLCCADEAALCGACDEEVHAANKLAGKHQRVPLLSDAGAAAAAAAPAVPKCDICQEASGYFFCLEDRALLCRDCDVAIHTVNSFVSVHQRFLLTGVQVGLDPADPVPPIAENRVNDAGGSVYQPAKHLPRRNPTVQFSGEGTASVPSKNLINGDYSRQNSVPTVRTGVVDWTMHNAAIQSVESPTKYMSEESPTLLQSSQTTAAFSNQINSNSDRAYNLPFSGGNGSDSLPDWPVDEFFTNSEYGTNFSFSEHGTSKSDNAKLGSAGGSPQCRLAEGFVAEELLGQVPGLVTDEYMSRVPENSWAVPEVPSPPTASGLNWHGNLHFAAYDSTMFVPEISSLQSSQDQFAVPSSFKRQRRQY

SEQ ID NO: 2122 - DNA, 1005 bp, Panicum virgatum
  misc_feature: Ceres CLONE ID no. 1771639
  misc_feature: Encodes the peptide sequence at SEQ ID NO. 2123
aacccagatcattcgttcggaccgacatccctccatctccgttcgagaccgccgccggcaaccgattccgccagatttgagtcgacaatgaatcccgagtatgactaccttttcaagcttttgcttattggtgattctggtgttgggaagtcttgcttgcttctcagatttgcggatgattcatatctggacagctacatcagcacaatcggagttgattttaaaattcggacagtagagcaagatgggaagaccataaagcttcaaatctgggatactgctgggcaagagcgtttcaggacaatcactagcagttactaccgaggagctcatggaatcattattgtatatgatgttacagaccaagatagcttcaacaacgtgaagcagtggttgaacgaaattgaccgttatgcaagcgacaatgttaacaagcttcttgttgggaacaagagtgatctaactgccaacaaagttgtggcaactgagacagcgaaggcgtttgctgacgagatgggcatcccattcatggagacgagtgcaaaaaacgccatcaatgtcgagcaggctttcatggctatggccgcatccatcaaggacaggatggccagccaaccagccgcgtcaaacgcaaggccagcgaccgtgcagattcgcgggcagcctgtcaaccagaagacgtcatgctgctcgtcctaagatcacctgatttttttggttccctgtaaacgacacgctattacttaccgttcgctcattttgcgaaaaatgtatttgcattatttgttcagcaaacgcccttgctgatagcatctgttcgttggtcagatgattagagagctgcagatgtgtaagaacaccgttgtagagagaggacctgcagttctctctcaacctaaggagcaaacagcagcaatttcattaccttcattcttttctaccttacaaccacactgtttataaatcacgcgttgcatttgtgaacaaaaaaaaaaaaaaaaaaaa

SEQ ID NO: 2123 - protein, 203 aa, Panicum virgatum
  misc_feature: Ceres CLONE ID no. 1771639
  misc_feature: Functional Homolog of  Ceres CLONE ID no. 1492 at SEQ ID NO. 465
  misc_feature (10)..(171): Pfam Name: Ras Pfam Description: Ras family
MNPEYDYLFKLLLIGDSGVGKSCLLLRFADDSYLDSYISTIGVDFKIRTVEQDGKTIKLQIWDTAGQERFRTITSSYYRGAHGIIIVYDVTDQDSFNNVKQWLNEIDRYASDNVNKLLVGNKSDLTANKVVATETAKAFADEMGIPFMETSAKNAINVEQAFMAMAASIKDRMASQPAASNARPATVQIRGQPVNQKTSCCSS

SEQ ID NO: 2124 - DNA, 840 bp, Panicum virgatum
  misc_feature: Ceres CLONE ID no. 1775129
  misc_feature: Encodes the peptide sequence at SEQ ID NO. 2125
gtgagcttagcgagtcttgggactccagaaggttcccacctccgcctccatatcttcttcttggtcctccgcctccaccacttcgcgtgctcttacgtttccgtgttgagagagagacagagagagaggacacgcgagaggctgccgtgtgggggccggagagtcaacgacagcgagggggagagaaggcgatggcggggatcgggccgatcaggcaggactgggagccggtggtggtgcggaagaaggcgcccaccgccgccgccaagaaggatgagaaggccgtcaacgccgcgcgccgctccggcgccgagatcgagaccatgaagaagtacaacgctgggacgaacaaggccgcgtccagcggcacatcgctcaacaccaagcgactcgatgacgacactgagaatctagcccatgagcgtgtcccaagtgacctgaagaaaaacctcatgcaagcaaggctggataagaagatgacccaggcacagcttgctcagatgatcaatgagaagccacaggtgatccaggagtatgagtcgggcaaggcgatccctaaccagcagattattagcaagcttgagagggcactgggaacaaagctgcgcgggaagaaataactttaaaacttgtgccccggagcagcatgaagctgaagaagacaaggcagtctgtctgcttgttatctaatgcttggtttttaatgtcatgcagattgtttctgtgtttggtacatgagtgaataacagtgtcgtggtggaccttgtaatgccttgctgcttttatgtgtcatatgacccctggtacgtaagagttgcgcgaaaaaaaaaaaaaaaaaaa

SEQ ID NO: 2125 - protein, 142 aa, Panicum virgatum
  misc_feature: Ceres CLONE ID no. 1775129
  misc_feature: Functional Homolog of  Ceres CLONE ID no. 474636 at SEQ ID NO. 1874
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
MAGIGPIRQDWEPVVVRKKAPTAAAKKDEKAVNAARRSGAEIETMKKYNAGTNKAASSGTSLNTKRLDDDTENLAHERVPSDLKKNLMQARLDKKMTQAQLAQMINEKPQVIQEYESGKAIPNQQIISKLERALGTKLRGKK

SEQ ID NO: 2126 - DNA, 1693 bp, Panicum virgatum
  misc_feature: Ceres CLONE ID no. 1776961
  misc_feature: Encodes the peptide sequence at SEQ ID NO. 2127
gcaacccatttcctctcccttcgctcccccagcggccgccgctcgccacgcggtcggcccgtgcgccgcgccgccgccctccacgctcccctgcccagctgcaggtcgagtccggctggtgcggcagcaccctcccttcccacgacttctctgttctttctctcggcctctgtcttccttcctagcggcgacgaccgggcgagttgcgctgcccgttgttcgtcaagggacgggcacttcgccggcgacgaatatcagacaggggtatgcctgcctattcccctcccttcccatcctgctgcgcgaaatcaaacgcccaaacccctaacatatggtatttgtattcggatctgaccatgatttgtattcggatctgaccatgtcctatactggttccgcccctgcccatgccccacgttaaggccgtcactgctaccttgggtgccagtgcaatgcccggcggatcttcagctgctgatggtgaagtggaggcaggatttgcaaagctccagggcgaagatttcgagtactacatgcagacatattcaatcatgctgggccgcaacagcaagaagtcgacagtggatgtggatctctcgagcctcggcgggggtatgaacatctcccgccaccatgcccggatattctacgatttccagcgtcgtcggtttgccctcgatgttattggcaagaatggatgccttgttgagggtgttctgcacctccctggaaacccacctgttaagcttgattcgcaggatctgctgcagattggggacaaaaagttttactttctgctgccaacgcgatctatctttgcctcagctgctgctgctcgacatgctcccattattcctccaccgctcccaccaccatcatatgcacgtccaggccgccctcgtttgtctgattttcacgaccgctcctttgaaggtgattatggcagggaagtggatgacattgggactggtatcagtgaaagtggggtgaggggaaagttgataaagagaaacaagaagtcctctggagagttggacatctatggtgggcaccgaatcaatgttgaagcaataggaaccctaggtgaagacagtagatcagaaataagatcaaggggtgacagggatattgacaatcaacaaatccttcaagcagaagagaaggaagtcgtgtcatctgttgccacagtgttatctgacctctgcggtcctggagaatggatgcccatggcaaaactccatacagagcttcttgaacagtttggcaacgtgtggcaccccagcagggtccgaaagtacctaacaacagatgactggtcaccaacggagacgaagggcaggccttggtttggccttctggccctgctcagaaagtacccagagcattttgtcatcaacacaagatcgaaaggcagagtgacttcgaagtttgtttcgctggtctccttgctctcctagaggggaaacgaggggggctagctgtcctgccgaggaaataacaggcgtttcagtctgttcagaagggtaggaggtgtctctctcatttgcctcttctgttttgaaccctacgtatggtatcaactgtgtttgaacagccgtaatgactggatcattatcatctctgtactgttgacttgtatatgtactatggaagcatgagttttaaccaatgctaaaaaaaaaaaaaaaaaaaa

SEQ ID NO: 2127 - protein, 349 aa, Panicum virgatum
  misc_feature: Ceres CLONE ID no. 1776961
  misc_feature: Functional Homolog of  Ceres CLONE ID no. 280261 at SEQ ID NO. 612
  misc_feature (48)..(123): Pfam Name: FHA Pfam Description: FHA domain
MPHVKAVTATLGASAMPGGSSAADGEVEAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASAAAARHAPIIPPPLPPPSYARPGRPRLSDFHDRSFEGDYGREVDDIGTGISESGVRGKLIKRNKKSSGELDIYGGHRINVEAIGTLGEDSRSEIRSRGDRDIDNQQILQAEEKEVVSSVATVLSDLCGPGEWMPMAKLHTELLEQFGNVWHPSRVRKYLTTDDWSPTETKGRPWFGLLALLRKYPEHFVINTRSKGRVTSKFVSLVSLLS

SEQ ID NO: 2128 - DNA, 549 bp, Arabidopsis thaliana; identical to SEQ ID NO: 1184
  misc_feature: Ceres CDNA ID no. 23389966
  misc_feature: Encodes the peptide sequence at SEQ ID NO. 1186

SEQ ID NO: 2129 - protein, 217 aa, Panicum virgatum
  misc_feature: Ceres CLONE ID no. 1963936
  misc_feature: Functional Homolog of  Ceres CLONE ID no. 224919 at SEQ ID NO. 585
  misc_feature (14)..(175): Pfam Name: Ras Pfam Description: Ras family
  misc_feature (124)..(124): Xaa is any aa, unknown, or other
  misc_feature (125)..(125): Xaa is any aa, unknown, or other
MGGRVDHEYSYLFKMVLIGDSGVGKSNILSRFTRNHFSLDSKSTIGVEFATKSLQMEGKTIKAQIWDTAGQERYRAITSAYYRGAVGALLVYDITKRQSFDNVHRWLRELRDHADSSIVIMMVXXKSDLIHLRAVSEDEGKALAEKEGLFFLETSAMEAVNVEEAFQTIISEVYGIVNRKALAAKEMAAAAAPLPSQGKTISIDSTSENTKKACCST

SEQ ID NO: 2130 - DNA, 1756 bp, Panicum virgatum
  misc_feature: Ceres CLONE ID no. 1792937
  misc_feature: Encodes the peptide sequence at SEQ ID NO. 2131
gtttttctctctcctgcgccgcgccgtccctcatctccgccgccgaatccgaggctccgatctcgggttcaccgcagcgcaccaagcacccccggctcgatctgctactcctcctccgcgcttcagtcatgtcgggaatggcacctgagggttcccagtttgatgctaagcactacgattctaaaatgcaggagctgctgagcactggtgagactgaggaattcttcacttcctatgatgaagtgtttgagagttttgatgacatgggcctccaagagaatcttttgagaggcatttatgcttatggttttgagaagccttctgctattcagcagagaggaattgtgcctttctgcaagggccttgatgtcattcagcaagcacagtctggtacaggaaagacagcaactttctgttctgggatcttgcagcagcttgactacggcctggttgaatgccaggccttagtccttgcccccacccgtgagcttgctcagcaaattgagaaggtcatgcgtgcgcttggtgactaccttggtgtgaaagttcatgcatgtgttggaggaacctctgtccgtgaggaccaaaggattcttgctagtggtgtgcatgttgttgttgggacacctggtcgtgtgtttgacatgttgcgtaggcagtctctccgacctgatcacatcaagatgtttgtcctggatgaagcagatgagatgctttctcgtggtttcaaggatcagatttatgacatcttccagcttctcccagcaaagattcaggttggagtcttctctgctaccatgccccctgaggctcttgagattacccgcaagttcatgaacaagcctgtgagaatcctcgtcaagagagatgagctcacccttgagggtatcaagcagttctatgtgaatgtggagaaggaagattggaaactggacacactatgtgatctgtatgagaccctggccatcacccagagtgtcatcttcgtcaacacccgccgcaaggtggactggctcactgacaagatgaggagcagggaccatactgtttctgccactcatggtgatatggaccagaacactagggacatcatcatgagggagttccggtctggttcatcccgtgtgctcatcaccaccgacctgcttgcccgtggtattgatgttcagcaggtgtccctggtcatcaactacgatctccctacccagccagagaactacctgcatcgcattggtcgtagtggtcgtttcggtaggaagggtgttgccatcaactttgtcactcgtgacgacgagcggatgctgtttgacatccagaggttctacaatgtgctgattgaggagctgcctgccaatgttgctgaccttctgtgatcaagttgatgaaaaacagcaaaacaaaaaattcggtaagggggacctgataaggcttgtttttgttgaaatattgccacatgtggggagggggtgatatggtcggtggcgtttctagtcgtggtcatggtctcatggacaatttgtgatttttccttatgccatgttttggtaatttttgtagctgcctaggccttgtggtatgtgctgctggggggggggggggggtcattagtatggagagggagacgctgctggagtctttttcgatttagtcttttgtttaaaactatgtatgaccctatgatggtattatttgtgtcatccttgacttatattctgccataactgcatgtatcctgcaaaaaaaaaaaaaaaaaaaa

SEQ ID NO: 2131 - protein, 414 aa, Panicum virgatum
  misc_feature: Ceres CLONE ID no. 1792937
  misc_feature: Functional Homolog of  Ceres CLONE ID no. 42530 at SEQ ID NO. 1610
  misc_feature (299)..(375): Pfam Name: Helicase_C Pfam Description: Helicase conserved C-terminal domain
  misc_feature (65)..(231): Pfam Name: DEAD Pfam Description: DEAD/DEAH box helicase
MSGMAPEGSQFDAKHYDSKMQELLSTGETEEFFTSYDEVFESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDHIKMFVLDEADEMLSRGFKDQIYDIFQLLPAKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVLIEELPANVADLL

SEQ ID NO: 2132 - DNA, 1524 bp, Panicum virgatum
  misc_feature: Ceres CLONE ID no. 1797459
  misc_feature: Encodes the peptide sequence at SEQ ID NO. 2133
atccagatcctccagtcgcccacggcccaccctccgccctctcctcttccttccttcctacctctccctgttcgtgttcgtctcggcttccggtcgctgattccgcgcggagattctgtggtggcggtgctcgctcgctctctcgcgcgcgcttgtggtttcgcgtgcatggggctcgacgtggcggagatcgggatggggctggatctggggctcgacctcaggctcttcgccgcgcggagcgccggcgggatggcggcggccgcggcaaagggcgcgcccgcgggaatcgaggcctgcatcaggagcctcgaggaggagcgccgcaagatcgaggtcttcaggcgcgagctcccgctctgcgtccgcctcctcgccgacgtgatcgaggagttgaaggaggaggccgcgaggaaaggcggcgattcggagttgaggccggacgacggcgacaagaggaaatggatgagcaccgcgcagctctgggtggactccgacgccacatccaagtccgagaaagagcaacgaaatgaggtgacctcgccggagcccaagttgctcggtggccccatgccgatacgggctgttccggcggtgccgctgccgcctccaccgtgcttcaggaaggatgacaacgcttcgggaactgccggattgcccggtctgtcgttgctgccactggctgcaaagacatcggtctctccggtccctgccgttgatgaacaccggcagaacgctggcgccgcaagattgtctgccaccatgtcaccatctggccctggactcaacctgcatgctcagactcagcagcagcaacaacaggcgaggaagacaaggcggtgctggtcgccggagcttcaccggcagtttgttgctgccttgcatcaactcggtggcccacaagttgctactccgaagcagatcagagaggtgatgcaagtggacgggcttacaaacgacgaagtgaaaagccatctccagaagtaccggctgcacaacagaagatcgcccggcgtggctccggtgagccagtcgattgtgttggtgggtggcctctggggttctcaggagcaaagcagctcacagtcagggtctcctcagggcccccttcagttctctgggtcagggacggccatctctgcagccaccgtcggcggcgacggcagcagcagcgacgaagatgacaagtctgatgaaggctacagccggaaatgattgcaaggctgcgtttgcagaagatcggttgagagtgtagatgtagcatcgcggctttgcgcatcggtggcaataacagattcgtcagtcaggagaggctgtagtgcagccaggccatgcatacagggagattgggcggtgcgtgccccagagatgaacttatcatgagtttggttgttggttgtcatgtacatgaaaagctgataccagttttcatgaggcttcttgactttagttcccgggcagatccaaattttcgccctgagaattatatacatgcgagattcacaaaaaaaaaaaaaaaaaaaa

SEQ ID NO: 2133 - protein, 348 aa, Panicum virgatum
  misc_feature: Ceres CLONE ID no. 1797459
  misc_feature: Functional Homolog of  Ceres CLONE ID no. 240112 at SEQ ID NO. 601
  misc_feature (223)..(274): Pfam Name: Myb_DNA-binding Pfam Description: Myb-like DNA-binding domain
MGLDVAEIGMGLDLGLDLRLFAARSAGGMAAAAAKGAPAGIEACIRSLEEERRKIEVFRRELPLCVRLLADVIEELKEEAARKGGDSELRPDDGDKRKWMSTAQLWVDSDATSKSEKEQRNEVTSPEPKLLGGPMPIRAVPAVPLPPPPCFRKDDNASGTAGLPGLSLLPLAAKTSVSPVPAVDEHRQNAGAARLSATMSPSGPGLNLHAQTQQQQQQARKTRRCWSPELHRQFVAALHQLGGPQVATPKQIREVMQVDGLTNDEVKSHLQKYRLHNRRSPGVAPVSQSIVLVGGLWGSQEQSSSQSGSPQGPLQFSGSGTAISAATVGGDGSSSDEDDKSDEGYSRK

SEQ ID NO: 2134 - DNA, 1422 bp, Panicum virgatum
  misc_feature: Ceres CLONE ID no. 1816333
  misc_feature: Encodes the peptide sequence at SEQ ID NO. 2135
gtctcccgtggtcctcctccactccacctccttctccgccttccccctcgagctcgcctcgcctcgaccaggctccgcagccctcgcccgcagctggccggctctctcgcgtccagccgggagccgggctctggggggatggcgttccactacccggaccacgcgctggcgatggaccccgcggccggggtcggcgcggcggtcaaccctagcttcgtgtcccccggcggcggcggggtcgggggaggagggggcgggtgggagcgggagaaggcggccatcgcggcgcacccgctgtacgagcgcctgctcgaggcgcacgtcgcctgcctccgcgtcgccacccccgtcgaccagctcccgcgcatcgacgcgcagatagccgcgaggcccccgcccatggcggcggccgcggccgcggccgctgcggcggcgggcggggcgcagtcgggaggcgaggagctcgacctcttcatgacgcattacgtattgctcctctgttcattcaaggaacaactccagcagcatgtgcgtgttcatgcaatggaagcagtgatggcttgctgggagcttgaacaaactttacaaagccttactggggcatctcctggtgaaggcactcgggctactatgtctgatgatgaagacaatcaggtagacagcgagagcaacatatttgatggaaatgaggggtcagatggaatgggattcggtcccttaatgttgactgagggtgagagatccttagttgagcgtgtgcggcaggagctaaagcatgagcttaagcagggatacagagaaaaacttgtggatattagggaagagataatgcggaagcgaagggctggaaaactccctggggacacagcttctacgttgaaagcctggtggcaagctcattctaaatggccatacccaactgaggaagacaaggctagactggtacaggaaacagggctgcaactaaagcagatcaacaactggttcatcaaccagcgtaagaggaactggcacagcaatccggcatcatcctcatccgacaaaagcaagagaaaaaggtgatggcaatgctgagcaatcctggtagagcgtggtcggagaagaattatatgtaaataacgcgtctactgagaagaatggcaccatatttgttgcgtgggaaacaaccattcgagtgggtgtttcctgagccccatattcatacaaagatatcacacgatgtaataatgttgtaagtagtcatgtaaactaaataatttgtatagcgaatcactagagactagcattcatgtttggtattgtatagttttaattgattgagcgtactgtctctgtataactctacgatttaaatgtatttgactagcactcgatattgtattttgtattagtatgtcatgcgaaaaaaaaaaaaaaaaaaaa

SEQ ID NO: 2135 - protein, 307 aa, Panicum virgatum
  misc_feature: Ceres CLONE ID no. 1816333
  misc_feature: Functional Homolog of  Ceres CLONE ID no. 21240 at SEQ ID NO. 1473
  misc_feature (210)..(231): Pfam Name: ELK Pfam Description: ELK domain
  misc_feature (42)..(86): Pfam Name: KNOX1 Pfam Description: KNOX1 domain
  misc_feature (99)..(154): Pfam Name: KNOX2 Pfam Description: KNOX2 domain
MAFHYPDHALAMDPAAGVGAAVNPSFVSPGGGGVGGGGGGWEREKAAIAAHPLYERLLEAHVACLRVATPVDQLPRIDAQIAARPPPMAAAAAAAAAAAGGAQSGGEELDLFMTHYVLLLCSFKEQLQQHVRVHAMEAVMACWELEQTLQSLTGASPGEGTRATMSDDEDNQVDSESNIFDGNEGSDGMGFGPLMLTEGERSLVERVRQELKHELKQGYREKLVDIREEIMRKRRAGKLPGDTASTLKAWWQAHSKWPYPTEEDKARLVQETGLQLKQINNWFINQRKRNWHSNPASSSSDKSKRKR

SEQ ID NO: 2136 - DNA, 1166 bp, Panicum virgatum
  misc_feature: Ceres CLONE ID no. 1826678
  misc_feature: Encodes the peptide sequence at SEQ ID NO. 2137
aagtcgtctactacaagtcttcatccattccattccacgcactagtgttgttattagcacccaagtcccatccctaatcaccgtctaatcaggctccccaaccatggcggcggcggcggcggcggtggcggtggaggtcccagtgtcggcgccggtgagaacagtgaaggtcacaaacgtctcacttactgcaactgtacaagacattaaggagttcttttccttttcaggagatattgaacatgtggagatgcaaagtggtgatgagtggtctcaagttgcatatgtgactttcaaagatgcacaaggtgcagagactgcacttcttctttcgggtgccacaatagttgatctttctgtcatcattgcacctgctccagaatatcagccaccccctactgcctctgctccaccaatgagtggaaccagagttccagttggtggagacaacaacgttgtccataaggccgaggatgtcgtcagcactatgcttgctaagggttttgtcctaggcaaagatgcagttggcaaggccaaagcttttgatgagaagcacggcttcacatccacagctggtgctaaggtggcttccattgacaagaaaatcggcctgagcgagaagatcaccacaggcacttccatggtgagtgggaaggtgaaggagatggaccagaagttccaggtctcagacaagaccaagtccgctttcgctgctgctgagcagaaggtgagcagcgctggatcggccatcatgaagaacaggtatgtcttcaccagcgcatcgtgggtcaccaacgcattcaacaaagtcgccaaggctgccacggatgttgggacgatgaccaaggagaagatggctgctgaggagcagcacaagacttcagggccttcttctggggggcactcgtatacgcccatccaatgattctttggctttggtcttgtgtgcctcctttggcgtgttgtattattggtggatgtaaaacatagatatagaacagatcaggcctcctgccatatgttcatcgttccatgtgttaaatttcatactgcaggaattttgtttttgtagaccagaaaagtatgaatgatggtggtaccaatgcattggcttatatgaatccatgttcaggctggttctggttgaaaaaaaaaaaaaaaaaaaa

SEQ ID NO: 2137 - protein, 273 aa, Panicum virgatum
  misc_feature: Ceres CLONE ID no. 1826678
  misc_feature: Functional Homolog of  Ceres CLONE ID no. 280814 at SEQ ID NO. 1866
  misc_feature (128)..(154): Pfam Name: Galanin Pfam Description: Galanin
  misc_feature (21)..(89): Pfam Name: RRM_1 Pfam Description: RNA recognition motif. (a.k.a. RRM, RBD, or RNP domain)
MAAAAAAVAVEVPVSAPVRTVKVTNVSLTATVQDIKEFFSFSGDIEHVEMQSGDEWSQVAYVTFKDAQGAETALLLSGATIVDLSVIIAPAPEYQPPPTASAPPMSGTRVPVGGDNNVVHKAEDVVSTMLAKGFVLGKDAVGKAKAFDEKHGFTSTAGAKVASIDKKIGLSEKITTGTSMVSGKVKEMDQKFQVSDKTKSAFAAAEQKVSSAGSAIMKNRYVFTSASWVTNAFNKVAKAATDVGTMTKEKMAAEEQHKTSGPSSGGHSYTPIQ

SEQ ID NO: 2138 - DNA, 708 bp, Panicum virgatum
  misc_feature: Ceres CLONE ID no. 1877540
  misc_feature: Encodes the peptide sequence at SEQ ID NO. 2139
ctcacctcttctgtcgaagctgctgccctcgtcgtcgctgacacctatcgccgcttccagagtcgccggcggcctgtgttctcccacgggcggcgaggcggcgggacgtgaggatgatgggcagcaacagcggcggagggggcggaggccctggcgggggcatgggtccgggcatgggcgggcccgtgggtggaggcggggacgggaggcacgacgacgaggccgcgctcaccgagttcctctcctcgctcatggactacacccccacgattcccgatgagcttgtggagcactacctcggacgcagcggattccactgccctgacctccgcttaacgagattggttgctgtagctgcccagaagttcctttcggacattgcaagcgattctcttcagcactgcaaggccagggtagtagcaccaatcaaagacaataagagcaaacagcctaaggatagacgtcttgtactaactatggatgatctttcgaaagccttgcgtgagcatggtgtgaacttgaaacacgcggagtacttcgcagacagcccttctgcaggaatggctcctgcaacaagggaggaatagattggattgagccaacctgtaccaagtgtctaagtggaactgggtatactgggatcatgtcaatgagtagcctgtccacattcttgccccattcgatgtaatggtgtactagcatagcctc

SEQ ID NO: 2139 - protein, 157 aa, Panicum virgatum
  misc_feature: Ceres CLONE ID no. 1877540
  misc_feature: Functional Homolog of  Ceres CLONE ID no. 25793 at SEQ ID NO. 1854
  misc_feature (51)..(101): Pfam Name: TFIID_30kDa Pfam Description: Transcription initiation factor TFIID 23-30kDa subunit
MMGSNSGGGGGGPGGGMGPGMGGPVGGGGDGRHDDEAALTEFLSSLMDYTPTIPDELVEHYLGRSGFHCPDLRLTRLVAVAAQKFLSDIASDSLQHCKARVVAPIKDNKSKQPKDRRLVLTMDDLSKALREHGVNLKHAEYFADSPSAGMAPATREE

SEQ ID NO: 2140 - DNA, 1022 bp, Panicum virgatum
  misc_feature: Ceres CLONE ID no. 1881892
  misc_feature: Encodes the peptide sequence at SEQ ID NO. 2141
gatcgacccccccgcatttacactgctccgcgggcacagtgaaccagacagccagcgacacgagcgacgagccaccaggtctccgagcgacgacggcgagcgccgccaccgcgccctgcagcggccacacctcgagctaagaaacgaagcagccatggcgacgcgtcgcctcccgtcgtccctcccgctgctgcttctccttgcggcgggatccctcgcagcggcggtggcggcggcaagcgcgcttggcgaatcccccgagacggacacggacatggtgccgcgcttcggccggatcctgcagcagctgcctcagcctcagcccatgccgcagccagacccgaacccacagccgcagcccggggtgaacccgccagtgccacagcccctgccgcaaccaaatccaaacccgccgcaaccgctgccgcagccacagcccgtgccgcagccgaacccgcagcccgggctgaacccaccccagccactgccgcagccgcagcccgggccacagccagacccaacagccccacagccgcagcccttgccgcagccggacccgaccctgccgccccagctcttgccggggccgcagccgcagccggaccctgccctgcagcagccgcagccagggacgacgacgcagccggctccgaacggccagaatccgcaggcgcagccggaccaggtgctcccgagcggcggggggtccaggatgctggtgaacctgcacaacttgatgtccatacttcttccaagtcttgcctatctgttaatgtaaactctgtacaatatatacgtttttctttcttcctttattcatttgttacccacgcctgtgtgtaaatatgtatagtcacgagatatgtatagttgtatttttcttatttttgcatcgttgtgcgagtgtgtagtagtgattacattgcatagatttttgcgagtgtgtggtaatgtgtatatatatacaatatgctccctacgttctaaattataagtcattttaaaaaaaaaaaaaaaaaaaa

SEQ ID NO: 2141 - protein, 207 aa, Panicum virgatum
  misc_feature: Ceres CLONE ID no. 1881892
  misc_feature: Functional Homolog of  Ceres CLONE ID no. 284030 at SEQ ID NO. 1868
MATRRLPSSLPLLLLLAAGSLAAAVAAASALGESPETDTDMVPRFGRILQQLPQPQPMPQPDPNPQPQPGVNPPVPQPLPQPNPNPPQPLPQPQPVPQPNPQPGLNPPQPLPQPQPGPQPDPTAPQPQPLPQPDPTLPPQLLPGPQPQPDPALQQPQPGTTTQPAPNGQNPQAQPDQVLPSGGGSRMLVNLHNLMSILLPSLAYLLM

SEQ ID NO: 2142 - DNA, 2813 bp, Panicum virgatum
  misc_feature: Ceres CLONE ID no. 1887320
  misc_feature: Encodes the peptide sequence at SEQ ID NO. 2143
gtgagcttagccggaactggggacgtgggaaggcaagacgctggtccaacggcagtgcccaggacaacgaagcggcgagcaggcactggttcgtgggttatcgactgggtccgtgaggaacacctgaattctttttttacaattcgaaacctctcaaaccgttagagctgagacatggaagatgaagaaaacattgaggaggaactgtttcttgtggagtcgcaactccatgacattcaaggtcaaattaaaacattacttgatcgccaagaggagttgtctgagcgacagttacagttaaaggctttgctagaagtatctaagatgtccagaaacaaatcaaattatggatcttcagttactctggaagattggtctgggagcttcccatgggattctcaggctgatgatacacgattcaatgtatttggcatcacctcctaccgatcaaatcaacgagaaataattaacacagtcatgagtggaaaagatgttctggtcataatggctgctggtggtgggaagagcctgtgttaccaactcccagctgtactttgtaatggaattgcattggttgtcagccctttactttctcttatccaggaccaggtcatgggactggcagctttaggtataccagcatacatgctgacttcaactaccaacaaggaagttgagaagttcatctatagggcacttgataaaggtgaaggagaattgaaaatattgtatgtgacaccagaaaagatatcgaaaagtaaaaggttcatgtctaagcttgagaaatgccatcatgctggacgtctttctctcgttgcagtagatgaggcacactgctgtagtcaatggggccatgattttcgcccagactacaagaatcttggcattttaaagatccaatttcctagtgttcccatgatagctctaactgcaactgcaacaagtaaagttcaaatggatttgatagagatgcttcatatcccgaagtgtgtcaagtttgttagcacagttaacaggcccaaccttttctataaggtatatgaaaaatcacctgttggaaaggttgtgattgatgagatcgcaaattttataagtgaatcatacccaaataacgaatctggaattgtgtattgcttttcaaggagggaatgcgaacaggttgcaaaaggattgtgcgataggggtatttcggctgagcattatcatgcagatatggatattattgctcgtgagaaaattcacatgcgttggagccaagggaaatcacaggtcatcgttggaacagtggcgtttggaatgggaatcaacaaaccagatgttcgatttgtgattcatcatagccttagcaagtcgatggagacatactaccaggagagtggtcgggcagggcgggatggattatcttcagaatgtgttttgtattatcggcctggcgatgttccaaggcagagttcaatggtcttctacgaaaattgtggccttcaaaacctatatgacattgtacgatactgtcaggacagtccaaccagcaaaagacgcttccatttcgaagccttttggccaagcttgaatgggttcatggaaacagttgaggctgcgtggactgctgtaccagcccgcccctgcccattggaaacactgtcactgaagttcgaggcaacagcaaggagcttgcaaagttggagccaaaatctaagaggagttgtcggcgtggtgctttctttcagcattttggagaggctctgcaggactgcaatggaatgtgcgacaattgtgcttctagtatcgagctcaaggagatagatgccaccaaccataccaaaattgtagtttcagttctacgcgacctgaaacttaatgaccaaagagctacattgttgcaattggtggataagttcaaggctaagtggaaaggtttaggttattccaataaagacgttgatcttaaaagagaagaaattgagcagttgatagtccagcttatactcgaccatgttttgaaagaagaatttcagcatacagcatattcaaccaatgcgtacgtcaccttaggaccactgtggaagccagccttgcaagggaacggaccggtgaagcttgagattgctgtcgagagttctcaggatagaggaggtggtggtagattgtccaaaggcgcaaagcgcagctggatgagtgatctggaagctaaacttgatgaactgcgcagggagctgtcgtcatcatctggtaacgggggcataagcatatttccccatgcagttctatcctctgagcagatttcgctcctgagctgccaaaagccaaccacggaggcggagcttgagaaggtcatagggaaggtgaagacggagaagtacggtggcaggatcattgagctgatgcggtccgatgtcacggatgcaagagctggaaatggagctgatgccagcaagaggaacaagaaggataaggatgttgtctttgtggagagtagcagcgaagaataacattggtcagggactccttggtatcctttccgcgtctctagtctcttggagtgtggttgtctcctgtcgctgcatacaagacacaaaatgcatacctagtgggataactttctttctttctttttgcgaaacatacccagtctcttgggggtgtggtggtttcctgtcgctgcatacaagacacaaaacgcatacctagtgggataactttctttctttctttttgcgaaacatacagtgggatagcctgaatgtcttgacactaaaaagtgcgtgcaaaattgcaaaaggaagaaatatcatcaaaaaaaaaaaaaaaaaaaa

SEQ ID NO: 2143 - protein, 542 aa, Panicum virgatum
  misc_feature: Ceres CLONE ID no. 1887320
  misc_feature: Functional Homolog of  Ceres CLONE ID no. 389585 at SEQ ID NO. 1581
  misc_feature (332)..(408): Pfam Name: Helicase_C Pfam Description: Helicase conserved C-terminal domain
  misc_feature (91)..(263): Pfam Name: DEAD Pfam Description: DEAD/DEAH box helicase
MEDEENIEEELFLVESQLHDIQGQIKTLLDRQEELSERQLQLKALLEVSKMSRNKSNYGSSVTLEDWSGSFPWDSQADDTRFNVFGITSYRSNQREIINTVMSGKDVLVIMAAGGGKSLCYQLPAVLCNGIALVVSPLLSLIQDQVMGLAALGIPAYMLTSTTNKEVEKFIYRALDKGEGELKILYVTPEKISKSKRFMSKLEKCHHAGRLSLVAVDEAHCCSQWGHDFRPDYKNLGILKIQFPSVPMIALTATATSKVQMDLIEMLHIPKCVKFVSTVNRPNLFYKVYEKSPVGKVVIDEIANFISESYPNNESGIVYCFSRRECEQVAKGLCDRGISAEHYHADMDIIAREKIHMRWSQGKSQVIVGTVAFGMGINKPDVRFVIHHSLSKSMETYYQESGRAGRDGLSSECVLYYRPGDVPRQSSMVFYENCGLQNLYDIVRYCQDSPTSKRRFHFEAFWPSLNGFMETVEAAWTAVPARPCPLETLSLKFEATARSLQSWSQNLRGVVGVVLSFSILERLCRTAMECATIVLLVSSSRR

SEQ ID NO: 2144 - DNA, 1908 bp, Panicum virgatum
  misc_feature: Ceres CLONE ID no. 1887966
  misc_feature: Encodes the peptide sequence at SEQ ID NO. 2145
agcgctcccaaccactcccaccactgttcctcccctctctcgagctgggagacgatatcctaaactccaaagcagcagcggaggggaaagcaacaagccaagcgatcgatcatccggaagacgccgggagcgagaggcacaaagatacacggcgcctgccatgtcgcctctccgtgacctggactggtcggtcatcacctgagagagagtagagtccgaccgacgaggggaaggtagctgccagtttgggcaagagtggtgagtgagtcaagggggcaagaagagagcggtttgttttcttccgatggcggccgcctcgtccgcgcccttcttcgggctcggcgacacgcagatgcagccgccccagggcccctctctgcagcagaactccgcggcggccgcgcccggcgccgccgccgcgccgccgaagaagaagaggaaccagcccggcaatccaaaccccgacgcggaggtgatcgcgctgtcgccgcggacgctgctggcgacgaaccggttcgtgtgcgaggtgtgcaacaaggggttccagcgggagcagaacctgcagctccaccggcgcgggcacaacctgccgtggaagctgaagcagaagaaccccaaggaggcccggcggcgggtgtacctgtgcccggagccgacgtgcgtgcaccacgacccgtcccgggcgctgggcgacctcaccgggatcaagaagcactactgccgcaagcacggcgagaagaagtggaagtgcgacaagtgcaacaagcgctacgccgtgcagtccgactggaaggcgcactcgaagacctgcggcacccgcgagtaccgctgcgactgcggcacgctcttctccaggagggacagcttcatcacccaccgtgctttctgcgacgcgctggctcgtgagagcgcgcagatgccgccattgggcgccggcctctacgtcggctccggcagcatgagcctcgggctctccggcgccgccgcccagatgcatggcttcgcggaccatgccggccagtcctcttcagcagcagcagcagcagcagccgctcaattcgaccacatcatgccaccgtcctcgggcccctctttgttccgttctcaggtgtcggcctcctcgtcgtctttcttcctcggcggcggcggcaacgccgatcacagcagcgtgatggcgtccatgggaagccacctcagctgcagcagcttcccctcttcgctgtacaactcatctccatcggccggcctggcgcagaactcggcgacggcgctcctgatgaaggcagcccagatgggctcgacgtcgagcgcgcagaacggccccagcgcgctgctccgcgccgccggcttcagcgccgccagcggccagggcactagcagggccgcaggagaagggacgtcgcacgaggcgcacttccatgacctcatcatgaactctctagcgggaggcagcggcggcgggggcggcttctccggcggcggcgcagggttcggcgccgtggacgacggcaagctgagcacgagggacttcctcggcgtcggcaggggcgcgatggcgccgcccgggctccatatcggcgcactggacccggcccagatgaagtgatcgatcgatgtgacgataggatcagggagtgaacaacaacaagaagaacaaaacaaggagaagatgcaagagaaccaagaagtctcaataaacagacgggcgcgtgcacgtgaaaccgagctttcgcgtgcatggaccatggagaaggtgagctaatgagggatcggagataccaagtaaacttaatctaacttcatcatgcaacttgattttgctattccggtacaatttcgtggagtttaactttcaagtgcttagttaatataattaaacttttggctgaaaaaaaaaaaaaaaaaaaa

SEQ ID NO: 2145 - protein, 433 aa, Panicum virgatum
  misc_feature: Ceres CLONE ID no. 1887966
  misc_feature: Functional Homolog of  Ceres CLONE ID no. 9804 at SEQ ID NO. 1136
  misc_feature (71)..(93): Pfam Name: zf-C2H2 Pfam Description: Zinc finger, C2H2 type
MAAASSAPFFGLGDTQMQPPQGPSLQQNSAAAAPGAAAAPPKKKRNQPGNPNPDAEVIALSPRTLLATNRFVCEVCNKGFQREQNLQLHRRGHNLPWKLKQKNPKEARRRVYLCPEPTCVHHDPSRALGDLTGIKKHYCRKHGEKKWKCDKCNKRYAVQSDWKAHSKTCGTREYRCDCGTLFSRRDSFITHRAFCDALARESAQMPPLGAGLYVGSGSMSLGLSGAAAQMHGFADHAGQSSSAAAAAAAAQFDHIMPPSSGPSLFRSQVSASSSSFFLGGGGNADHSSVMASMGSHLSCSSFPSSLYNSSPSAGLAQNSATALLMKAAQMGSTSSAQNGPSALLRAAGFSAASGQGTSRAAGEGTSHEAHFHDLIMNSLAGGSGGGGGFSGGGAGFGAVDDGKLSTRDFLGVGRGAMAPPGLHIGALDPAQMK

SEQ ID NO: 2146 - DNA, 709 bp, Panicum virgatum
  misc_feature: Ceres CLONE ID no. 1890779
  misc_feature: Encodes the peptide sequence at SEQ ID NO. 2147
atcccttttttcctcctgcaaagaggaatacgattcagctcaccccatctccaccaagaacaagatctgaagcagccaggccggagcacgagtcaactctgcagcagtcaagcaaggctctcccgctcgcacgcagccagcggtcaagccggtcagcagcagacatgagtaccatgaagttttgccgggaatgcaacaacatcctgtaccccaaggaggacagggagcagaaggtgctcctctacgcctgccggaactgcgaccaccaggaggttgcggacaacaactgcgtgtaccggaacgtggtgcaccacagcgccggcgagttcacccaggtgctccaggacgtcgccggcgaccccacgctgccccgcaccaaggacgtgcgctgcgccgtctgcggccacggcgaggccgtcttcttccaggccactgcgaggggtgaggaggggatgacgctcttcttcgtctgctgcaaccccagctgcggccaccgctggagggagtgaggagtgaggagctgataaacagagcaaaaggatccctctgctgcagtagccagaggggcatgatttttgaaatttccacccaagaaacctgcccatgttaccatgaactgattgtatctttcaagcacattaataacttcaggagggagataatcaagtgagccactgggataaatttccctgtggttctgttgcatcag

SEQ ID NO: 2147 - protein, 114 aa, Panicum virgatum
  misc_feature: Ceres CLONE ID no. 1890779
  misc_feature: Functional Homolog of  Ceres CLONE ID no. 12256 at SEQ ID NO. 417
  misc_feature (4)..(58): Pfam Name: RNA_POL_M_15KD Pfam Description: RNA polymerases M/15 Kd subunit
MSTMKFCRECNNILYPKEDREQKVLLYACRNCDHQEVADNNCVYRNVVHHSAGEFTQVLQDVAGDPTLPRTKDVRCAVCGHGEAVFFQATARGEEGMTLFFVCCNPSCGHRWRE

SEQ ID NO: 2148 - DNA, 740 bp, Panicum virgatum
  misc_feature: Ceres CLONE ID no. 1897613
  misc_feature: Encodes the peptide sequence at SEQ ID NO. 2149
acccacctctctcccctcctccccctccgcctccagtctctccctctctagctcgttccattcctcgctcgcaatggccaagccgcgcaagaacagcgccgccgccgccggcaacagcagcagcagcggcgccgcggcggccggggacgccggggtgcgcgtgaagccgaagcgcacgcggaagagcgtgccccgggagtctccctcgcagcgcagctccatctaccgcggcgtcacccggcacaggtggacggggcggttcgaggcgcacctgtgggacaagaacagctggaacgagacccagaacaagaagggcaagcaagtttacctcggcgcgtacgacgacgaggaggcagcggcgcgggcgtatgacttggcggcattgaagtactggggccccgacaccatcctcaacttcccggcgtccgcgtacgaagaggagctcaaggaaatggaggggcagtccagggaggagtacattggatccctgaggaggtccatgaaatttatccgcaggaaaagcagcgggttctcgagaggtgtctccaaataccgaggcgtcgcgagacaccaccacaacgggagatgggaagcgaggatcggtcgtgttttcgggaacaagtatctctacctcggcacttatgcgacgcaggaggaggcggcgatggcgtacgacatggcggcgatcgagtaccggggcctgaacgccgtcacaactttcgacttcagccgctacaatc

SEQ ID NO: 2149 - protein, 222 aa, Panicum virgatum
  misc_feature: Ceres CLONE ID no. 1897613
  misc_feature: Functional Homolog of  Ceres CLONE ID no. 222885 at SEQ ID NO. 583
  misc_feature (49)..(109): Pfam Name: AP2 Pfam Description: AP2 domain
MAKPRKNSAAAAGNSSSSGAAAAGDAGVRVKPKRTRKSVPRESPSQRSSIYRGVTRHRWTGRFEAHLWDKNSWNETQNKKGKQVYLGAYDDEEAAARAYDLAALKYWGPDTILNFPASAYEEELKEMEGQSREEYIGSLRRSMKFIRRKSSGFSRGVSKYRGVARHHHNGRWEARIGRVFGNKYLYLGTYATQEEAAMAYDMAAIEYRGLNAVTTFDFSRYN

SEQ ID NO: 2150 - DNA, 1388 bp, Panicum virgatum
  misc_feature: Ceres CLONE ID no. 1911944
  misc_feature: Encodes the peptide sequence at SEQ ID NO. 2151
acattttgccattcgcccccagaaggcccatctctctctctctctctctctctctctctgacccgccccctttcccctcggtggctcggtctcacttgcctcctcacctcgccttcgccatggcgttcttctctcaccaccatctccagcagccgcacccgcagcaggccccgccgccgccgcagcatcagcaacagccggtgcttccttccttcaggaacgcgctgccagtgccggtggatggccagatcccggcgccctttgccttcttcaacccgccgcctgccttcccggagcagcccgcgcaggcaccgctggtggatgcggtggggttgacggcggccgcggggcttgggtggaggcagccgagggagcaagagctgcttggggagaactcccagatgtcgtccatcgatttcctgcagacgggctcggcagtgtcaacggggctggcgctgtctcttgaggaccggcgccacggcgggggcgggggcgggggcggcggggctgagaactcctcgggcgattccccgctgctcctgctgcccatgctggacgatgacatctcccgcgaggtgcagcggcttgatgctgatatggaccggttcattaaagctcagagtgaacggctaaggcaatctatattggagaaagttcaggcaaagcaatttgaggcactggcctctgttgaggacaagatactacggaaaatacgggataaagaggctgaagtggagaccattaacaaaaggaactctgaacttgaggatcagattaagcagttggcagtggaagttggtgcgtggcaacaaagggccaagtacaatgagagcatgatcaatgcactcaagtacaacttggagcaggtatgtgcccatcagagcaaggatttcaaggaaggttgtggtgatagcgaggtagatgacacggcatcctgttgcaatggtggtgccgtcaatttgcaactgatgccgaaggagaacaggcaaccgaaggatttgacggcctgcagggtctgtaattcaagcgaggcatgcatgctcttgttgccttgtcggcatctttgcctatgcaaggagtgcgagagcaagctgagcttctgccccctgtgccagtcctcgaagatacttggcatggagatatatatgtagaatagaatttatgtaccacatgagtatcttacgaggtatcttacaagatactgctgtgttaatatgccaatctattgccaaactttagaacctgtgtaccactatgacctgccacttgatcgaaaagactgccgtttatggtagatttgcctcagcaaatttcatcagactttaatgcttaatttgtaataaacttcttagtagagttgattttgtcaaaaaaaaaaaaaaaaaaaa

SEQ ID NO: 2151 - protein, 343 aa, Panicum virgatum
  misc_feature: Ceres CLONE ID no. 1911944
  misc_feature: Functional Homolog of  Ceres CLONE ID no. 285598 at SEQ ID NO. 638
MAFFSHHHLQQPHPQQAPPPPQHQQQPVLPSFRNALPVPVDGQIPAPFAFFNPPPAFPEQPAQAPLVDAVGLTAAAGLGWRQPREQELLGENSQMSSIDFLQTGSAVSTGLALSLEDRRHGGGGGGGGGAENSSGDSPLLLLPMLDDDISREVQRLDADMDRFIKAQSERLRQSILEKVQAKQFEALASVEDKILRKIRDKEAEVETINKRNSELEDQIKQLAVEVGAWQQRAKYNESMINALKYNLEQVCAHQSKDFKEGCGDSEVDDTASCCNGGAVNLQLMPKENRQPKDLTACRVCNSSEACMLLLPCRHLCLCKECESKLSFCPLCQSSKILGMEIYM

SEQ ID NO: 2152 - DNA, 1614 bp, Panicum virgatum
  misc_feature: Ceres CLONE ID no. 1950861
  misc_feature: Encodes the peptide sequence at SEQ ID NO. 2153
gcaggttccggctgcttccatcccaccacggagtcccgaaccttctcgagcaccccctctccggctctccccaccccttccacgcagaaaacaatgagcaggcgcaacagccgcaccatctatgtaggtaacctccctggggacatccgtgagagggaagttgaggacctcttctacaagtatggtcgaattttggatattgacctgaagatacctccaagacctcctggatatgctttcgttgagttcgaggacccacgtgatgctgatgacgcaatttatgggcgtgatggatataactttgatggctacaggttgcgggttgaattagctcatggtggaagaggtcagtcttactcttatgatcgttctagcagctatagcagcgctcgccgtggaggtgtttctaggcgctctgattaccgtgttatggtcacgggtttaccttcatcggcatcgtggcaagatctgaaggaccacatgcggcgcgccggtgatgtttgtttctctgatgtataccgtgaggctggagaaactattggaattgtggattacacaaactatgacgacatgaaatatgcgatcaggaagcttgatgactcactgttcaagaatgcattttctagggcgtatatcagagtgagggagtatgatgctagatcacaaagcagaagccgtagccgctcgtactcgagaagctccagttacagcaggagcaggagtccaaaatctgtttctcggtcaccatcacctgtggatgaaagatctggccatgccggcgatctggggactgcattgatagattattggatgtattgagaatcgaagtggatggtttgggactttggatagtagagctggattgtgatgcatgtatgacaagtgggctacaaccagtcctaggagcaagataggactgacagtaaggatatgtggatctcgtggtgtgtcgactatattgtgcttcaatttcaatggctcaatataacatcaacatcaacatcaacaaagccttttaatcccgagcaagttggggtaggctagagttgaaacccaacaaagaccattatttatggttctggcacgtgaatcgcggctttccaagcactcctatccaaggacaaatctttagatcactatcaagatcccgatcccctgtctcttctccttctggtggaagatctgcgagcagaagcccgaggagcagaagcgcatcccgttctcattctcctgtgagatctgattgaactaggggacccttgaagcggtgagcaactgtaaccagagagaaggaagctgagaacatgcattaccatctcaatgacctgaatgattctgttgttgccactgcaccccctcattttggaggtttcctcttatttagtatttaataattacattatattgctaaagagacttattatgcctagcgcagtggtgtaaactgaacttttgtgtactgggttcccggcactcaggtttcatctactctccggtagcctgtttttaattgacacttctctttcaattggtcgcttgtaatattgcatagttgaggggtcgatgtattcggttatttggttgctgtgtccggaaaaaaaaaaaaaaaaaaaa

SEQ ID NO: 2153 - protein, 241 aa, Panicum virgatum
  misc_feature: Ceres CLONE ID no. 1950861
  misc_feature: Functional Homolog of  Ceres CLONE ID no. 7559 at SEQ ID NO. 1681
  misc_feature (9)..(77): Pfam Name: RRM_1 Pfam Description: RNA recognition motif. (a.k.a. RRM, RBD, or RNP domain)
MSRRNSRTIYVGNLPGDIREREVEDLFYKYGRILDIDLKIPPRPPGYAFVEFEDPRDADDAIYGRDGYNFDGYRLRVELAHGGRGQSYSYDRSSSYSSARRGGVSRRSDYRVMVTGLPSSASWQDLKDHMRRAGDVCFSDVYREAGETIGIVDYTNYDDMKYAIRKLDDSLFKNAFSRAYIRVREYDARSQSRSRSRSYSRSSSYSRSRSPKSVSRSPSPVDERSGHAGDLGTALIDYWMY

SEQ ID NO: 2154 - DNA, 1006 bp, Panicum virgatum
  misc_feature: Ceres CLONE ID no. 1956018
  misc_feature: Encodes the peptide sequence at SEQ ID NO. 2155
ccgaccaacgtcggagtcttctcccctctccctccctccccttcccttgtcttgcgttgcccgcaatcgaaagcagatcaaaccctagatctcgtctcgccgccccgatccgaatcccatggattcgtcgtcgtcgtcgtcctccagcctgagccagcagcccgagttcgactacctcttcaagctgcttcttatcggcgactccggcgtcggcaagagcagtctcctcctacgcttcaccgccgactccttcgaggacctctcccccaccataggtgttgacttcaaggtgaagatggttaacattggtggcaagaaactcaagcttgccatctgggacacagctggacaggagagatttaggaccttaaccagctcatactacagaggggcacagggaatcattatggtgtatgatgtcactcgacgagaaacatttaccaatctttctgatatatgggcaaaggaaattgacctgtattcaaccaaccaggattgtataaagatgcttgttggaaacaaagtagacaaggaaagtgaaagggctgtcacaaaaaaagaaggaatcgaatttgctcgggaatacggatgtttatttctggaatgcagtgcgaaaacaaaagtaaatgtagaacagtgctttgaggaactcgtcctaaagatattagacacgccaagcctcctagctgatgcttcgtcaggggccaagaagaacattttcaaacagaagccaccggaagctgatgcagcggcaagcagctgctgttaacttgcgtgctaatccaggtcggatccctcctgggggtgatgatatctttgttgcataaagtgataagctctgttgtgttgatttattttgcttatggtcctgtatattgccatgctaaaattagaccccacatgcataacactacgttggcagcagatatataatgtattaagttaaatctacctgacaatacgaattgtttacaactgtgatctggagtacatcgtagtttaaact

SEQ ID NO: 2155 - protein, 216 aa, Panicum virgatum
  misc_feature: Ceres CLONE ID no. 1956018
  misc_feature: Functional Homolog of  Ceres CLONE ID no. 2898 at SEQ ID NO. 652
  misc_feature (22)..(184): Pfam Name: Ras Pfam Description: Ras family
MDSSSSSSSSLSQQPEFDYLFKLLLIGDSGVGKSSLLLRFTADSFEDLSPTIGVDFKVKMVNIGGKKLKLAIWDTAGQERFRTLTSSYYRGAQGIIMVYDVTRRETFTNLSDIWAKEIDLYSTNQDCIKMLVGNKVDKESERAVTKKEGIEFAREYGCLFLECSAKTKVNVEQCFEELVLKILDTPSLLADASSGAKKNIFKQKPPEADAAASSCC

SEQ ID NO: 2156 - DNA, 618 bp, Panicum virgatum
  misc_feature: Ceres CLONE ID no. 1958407
  misc_feature: Encodes the peptide sequence at SEQ ID NO. 2157
  misc_feature (328)..(328): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (554)..(554): n is a, c, t, g, unknown, or other
  misc_feature (555)..(555): n is a, c, t, g, unknown, or other
gtgatctcctccctgtccatcgtcatccacctcccccctttctttccttcatccaccccccctccaccccccttcctccctccgccgcccctctcctctcgctctccgatccgatgctctcctcccgactcccatgatctgaaatctccgacggagtaggaccgagactattcagaaactgacaagccatccaacaattcaggcacaggaagccagcatcaagacgaccaagcggagctaaagggggaaggagaggagagagcgcatccgggtccgtcatggagggcggcgagacgacgctgtcggggttcggcggcggcggcggcgncgcgggggccggcgtggacactaaggagctgcacgcgttccatacgagattcgtgcaggtgcagagcctgctggaccataaccgcgtcctcatcaacgagatcaaccagaaccacgagtcctaggtgcccggcgacctctcccgcaacgtcagtcnnnnnngggagctcaacgacaacatccggcgcggcgtcgacctctacaccgacctctcctcgctcttagcnncctccgacggcagtggacgcgcggcctcccagggcggatccgtcggcaccgtcccggcggccg

SEQ ID NO: 2157 - protein, 124 aa, Panicum virgatum
  misc_feature: Ceres CLONE ID no. 1958407
  misc_feature: Bit Score of 231.6 for HMM based on sequences of FIGURE 107
  misc_feature: Functional Homolog of  Ceres CLONE ID no. 397320 at SEQ ID NO. 1585
  misc_feature (18)..(109): Pfam Name: DUF1313 Pfam Description: Protein of unknown function (DUF1313)
MEGGETTLSGFGGGGGAGAGVDTKVLHAFQTSFVQVQSLLDQNRVLINEINQNHESKVPGDLSRNVGLIRELNNNIRRVVDLYADLSSLFAASDGGGRAASEGGSVGTVRQAGAGHKRIRSGLD

SEQ ID NO: 2158 - DNA, 642 bp, Panicum virgatum
  misc_feature: Ceres CLONE ID no. 1963208
  misc_feature: Encodes the peptide sequence at SEQ ID NO. 2159
gcttcaattccttctccaaccccacccaacccaatcgacgccaccaccagcagctagcgcccaaccatcatcgatcgatccatccatggggcggtcgccgtgctgcgagaaggcgcacaccaacaagggcgcctggaccaaggaggaggacgaccgcctcgtggcctacatccgggcgcacggcgagggctgctggcgctccctccccaaggccgccggcctcctgcgctgcggcaagagctgccgcctgcgctggatcaactacctccgccccgacctcaagcgcggcaacttcaccgccgacgaggacgacctcatcgtcagcctccacagcctcctcggcaacaagtggtcgctcatcgccgcgcgcctccccggccgcaccgacaacgagatcaagaactactggaacacgcacatccgccgcaagctcctcgccaggggcatcgaccccgtcacgcaccgccccgtcgccgccgacgccaccgtctccttccacccgccgcagctcaagccgcccaggtgccccgacctcaacctcgacctctgcatcagcccgccgtgccgccaggacgaggaccaggagctcatcaagcccgtcgtcgtcgtcaagcgcgagctgctgcagtccggccacggcgc

SEQ ID NO: 2159 - protein, 185 aa, Panicum virgatum
  misc_feature: Ceres CLONE ID no. 1963208
  misc_feature: Functional Homolog of  Ceres CLONE ID no. 120302 at SEQ ID NO. 1395
  misc_feature (67)..(112): Pfam Name: Myb_DNA-binding Pfam Description: Myb-like DNA-binding domain
MGRSPCCEKAHTNKGAWTKEEDDRLVAYIRAHGEGCWRSLPKAAGLLRCGKSCRLRWINYLRPDLKRGNFTADEDDLIVSLHSLLGNKWSLIAARLPGRTDNEIKNYWNTHIRRKLLARGIDPVTHRPVAADATVSFHPPQLKPPRCPDLNLDLCISPPCRQDEDQELIKPVVVVKRELLQSGHG

SEQ ID NO: 2160 - DNA, 949 bp, Panicum virgatum
  misc_feature: Ceres CLONE ID no. 1963936
  misc_feature: Encodes the peptide sequence at SEQ ID NO. 2029
ctcttgctttcttggctgccgcctcctccctcgggacctcctcaccacggaggagatctcctctaccgggcgagcaggagagcaggggagagacatgggcgggcgggtggatcacgagtactcgtaccttttcaagatggtgctcattggggacagcggcgttggcaagtccaacatcctctctcgcttcacgcgcaaccacttctccctcgactccaaatcaaccatcggcgttgagttcgccaccaaatccctgcagatggagggcaaaacaataaaggctcagatctgggacacggccgggcaggagaggtaccgtgccattacaagtgcgtactaccgtggtgctgttggggctctactcgtatatgacatcacaaagaggcagagctttgacaatgttcacaggtggctgcgtgagctccgcgaccatgctgattccagcattgtgatcatgatggtcgscarcaagtctgacctgatacacttgagggctgtttctgaggatgaaggcaaagcgttggcagaaaaggaagggttattcttcctggaaacatcagctatggaggcggtaaacgtggaggaagccttccagactataatctcggaggtctatggcattgtgaacaggaaagcgctggctgccaaagaaatggcagctgcagcagctccactgccttcccagggcaagaccatcagcattgacagcacttcagaaaacacaaagaaggcatgctgctccacttgaaatgtaattgggcttcggacatcatattatagagaactttgggcaacaaatgttggtagaaagcggagcatagtactcacaaatggtgttgagggaatatctattcgtaccttgttttttctttgttgcgtgaactcgctggatcatatgcagtttgttcagtgtttctgaatcaaaagttagatgtgtgtattaggattc

SEQ ID NO: 2161 - DNA, 774 bp, Sorghum bicolor
  misc_feature: Ceres ANNOT ID no. 6005736
  misc_feature: Encodes the peptide sequence at SEQ ID NO. 2162
atggaacccaacaacaatcagcccgcggccacggccgaggaagctgcggcaggcagcggccccggcggagaaggcgggcggaagggcaaggcgcccaagggcgggcccgagaacggcaagttccggtaccgcggcgtgcggcagcggagctggggcaagtgggtggcggagatccgggagccgcggaagcgctcccgcaagtggctcggcaccttcgccaccgccgaggacgccgcgcgcgcctacgaccgcgccgcgctcctcctctacggcccccgcgcgcacctcaacctcacctccccgccgccgcctacgctcgccgcgccgcgctcgcacccgcactcctccgcgacgtcgtcgtcgtctgccccgccagcgctccggccgctcctgccgcgcccgccgctgcaccatcagctctccagcggcgcctgtgctcctgcaccggatttccaccaccaccaccagcagttccagtgccaccacctcttgccgcaggcgcagccgacaccgccgctatactacgccaacacggccacggcgtccacggtcaccaccactgtgccgacacgggtggcggttccgcaggagccggccgtcgcgcccgcagtaggttcctcgacatctctacaggagccgcaggcgagtacgccggaggaggcgcccagggagacagggtgggactaccacggcggcgaggaggaggactacgcggcggcgctgctctgggacgagccggagcccttcttctggtttgatgtcttcctcaagtga

SEQ ID NO: 2162 - protein, 257 aa, Sorghum bicolor
  misc_feature: Ceres ANNOT ID no. 6005736
  misc_feature: Functional Homolog of  Ceres CLONE ID no. 557009 at SEQ ID NO. 1052
  misc_feature (41)..(92): Pfam Name: AP2 Pfam Description: AP2 domain
MEPNNNQPAATAEEAAAGSGPGGEGGRKGKAPKGGPENGKFRYRGVRQRSWGKWVAEIREPRKRSRKWLGTFATAEDAARAYDRAALLLYGPRAHLNLTSPPPPTLAAPRSHPHSSATSSSSAPPALRPLLPRPPLHHQLSSGACAPAPDFHHHHQQFQCHHLLPQAQPTPPLYYANTATASTVTTTVPTRVAVPQEPAVAPAVGSSTSLQEPQASTPEEAPRETGWDYHGGEEEDYAAALLWDEPEPFFWFDVFLK

SEQ ID NO: 2163 - DNA, 1804 bp, Sorghum bicolor
  misc_feature: Ceres ANNOT ID no. 6006556
  misc_feature: Encodes the peptide sequence at SEQ ID NO. 2164
atgactggccaaaatcacatgccccacgaccatcaccgcatattccattgtatcttgccagatcaatcttgtaacggtttggtcatttctgacataaatatcaggccaccaccacccacaaacacaaataagccagttataaggatgggtcaagagacatttgaagataataagatgaagaactatggtgagagaaagttaaagagggcacacaagatagatgagggagaggacgactttgaagctgatttccaagcattctctaagaagtgcgatgaggaggatgagagccactataagtttatggctctgctaccattcaaggaaggtcttactagtgtctcaacaccaacagaagggaaagttcgactcgattttcccatgaaaggtatgatttgctcacaaagatgtgtatttgtatgttcatcactacaatatgcagttatatatgtgaatctatgtgattttttctcacaccttttattcttaatgtaaagttggtgaattgtcttttgttaataaattctagtatcattttacagtttcgcatgattataatttaatttggcatggccatatattgcttgcgctcacgattttctcatatctttgcctgttgtttttcctataagaattcagtgggcaggttggggttggaggtatctcaaaaaggctattataataataccactaattagatcaatacttggatgtatatttaatattttcttagattatcccaagcgaggtggtttgtttgttttgtatgttacatttcacatgtcctggacccttgtgagttgtttcttgatagtatgaatatctcatatggtaaatttcatgagttctggtttagattcatgttctgtaaagaactaccaataggattgtctattattatttattaatcaataattgcttcctctatatagatgatgtgattagtcgagaaccaaccactaccaatgaaggtaccagtgtaaggccaaagcgcaagcgcaagaccccgtataggggcatccgccaacgcccttggggaaaatgggctgctgagattcgtgatcctgcaaagggtgtccgtgtttggttaggaacatatagaacaccagaagatgcagctagggcatatgatgctgaggcccgcaagattagaggcaataaggcaaaggtgaatttccctaatgaaggaccaccaaacatggtgagcaatacaccaaaactaactgctactgcaatgaccacaatggatattccagcagagaaaatgaataccgatgaattggtgtgccatacaaactactctaatgaggatatgttgtcaatggcgaactttagtggtaacaatgctagcttaatttctgctcaagcttttggcttacactatatgaaaaagcctcgtgttccttatgacatcccaagcatgggtgagtgttcaaatcaaaacaaaatcacatatggttcaagtaatggattgggcattgaggctagtaggaacttgaatggatgctctttcttaccacaagttggcatgccgatgttcattcaacctacttttgatggtccatcaaggatgatagaaagaaatgatgtcgtgatttctcctactctgactaatgccacaccaatcactccattgggtgtggctggtgttgatgttgcaaaaaagatgaataagcatcctattctccaagagatggaaaatgaagctactcctattttacaaggtgatgttagtgaggacgtggcggctgagattagtatgtgggagttttatgaccacctattagataataagcaaaattga

SEQ ID NO: 2164 - protein, 419 aa, Sorghum bicolor
  misc_feature: Ceres ANNOT ID no. 6006556
  misc_feature: Functional Homolog of  Ceres CLONE ID no. 158240 at SEQ ID NO. 520
  misc_feature (154)..(205): Pfam Name: AP2 Pfam Description: AP2 domain
MTGQNHMPHDHHRIFHCILPDQSCNGLVISDINIRPPPPTNTNKPVIRMGQETFEDNKMKNYGERKLKRAHKIDEGEDDFEADFQAFSKKCDEEDESHYKFMALLPFKEGLTSVSTPTEGKVRLDFPMKDDVISREPTTTNEGTSVRPKRKRKTPYRGIRQRPWGKWAAEIRDPAKGVRVWLGTYRTPEDAARAYDAEARKIRGNKAKVNFPNEGPPNMVSNTPKLTATAMTTMDIPAEKMNTDELVCHTNYSNEDMLSMANFSGNNASLISAQAFGLHYMKKPRVPYDIPSMGECSNQNKITYGSSNGLGIEASRNLNGCSFLPQVGMPMFIQPTFDGPSRMIERNDVVISPTLTNATPITPLGVAGVDVAKKMNKHPILQEMENEATPILQGDVSEDVAAEISMWEFYDHLLDNKQN

SEQ ID NO: 2165 - DNA, 1998 bp, Sorghum bicolor
  misc_feature: Ceres ANNOT ID no. 6006703
  misc_feature: Encodes the peptide sequence at SEQ ID NO. 2166
atggggtacgggcggccggcgccgtcgactgcgccgccggcgccagtaatggcgggcatgtggagcagcgaggccttcaaggtcgtcgacagcggccacggcaccagcgcgtccaccgtcatggaggccgacaccaagttcgagacaagggtgagtgctcgtgattgctggtttttttcttgcgtgtcgtctgctgtgatttgtctaccaaaagggtagaagagcgctcatgatgtattgatgtcatgttgacgagctttgtgcagctagaagatgttcaggtagcacttgagccaacaagaagtacggatcaggaaacaagcaagccgccagagagggtacataagtttaagcatctttcacttgtttttcttctatccttttgactgccatagcatgtttagtcttccttaaatacagtatacatgatactacagagaataatctcttcaggtcttaactgtccattcttgcaaaagagaaataaaatgctcagaatgtataaacctgaaatgatttgtctcaggtcatgagaaggctcgcgcagaacagagaggctgctcggaagagtcgcctgcggaaaaaggtgaccacaagaacttcaccaatcctgccctttggtgttatataaaccatgctagattatcattacgttattatgtgcccaataaccgttggcgccaattctgtcgttgttcaataggcctacatccaccagctagagacaagccggatgaagctggcccagttagagctggagcttcaacgggctcgacagcaggtacatgaacgaatctgttggttaaagccatttcaacagtcagtgttagtgttacactgacttattactgttctgcagggtgcatatgcaaatgggaacatgggagactcagctctcggttatgcagggtcgatagatccaggtcaggctctgtgctgatcgttctgaattgaaagaacgaaacactagccgtttgtccaatggcattctgcgcaatgttcagtcagtccctgtgcatcttctaactgctggcgcgtgcgtggttcaggtgtcagcgcgttcgagatcgagtacagccactgggtggacgagcagaagaggcacacggcggagctgatgtcggcgctccaggggcagcagacgtcggagctggagctccgcctgctggtggagacggggctcagcaactacgagcacctcttcaggatcaaggcgatggccgccaacgcggacgtgttccacgtcatgtcgggcatgtggaagacccccgccgagaggttcttcctctggatcggcggcttccggccgtcggaagtcctcaaggtgcggcggctgtttcccccaacccacccacaggagtgatgattcgtctttgcatggtgattggtgatgacggatggatctctctcgttgttgctggtggcatgcagatcctgagcccgcagctggagccgctgacggagccgcagcgcatgctggtcggcggcctccagcacacgtcgacgcaggcggaggacgccctgtcgcagggcatggagaagctgcagcagaacctcgcggagaccctgacggcggaggccgacccgttcgggccccccgacgcctacatgctgcagatggccaccgcggtggacaggctcaaagagctcgtcggcttcgtcacccaggtaaaaccgaccgaccgacccaaccggtcgccaagaaccatccatctccattctccatggatcatggattccaggcctggagcgcacgcaccgtgcgcgcgcgcgcggcgtggtgtgtccctgatcgatgctcacccgtgcggcctctgctcggttggctgtgctgtgcaggcggaccatctccggctgacgacgctgcagcagatgcacaagatcctgacgacgcggcaggcggccaggggcctcctggcgctgggcgactacttccagcgcctccgcacgctgagctcgctgtgggcggcgcgcccgcgggaggcggcgattagctag

SEQ ID NO: 2166 - protein, 364 aa, Sorghum bicolor
  misc_feature: Ceres ANNOT ID no. 6006703
  misc_feature: Functional Homolog of  Ceres CLONE ID no. 33016 at SEQ ID NO. 1904
  misc_feature (70)..(102): Pfam Name: bZIP_1 Pfam Description: bZIP transcription factor
MGYGRPAPSTAPPAPVMAGMWSSEAFKVVDSGHGTSASTVMEADTKFETRLEDVQVALEPTRSTDQETSKPPERVMRRLAQNREAARKSRLRKKAYIHQLETSRMKLAQLELELQRARQQGAYANGNMGDSALGYAGSIDPGVSAFEIEYSHWVDEQKRHTAELMSALQGQQTSELELRLLVETGLSNYEHLFRIKAMAANADVFHVMSGMWKTPAERFFLWIGGFRPSEVLKILSPQLEPLTEPQRMLVGGLQHTSTQAEDALSQGMEKLQQNLAETLTAEADPFGPPDAYMLQMATAVDRLKELVGFVTQADHLRLTTLQQMHKILTTRQAARGLLALGDYFQRLRTLSSLWAARPREAAIS

SEQ ID NO: 2167 - DNA, 1456 bp, Sorghum bicolor
  misc_feature: Ceres ANNOT ID no. 6007065
  misc_feature: Encodes the peptide sequence at SEQ ID NO. 2168
atggatgagcacatgggaagacgaacagttggcggcctcctcttcaccaagggaggctcaattcttctcttcagagaagacggttcgcgccccaagtccaagaactgctgctcgcgccatggctgtagtggtcagcattctgctgacaaagccaaaggcaaggaggtgcacagggcggcggcgcccaatgaatcaacgccagccacccctgggagatcacagatttttcggaagcccaacagaaagcctccacatgaaagcagtgcttcaggcagcatcagcagggatgcaggaggctcttgtagcgaaaccggcaacaggtcaagagacactcctgggcccgggcgtgatctactggctaggcttaaggagagggtcaacacatcaaggaaacgatcgttgaacagggagaacagcccacagtcaccgagtggattcagtgctggttccccgagcaatagtcgatcggtctcaaggccgtcgcatcgggcagcttcgaggataagaaaagctgatgaaggtgcagcaaatgcaggagctgacggtgtgcgcagaaatggtgctggagatgctaggaggagttcagagaggagtgacgacgacttgctgctagttgagcaggtaacaagaaaccatgtgccttctgaagggtttctttctggattcatggcgagatacagaagcggccttcagggagacctttcatctctggacgacagcatggaggactcaaatggatacttgcgctttgatgtgggtggaatagaagaggtaaggcattctatcactgcacaattgtcatgctaaacgtccaaattatatagagaatgcaaatcatataattacattgtgcattgcagcttgagaactacttcatattcaatgatcggcatagaggaatgaggatggatatcgacggcatgtcctacgaagtatgtctggatgcctgaccccttactctgacgacgccattttctgatttccttcgttgcttcatcctcttgtctctcttcagttagcaaacattttttgtttgtcatgctttgtatctccagtgtacttatctaatttgtgacactctgctttgaaggagctgcttgctttgggagagcgaattggtactgtaaacactggtctttcagacaatgcattgtccacgtgcctgaacaggagcctctacatgcccacagcttcaggttctcatgaagattgtgaaagaaaatgcagcatatgccaggcaagttcatttgtatcagattgttctgtagcaggatattagttgcaacctctaaatattttctttcactgaaatatttctcaggaggagtatttagccggcgaggaggtgggaaagatggcatgtaagcactactaccacctttcctgcatacagcattggcttcggcagaagaactggtgtcctatctgcaaatctgttgccctgaaaatcaactag

SEQ ID NO: 2168 - protein, 374 aa, Sorghum bicolor
  misc_feature: Ceres ANNOT ID no. 6007065
  misc_feature: Functional Homolog of  Ceres CLONE ID no. 261272 at SEQ ID NO. 1858
  misc_feature (326)..(366): Pfam Name: zf-C3HC4 Pfam Description: Zinc finger, C3HC4 type (RING finger)
MDEHMGRRTVGGLLFTKGGSILLFREDGSRPKSKNCCSRHGCSGQHSADKAKGKEVHRAAAPNESTPATPGRSQIFRKPNRKPPHESSASGSISRDAGGSCSETGNRSRDTPGPGRDLLARLKERVNTSRKRSLNRENSPQSPSGFSAGSPSNSRSVSRPSHRAASRIRKADEGAANAGADGVRRNGAGDARRSSERSDDDLLLVEQVTRNHVPSEGFLSGFMARYRSGLQGDLSSLDDSMEDSNGYLRFDVGGIEELENYFIFNDRHRGMRMDIDGMSYEELLALGERIGTVNTGLSDNALSTCLNRSLYMPTASGSHEDCERKCSICQEEYLAGEEVGKMACKHYYHLSCIQHWLRQKNWCPICKSVALKIN

SEQ ID NO: 2169 - DNA, 1456 bp, Sorghum bicolor; identical to SEQ ID NO: 2167
  misc_feature: Ceres ANNOT ID no. 6007067
  misc_feature: Encodes the peptide sequence at SEQ ID NO. 2170

SEQ ID NO: 2170 - protein, 374 aa, Sorghum bicolor; identical to SEQ ID NO: 2168
  misc_feature: Ceres ANNOT ID no. 6007067
  misc_feature: Functional Homolog of  Ceres CLONE ID no. 261272 at SEQ ID NO. 1858
  misc_feature (326)..(366): Pfam Name: zf-C3HC4 Pfam Description: Zinc finger, C3HC4 type (RING finger)

SEQ ID NO: 2171 - DNA, 3519 bp, Sorghum bicolor
  misc_feature: Ceres ANNOT ID no. 6009287
  misc_feature: Encodes the peptide sequence at SEQ ID NO. 2172
atggccggcgatgaccatgttgtggttgatgtggacggcttagcgaaatccaaggaggccgaggttactaagaaaccgtctgaggttgcaaacagtccagctgcggctgctgcatctccgtcagctgttgttgacttggtccatgacgaggaggagggcggtggggaggaggagccgctcatccaggctgcagagtgccgcatatgccaggaggaagatagtgtcaagaatctcgagaaaccctgtgcttgcagcggcagcctcaaggtctacatccgatcctctattaattaaattattattgcatgacattattatctctgtacagctttaagcctcacagttgttcacgaggtgcacagaaagttaaatttgcatcaacatgtgtctatcatttccattgacatgttctcttgattaaaaagcacaaaacaatcatatggtgccattcataatatcggacaccattgtgggaatatagtctatacaaggttgctcaaatcacctgtccccaatcgctagtgcaccatatctataatattgcctgtttatgtcccctcagttgggagagcacccaagcatttattcactttagcatgttctctatatagtagagttgcactatgtttctaccacattgctaacaggaatgaaccagttcagctaccgtggatacatgttatgcaattaggcatgttatcactacacatttgcaacaaaatgattccatttcagtcttgtaccagtagctggttgaattttatggtctatcagtttaagtttattatcatgatcaatatgaatttgtgatctggactgttctttggatagagtatagtgattaatgactactggactgactatcctcgctgcaatttttcttgttctttgtatttagtcacttagctcctttttcattaatgatttattcatggacatttttcaacttctaccacaaatatagaaagccttctaatgttgtcaatgtagaactttgtattcttttatataatttttcctagaaaaaagatcttggggtttattttatacctttttgtgattaagaagttttattttctttctattcatgctgagtgatatagttaaatattttcttttgcttgatactctgatgcaatcaagaacttatagctctacttatcttctgcagtatgctcacagagcttgcgtgcaacgctggtgcaatgagaaaggagacactacttgtgaaatttgccatgaggtcggttaagtttttttagttcattccactgatgtttcatttaggttctagttttttttagtgctgatacaaaattggcatagtacaaacaactagaactaaaatggttgaaggcccatgaccaaacaactgcacatatatggacctctgaatcttttttcccatgtttcttctactcaatgggttgttctcatgatcacctcactgtattatgcactacaaacaactagaactaaaatggttgaaggcccatgaccatgtgcagttggtttgcttatctacctgggtttgtactagaagggatggtaccatgcgtgattagactttagtggtttaggctagttatttaatttggatggtgttttaagaaactaactaatcatatgatacatttatgtgtgttttaaatggtatttatctagttcaccaattttggtcaatctgatttgtacgatcgatattcttatttaagtatattcatcgcttctaagttctattattattgattctacctactttttcagcacccccgcccccctctcctgacacacacttttctttttaacctcttagataatatgaatattctacccacaaaaaaagagataatataaatgttcaaggatttttttttttgcacgtactgttatggaagattctaaattttccagtgtgttagacttggagaacatgctttggccctctctatgtgcattttaatgtttcctttcttgtatactgattccttccaggctttatgctaacctgcaggaatacaagcctggttacactgcgccccctcgtcctcagccagatgagacaaccatagacatcgagtaagttattttggatatttggtgctattttaatttgagtgaatagaattagaacatatctgagcaaaaggcatcactttgcagcggtgatttgattatggatttgcgtgacccaagaattctcgctgtagcagctgcccaacgtcgtcttcttgaggcggagtatgatggttatgctactacagatgctagtggtgctgcattctgccgttcagctgcacttattgtaagcactgtccagcaattcttgatcttattgccctttattagctgaaccgatgtatgaatattactccttccatcccaaattgtaagtagtttcggcttttctatgtacaatagcttttgctatgcatcaagatataccttatgtctagatacatggtaaacattgtgtatctaaaaaagctaaaaccactggcaatttggaacggagggagtagctatttcaggacagtttttgtttttggattgaaggagtgaaggataatgcttttatatatttaacagttggctcacaaggcacaacttgtttgtggatggaaaaacagtgcctttagttgcctaattgcttagagaatatgaaaaatgttgttgcttttcacagcaatcctcttctgctctgctcctagtctaatcaccttagctctcctccagtatttactgaatgtcaaggaacagatttcgagtatgtcctggtagactaccttaaaatcctacttggttttgcagttaatggcgctgttgcttctacgacatgcattgtccatctcagacaacgaaggaaatgatgatgatgcttctaccatgttctcagtgagtgttgtaggcttcatttttacatggatgttagtgatcaagatagtgctttgtgctgactcaatcctttgcagctttttctgctgcgagctgctgggtttctgctgccgtgctacatcatggcatggatattcagtattttgcatcgcaggcgacaaagacaggtacccaatttgatgcaatcttgaagtgatcatgtgtttggccatgtaaaaaattggacccaaatcatcattgtaataatatacgcatcctattgaaccaattgcaaacaaatatttcttttgaccatggcattgaactttaggtgggtttccttttgaaccaattgcaagcaaatatttctttggcataggaagatcaccatagcattgaactgttggtggttagataaaccattctgtagctactggtccgaaacttctgttgctgatatggcacgccatctaactgctccatgtgcttaatttcttcctttgtctgcaggaggaggctgcactggctgcagcagaggtggccttcatcctacagtcagccagggggcgcgccctccagtttgccatcgctccagactcccccgccaccccgcagcacgagccagcaccgcagcaacagcaatag

SEQ ID NO: 2172 - protein, 284 aa, Sorghum bicolor
  misc_feature: Ceres ANNOT ID no. 6009287
  misc_feature: Functional Homolog of  Ceres CLONE ID no. 118756 at SEQ ID NO. 411
  misc_feature (66)..(111): Pfam Name: zf-C3HC4 Pfam Description: Zinc finger, C3HC4 type (RING finger)
MAGDDHVVVDVDGLAKSKEAEVTKKPSEVANSPAAAAASPSAVVDLVHDEEEGGGEEEPLIQAAECRICQEEDSVKNLEKPCACSGSLKYAHRACVQRWCNEKGDTTCEICHEEYKPGYTAPPRPQPDETTIDIDGDLIMDLRDPRILAVAAAQRRLLEAEYDGYATTDASGAAFCRSAALILMALLLLRHALSISDNEGNDDDASTMFSLFLLRAAGFLLPCYIMAWIFSILHRRRQRQEEAALAAAEVAFILQSARGRALQFAIAPDSPATPQHEPAPQQQQ

SEQ ID NO: 2173 - DNA, 4631 bp, Sorghum bicolor
  misc_feature: Ceres ANNOT ID no. 6009958
  misc_feature: Encodes the peptide sequence at SEQ ID NO. 2174
atggaccagcgcgcgcggagggcgcgggagagggagcagcgccgcctgctcgacctcgccgtcgagtccggcttcgaccgcgacctcgccgccagctgcctcgcccgcctcctcgaggtctacggtacgtacctactgcgccacctccgccgccgcggcttcctctcctctctctcaggtcggctggtccggcccgctgggatggacgcgcccgttcttcttccgattttggccttgtgtgcccgttggtggactgggcgggggggcactgggtgggcagtctctaactgaaaaagggtggggaattagctactgctttggatgttcagatcccaagtttttacctgttatgcactttctcatggacaggtggtatgcattgttaccaggtttggatagtgtgctttgtggttcagatgctcatgctcacgccttattggtgtggtggtatgtattagctgtgagagcaagggtagggtacccatggaaaatcctctacgtatcccttcttgttggaaaacgtgtgtcactcctggggctcattgtgccatcttgtctcttgaatgtgtggtggctaccagagtatggaatcctgtgtctcagtttctagtggcttcagagttgttacaaattgtcaacattgctagtaaagggttgagtctgaaataaaagagtatgatgtgttgaatattttgctgctggaactttttggggggagaccaaggctacctatctgcactctttggtttttgaggtgccaagactctaacattcctttgttattggaaaacctgtgtccctccagtgacttatgcttgtgaggctgatttcttagggcactcacaatacaagactctatcacagagtccaagacaattaattacatattatttatggtattttgctgatgtgacaccatatttattgaagaaagaggtagaaaaactaagactccaagtccacattgttcgaggtaataaataactttagactccatgatagagtctgcattgtgagtggccttataacaaaataatgactgctgatagtttggtgaaaagaggagcgtcgttctaaaaaaagcagacaaccttgggacttcgaccaatgcacatgctgctggtctgctggaaaaataaatacactttttccaattttcctgctattaaacatgtgattttgcttaaatccttttgcctgttttggcaagagtggtttaggggtattcagaaatgtggatgcatgtttacattgtcttttttttaagcaaatgttacattgtcaaatccgtgcacctgctcctaggaggtaatagctcatcctaaccatttaaattcaaacatcaaaataaatggatggtctaaattgagtttggagtaccgtagaaattgacatatctgttggacctggactgggcaatctccacaacttgggattctgggacctggtgctctattgataatgatgaaggggaaagtttggctattgtttgggattatgtttctcagtttctattgttgcaaattgtgaagatattgctagtaaatggctcggtgcattaaagtactgtatgatgttttgcatattattgctgctgggactgttttgggggtatttgtctaactagagaatggcattatcttcacaacgtggcctgtcaccctaaaggaaaaaggagcaaatggagggcttcgaccaatacacatgctgctctgctgggaaaataaaaaaacaccttgtactgctagtaatttagtgaacatataattctgcttaatatttttatgttgtttgcttgtgctggcaagagtgcaaggttgagtttcacacaaaaagggccatactgtaggtattcagaaatgtggatgcatgcttacgttgtcttcctttcttaaagcgaacatttacattgtcatatctgctaacctgctcttggtgtaggtcacccaggtttttcttttactactgtttattgggattgccattgcctgatcacttgatatatggttccttattctggtacaggggaggatggcctggctttggttactgtcgagaactgtggcaatgatttccttgcgtcgctggctgatgccacacaacctaccgatgactgggacgatctcaaagggattgagaccgaagcatgtggcaacctgaatgatatgatgatgaagaatgtgactgactgtactggaggagttgctatggacaacagtcatacgtccagagagccaaatttgtcctctgatgctctggatcattctgaagatttcgattttgcctctgatgattcagattttgaaatgggtgatggaatggacaaccttcatgacaactctttcaatatgcaaaggcagacacaatctagaaactctggaatgcagagccgaagctcagcaaaatccacagtaagccacttactctgatcttccactaatagacaattccattgtcgttattctagtttgtgtaaggtgatgttataacataatgtttgcatacagacaacatatgaaacatgctattctgttctttctgtgctttcaaacaagtgtagcttgcttttgtctttcttctgttactttttagttaatattttatcttccacaatttttaattttgaaggtgactagggctaccaacagatatgagtcaatgactcccacttcaaatagagagatgcctccagctgcatttcatcaaaggagagaagttctgagctatgaacaactttgtggccttgatgatgtcaattttgccaatgttgtcatctttggcaacaaaagctttaggcccctgcagtatgaagcttgcagggctgcaatgaataatcaagactgtttcatacttatgccaactggtggtgggaagagtttgtgttaccaggtctgtaaattctgtattcttgttcaacattgttctttttattgcttggtatcatgatctggaacagttcatcaacatttatattcttgcagctccctgcaacattgcacccaggtgtcactgttgttgtaagcccactactgtcgctgatccaggatcagattgtggcattaacttacaagtttgcgataccagcagcatttttaaattcccagcaaactcctgctcaggcatctgcagtaatccaagagctaaggtatgtaatattgtttggtgtctgtaacctttgtgatcagattaaataatgaaccttacgttatatgcatatgacatatttccatttgattgatcatcccattgcagatatggcacaccatccttcaaacttctgtatgttactcctgaaagaattgctgcgaactattcatttatggagatgttaagaggcttagatcagagggtattagtcttgaatttcattgcttaaattttcaatgctctttatttcaagtttaactcacaagctgcattctaaaattgaacctttaattagggactgttagcaagatttgtgattgatgaagcacattgtgtaaggtaacacattttgatcctaaatctgtgatgattgtttcagaagcaactatttcctgaatgctgccactacctgattttcatttctaaaaaaacagtcagtgggggcacgatttccgtccagattatcgtggtctagggtgcctcaagcagaactttcctagggtcccaattatggctttaactgcaacagcaactgaatctgtccgtaaggtaattaagagctttcccacactacagcttcgagcacaattacacaaaccgcttactgttaactggatggaatctgcaggacgtccttagtgccttgaggatccctaatgctgtgatactgaagaggagctttgatagactgaatctcaattatgaggtgattggcaagacgaaaactccccagaagcagctgggtgatctcctgaaagagcgcttcatgaacaaatctggtatcgtgtactgcctctcgaagaacgaatgtgcagacactgccaagtttttgagggagaaatacaagatcaaatgtgcacactaccatgctggcttggcagctcgtcagcgaaccagcgtccaagagaaatggcacagcggggaggttaaagtcatctgcgccaccatagccttcggcatggggatcgacaaacctgatgtggtaagtggtttcagcttttgttagcatacttctgtctacagtttgtcaatctctgcaagttttcctttgctaatatcttcactgtgcagcgttttgttatccacaacacaatgtcaaaatcaatagaaagctactatcaggagtccgggagggcagggagagatgacctcccagcacattgtattgtcttataccagaagaaagacttcagccgtatcgtgtgcatgttgaggaacgctgacaacttcaagagtgagagcttcaaggttgcgatggagcaagctaagaagatgcaaacatactgcgagctgaaggtaattctacgattcactgtgtcattgaaatgctgcatgaaaccgaataatatcggagtgatcattttcctttttccctgaagaccgagtgtcggagacaggcacttctagagcacttcggcgaacagtacaacaggcaaaggtgcagagacggccctagcccctgcgacaactgcctgaagacatag

SEQ ID NO: 2174 - protein, 581 aa, Sorghum bicolor
  misc_feature: Ceres ANNOT ID no. 6009958
  misc_feature: Functional Homolog of  Ceres CLONE ID no. 389585 at SEQ ID NO. 1581
  misc_feature (183)..(356): Pfam Name: DEAD Pfam Description: DEAD/DEAH box helicase
  misc_feature (422)..(498): Pfam Name: Helicase_C Pfam Description: Helicase conserved C-terminal domain
MDQRARRAREREQRRLLDLAVESGFDRDLAASCLARLLEVYGEDGLALVTVENCGNDFLASLADATQPTDDWDDLKGIETEACGNLNDMMMKNVTDCTGGVAMDNSHTSREPNLSSDALDHSEDFDFVTRATNRYESMTPTSNREMPPAAFHQRREVLSYEQLCGLDDVNFANVVIFGNKSFRPLQYEACRAAMNNQDCFILMPTGGGKSLCYQLPATLHPGVTVVVSPLLSLIQDQIVALTYKFAIPAAFLNSQQTPAQASAVIQELRYGTPSFKLLYVTPERIAANYSFMEMLRGLDQRGLLARFVIDEAHCVSQWGHDFRPDYRGLGCLKQNFPRVPIMALTATATESVRKDVLSALRIPNAVILKRSFDRLNLNYEVIGKTKTPQKQLGDLLKERFMNKSGIVYCLSKNECADTAKFLREKYKIKCAHYHAGLAARQRTSVQEKWHSGEVKVICATIAFGMGIDKPDVRFVIHNTMSKSIESYYQESGRAGRDDLPAHCIVLYQKKDFSRIVCMLRNADNFKSESFKVAMEQAKKMQTYCELKTECRRQALLEHFGEQYNRQRCRDGPSPCDNCLKT

SEQ ID NO: 2175 - DNA, 603 bp, Sorghum bicolor
  misc_feature: Ceres ANNOT ID no. 6009977
  misc_feature: Encodes the peptide sequence at SEQ ID NO. 2176
atgagcaccatgaggttctgccgtgaatggtgagctcagctcatgatcgattgattagcatatgctcatccggttactccctttcttgagtaggagtagtactttacatactttgcccaagaggaggcgattgattgatgaacagaagaggctttctgttcctttgatgcaatgcaatgcaatgcagcaacaacatactgtatccaaaggaggacagggcgaacaaggtgcttctctacgcctgcaggaactgcgagcatcaggaggtggcggacagcaactgcgtgtaccggaacgtggtggaccacgacgccggcgagctcacgcaggtgctgtccgaggacgtggcctccgaccccacgctgccacgcaccaagtccgtccgttgcgccgcctgcggccatggcgaggccgtcttcttccaggttagaggatcatcatgggctcatgcatgaatcttcagtgatcggttcagtgacctcgaagaacatgagtgctgatgcatgggcgggggcggtgcaggcgacgacgagaggcgaggacggcatggcgctcttcttcgtttgctgcaaccccagctgcggccaccgatggagggactga

SEQ ID NO: 2176 - protein, 115 aa, Sorghum bicolor
  misc_feature: Ceres ANNOT ID no. 6009977
  misc_feature: Functional Homolog of  Ceres CLONE ID no. 12256 at SEQ ID NO. 417
  misc_feature (4)..(58): Pfam Name: RNA_POL_M_15KD Pfam Description: RNA polymerases M/15 Kd subunit
  misc_feature (75)..(114): Pfam Name: TFIIS_C Pfam Description: Transcription factor S-II (TFIIS)
MSTMRFCRECNNILYPKEDRANKVLLYACRNCEHQEVADSNCVYRNVVDHDAGELTQVLSEDVASDPTLPRTKSVRCAACGHGEAVFFQATTRGEDGMALFFVCCNPSCGHRWRD

SEQ ID NO: 2177 - DNA, 2320 bp, Sorghum bicolor
  misc_feature: Ceres ANNOT ID no. 6010155
  misc_feature: Encodes the peptide sequence at SEQ ID NO. 2178
atggctcggcggccggcgtcgtgggagcagggcggcgacgagtacgactacctcttcaaggtggttctcatcggcgactccggcgtgggcaagtccaacctgctctcccgcttcaccaagaacaccttcgccctcgactccaagtccactatcggcgtcgagttcgccacgcgcacgatccaggtcccacgaattttgcacctctccccctagttccctcttccctgtctcttgctaatccacttgttcttcaacgttctactggtggtggtgatggcaattttttttcttctactagtgtataatagtatgtttgacttgtaatgttcgcgggggagattccgcgcttcacttgggtgctctgtctgagagattcttgaatggcaaccggctgcaaccccataaaaatatagttgttcggatttggaatttggttaagatatgcttatgatgatggattgggtttcttgtcttcagaagtactaggagaactctgccgtttagtgttcaatactccctccgctacaatttctagagttgtcctaagttaaaattttgaaactttgaccaaatttatagaaaaaaacattaagatttatagtaccattagatttatcattgaatatattttcgtaagatactcattttatgttatacatattgatgctcttttctataaagttggtcaaagttaaacagtttgactggtacggattctaggaattgaagctttcagggacagagggagtatatagatattggtatggtcgtctcggtactttctcaacttttacccatgggaagttgcccaagggtaagccgcggatgtgctgctggtggccacaaattgtggatgcatgtttaatttggtggcagttatttcttttaggccattggtagttgataacttgaataaagtgactactgacagatatttacttcttctggtttgaattactctgtttagactcatgcacatagatcacgcttaaccttctgacttagtttgctcttattgattatccactcctctctccagcaccattcaaagctataaagaggtgtaatttggtggaaaatgttatatcgcaattgattattatgtttgcctgggggattgaattttgaattcatttattttttgtttgaccttaattagaatactgcagtgctctgctttgtgataatcttgcttgtgcaccctactgaaatgtacagacagacatttattctggttcctcaatcccagaccttgagggacatgaatcgttacagggaatgaagaaaagaaattcttttctgatgtgtttggttatggtgtttcaaggtttagtaacgatactggattgaaagttctcgttgtttgttggaatagattcagttagtaatcagatcaatgatacatggacaaatagttagtttacaatgtatcaatgcactataggatgtttttcaacctatgaaatgctataaagattttactaccgtttggcatattgccatgatgaaatatgatttactgcttggctatcccagcccattccacataggtgggtcaggattgatctaaattgctggcccatccatttggactgggcaaggatttgagccactcatggaagctcagcatgtaacagaatttgaaacagatgatttgaagaaagttactagttaatttcattattcagataaatttatcatgattacacttatctgtgatgcatggtgtacttacttatgaattaattttgcctttttattaacacaataatacttcttttcccactgctactgaagaaataagttatcaaatttgatttctctgatccaggtggacactaagactataaaagctcaaatttgggacactgctgggcaggagaggtatcgagcaattacaagtgcttactaccgaggagctgtaggggcattgctagtgtatgatgttactaaagtaatgacgtttgagaatgtgaagaggtggctgaaggagctccgagaccatgctgactcgaacatagttgtcatgctcattggcaacaagatcgaccttagacacctgcgttctgtcgcggttgaggatgctgcaagctttgcagagagcgaaggtttgttcttcatcgagacctctgcacttgatgcaacaaacgtcgagaaggctttccagactgttctagctgagatctacagaataatcagcaagaagcccctatcttccgaggagtctggttcagggtctggtaacctcagagaggggcaatccattcaagtgtcagccacaaattctagtgctcttacgtcacggtgctgctcttcttag

SEQ ID NO: 2178 - protein, 223 aa, Sorghum bicolor
  misc_feature: Ceres ANNOT ID no. 6010155
  misc_feature: Functional Homolog of  Ceres CLONE ID no. 312833 at SEQ ID NO. 686
  misc_feature (20)..(181): Pfam Name: Ras Pfam Description: Ras family
MARRPASWEQGGDEYDYLFKVVLIGDSGVGKSNLLSRFTKNTFALDSKSTIGVEFATRTIQVDTKTIKAQIWDTAGQERYRAITSAYYRGAVGALLVYDVTKVMTFENVKRWLKELRDHADSNIVVMLIGNKIDLRHLRSVAVEDAASFAESEGLFFIETSALDATNVEKAFQTVLAEIYRIISKKPLSSEESGSGSGNLREGQSIQVSATNSSALTSRCCSS

SEQ ID NO: 2179 - DNA, 3798 bp, Sorghum bicolor
  misc_feature: Ceres ANNOT ID no. 6011078
  misc_feature: Encodes the peptide sequence at SEQ ID NO. 2180
atggcggcgccgccgtcgaggtcccggggcgactacgaccacctgattaagctcctgctcatcggcgacagcggtgcgtgtttcccccctcccccgcactccccttaacgaatcccccgaagaacacgctgccggtcccctcgatcctccgcgcggctccggctcctagggctcctgctgcccgcgggggctcgcctccgcatgctcgctcgctagtctgattagctcgattggctggcgatgtaggcggcggcggcggctgctgctgctgctcgcgcgtgcgtttaccgatccttccttccgcatcaccggaggagtcggtcggctgtacggtgcgggcggggcagtttgttgcccagggatgaaggaacagggtggttttgcttctactacctttgcttgttgcttgtggacttgctagtgctagatgtacatgtagtacggcaacagacccatggttgaagcttttcacgagcgatgcgtggcggttaatgctttattattgatgcttcataattgttgctgcttgcttgctacacttgacttgacacacacccgtcggttgggagcccatgatcacacatggatggccttttatttctgcatcagagctcaaattttctactctgctcttgcagctgtgctttccttcattcacatgttcttctcaggagccaaaaattcccccacaacagatgcttttttgtacacgcttctggtgtgatcatccgcgattttctagctgtacatagtttacaccttgcttcaagtgttggtttgccgagcattccccacagcagagttattccctaggtcaattgctgagttaggtaggctagaaattcgggcagtgtaaaattggagaggtgtgaaatgaggcttgggggttccaatccagttccagaaagaggctccgctctatcgcacttgcagttgactgtgtttttggttggatcgctgaggttgggtcgaattgttgagttaggtttgctgtttagttttaccacctactcctagctcctaatcactcctacctgtaccactatagttttacatctatgctgctggcctgattagagtttagtacttttgaatctcaaccatgcgatagagctcttgaaggcttccacaggttcatgccagatcctgaagttgattgtgtcagtatggttagtatttggtttagtaacttctatgacacttgatacggacatttatccattgttattctctgcatcaataattcgaaactaacgaggtatatgttaaaagataaataagaaaaaactggacgatgatggttctttcttattgagacaattgggagcagaacaaatggtcacatttcgcctacgcataccatctgttttgttgggatacaatcgttcctcattcacctgtctactttctatcatgcacttaaatgtgttccgtgttcctctgttagtagaccttcatatgttcaaatcgccatctccatcttcttcttttctctgtccatttttcttcatatgcatgctgattgtgctgtcaccatattggcagttgttagcttgcatgggtttcattaagcaactgcatatttagcttcagttgtgggtggggacgagggaggatgaaatgcctccatcgagcaattcataggcaaccatggtgaacaccttgcagcacggatacagatgtgagtatcagtatcggaaggataaggatacacagatacggcaattttctaaaaaatctgatacgcggatacaccatgaacacctgtttgtaacatttgattgaaaacttgacatgtcaacccccacccccacctttaccaacaatatacatatacatgcacagaattccgaatatttttttctcaattaaagtaggtgtgatcttcctcttaataaatttttggttggacagtcaaaaccctgtgaagtctattcccttgctgttgattgtactcactgatgatccacatccttgccggtgtgccatattctgtattttctctcattgaccaataccttttggtcaaactttttatgtgttgcatcaactatccctcacataatataaagcccagtctaatgagagccccatttctatttccaggagttggaaagagttgcttgctgctgcggttctctgatgacacattcacaacaagttttatcaccaccattgggtatggacccaggcaatgttatatcctctcttttacccattcatttatggagttagtattctaaactctacttttcccctcttctgcaaagcattgatttcaaggtcaggacagttgagcttgatggaaagcgtgtaaaattacaaatctgggatactgctggtcaagaacgtttccgaacaattaccacaggtaactattttctcccttatttttaactatgatgctcttatggggctactacgtaggcataatttcagaagcatcgtatacttgatcttcagaaggcccaacctagaccaagactttaacacttagaaaatgatagatttatttgtgccttgaaattatgcgcgtctggtacttttaagagaaagtaatggaaaatagtttgctatgataagtaaaatacagctatcttgtggccaagctgggctggctgagccatgccttattagtgaatcttgtttattattacggaaccaaaagagctaaagcctaccttgaccatgaagcctatacagacaattctctaagcctgaaggttcaggaaatgcatgccactaccacatctgttcttgactggtttcacaaaggagttctaaaactataacagttatatgttgatcatctgtaaatcttttgatggtgacatatttcatgtatgggatggtataaatcagcagcatgttattgggcactggatctcatatattttttccatagtccagtgaatgtaaaatagcaattcattttgttgatttttaagcaaaatatctgctcctttgatttattgttctttttttctttcccatttgcagcttactacagaggagctatgggcattctgcttgtatatgatgtcacagacgaatcatccttcaatagtatgccacatgcatgtgcattcccatttgttgacagaagatgaaaatgctagtcaccttatttattgttttttcttaattaacttgtagacattagaaattggattcgcaacatagagcagcacgcatctgataatgtcaacaagatcttggtgggcaacaaggttgatatggatgcaaagcgggtacatgttttcataaaactatctactgctaggcccccatgactggctttcttctctgtgccctaataactcccctgttaacaggtagtgtccacagctcaaggtcagaagctcgcagatgaatatgggatcaagtttttcgagacggtaatattttgttcatataagccgagtaatatacgatatacctcctgagtgtcatagtcacttcttcatgaagttgtcaggttgctaagatggttagttacagatttcagttccactgtacatttgtatgcagagtgcaaaaacaaatcaaaatgtggagcaggttttcttcaccatggcaagggacataaagcaaagactcaccgagactgtagccgctgcgactgaggtagcttgtgtactcatgcaagtgttatccccatttcattgatcgccatgtaaatcgtcacctctaatctttcaccaaactatgcagcccccaactattcagattagcaggccagatcccgaccaggctggcacggcctcgtcaaggtggtcatcctgctgtaacacctga

SEQ ID NO: 2180 - protein, 216 aa, Sorghum bicolor
  misc_feature: Ceres ANNOT ID no. 6011078
  misc_feature: Functional Homolog of  Ceres CLONE ID no. 543118 at SEQ ID NO. 994
  misc_feature (17)..(178): Pfam Name: Ras Pfam Description: Ras family
MAAPPSRSRGDYDHLIKLLLIGDSGVGKSCLLLRFSDDTFTTSFITTIGIDFKVRTVELDGKRVKLQIWDTAGQERFRTITTAYYRGAMGILLVYDVTDESSFNNIRNWIRNIEQHASDNVNKILVGNKVDMDAKRVVSTAQGQKLADEYGIKFFETSAKTNQNVEQVFFTMARDIKQRLTETVAAATEPPTIQISRPDPDQAGTASSRWSSCCNT

SEQ ID NO: 2181 - DNA, 1565 bp, Sorghum bicolor
  misc_feature: Ceres ANNOT ID no. 6011590
  misc_feature: Encodes the peptide sequence at SEQ ID NO. 2182
atggccgccgccgtcacagcaaccttccgcaccctgctccagcacgcagcggctggcggcgtccccgtcccgcttcccagcgttcggttccagagcctgcagcgccaccgcgtcggcctccgcctcctcgcgcccccgcgtgggcgccccgtcctactcccgcccgtcgccgccgccgcagccggcgaggaattctcttccgacggagaggattccaccggcgacgagtacttcgatgaggaagaggcctccgagtcggaggaagaagccgaggccccgcgcgcctactcgccgccacgaagccgcccgacgcgcggcgacgaccccggccggctcttcgtcggcaaccttccctatacctatacctctgaggagctcgcccaggtcttcgctgaggccggcagggtcgacgacgcgcaggtacccgtatcttccaattcttggtctgcctcctggaacaatccctgaacggtatcatcattcatggctgacggttccatttcctgcagataatctatgacaaggtcaccaacaggagccggggctttgccttcgtcaccatggccaccgccgaggaggctgccaaggccatccagatgttcgacggcgctgtaagtaccacaccggccaattggatcagtccttgctcagttcacagaattgggttcttgctcttgcccatgaatgtgcaagtgtgtgctctgactctgacatgatcttggcacatttgtcttcaaacaaatgcagctgctgggagggaggaccgctagggtgaactacccggaggtgccgcgtggtggggagaggagaacggtcaccatggctggccgcaggcgtgacgatggcacatacaagatttatgccggcaacctggggtggggagtgcgtgccgacacattgaggaatgtgtttgagggtcgggccggcttgctcgacgccagggtcatctttgagcgtgagactggccgctccagagggttcgggttcgtctccttcaggacagcagaggatgcacaggctgcattggaggctttggatggagtggtatgttctgtcttcatctaggccaatgttgttcagtgcccttacatctctttattagtagtagatatatggaaatgccaactgatgcagtagcatgggcacttcaaattgattcatcaaattagagcacacaagatagctaatatatggattttcagtgtgggctggactggacaatgcatacctgctaattgcacttcgtccaagtagcatgtgaataagtgaattgtgatttacttgagtgtataccttctttcacattacttgagtgaccttggtcttgttgtagcagtggttaacatggttatggaatggcaatgcaggaactggaagggaggccacttcgacttagtctggcggaacagaatccaccacctggttccccgcctagtaatgcgcaggcacagcaggaagaaacagattcaggcgcatctgatgcagagacggaagtagtcagttcttcagaattatctgaagcagagttggacgagaacaacttgcagacagctgcaacttattaa

SEQ ID NO: 2182 - protein, 338 aa, Sorghum bicolor
  misc_feature: Ceres ANNOT ID no. 6011590
  misc_feature: Functional Homolog of  Ceres CLONE ID no. 14246 at SEQ ID NO. 1423
  misc_feature (112)..(183): Pfam Name: RRM_1 Pfam Description: RNA recognition motif. (a.k.a. RRM, RBD, or RNP domain)
MAAAVTATFRTLLQHAAAGGVPVPLPSVRFQSLQRHRVGLRLLAPPRGRPVLLPPVAAAAAGEEFSSDGEDSTGDEYFDEEEASESEEEAEAPRAYSPPRSRPTRGDDPGRLFVGNLPYTYTSEELAQVFAEAGRVDDAQIIYDKVTNRSRGFAFVTMATAEEAAKAIQMFDGALLGGRTARVNYPEVPRGGERRTVTMAGRRRDDGTYKIYAGNLGWGVRADTLRNVFEGRAGLLDARVIFERETGRSRGFGFVSFRTAEDAQAALEALDGVELEGRPLRLSLAEQNPPPGSPPSNAQAQQEETDSGASDAETEVVSSSELSEAELDENNLQTAATY

SEQ ID NO: 2183 - DNA, 5694 bp, Sorghum bicolor
  misc_feature: Ceres ANNOT ID no. 6011832
  misc_feature: Encodes the peptide sequence at SEQ ID NO. 2184
atggatcagagctttgggaatctcggggccggagctggtggtgggagcagcagcgggggctccaactccaaggcggcggtgtcgtcgtcctcgttcctgcagctgccgctgtcgacggcgtcccccgcgtactacggcgcgccgctcgcgctcctgcaccaccacgccgccgccgtcgccgcgggcggccccggcccgtcgtcgtcgcagcagcagcagtcgccgtacgccaccaagcacgccagcaccgccgagatgtcgtcggcggaggccgaggccatcaaggccaagatcgtcgcgcacccgcagtactcggcgctcctcgccgcctacctcgactgccagaaagtactgagcttgagctcccgcaccctggctgctgccatcactggccgccggaaaaatcgcatctttttttttatttcttgatttgtgaagcaagatttgcttaatttgatgcgtaatctatctatatctatccacgcctgtcgcgtcgctcacgctcaccctcacaaacatggtggctatgaaatgacgcacgctttctcttctgtgtgtgattacaggtgggcgcgccgccggacgttctggagaggctgacggccatggcggcgaagctggacgcgcgcccgccgggccgccacgagccgcgcgacccggagctggatcagttcatggtctgtctgtctgtctcggttcccatcccatccccgttcatcgatccacacagcctgcttctgcttgtgcagtgcatcgatttgctgcgactctaaccttgtatctgccaatcacatcacatgctctcccgtcccgtcccgcaggaggcgtactgcaacatgctcgtcaagtaccgggaggagctgacccggcccatcgacgaggccatggagttcctcaagcgggtggaggcgcagctcgactccatctccggcggcggcggctcctcctcctccgcgcgcctctccctcaccggtaagataagttcgccacatcatcggatatcggaatcggaacaacagcagctgccggaccgccgcctcgtacgtcttgctgcttgctcgctcccttcctcttcctcttcctcctctcttgctgctcgtacatggcggtggtacggcggccggcccagcccggtgtttttatatatactggagttggaacaggcttgccgcattgggtatggttgattctggatagtgggggtggttgctctgggtcattgccattgtgagcaaacctgacctggccctggccgcccgctctcctcgcccttccctctccggccattactttaatcacctcctcctaattaaaaaaatcgattaaccatcatcaatcagataagccccagcacagaaccacagcacgagctaattgtctaatcataaaagcatttagcgacgggattagtcactaagtatcatcagcttagcttttggttggcatcgagggcacagtgaggcgccgtgtcgcatggccgggcctccacctctcgttcctcgccattgtttaattaattaatcagcctctccgcttgcgttatcctattattattattattacctgatggatagatccagcacaagctataagcttgctttcagatgagcatgagctcgtcggcagatgatacgcctccttgccctttttttttcaattcaacagaggcccatgacatgacgtttgacaagtgacagcatgcttgcttatgtgttaattaatttgcttgcttgtgatgttaattaatttagggttccaaggcaggagaatccgtctgtttcgtttcatctctgcactggagtccgctccttgatcgatgcaaaactgtgtagtattttttgtgtgtagagttgctgcgcagctgctactaggtagtcgtagctagcagcatcccatctctctcacccgtcccatacatcccttcttttcttgcagctctactcctagattagagacagatcagagatgcattgggaaatggtgccatggctgactatccaattcttctttcacctgtctcaactgtagcaacattgctggtagttctggcctgtagcacgtactccagtactcctcctgcaagcctgtgagagagagatggtcgccggaacgtgtcttccggggggatgctgccggccggcctgttttgcagctctggacgtgcagcttctacagtgcatttgcagatgtattttaacaccgggaccaggggcttggtgggggggatttgtctaactgttctactacgccactgtggctgtgccaagctgtgtacaggaacattggctgatctagatcgtcttatgtgggttgtagtacgtgttcagatgttttccgcaacagaaaccaccagaaaatcaccacatccagaaactgctatatgttctcagcctcagccattgatgatttagtttaggtacacctgtttttgtattgtgaaatggtaggtttgtgttggttttttgttcatcatacgttgtagtgtcagataattaatgaggtcaatttaagattactgcatttgatctggctaaacaggcggaggaaatcatccactgcagtagaagactaggttcaaatttgccgtgtatagttcaagcatacaactttgactatatatttcttgtaacaataagtcatggtttagttttgctctgatttttcaacagcaaaagcgataaaaaatcaggatcattttcctgtgtgtgactagttcagatactctaacatgaagccagcaattattatcatcaaagattaccaaagcttgggtgtgcactttttcaaaagtgccaaagtgtatcttctatacaaattcatgtagttaatattagatgctgaaataggaatgttctggttcttccataaagtttcagccttttccaccgtttctgttttaaccattcgaataaatagtagatcttatcttgtgcatctgataatgcatttttttgacgctacagatgtttcactttttattcaaaagttgaaaagtaaccaatcctatcccaaaaataccattcccagatggagggttgtttttatgcattccttttctatatagaagtattgttggcaggattaatcattttctactcattcagcaagaaagtgtattagctattctgttaaataattgcttgttttttattggctactccctccctcttgaagtatacaggatcgaagtttgtcctaagtatcataagtttgatcaaattagcatatataattggatacactaaaaaaaatatagtttcataatttacctctttttttttcccgaaaggcagcaaaagtataatttacctctttgatgtgataagtattgatggtctttgtatttttggaaattaggatagtctgactttggacaaaatttgatcccatactttttaggatgtagcgagtattggtcatcctgcacgcaaggtataaaattagcaagtgataattcgggctctggctttactttttgtatggatttatgtatgaaactagcttaagaacgttgataaatgcatacatatgtattgaagtataagtgcactgcccacctttcccacatggcttaggaatttaggtctaattggttggtggtacatgcagatagtatatatatctgcctcatttagaggtttctggcaaagtttcactgccattttatcagaacacaagccatgttttgtatcttattatgatctcaacgctgaattaaaagctaatagtttatgcaaaccaaattaattggtctataagctttgcccttgtttccctgctatcttgacgcggtgtaaaaaatgttaatgctagctcaggttttataattattgtgatgcatatgaaaaaaagagactttagatgtacaaaaaaataaatagtatccatgggaaaaatgtgtggcagaaccacagctattctactaaacatacactgcgtacaattttttatagttcccaccagttgaaagaacacaagatattcctttctgtaaagtatctttcctgtttgtttacaatacatggaaaaaggatgcatgaactttccttgttgagtaccatgtattatatgatattttgttatgattccatcatcacgtggccaacaaatcctatcactatacccttattaaaggatccactactttttctactcatcatttgaactaaagttatggccatatatatcattgtttattttcaacgtcatttttcacttacaccgcgactgggatacttgtattctccaactgaaaagtttattcattgaattacattggtcgcagatataaggattaatacaagcaataattcacttattctggtgatgttagtgaacaattgtctaattttctttatatttccatttctgttttccatgtattccccttcttcagatacattattacttggaacctttctgtttataaccaggaaaaactgctttacatctatttagtttctctatgattattgtttgacctgaatatgtttgatgcaaaatgtatgtatagaagatttattaagttgaaaagtttttactagttcttgctattttactttcctcccattgattttctgatgattctgttatcagctttctctacaaataaagtagtggtgagtagcgacatagtgcattatttcataggtgtatcatgatgactgggcaggttcatgtaatgacaggccacaaagttttggtcttcacattcttgatttcatctggtcttgtttgttttattgtttcaatcctatattaaaaatccttatcctatcacttccattggcaatattctactaattgcgactgtagctacactactgctgttctaaaattccactgttcgacctaccctagcattccagaatggatataattctttacatacagttatgggctctctgatgtgctcacttgattggtagcagtccagcatggtcgagactgaaatactttgaaattttgaccgaataaacctctggactgaaaacatgtgaccttaccaaaaactagttttgtctgcagatggtaaatcagaaggtgtcggctcttctgaagatgacatggatccaagcggccgtgagaatgacccaccggagattgacccgcgagcggaggacaaggagctcaaataccagctcctgaagaagtacagtggctacttgagcagcctcaggcaagagttttccaagaaaaagaagaaagggaagctcccaaaggaggccaggcagaaactgctccactggtgggagctgcactacaagtggccttacccttcagtaagatatctcccataccataccttagtgctcatatatgtataaacacaataccattgcctgtctgtattctgtacaatgacaaaaggataacagatttccgtgacctgtctgcaatgttaacactacttcagaatctcggagaaatagtgaggaagaagcctgcatatataacattgttactgatctaatgttattcgagcaggagacggagaagattgcgcttgcagagtcaacaggcctagaccagaagcagatcaacaactggttcatcaaccagaggaaacggcattggaagccgtcagaggacatgcctttcgtgatgatggaaggcttccacccgcagaacgccgctgcgctgtacatggacggcccattcatggccgacggcatgtaccgcctcggttcatga

SEQ ID NO: 2184 - protein, 356 aa, Sorghum bicolor
  misc_feature: Ceres ANNOT ID no. 6011832
  misc_feature: Functional Homolog of  Ceres CLONE ID no. 541719 at SEQ ID NO. 1779
  misc_feature (139)..(190): Pfam Name: KNOX2 Pfam Description: KNOX2 domain
  misc_feature (237)..(258): Pfam Name: ELK Pfam Description: ELK domain
  misc_feature (285)..(319): Pfam Name: Homeobox Pfam Description: Homeobox domain
  misc_feature (92)..(136): Pfam Name: KNOX1 Pfam Description: KNOX1 domain
MDQSFGNLGAGAGGGSSSGGSNSKAAVSSSSFLQLPLSTASPAYYGAPLALLHHHAAAVAAGGPGPSSSQQQQSPYATKHASTAEMSSAEAEAIKAKIVAHPQYSALLAAYLDCQKVGAPPDVLERLTAMAAKLDARPPGRHEPRDPELDQFMEAYCNMLVKYREELTRPIDEAMEFLKRVEAQLDSISGGGGSSSSARLSLTDGKSEGVGSSEDDMDPSGRENDPPEIDPRAEDKELKYQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMADGMYRLGS

SEQ ID NO: 2185 - DNA, 1583 bp, Sorghum bicolor
  misc_feature: Ceres ANNOT ID no. 6011964
  misc_feature: Encodes the peptide sequence at SEQ ID NO. 2186
atggggctcgacgtcgtggagatcgggatgggcgccgatttgagcctggatctgaggcacttcgccaccaaggccgtgaggcagagcaaggacgacgcgcctgcgccggacatggacgcctgcatccgccgcctcgaggaggagcggggcaagatcgagatgttcaagcgggagctccccctctgcgcgcggctcctcgccgacggtgagcgcgcacctacctcttccccctttttttctcacctgtgattctttttcctttcgcttcttttccatttttggggggcggttttttcttacgcggcgatgcggtggcgtgtgcgcagtgattgatgtcatgaaggaggaggccggtaagaagacgacgaagagaagtgatcgcagcctgccggcggcggaggaggacgaggacggcgccgctggggacaagagcaagtggatgagcacggcgcagctctggacgggcgattccggccgggaggacgcggaatcagaggtacggcacgattcgatcaccgatacggcgacttgaatgctcaccggggacaggatctggggggtgtctggtgctcgattgtcggtagcctaaaagtttggagctttgcgatcgcagaagcaagacaaggggaggagtttgccggaggccaagtcccgcggcggcgctctcttgccgttcaaggctgctgtgggctccggcgcgccggcgttcgcgtcgctctgcttgagaacggacgacaaggctgcgcgcgtcgggatgccggatctgtccttgctgtcgccgccggcgaccaagagcgccgccgaggagagccggcgccaggtggtggggcttgcgcaggcagcagcgagggcggccgccatggcgccagctgcccctgcgcttggcctccagtcccaatcgcagcagcagacagctcagcagcagcagcagcaggcaaggaaggttcggcgttgctggtcgacggagctgcatcgccagttcgtcgccgccttgaatcaactcggtggcccccaaggtgagacttcttcttcagataccaaattcacaatttttcttgccagttttgggcaccaacatgttagtattgcctaattgctcgccatattagaaacataaatttggaattaatgagttcattcattcatgccgtgtctgcagttgccaccccgaagcaaatcagggagctgatgaaggtggatggcctaacaaacgacgaagtcaagagccatcttcaggttagcaatccagcagctccccttgacattcatccatctcatctctggtagatgaagattcattgcccttgtctgttgtgagaattgctgacatggattctctgattctgatgtttcttcagaaataccggctgcacaaccgaagggcgcctggatcaggcgtggtgagccagccgattatgctcgtgggagggctctggattccccaggagcaaagcagctctcagtctgggtctccccatgggcccctccacttctccaccgcctcaggcatcgccgtctcgtcggcggccaccgtcagctgcgaggaggaagatggccggtcagaaagctatggctggaaatga

SEQ ID NO: 2186 - protein, 359 aa, Sorghum bicolor
  misc_feature: Ceres ANNOT ID no. 6011964
  misc_feature: Functional Homolog of  Ceres CLONE ID no. 240112 at SEQ ID NO. 601
  misc_feature (237)..(288): Pfam Name: Myb_DNA-binding Pfam Description: Myb-like DNA-binding domain
MGLDVVEIGMGADLSLDLRHFATKAVRQSKDDAPAPDMDACIRRLEEERGKIEMFKRELPLCARLLADVIDVMKEEAGKKTTKRSDRSLPAAEEDEDGAAGDKSKWMSTAQLWTGDSGREDAESEKQDKGRSLPEAKSRGGALLPFKAAVGSGAPAFASLCLRTDDKAARVGMPDLSLLSPPATKSAAEESRRQVVGLAQAAARAAAMAPAAPALGLQSQSQQQTAQQQQQQARKVRRCWSTELHRQFVAALNQLGGPQVATPKQIRELMKVDGLTNDEVKSHLQKYRLHNRRAPGSGVVSQPIMLVGGLWIPQEQSSSQSGSPHGPLHFSTASGIAVSSAATVSCEEEDGRSESYGWK

SEQ ID NO: 2187 - DNA, 891 bp, Sorghum bicolor
  misc_feature: Ceres ANNOT ID no. 6014857
  misc_feature: Encodes the peptide sequence at SEQ ID NO. 2188
atgaccaaccgcgccttctccgccatggcagcgagccaccaatcatcctacatgatccgattcgacggcgcccactccgacgacccgtcgccgagctccgccggcgccgagccgccgggccccgcgcagccgcagccgcagccgcagccaccgttcgcggggcggaggatgatctcccccgagcaggagcaccaagtcattgtcgccgccctgctccacgtcgtctccgggtacaccacgccgccgccggaggtcttcccgcctccaccgccgccgacagcggcgtgctgccagctgtgcgggatggagcggtgcctcggctgcgagttcttcgccgccgccggggagggctgcttattaccagcgacgaccgcattggacggcgcggggaaggcagtggccgcggcgacaagcgcggcgccggggcagaggaggcggaggaagaagaagaacaagtaccgcggcgtgcggcagcggccgtgggggaagtgggcggcggagatccgcgacccgcgccgcgccgtgcgcaagtggctgggcacgttcgacaccgccgaggaggccgccagggcgtacgaccaggccgccatcgagttccgcggcccgcgcgccaagctcaacttcccgttccccgagcagctggcgacgggcacgggccacgacgaggccagcgcggccgccaccaccaagtcgtcggacaacacgctgtcgctgtcgccgtcgctctgcagcgacgagcgggagcgggagcgggggcagccggagtggctgccgagcgccgggctcggagggcaggaaacaggggagcagctctgggaaggcctgcaggacttgatgaagctggacgaaggcgagctctggttcccgccaacctcgagcgcttggaattga

SEQ ID NO: 2188 - protein, 296 aa, Sorghum bicolor
  misc_feature: Ceres ANNOT ID no. 6014857
  misc_feature: Functional Homolog of  Ceres CLONE ID no. 691319 at SEQ ID NO. 1675
  misc_feature (151)..(202): Pfam Name: AP2 Pfam Description: AP2 domain
MTNRAFSAMAASHQSSYMIRFDGAHSDDPSPSSAGAEPPGPAQPQPQPQPPFAGRRMISPEQEHQVIVAALLHVVSGYTTPPPEVFPPPPPPTAACCQLCGMERCLGCEFFAAAGEGCLLPATTALDGAGKAVAAATSAAPGQRRRRKKKNKYRGVRQRPWGKWAAEIRDPRRAVRKWLGTFDTAEEAARAYDQAAIEFRGPRAKLNFPFPEQLATGTGHDEASAAATTKSSDNTLSLSPSLCSDERERERGQPEWLPSAGLGGQETGEQLWEGLQDLMKLDEGELWFPPTSSAWN

SEQ ID NO: 2189 - DNA, 729 bp, Sorghum bicolor
  misc_feature: Ceres ANNOT ID no. 6015724
  misc_feature: Encodes the peptide sequence at SEQ ID NO. 2190
atggcgccccgggtggcggacaagtcgccgttgccgccggccaccggcctcggactgggcgttggcggagtagtcggaggcgtgggcatgggcccacactacagaggcgtgagaaagcggccgtggggacgtttcgccgctgagatccgcgaccctgccaagaaaagccgcgtgtggctaggcacgtacgacacggccgaggaggccgccaaggcctacgacgccgccgcccgcgagttccgaggcgccaaggccaagacgaacttcccgttcccgtctcagtgcgccgtcgccgccggcggtgctggcagcccctgcagcaacagcaccgttgactcgagcggcggcgccagcggctgtgccgtccaggcgcctatgcaggccatgccgctgcctccggccctcgatctcgatctcttccatcgggcggccgccgtgaacgcggtcaccgcaggcggcatgcggtttccgttcaagggctaccccgtcgcgcgtccaaccccgcaccagtacttcttctacgaacaggccgccgcagccgctgccgcggcggccggctaccggatgcttaaggtggccccaccgccggtcaccgtggccgccgtcgcgcagagtgattcggactcctcgtctgtggttgatcacaccccttcgcctcccgcggtgacggcaaagaaggaggtgggcttcgagctggatctgaactggccgccgccggcagagaactag

SEQ ID NO: 2190 - protein, 242 aa, Sorghum bicolor
  misc_feature: Ceres ANNOT ID no. 6015724
  misc_feature: Functional Homolog of  Ceres CLONE ID no. 560961 at SEQ ID NO. 1062
  misc_feature (32)..(83): Pfam Name: AP2 Pfam Description: AP2 domain
MAPRVADKSPLPPATGLGLGVGGVVGGVGMGPHYRGVRKRPWGRFAAEIRDPAKKSRVWLGTYDTAEEAAKAYDAAAREFRGAKAKTNFPFPSQCAVAAGGAGSPCSNSTVDSSGGASGCAVQAPMQAMPLPPALDLDLFHRAAAVNAVTAGGMRFPFKGYPVARPTPHQYFFYEQAAAAAAAAAGYRMLKVAPPPVTVAAVAQSDSDSSSVVDHTPSPPAVTAKKEVGFELDLNWPPPAEN

SEQ ID NO: 2191 - DNA, 2718 bp, Sorghum bicolor
  misc_feature: Ceres ANNOT ID no. 6015893
  misc_feature: Encodes the peptide sequence at SEQ ID NO. 2192
atggagtggggggacagggccaaggcctccgccgccgccgccgcagcagcagcagcggcggcggcagcagacgagaggtccgcggtaggtgaaggactcgggggatacgtcaaggtcatgactgacgaacagatggaggtgctccgcaagcagatctccatctacgccaccatctgcgagcagcttgtcgacatgcaccgcaccctgaccgagcaccaggacaccattgcaggtcggtcggcgcagttgcgggcaaaaccaattgctactctctagcctcttctgctcgtcttgttgtctgttctgggggtttgcgagcagaaaattggggggattcctttgctttgccttgggacttgcattgtggcttgtcagttccatctttgcctctttgtgcagaaagaaaaatcgtgtcctcttttttgccatgacttctctaaagtccgcatcctttgtttatttatatgaatagagctaattgtggtgttacaggaagctgcgcttgctaatcttacgaaattattagcggtcaaactctctttttttttttttgaactgaaactctctttcatttttactagtcattcaatttatgtccagtactttagtctgccttctccaattggtgaaaagtgaaggagtatcttttcactctgttcatgttgctagatgcatagttgcggctgtctagtctgctttactctgcttggcatctgtgtactgcggcttttgtctagtctgttttactctgctagccgtgaccgtctatgtactatcttacaatggtaataatggttatggggtagcaagaatgtaattcataatgtgttattttctgtcattaattaactgttagtgatttctgttggatttgatatttgcacgagatgctactcgtaacatatatcttggtaatggaattgtagtgaccatccttttgattggtctagtgaaccaatttagcagtgtgtgttgggctgcatttattctttgcggcgcagttaaggcactctgccttaatgcgttgattgcagaatctagaacttgcaagcagagttccatttagtggaccttattgtctggttgaacagaactagcattcatttattttgtactttgtagatacttgacaataggttgtacaagtgccaacacatgaaaatgggaataggttcagtcagtaccaaagagtgggaatccttgttcttatttgtttctcaaggtcttcatggttgcagcatgattgttatttgtgctaagattcaatttttctctatatgataagttttctatgcccaagcaattacttccccttttaattggaaggttagcatgacacctatgtaagaatgaaacacacaaatcgagaaatggtcctttgattaaagagataataatgaatagctattaacacatgattgtcatgtagggccgaccaattgctattttgtgccacgtgcaccctgccaccctgattattccatattcttcttctgttctgcagaatctaagcttgactttcagggagctataatctgtccatgtgtctttcgttgggccaacacacttacctttttactatgtgattgcccttttttattacttatagccatcacatatcacttagtatttaaaattttgcaaacttgtccgtgctgtaatcattttatatacttcacttagcaagttttcttcttctcaacttatgcataaaccttttgattttaagtttttaagtcattaattttttatattctgatgattcagcctaattacttgcatgatggccatacaagagttccacctgtagctgagtaactgttttttggaatgctgatttctaccactgcaggaatattgccctctctgttagataatctttaaaacagatttttactgaatttacccttccccctctatgtatatttattgttcctttgtaatgtatacattgtcgatggaatatagccccttgttttctgatcgactgaattttggttttttcctcaggaatgaggtttagcaatctgtactgtgatcctctaattatcccaggaggtcacaagatcacagcaaggcaacgatggcaaccaacaccaatgcagctgcagatcttggagaacatctttgaccaaggcaatggaacaccaagcaagcagaagataaaagagataacagcagagctctcgcaccatggccaaatctcggagacaaatgtttacaactggtttcagaacagacgggcacggtcaaagcggaagcaggctgcttctttaccaaacaatgctgaatctgaagctgaggtggatgaggagtctctcaccgacaagaagccgaagtcagataggccgctccaggatcacaaggctatgggcgctcacagtgctgacaggatctcagggatgcatcacttcgacacagatcatgaccaaatcggtggcatgatgtatggatgcaatgacaatggcttgagatcgtctggcagttcaggccagatgtccttctacgagaacatcatgtcgaatccaagtatcttctctgcaaccagcatcgttacttcatttcattcattaggcaacgtaagattctgaaagagtgttactaaaagtttggcatcggttggtttgtgcaggaatcgatcatttcccggggaaggtggagagctcccggagcttcccccatctccaacacggtgaaggctttgacatgtttggatga

SEQ ID NO: 2192 - protein, 278 aa, Sorghum bicolor
  misc_feature: Ceres ANNOT ID no. 6015893
  misc_feature: Functional Homolog of  Ceres CLONE ID no. 119790 at SEQ ID NO. 415
  misc_feature (99)..(160): Pfam Name: Homeobox Pfam Description: Homeobox domain
MEWGDRAKASAAAAAAAAAAAAADERSAVGEGLGGYVKVMTDEQMEVLRKQISIYATICEQLVDMHRTLTEHQDTIAGMRFSNLYCDPLIIPGGHKITARQRWQPTPMQLQILENIFDQGNGTPSKQKIKEITAELSHHGQISETNVYNWFQNRRARSKRKQAASLPNNAESEAEVDEESLTDKKPKSDRPLQDHKAMGAHSADRISGMHHFDTDHDQIGGMMYGCNDNGLRSSGSSGQMSFYENIMSNPRIDHFPGKVESSRSFPHLQHGEGFDMFG

SEQ ID NO: 2193 - DNA, 1958 bp, Sorghum bicolor
  misc_feature: Ceres ANNOT ID no. 6016469
  misc_feature: Encodes the peptide sequence at SEQ ID NO. 2194
atgtcttttgctaggcgtctggacccatcagcttacacggataatctatacattcacaaatttgccacaccaagctcaacttttgctgctcgaagattctcctctgatacacagttgttccgttatgacccagaaccatacaatgagtatgggcatatgggtttcactggagcaccatccgctgcatttcaaaactccctttgtagtcaacaggcctcactaaaaccataccatgtaactaatgatggacgatctccaagtgttgcagatactcagtctaactcatgctctgatgcagcaaaagattcaccagtggtttccaatgtctctcagcagaactcccagtctgtatcagatagtcagagttctgaaatcgaagtagagttcgatgaagatgacattaggctgaagcttcaggagctggagcatgctttacttgacgatggtgatgatatcttgtttgacatttcccaggcaggtagcattaatgatgaatgggctgaccccatgaagaatgtattgcttccaaattcaccaaaagaatcagagtcaagcatcagttgtgctgttagcaacagtggagctccaaggactccaaagcaattgctctttgactgtgctactgcattgtctgaatacaacacagatgaagcacaggcgatcataacagaactccgacagatggtctccattcaaggggacccttctcaaaggattgcagcataccttgtagagggccttgctgcaagaatagtagcttcagggaacggcatctacaaggctttgacatgcaaggatcctccaactctgtatcaactttcagcaatgcaaatcctctttgaaatatgtccatgcttccgtttgggcttcatggctgctaactatgctatagttgaagcctgcaaaggagaagaaagacttcacattatcgactttgacatcaatcaaggcagccagtacattacattgatacaatttctgaaaaacaatgcaaacaagccacgccatttgaggataactggagttgatgatcccgagacagttcagaggcccattggaggtctgagggtcattgggcaacgcctagagaagcttgcagaggactgtggggtatctttcgaattcagggcagtgggtgctaacattggggatgttacacctgcaatgcttgattgccgtcctggtgaagcacttgttgtcaattttgcattccagttgcaccatcttcctgacgagagtgtttcaattatgaatgaaagggaccagctcctccgtatggtgaagggactccatccaaagctagtgaccctggttgagcaagatgccaatactaatactgcaccgtttctgccaaggttagtgaccttcataaaaagaaagtctcaagtccactctagatggtaatctaatataaggttgtactgcagaatttatatatgaactctcatgcatgttttaatcgtgtgactcctatagtatcattaacatctgacttttacaggttccgtgaagtctatgattactactctgcgctttttgattctttagatgcaacacttccaagggagagcccggatagaatgaatgtggagaggcaatgtcttgcacgagaaattgttaacatcttggcttgtgaaggtcctgatcgtgtggagaggtaccacccgatcatgcttaccagtcctgcaccctgcaaattctcacccttccttttcctgcaatttaaagaaactggtagtgaagctgttacatgttgcaggtacgaagttgctgggaaatggagagcaagaatgacaatggccggtttcataccatgcgcatttaacagcaatgtcatcagtggaataaagtcgacactgaaatcatattgtgataggtacaagttccacgaggatcatggcgggcttcacttcggttggggggagaagactctcattgtctcctctgcatggcagtag

SEQ ID NO: 2194 - protein, 569 aa, Sorghum bicolor
  misc_feature: Ceres ANNOT ID no. 6016469
  misc_feature: Functional Homolog of  Ceres CLONE ID no. 109490 at SEQ ID NO. 1294
  misc_feature (175)..(479): Pfam Name: GRAS Pfam Description: GRAS family transcription factor
  misc_feature (175)..(479): Pfam Name: GRAS Pfam Description: GRAS family transcription factor
MSFARRLDPSAYTDNLYIHKFATPSSTFAARRFSSDTQLFRYDPEPYNEYGHMGFTGAPSAAFQNSLCSQQASLKPYHVTNDGRSPSVADTQSNSCSDAAKDSPVVSNVSQQNSQSVSDSQSSEIEVEFDEDDIRLKLQELEHALLDDGDDILFDISQAGSINDEWADPMKNVLLPNSPKESESSISCAVSNSGAPRTPKQLLFDCATALSEYNTDEAQAIITELRQMVSIQGDPSQRIAAYLVEGLAARIVASGNGIYKALTCKDPPTLYQLSAMQILFEICPCFRLGFMAANYAIVEACKGEERLHIIDFDINQGSQYITLIQFLKNNANKPRHLRITGVDDPETVQRPIGGLRVIGQRLEKLAEDCGVSFEFRAVGANIGDVTPAMLDCRPGEALVVNFAFQLHHLPDESVSIMNERDQLLRMVKGLHPKLVTLVEQDANTNTAPFLPRFREVYDYYSALFDSLDATLPRESPDRMNVERQCLAREIVNILACEGPDRVERYEVAGKWRARMTMAGFIPCAFNSNVISGIKSTLKSYCDRYKFHEDHGGLHFGWGEKTLIVSSAWQ

SEQ ID NO: 2195 - DNA, 2112 bp, Sorghum bicolor
  misc_feature: Ceres ANNOT ID no. 6016483
  misc_feature: Encodes the peptide sequence at SEQ ID NO. 2196
atggggcgcggcaagatcgagatcaagcggatcgagaactccaccaaccgccaggtgactttctccaagcgccgcaacgggatcctcaagaaggcgcgggagatcagcgtgctctgcgacgccgaggtcggcgtcgtcatcttctccagcgccggcaagctttacgactactgctcccccaagacatcgtgcgtgccgttacctactacctgtttttcttccagtatctgattatcttttcactgtgccttagcatattgttctagttttttgccgggactggagaaaggttctattttttttagtctgctactgttgcattttagttggatttggatactgttatactttccgttactgtagcaagtatgcaatttaaagttgttttgaattggggaagagacagcataattaggtaaaggataagatttttggcggtactgctacttttcttatctatttgtcatgaacgagcttgtataagtcttaagatttttgcctgaatggtttcttgtccatttaaagtatacttttctatttgtataggttaaccacctgtggtgctctttactaaaatcgttatggcttgcgttattttgattcacttggtttctgttgagccgacacactagcaaatatccatccctgtatatgtgatatccttttggtatgtcataggctatcaaaaatcttggagaagtaccagaccaactctggaaagatactgtgggatgagaagcacaaggtaatatttgatttccggagagaacagaaaccccttttttagagcttaactgtcattttgctacctcctagtcctagaattagttgaacatattgactgactatttgatgcgcacacgaaccatttcagagccttagtgccgagattgatcgtataaagaaagagaacgacaccatgcagattgagctcaggtaaatgcttaaacttgaataaattgtcttttgttttggaatttcatatgaagtttttatttaaagagagtggtctcaaagtaatcttttaagctataatagattgtctttcctttttgggaatttacctcttcagtttcatgttcatatgatctcctgtgtgatggtgcaggcaccttaaaggtgaagatctaaactcactgcaacccaaagacctgatcatgattgaggaggcacttgataatggactgacgaaccagaatgagaaactggtaacaaatatactcaatcagtcaatatcaatgtggttgatgttgcaggtattgtcatctgtgtaataattctgatattggttgttttgttgatgcagatggagcactgggaaaggcgtgttgcaaacgtatgagcttaatctgactaatgattctgtattatgaattttatttgagcatatggttatttttaattctttccctaatccgctattttgttggttggttgtagaataagatgatggaagatgagaacaaattgctggcctttaaacttgtaagtgtctttgcagagttgcatttgacgagttgaaattgtacttgaaaaaaggctgttcactcttcacttgaaaaatcaatttgaaatctaagactacctctactttgatgtttaaattacttgtgctgtgtacagttatcagagaccaagttaatccactatttcataaaaaacaggggaaatccatgcaactaacctatattgacaatcatgcatcatactttatcggccaactagaatgtcatggaatgtgtttgtcatattttcctccatctactaaattatttctgattagtcaaatcaaactggataagtaaatgccagactttctaagttggtgggatgtaaacatattagccttcgtggtttcaatgttgttcgaaaatttttatacacaatatctatgcgctagtacttactacttctagttaatggtctgaaactagaaaacttgcctaagccactgttcttcttcattgtctgcagcaccagcaggatattgcactgagcggcagcatgagagagcttgagctgggttatcatcctgaccgggacttggcggcccagatgccaatcaccttccgcgtgcagcccagccatcccaacttgcaggacaacaattag

SEQ ID NO: 2196 - protein, 209 aa, Sorghum bicolor
  misc_feature: Ceres ANNOT ID no. 6016483
  misc_feature: Functional Homolog of  Ceres CLONE ID no. 1480 at SEQ ID NO. 461
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENSTNRQVTFSKRRNGILKKAREISVLCDAEVGVVIFSSAGKLYDYCSPKTSLSKILEKYQTNSGKILWDEKHKSLSAEIDRIKKENDTMQIELRHLKGEDLNSLQPKDLIMIEEALDNGLTNQNEKLMEHWERRVANNKMMEDENKLLAFKLHQQDIALSGSMRELELGYHPDRDLAAQMPITFRVQPSHPNLQDNN

SEQ ID NO: 2197 - DNA, 2112 bp, Sorghum bicolor; identical to SEQ ID NO: 2195
  misc_feature: Ceres ANNOT ID no. 6016483
  misc_feature: Encodes the peptide sequence at SEQ ID NO. 2198

SEQ ID NO: 2198 - protein, 209 aa, Sorghum bicolor; identical to SEQ ID NO: 2196
  misc_feature: Ceres ANNOT ID no. 6016483
  misc_feature: Functional Homolog of  Ceres CLONE ID no. 40334 at SEQ ID NO. 865
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)

SEQ ID NO: 2199 - DNA, 3199 bp, Sorghum bicolor
  misc_feature: Ceres ANNOT ID no. 6016517
  misc_feature: Encodes the peptide sequence at SEQ ID NO. 2200
atggggaggggaaagattgagatcaagagaatcgagaacaccacgagccgccaagtgaccttctgcaagcgcaggaatgggctgctgaagaaggcctatgaactctccatcctctgcgacgctgagatcgctttggtcatcttctctagccgaggtcgcctatatgaatattccagtaacaggtgagtacgtatatataagttatggtttgcattggctaattaattatcgtttcattttatgttgtatatcttcttaattcaaacgaaactgcaggtgctatatgttagttttggcggtatagttagtagatatatcttgaatatgcaaatcatgcatttttttatattagtacagcttaattaggcgtttgcgtagatcatctaatagttacagttaaactagtaaaactaccttatatgaacttccaaataaaacaattagtattattttcatgaactccatgatcattagttataatttagctagttcccttttggattttggcatcacaaaaaaaaagaaatcactgatcgatgtgttaataaattttgaaatcaatttagtggtgatctgaatagtcgatcagcagtaaactatattcaagataaatactccattttaggttaattaacaaagccatttatattagcacacttgtatagataactttatttccatcatttatgagaagcactttattaatgacttatagtaaggctttttgtgactgatcatttcgatttttcgtcactgtgtggagcccatttggattagcgaaactttttataagatgcaatatagttatagagagctagttaatagctttttataaactgggtggttgagagaatagttcaaaaatgggttactattaagctgaattgtttgaatcacctagaacttcttcaacagttagattttggctgatccaaaaatggcagtttgtgcagtggatattaaagaagcatactacttgtgtgatagtttgggactttggtcgatcatcactttttcattcatgcacgaaacgagcgacattgtggtataaaccagtttcacgcacagttgcaagttctgtccttgttggcaactttatcattctgtgccatgcactgatgaatcatcacatgcatgcggccctcgatcagctccctgaaaaggtcgttgtttattcatttcatgcgcccactgtacagaaatctctctctagagcatactgtacattgcatggagatggaaactgtaggttctccctgccttccttccttggtgatgctaaggagttaaagaacgcctttgattgctggtcgttgtgtttttgcaccgcgggaaacctctatatatatatatatatatatatatgctggagctggactcaccattattcaaaatgatgatgatgtgcatttctttggggctttttgtttgcatctttttgtgtgcaacatgtgtgtcgtaataagacaacctgaatatacgtacatacgagaatgaaggttttgtcgatcagcacagcacttcttttatgtacagagatatctacacatgcatattagttcctggtttgctgtatatacattattcttctactctagcttaatgcataggtggaacaagtacccttttttatctccttattattatagtatggatattatatatagtaaatttcatccagatatagataacatcatactgataaacatatgtgtttcatttcacaagacaacctgtgtacactgctggtttcttgtacactattttttttatggaacgatcttgtaaactacttttcataagcaagagcctaattttatttgacaagtaatcaacattattttatcagtgtaaggtcgacgattgagaggtacaagaaagcatctgccagcacttcaggaacagctccagtgatagatgtcaactctcttgtaagcactgttgtttccatgattttctcgatttaatttgtttgcaaacgttaaattgtatatgatcacacaccttatcgatcatattaactaaccatctgcatcaacaaatgttaaacaacttttaactctggaatttttacagcaattctttcagcaagaaacggcaaaactgcgccagcagatacaaaccttgcagaactcaaacaggtaagccgcctaataactagtcgttcctgtaactgttctaattttattcgatcgtctccataggataggcatatactgaagtaactgttcctttggtaaataatactttgtcaggcacctgatgggtgaatcaattggcaatatgaccgcaaaggagctcaagggccttgaaaacaggcttgaaagaggcattggccgaatccggtccaagaaggtaataacgtaaaccactaaacctagtatatagctagctagctagtcggctgattattcatatgaatttgggaatcgcaaattcaaggacacctcgctcttgaatcctgtagtaatctatttgcacctttgtgtttttctcagaacgagttgctactcgcggagatcgaatatatgcagaaaagggtaagctcgtcatgactcatgacagcattcttcctgtatattagtagtattatatgaaacatgaacgtgtggagaatctcacgtgcattttggttgacagggctcctatttaaattgctctgatcttgtctatattatatttgcaggaagcggatctgcacaatgaaaacatgttcctacgggccaaggtatacgactgatgaccattcactaaactaacacagtcattcagggctcaggaataatatttaaagtcagtgctgctgcctgctagcaagtactagggggggtattctcttgatcaaaatatgtacttactgcgctgtaatttgcaacaggttgcagaggttgagcgagctctgcagcaggaggcggcggcagaagaccagacgatggcaatggggccggcggccgtcggcggggctacgacggagctgaaagcgctgccggcgtcgttcgacccgcgtggctatggctactaccagcagcagcagcagcagcatgtgctggccgctgcctccgctgcctcgtcgtcgcagtactcggagcagccccagggccagggccagcaggagtacgagtaccaccaccagactgccctccacctcggctaccatgtcaagatccactccgccgccggcggcaaaggcttcctctga

SEQ ID NO: 2200 - protein, 277 aa, Sorghum bicolor
  misc_feature: Ceres ANNOT ID no. 6016517
  misc_feature: Functional Homolog of  Ceres CLONE ID no. 542773 at SEQ ID NO. 980
  misc_feature (73)..(174): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENTTSRQVTFCKRRNGLLKKAYELSILCDAEIALVIFSSRGRLYEYSSNSVRSTIERYKKASASTSGTAPVIDVNSLQFFQQETAKLRQQIQTLQNSNRHLMGESIGNMTAKELKGLENRLERGIGRIRSKKNELLLAEIEYMQKREADLHNENMFLRAKVAEVERALQQEAAAEDQTMAMGPAAVGGATTELKALPASFDPRGYGYYQQQQQQHVLAAASAASSSQYSEQPQGQGQQEYEYHHQTALHLGYHVKIHSAAGGKGFL

SEQ ID NO: 2201 - DNA, 3439 bp, Sorghum bicolor
  misc_feature: Ceres ANNOT ID no. 6016572
  misc_feature: Encodes the peptide sequence at SEQ ID NO. 2202
atgatcggaaagataatcggagacatcacgggcagcaacaagcatgcgcagctcaagggcaacgtggtgctcgtgcgcaagaccgtgctcggcttggacgtcaccagcatcgccggctccctcctcgacggcgttggcgagttcctcggacgcggcgtcacctgccagcttatcagctccaccgtcgtcgaccccagtgagcacagacagcaccctccctcccctgccggacttccttaattctctccctctcagttctcttgcatgcatcagtaacaactaacaacagagtgaaaaaaaatgtcgttttcaaaaacaatataatatgacgaaaacgaagatcaatccactttaaatctacttattagtatagtaaaccggatctaggcaaaaaaaagatcggataatgctttttattaacatattaggagcgcacattttacacgttggtcgtctgtgggactctgaatccatggtactgtggcgcgcgcgtgcagacaatggcaaccgcgggaaggtgggcgcggaggcgagcctggagaagtggctgctgaacccgccgccgcttctgtccggcgagaacaagttccacgtcaccttcgactgggaggtggagaagcagggcattccaggcgccatcatcgtcaagaacaaccacgcctccgagttcttcctcaagaccatcaccctcgacgacgtccccggccacggcaccgtcgtcttcgtcgccaactcatggatctacccgcagtccaagtaccgctacaaccgcgtcttcttctccaacgacgtgagtagcgcgccgcccattattccaatgttcgtcagcaaaccaaggatctgagcagagtctcttgacatgaattctctcctctctgcacgaacagacgtacctgcccagccagatgccggcggcgctcaagccttaccgcgacgacgagctccggaacctgaggggcgacgaccagcaaggcccgtacaaggagcatgaccgcgtctaccgctacgacgtctacaacgacctcggcctgcctgacagcggcaacccgcggcccgtcctcggcggcaacaaggagctcccctacccgcgccgctgccgcaccgggcggaaacccaccagaaccggtgcgtgtcctccgatccctttccttcgttttcttccccgtttttaagttaattttaacctacggacgccggccggcagcaattttaacttaattttgatgatgacacgacgacgacagaccccaacagcgagagaaggctgacggtggtcgagggcgacgtctacgtgccgcgcgacgagcgtttcggccacatcaagaagtcggacttctacggctacgcgatcaaggcgctcgtgaacgccgtcatcccggcgatccgcacctacgtcgacctgtcgcccggcgagttcaactccttcaaggacatcatcaagctctacgagggcggcatccagctgcccaaaataccagtccttgaagacctgcggaagcagttcccgctcgagctcgtcaaggacgtcctccccgtcggcggcgactacctcctcaagctccccatgccgcaaatcatcaaaggtcgatcatcgctgcgtgcaaatgatgcggagcttgcctttacttcagtagtcgttattatatatatatgattaccaatgtcatctcgattattctggctatatatgcagaggacaagacaggttggatgaccgatgaggagtttggacgggagattctcgccggcgtcaaccccatgatcgtcaggcgtctcacggtgagggaacaacaatgcatcctcgctcagtagacttggaacatggaaaagttgcaactcaagaataatatatagctagtatatatgacttaaataattctacccgggcggccgtgttttcaggagttccctcccagaagcacccttgaccccagcaagtacggtgaccacacgagcaccatcacggaggcgcacctcgagaacaagctggagggcctcaccgtgcagcaggcgctggaaggcaaccggctctacatcctggaccaccacgacaacttcatgccgttcctgatcaggatcaacaacctggagggcaacttcatctacgccaccaggaccgtgctgttcctgcgcggcgacggcacgctggtgccggtggccatcgagctgagcctgccggagctccgggacggcctgaccaccgccaagagcaccgtgtacacgcccacgtcgaccaccggcgcggaggcctgggtgtggcacctcgccaaggccttcgctaacgtcaccgactactgctggcaccagctggtcagccactggctcaacacgcacgccgtcatggagccgttcatcatcgcgaccaaccggcagctcagcgtgacgcaccccgtccacaagctcctgctgccgcactaccgcgacaccatgaacatcaactccaacgcacgccagatgctcgtcaacgccggcggcctcttcgagacaaccgtcttcccgcgccagtacgcgttcgagatgtccgccgtcatctacaagaactggaacttcaccgagcaggctctccctgacgacctaatcaagaggttaatctggcgtgtgtagttaactagcattgcgcacagtgacgctaacaacactaacgcacaaatgtgcaataatatgcaggggcatggcggttgccgatgcatcgagcccgtacaaggtgaagctgctggtggaggactacccatacgcgtcggacgggctggcaatctggcacgcgatcgagcagtgggtgacggagtacctgggcatctactaccccaacgacggcgtgctgcaggcggacgtggagctgcaggcatggtggaaggaggtgcgcgaggtcgggcacgccgacctcaaggacgagccatggtggcccaagatggagacggtggcggagctcgtcaaggcctgcaccaccatcatctggatcgcgtcggcgctccacgccgccgtcaacttcgggcagtacccgtacgccgggtacattcccaaccgtccgtcggtcagccggaagccgatgccggcgccgggcagcgaggagtacgcggagctggggaagaacccggagaaggtgttcgtgcgcaccatcacgagccagttccagacactcgtcggcatctcgctgctggagatcctgtccagccactcctccgacgaggtgtacctcggccagcgcgacacgccggagtggacgtcggacgccaaggcgcaggaggcgttccggcggttcggggcgcggctgaccgagatcgagagccgcgtgatgaccatgaacgccgacccaagtctcaagaaccgcaacgggccggccaagttcccctacacgctgctctaccccaacacctccgacaagaatggcgatgccgccggcatcaccgccaagggcattccaaacagcatctccatctga

SEQ ID NO: 2202 - protein, 868 aa, Sorghum bicolor
  misc_feature: Ceres ANNOT ID no. 6016572
  misc_feature: Functional Homolog of  Ceres CLONE ID no. 362993 at SEQ ID NO. 2085
  misc_feature (171)..(846): Pfam Name: Lipoxygenase Pfam Description: Lipoxygenase
  misc_feature (53)..(159): Pfam Name: PLAT Pfam Description: PLAT/LH2 domain
MIGKIIGDITGSNKHAQLKGNVVLVRKTVLGLDVTSIAGSLLDGVGEFLGRGVTCQLISSTVVDPNNGNRGKVGAEASLEKWLLNPPPLLSGENKFHVTFDWEVEKQGIPGAIIVKNNHASEFFLKTITLDDVPGHGTVVFVANSWIYPQSKYRYNRVFFSNDTYLPSQMPAALKPYRDDELRNLRGDDQQGPYKEHDRVYRYDVYNDLGLPDSGNPRPVLGGNKELPYPRRCRTGRKPTRTDPNSERRLTVVEGDVYVPRDERFGHIKKSDFYGYAIKALVNAVIPAIRTYVDLSPGEFNSFKDIIKLYEGGIQLPKIPVLEDLRKQFPLELVKDVLPVGGDYLLKLPMPQIIKEDKTGWMTDEEFGREILAGVNPMIVRRLTEFPPRSTLDPSKYGDHTSTITEAHLENKLEGLTVQQALEGNRLYILDHHDNFMPFLIRINNLEGNFIYATRTVLFLRGDGTLVPVAIELSLPELRDGLTTAKSTVYTPTSTTGAEAWVWHLAKAFANVTDYCWHQLVSHWLNTHAVMEPFIIATNRQLSVTHPVHKLLLPHYRDTMNINSNARQMLVNAGGLFETTVFPRQYAFEMSAVIYKNWNFTEQALPDDLIKRGMAVADASSPYKVKLLVEDYPYASDGLAIWHAIEQWVTEYLGIYYPNDGVLQADVELQAWWKEVREVGHADLKDEPWWPKMETVAELVKACTTIIWIASALHAAVNFGQYPYAGYIPNRPSVSRKPMPAPGSEEYAELGKNPEKVFVRTITSQFQTLVGISLLEILSSHSSDEVYLGQRDTPEWTSDAKAQEAFRRFGARLTEIESRVMTMNADPSLKNRNGPAKFPYTLLYPNTSDKNGDAAGITAKGIPNSISI

SEQ ID NO: 2203 - DNA, 3346 bp, Sorghum bicolor
  misc_feature: Ceres ANNOT ID no. 6016579
  misc_feature: Encodes the peptide sequence at SEQ ID NO. 2204
atgttcgggaacattggaaagatcccggtgatcagcgacatcacgggcagcaacaagaatgcgcaccttaagggcaacgtggtgctcatgcgcaaaaccgtcctcggcttcgacgtcaccagcatggccggcgccgtcatcgacggcgtcggcgagttcctcggccgcggcgtcacctgccagctcatcagctccactgtcgtcgacccctgtgagcactgagcagagcaccatcccctccctctctccctcacactgttctcgcacatgcgtcaataataacaatgccgtgtttccagaaaaaaaaaaaagaaagcgacaaaactagtaaaactacggatgctcttgacacaatcatggacgaaaacgacaccgattgatcgagccactttaaatctagtacaaaccggccggatctagagcttattagacaaagaacgcataattactttttatagtatactactattactaataatatctacggtaggggtacatttacacgttgacgtacgctgacgctgaccggcgcgtgcagacaacgggaaccgcgggaaggttggcgcggaggcgagcctggagcagtggctgctgcaaccgccgccgctgctgtccggcgagaacaagttcggcgtcaccttcgactgggaggtggagaagcacggcgtgccaggcgccatcatcgtcaagaacaaccacgcctccgagttcttcctcaagaccatcaccctcgacgacgtccccggccacggcaccgtcgtcttcgtcgccaactcatggatctacccgcagtccaagtaccgctacaaccgcgtcttcttctccaacgacgtgagtaccgcgccgcccattattgcaatgttcgtcagcaaaccaaggagcttcagctacctgtctcttgacatgaatcctctacacacgaacagacgtacctgcccagccagatgccggcggcgctgaagccctaccgcgacgacgagctccggaacctgaggggcgacgaccagcaggggccataccaggagcacgaccgcgtctaccgctacgacgtctacaacgacctcggcaaccccgacggcgggaacccgcgcccggtcctcggcggctccaaggaccacccctaccctcgccgcggccgcacgggccggaagccgacgctgacagaccccagcagcgagagcaggctgacgctggtcgacggcgacgtctacgtgccgcgcgacgagcggttcggccacatcaagaactccgacttctacggctacaccatcaaggcgttcgccgacggcctggtgcccatcctccaaggctacttcctcggcctcgagttcaactccttcaaggacatcctgcagctgtacgagggcgggatcaagctgcccgacatccccgcgctcgaggagttccgcaagcagttcccccttcagatggtcaaggacctcatgcccgccggcggcgactacgtcctcaaactccccatgccccaaatcatcaaaggttttaattaataaattgcattcgatcgctgatgaatcatcgttaatttctggcttgggcaaaatgtcccttacatacctgtaaattaatgcagaggacaagaaagcttggatgagtgacgaggagttcgcaagggagacactcgccggcgtgaaccccctgatcatcaggcgtctgacggtgagtggatggactgtggaggcgcgcctagctaattaaacaccatgggcggtcttgcttgatttcagtgtcatggcaaccaagtagtaacattattatcctgcgtcttggatgatcatcaaacaggagtttcctccgaaaagcacccttgatccgagcaagtacggcgaccagacgagcaccatcaccgaggcgcacatcgcggggagcctggagggcctcaccgtgcaggaggcgctggacagcaaccggctctacatcctggaccaccacgaccactacatgccgttcctgatcgaggtcaacagcctggacgacaacttcatctacgccacccggacactcctgttcctgcgcggcaacggcacgctcgcgccggtggccatcgagatgagcctccccgagctcgtccgggacgtcaccgccgcgaagagcacggtgtacacgccggcgccgccgacggccgccggcgcggaggcgtgggtgtggcgcctggccaaggcctacgtcaacgtgaacgactactgctggcaccagggcgtcagccactggctcaacacgcacgccgtcatggagcccttcgtgatcgccaccaaccggcagctcagcgtgacgcaccccgtccacaggctgctgctgccgcactaccgcgacaccatgaacatcaacgcactcgctcgacagaagctcatcaacgccggcggcatcttcgagatgaccgtcttcccgcgcaagtacgccatcgagatcacctccaaagtctacgccacctggaacttcgccgaccaagccctccccgacgacctcatcaaacggtaatcgacgaagcaattaacaataattacggagtaacagttaaatcaacaatcgtcctgtcctgctgcaatgtcaatgcagaggcatggccgttccagatccgtcgagcccgtacaaggtgcggctgctgatcgaggactacccgtacgcgtctgacgggctggccgtctggcacgcgatcgagcagtgggtgacggagtacctgggcatctactaccccaacgacggcgtgctgcaggcggacgtggagctgcaggcatggtggaaggaggcgcgcgaggtcgggcacgccgacctcaaggacgagccatggtggcccaagatggagacggtggcggagctcgtcaaggcctgcaccaccatcatctggatcgcgtcggcgctccacgccgccgtcaacttcgggcagtacccgtactgcgggtaccacccgaaccggccgtcggtgagccggcggccgatgccggtgccaggcaccgacgagtacgcggagctggaggagaacccggagaagttcttcttgcgctccatcaccacgcagttccaggccgtcgtcggcatctcgctgctcgagatcctgtccagccactcctccgacgaggtgtacctcggccagcgcgacaccaaggagtggacgtcggacgccaaggcgcaggaggcgttcaggcggttcggggcgcggctggtcgagatcgagaaacgcgtggaggccatgaacaaggacccacgctacaagaaccgctacagcgaggcccagttcccctacacgctgctcttccccaacacctccgacaagaagggcgacaacgccggcgtcaccgccaagggcatacccaacagcatctccatctga

SEQ ID NO: 2204 - protein, 873 aa, Sorghum bicolor
  misc_feature: Ceres ANNOT ID no. 6016579
  misc_feature: Functional Homolog of  Ceres CLONE ID no. 362993 at SEQ ID NO. 2085
  misc_feature (176)..(851): Pfam Name: Lipoxygenase Pfam Description: Lipoxygenase
  misc_feature (58)..(164): Pfam Name: PLAT Pfam Description: PLAT/LH2 domain
MFGNIGKIPVISDITGSNKNAHLKGNVVLMRKTVLGFDVTSMAGAVIDGVGEFLGRGVTCQLISSTVVDPYNGNRGKVGAEASLEQWLLQPPPLLSGENKFGVTFDWEVEKHGVPGAIIVKNNHASEFFLKTITLDDVPGHGTVVFVANSWIYPQSKYRYNRVFFSNDTYLPSQMPAALKPYRDDELRNLRGDDQQGPYQEHDRVYRYDVYNDLGNPDGGNPRPVLGGSKDHPYPRRGRTGRKPTLTDPSSESRLTLVDGDVYVPRDERFGHIKNSDFYGYTIKAFADGLVPILQGYFLGLEFNSFKDILQLYEGGIKLPDIPALEEFRKQFPLQMVKDLMPAGGDYVLKLPMPQIIKEDKKAWMSDEEFARETLAGVNPLIIRRLTEFPPKSTLDPSKYGDQTSTITEAHIAGSLEGLTVQEALDSNRLYILDHHDHYMPFLIEVNSLDDNFIYATRTLLFLRGNGTLAPVAIEMSLPELVRDVTAAKSTVYTPAPPTAAGAEAWVWRLAKAYVNVNDYCWHQGVSHWLNTHAVMEPFVIATNRQLSVTHPVHRLLLPHYRDTMNINALARQKLINAGGIFEMTVFPRKYAIEITSKVYATWNFADQALPDDLIKRGMAVPDPSSPYKVRLLIEDYPYASDGLAVWHAIEQWVTEYLGIYYPNDGVLQADVELQAWWKEAREVGHADLKDEPWWPKMETVAELVKACTTIIWIASALHAAVNFGQYPYCGYHPNRPSVSRRPMPVPGTDEYAELEENPEKFFLRSITTQFQAVVGISLLEILSSHSSDEVYLGQRDTKEWTSDAKAQEAFRRFGARLVEIEKRVEAMNKDPRYKNRYSEAQFPYTLLFPNTSDKKGDNAGVTAKGIPNSISI

SEQ ID NO: 2205 - DNA, 4146 bp, Sorghum bicolor
  misc_feature: Ceres ANNOT ID no. 6016718
  misc_feature: Encodes the peptide sequence at SEQ ID NO. 2206
atggcaaaagaactatggctcacaattggtagtttaaaggtctgctcttgatgttagcaacaaggaaaatggtaaaacatgaagaatgcgtgaattttctctctctcaagatctgttgacacttgaatgaattaatataagaagggaagcaacacaaatacaagaggcagttcgtgccaggagcacgatctgcattacatgaggctttcagattactctgaggtctgagctacgcgccacccctgaattgtttcttctgtaactgcctagcctccttacatacatggctgcatgaagcctcagcctttacattgcaacctttactgcatgcattcagtttgtgagtctgaatctgaactgaaacaaacaggctttcattttggttccaagtgaaacgtggtgttctgatctgcagcgaatggggccatggctagtttgttacaggttttagcagctctcacagggctgcagagtagcttgggacggcgcacaaacaggctttatttagtagtaaatatttggagtacaatctgttggatcccaagattcttagtactgagaactgaaactcaaatattttttcttctctttttgaaatgcagtatataggtatagcattgaatttttgtcagccaactgtaatgaaatagtgcagccgaacacagtggttggttgtcacaaggcggcatgccctcaccctcctatctattggattcgttttgttttgagaaatatgcaaacacacacttctcaaaacgaatctaataagtgagagtgagggcatatactctcaagagtaaaataaactttaccttgattgtcaggggcgcttggcactttggcagcgaatgatgtactccttaagttgagatcgcaataattgtacatgctgctaggccaattcaaatttctccaaagcgatgcaacctttttttttaggataacatgacaccatttgaatggaagttgtgcttctagcaggtcttcaaacacgcctaggcatcgcggataaacaacataaggctttgtttggatgttgtcggattcacctcaatccacatgtgttggagtggattgagttggaatttagttcaagtttcacttcaatccaccccaacgcatatagattgatgcgaatccgattacatccaaacaaagcctaagttggaccttgggcccagcataggctgggctgggcgcccaagccctagttgaagaactccgtgacccttttctcattttgctcctcttgtgagctctccggttcaaaaacacaggtggcaaaagccgcaacaatattatggaaaaaaaaacgcccataacgaagggggcagatccccaggtcacgaatcggacggtccagacgatccgtccaccctttaagagcggcccctccccgttattccctctcccccaattcgaccccgccgctaaaccctaaaccccgctccggcgcctcccgctccggctcctactcccagtcggctagggttctgcgcggccgcttcctcgtcggcgcaatggagttctggggtaaccacttcgcacttttcccctcgctactactatcgatcgactgttcttacgcatactaggcggtttttgtttcgcccctgtgttccgtttactattagtagtctccgattgcttttgttctgtgatacccggtccagatgccagtttatgtactgctttatgttacttttggaattgaactgaagttgcgatggagttagattcagctcgttgcgttggctgtaggcatctatcgtacaactagtgttcattttaattggctaaagcactcctgttgaaaagtatgttgtttggatgtcactttctacatttgttctatgaattgcgaactaggatatgtatgagtctgttgtccatgtctacgtggacaggtatcatcgaagttttatttttgccccttcgagaatgattatattctgttgatagatatatcatatatgtacatatatggtacacaatcggtggccactgctgaggctgtctactgacttaaccaaggttggatattgcacatgttacttaattactatcttcatacttggccaatctgttttgtcatgtgtaaaatatatggtcagatttctgtggttccgccagtcagtatgttgcaatttgttagatttctgtggttgtccgccagtcagtatggtgctgtttgttagaaagcttggtgtctgatagccactttttgattgttgatattagcctatcactgttttgtttctggatttattagaaagtgcattaagtagtttttttctttctatttttgtttctttgtttgtgatactaaattaaagagttgtttttattatcatataggtaaagaagtaaagccaggagccacggtttcttgcgaagttggtaatgatttggttatccacctttcacaggtttacacaccttacccctgtaaattttaggtccttttcatttgattcaacattgtaattgcaaatgttatatgggtttttaaggtcccttgctcatttaattctgcattgtaattttaacttttttataccacattgtagttgcaaatgctatgagtttttttaggtcccttggctgatttgattctacattatgtctgatttgatgattttccttaggctgcactgggggaaccaaagaaagcgagtgagaatgtcattgtgtctgtcaaaatcgacgataagaaattagtgcttggaaccttatcggttgagaagcatcctcagatttcatgtgatcttgtctttgataaagattttgagctatcccacaattcaaaaacagctagtgttttcttctgtggctacaagtctcctgttcctcagtttgaatatcctttcttatgatttttcaagattaagatttatgtccttctgattatcaaaatttattattttttaagatttttgtttaaaactaggctctgtttcatggtaactctattttccttaactgccattggttttattcacgtcttattctggtgaagacagttcggatgaagagctagaaactgaccaccaaattccaagaaatggtaagtggttttattttttgtctattgcattataaatttcattatgcataagagtgtacaaaacaagtttcattgcatgtgtcacttattttggttttggttttccaagaaatttctgcggcaaaggttccagtgaagggtggtataaaagttgaatcatcttccagtgatgatgatgatgatgatttcactgatagtgaaatgtctgatgaagatgactccagtgatgaagatgatgtgtcaactggtgatgattctagtgatgattctggttcggaagaacagactcctaccccaaagaaggtctgcactagatagttgtcattttcctctggtgcttattgcagtcatgtctccctctatttattctttttattctttaaattgtagactgatgtagtagttggcaagaagagagccattcaagctgaggcaccttctggtaagaaggcaaagtctgaacaatctgctcagaaaacaggtgagctgctcctttttatgtctttataaagcccaactaatggatgtgtaatgttaacatgtgaagtctaaaccctttttatgttcttgtattgagcacaactaatggatgtgtaaggttaacatgtgatgcttaacttcattttcatttacctaatataaagctcaactaatggatgtgaaatgttaacatgcgaatgtttaactaattgatgtgtaaggttaacatgtgatgtttaactatattttcatttacctaatataaagctcaactaatggatgtgtaacgttaacatgcaaatgtttgactatattttcatttacctaaggtgacaagaaggtctcaactcattctgcaaagcagtctagcaagactccagacaaatctacaaagacccccacagctgacaagaagtcccccaaatctggtagccatgcctgcaagtcatgcaacaagtatgtttattttatagtttttttaggtgaatgattctaatttggtattatatagtttgctaatagtatccttttggaccagatctttcagcagtgcgacaggacttgagtctcatcagaaggcgaagaagcatgaagcctag

SEQ ID NO: 2206 - protein, 277 aa, Sorghum bicolor
  misc_feature: Ceres ANNOT ID no. 6016718
  misc_feature: Functional Homolog of  Ceres CLONE ID no. 15990 at SEQ ID NO. 524
MAKELWLTIGSLKYIGKEVKPGATVSCEVGNDLVIHLSQAALGEPKKASENVIVSVKIDDKKLVLGTLSVEKHPQISCDLVFDKDFELSHNSKTASVFFCGYKSPVPQFDSDEELETDHQIPRNEISAAKVPVKGGIKVESSSSDDDDDDFTDSEMSDEDDSSDEDDVSTGDDSSDDSGSEEQTPTPKKTDVVVGKKRAIQAEAPSGKKAKSEQSAQKTGDKKVSTHSAKQSSKTPDKSTKTPTADKKSPKSGSHACKSCNNATGLESHQKAKKHEA

SEQ ID NO: 2207 - DNA, 2150 bp, Sorghum bicolor
  misc_feature: Ceres ANNOT ID no. 6016768
  misc_feature: Encodes the peptide sequence at SEQ ID NO. 2208
atgaactgtgggccgcccgaccagctgccgccggcgtcggcgccggcgtgcttcctcaacctcaactgggaccagtccatggccgccgccacggccggcgaccacctcgacccggcgctcagctcgatggtctcctccccggcgtccaactcgacggccgccgcggcgactgacggcctcgctctccacgggatctcgccacagccgcagtacggaggcacccctctcagctcgccccccaagctcaacctctccatgatgggccagttccaccactacccgccgccgcaggtcggtggcgctgcgcccagcggcctgccaatcctcgagaacttgatgccgatggctcatctagaccagttcctcgccgacccaggcttcgccgagcgcgcggcgaggctctccggctttgacggccgccccggtggaagtggctatggcggcgccgtcccgggacagtttggcctcccggacgctgaccccatcgacgcattgaaggagctggagctcgggaacggccgggacgagtcatcggtgtccgatccggcgtccgccagcgcggagatggcgctcaaggggccttccgatggcaatgcaaagaaacgcaaggctagcggaaaggggaaaggcaaggacggccccgggtccaccgccgccaaggatctcgcgaaggtacgtgcacaattgcgttgctttggttccccgattcccccacgcagttcaggtttggggcaaaagatttcattctgggggcgttttacaggaggaatccggtgggaagcggtgcaaatcggcggacgagagcaatggcgcggaggacaactccaccaagggcaaggccgcgcagagcaatagcgagaatggtggaaagaagcaggggaaggacagcacatcgaagcctcccgagccgcccaaggactacatccatgtccgggcgaggcgcggtgaggcgacagacagccacagcctcgcggagagggtacggttccttgaggctcaattgcattgttctttctgctatcatccttgctggctgtagatttgtgtgttgagtttttctcgcttcttgtgaacaattcaggtgagaagggaaaagatcagccagcggatgaagctgctgcaggatcttgttccgggttgcaataaggtactcactcagcggatgaaactgcatcaggcacttgctgtcactcgagtagtttggtgtgctcagatttgaatttgggaaatgtttctcgtttcaggtggttggcaaggcagtcatgctcgatgaaatcataaactacgtgcagtccttgcaacggcaagtcgaggtatatttccactgtcaattcacagctggaatgactctgaaactgcagtttttttgccgttttagaatggaacaagggtcgatgtgctctatctgaaccctttcccttcacatcgattttgcagtttctgtccatgaaattggccactgtgaatccccagctggacttcaacaacctgcctaacctccttcctaaagatgtgaggacacgcatatatgatcgttcacattactatgtttggttcctggtattgagggaatggagcatttcaccctgtctcatattccaattctgtttgtaatcagatacaccagtcctgtggcccgctgcagaactcgcatttcccgctggagacctcaggtgcaccgctgccataccttaaccagcctcaccaggggaaccctctaggttgcagcctaaccggcatggacagccagagttctatgcacccacttgacccggcattttgccggccaatgaattcgcaacatcctttcctcaacggtgttagtgatgctgcatctcaggtaatgcaaccactgtcctggctcttaagcttagatcatattcgtatgcagtgacactgaggatgaaacgtggatatgtcacaggtcgggactttctggcaagacgaccttcaaagcgtagttcacatggatatcgggcaaagtcaggagatcgctcccacctcttcgaatagctacaacggtatgaaaaaaatcagcgtcctatcggctgatagcttagttgacaaacatcgctatatattgagctctgacatcgaattaccactcaccaggttcactgcaaacagtccacatgaaaatggagctttga

SEQ ID NO: 2208 - protein, 479 aa, Sorghum bicolor
  misc_feature: Ceres ANNOT ID no. 6016768
  misc_feature: Functional Homolog of  Ceres CLONE ID no. 98716 at SEQ ID NO. 1163
  misc_feature (287)..(337): Pfam Name: HLH Pfam Description: Helix-loop-helix DNA-binding domain
MNCGPPDQLPPASAPACFLNLNWDQSMAAATAGDHLDPALSSMVSSPASNSTAAAATDGLALHGISPQPQYGGTPLSSPPKLNLSMMGQFHHYPPPQVGGAAPSGLPILENLMPMAHLDQFLADPGFAERAARLSGFDGRPGGSGYGGAVPGQFGLPDADPIDALKELELGNGRDESSVSDPASASAEMALKGPSDGNAKKRKASGKGKGKDGPGSTAAKDLAKEESGGKRCKSADESNGAEDNSTKGKAAQSNSENGGKKQGKDSTSKPPEPPKDYIHVRARRGEATDSHSLAERVRREKISQRMKLLQDLVPGCNKVVGKAVMLDEIINYVQSLQRQVEFLSMKLATVNPQLDFNNLPNLLPKDIHQSCGPLQNSHFPLETSGAPLPYLNQPHQGNPLGCSLTGMDSQSSMHPLDPAFCRPMNSQHPFLNGVSDAASQVGTFWQDDLQSVVHMDIGQSQEIAPTSSNSYNVHMKMEL

SEQ ID NO: 2209 - DNA, 3663 bp, Sorghum bicolor
  misc_feature: Ceres ANNOT ID no. 6017514
  misc_feature: Encodes the peptide sequence at SEQ ID NO. 2210
atggcttccgccaaggagacctatcgcgccgagctccgcgccgccgcccgccagcttggagagcgctgcctctactccgccgctaaatggtatgccccacgtcaaagctccttcttcaaaccctaaacccccgaaccctaacaatcccctcccttttccgcagggccgccgagctgctcgtcggtgtagagccggatgcggccccggtcccgtcggccgtgatggacaccccttcctcctcgtccgcgacctccgcggggcggctattgcacctgcaccgtagtgggggttccagcttccgccaccgcccccgccccgctggcggcggcactagctcggaggccgggacccctctcggtggcgtgtcgtacgtcagcacgcccatccccgacgacgatgcgttcgattcgggcggcgacaagtacctgctggccaagacctatttcgactgtcgggagtaccgccgcgctgcgcatgtgctgcagaagcaggtcgggcgtaaggctgtgttcctgcgatgctacgcgctctacatggtgagataggatcggcttcttactggctgtgtttattttctcgctgcatctgcgagttttcagatctgggatagggtgagtggtgtttggtgaaatgcctcagtagagctgctgcattgtaggtgagatttggttaggtatgggactgcctatggtttaattgatacttctttatcttttattttggtggatcgacatgttttagtggctcagaagtctgtttagttactttcatgtgagaatggagtggttactaaaatctggtttactgtgattttacctaaaagactgaacagaactggattgcaggactaacgagtaacaagagctgttccaacttgtaatggtccaatttatgggttctgtatagtgctttgtgctcatgtactttaagcgaatagaatggtttgacatttgtaaaagctctggccatgtattccacattacacatagctattggtttgctatttaagtatttattgataagttgttagctctgtgaaccaatgatagctctatggccatgtattccacactagtagggaagttgcgctgtgatgatagaatttgatggatatattacgggcttgtttggcacagctcaacttcactagtaaagctgtttttttagaaaatagcttcatgagtgactttctagatgaagctgagctgttttggaaaaagtgtttggcaaaatagcttcaccaactacttcatgcatagttgagagagagatatgagggagaagctgcaataagctacttttttccagcttcatcccaacttatgtctttgtgagaggaggggaaaaatagcttcacccatgaagctgttttggaaataagtgtttggcaaaaaaaaacagctcacaacagctcatgaagctgttgtgagctgtaccaaacaggccctacattcaagaagttataattatgatggcttaaaactaagtccctttaaatgattggcaatttctattcaatgctgatacttgtacacgaaagttatgtcctgccataaaatctggctacgccacttgtaagttgtaactactaagtgaatattattcgcatttgttctagagcaataacatttttccatgtcaaaataatcctctgccagcattaaaagtttaaaaccctttctgctggctggtaatatttgtttaatgtgaagaattgtaacatttacaagctaaaactccattaaaagtccttgctttagtttttagtgtcaagttgtttgttttactgattgtgcatttgttgggattgtaagggtagtagtatttgtgacattgtctgcaaattttcatataatccgttattctgctaaaggatttatgtgtgcaatttaatgtgccttccttcccttgtccaccgactatatgaaagttcgctaatgcccccaagttttccacttggtccatagtttaactaatgatctatttgctctgctattttaggctggagagaagcggaaagaggcagagatgatagagcttgaaggatcgttgggcaagagtaatgctgttaatcaggaactaattgctttggagaaagagctctcaacacataaaagaactggatctattgattcgtttggactctacttgtatggcattgttctacgtgataaaggatgtgaaggtctagctagaacgatcttggtagaatctgtcaatagctatccttggaactggagtgcttggtcagagttacaatctttatgtaccagcagtgacattttaaacaagttaaatctgaagaatcactggatgaaagacttctttcttgctagtgcatatttggaactaaagatgcatgaagaagctcttaaaagatatgaacgcttgatgggggtcttccgctgcagtggttacattcaggctcaaattgcaacagttcagtacagtatgagggaccttgatgaagctgagatgattttcgaagatctgctcaggactgatccttttcgtgtggattctatggatatttactcaaatttactatatgcaaaagaaagcttgactgctttgagtttccttgcgcacagagtatttttgacagataaataccgcccagaatcttgctgcataattgcaaattactacagtctgaagggtcagcatgagaaatcagttttgtactttcaaagggcactaaagcttaatcgaaagtacctctcagcttggaccctgatggggcatgagtatgttgaactgaagaatactcctgctgcaattgatgcctacagaagagctgttgatattaatcctagagatttccgtgcttggtatggtcttggtcaaatctatgagatgatggggatgccgttttatgcacttcattacttccggaaatcgtcatacttgcaacccaatgatgctcgtctctggattgccatggctcagtgttacgaaagtgatccacttcaaatgattgaagaagccatcaagtgctatgagagagctgcagatagcaatgacactgaaggaatagcacttcaccaactagcaaaattgcatggaatgctggggcaatctgaggaagctgcgttctactacaagaaggatttagagagaatggaggttgaggaaaggcaaggccagaatgttgttgaagctctgctgttccttgctaagtataacaagagcataggcaagtttgaggaagcagaggactattgtacaaggcttttggattacactggcccagtaagttctttttatatattattttctgaaaagagtgaactaagtgaacatagaaaaccaaatttctacacggaaattagctaacaatgagttaatgttgagtataatcaattgttgaaaccaacacgaacctaattattttcagcaacacaagataactccattaacatttagtactacaaggtttacaagtgaaagaaaggcatctaatgaaactgtccactgataatcatctctccttgcattaattcccagaatcccatgattctggttacatgtcaccactgcttttgtatgctgatatgcattcaatatgtgcaggagaaggagactgctaaaaatctgttgcaagggataaaaaggttacagtcaggatttccatcaatgaatactgatcattttgcactgtaa

SEQ ID NO: 2210 - protein, 600 aa, Sorghum bicolor
  misc_feature: Ceres ANNOT ID no. 6017514
  misc_feature: Functional Homolog of  Ceres CLONE ID no. 5398 at SEQ ID NO. 1897
  misc_feature (1)..(182): Pfam Name: APC8 Pfam Description: Anaphase promoting complex subunit 8 / Cdc23
  misc_feature (394)..(427): Pfam Name: TPR_1 Pfam Description: Tetratricopeptide repeat
  misc_feature (428)..(461): Pfam Name: TPR_2 Pfam Description: Tetratricopeptide repeat
MASAKETYRAELRAAARQLGERCLYSAAKWAAELLVGVEPDAAPVPSAVMDTPSSSSATSAGRLLHLHRSGGSSFRHRPRPAGGGTSSEAGTPLGGVSYVSTPIPDDDAFDSGGDKYLLAKTYFDCREYRRAAHVLQKQVGRKAVFLRCYALYMAGEKRKEAEMIELEGSLGKSNAVNQELIALEKELSTHKRTGSIDSFGLYLYGIVLRDKGCEGLARTILVESVNSYPWNWSAWSELQSLCTSSDILNKLNLKNHWMKDFFLASAYLELKMHEEALKRYERLMGVFRCSGYIQAQIATVQYSMRDLDEAEMIFEDLLRTDPFRVDSMDIYSNLLYAKESLTALSFLAHRVFLTDKYRPESCCIIANYYSLKGQHEKSVLYFQRALKLNRKYLSAWTLMGHEYVELKNTPAAIDAYRRAVDINPRDFRAWYGLGQIYEMMGMPFYALHYFRKSSYLQPNDARLWIAMAQCYESDPLQMIEEAIKCYERAADSNDTEGIALHQLAKLHGMLGQSEEAAFYYKKDLERMEVEERQGQNVVEALLFLAKYNKSIGKFEEAEDYCTRLLDYTGPEKETAKNLLQGIKRLQSGFPSMNTDHFAL

SEQ ID NO: 2211 - DNA, 3663 bp, Sorghum bicolor; identical to SEQ ID NO: 2209
  misc_feature: Ceres ANNOT ID no. 6017514
  misc_feature: Encodes the peptide sequence at SEQ ID NO. 2212

SEQ ID NO: 2212 - protein, 600 aa, Sorghum bicolor; identical to SEQ ID NO: 2210
  misc_feature: Ceres ANNOT ID no. 6017514
  misc_feature: Functional Homolog of  Ceres CLONE ID no. 539801 at SEQ ID NO. 964
  misc_feature (1)..(182): Pfam Name: APC8 Pfam Description: Anaphase promoting complex subunit 8 / Cdc23
  misc_feature (394)..(427): Pfam Name: TPR_1 Pfam Description: Tetratricopeptide repeat
  misc_feature (428)..(461): Pfam Name: TPR_2 Pfam Description: Tetratricopeptide repeat

SEQ ID NO: 2213 - DNA, 795 bp, Sorghum bicolor
  misc_feature: Ceres ANNOT ID no. 6017518
  misc_feature: Encodes the peptide sequence at SEQ ID NO. 2214
atgagcttgcttgtgactgccagcttcgcacagtgttcatcgcccaccatggaagaagagcgagcactgtccccggtgtccgacgcctgcaccacctgcagcagctccggcgccggtactaccggccccaactcccctgtctcttcgtcgtcgcagtctttggatgacaccagcggcggcggctcgagcagccggaagcggccgcgccgggagctcaagcacccaacgtaccgcggcgtccgcatgcgcgcgtggggcaagtgggtgtccgagatccgggagccccgcaagaagtcccgcatctggctgggcaccttcgacacccccgagatggccgcgcgcgcgcacgacgtcgccgcgctcgccatcaagggccgcgccgcgcacctcaacttcccggagatgtcccacgagctgccccgcgcggcatcggcggcgcccgaggacgtgcgtgccgcggcggcgctcgcggccgcgatggacaggagggagagcgtggcgccgctgcccacgtctagcgattctagccacggcgcccgcaatgacgaaagtgaagagccggccgcatctagctcctccggcaacgacgccgacgacagtgtccagagcgatgagccggctgcgccgccgtctgagcattcgatgctggtggacgggcacatccttgatctcgcgctcttcgagctgccggacgttctactcgagttcggcttcgcgctgccgccaccgccgtcgtcgacgtcttgtggctacgatttgtcctgggacgagccgttgctgctctgggagcactga

SEQ ID NO: 2214 - protein, 264 aa, Sorghum bicolor
  misc_feature: Ceres ANNOT ID no. 6017518
  misc_feature: Functional Homolog of  Ceres CLONE ID no. 31044 at SEQ ID NO. 680
  misc_feature (75)..(126): Pfam Name: AP2 Pfam Description: AP2 domain
MSLLVTASFAQCSSPTMEEERALSPVSDACTTCSSSGAGTTGPNSPVSSSSQSLDDTSGGGSSSRKRPRRELKHPTYRGVRMRAWGKWVSEIREPRKKSRIWLGTFDTPEMAARAHDVAALAIKGRAAHLNFPEMSHELPRAASAAPEDVRAAAALAAAMDRRESVAPLPTSSDSSHGARNDESEEPAASSSSGNDADDSVQSDEPAAPPSEHSMLVDGHILDLALFELPDVLLEFGFALPPPPSSTSCGYDLSWDEPLLLWEH

SEQ ID NO: 2215 - DNA, 705 bp, Sorghum bicolor
  misc_feature: Ceres ANNOT ID no. 6017519
  misc_feature: Encodes the peptide sequence at SEQ ID NO. 2216
atggccatggacgactcgtcctccggctccgagcccgagcccacctcgtcgtcctccgtggaggctcccgcgtccccgaccgcgtcgtcctccgactccgcctccgccgcgggcagcgacagcaagaagcggcggcgcaccaaggacgggcaccacccgacgtaccgcggcgtgcgcatgcgggcctggggcaagtgggtgtcggagatccgggagccccgcaagaagtcgcgcatctggctcggcaccttcgccaccgccgagatggcggcgcgcgcccacgacgtggccgcgctgcgattcaagggccgcgccgcgcacctcaacttcccggagctcgcgggcgagctcccgcgcccggccaccgccgcgcccaaggacgtccaggccgccgccgcgctcgccgccgccgcggacttcccggcaacgcccgccaatgcagccggcgccgacgacgactgtggcccggacgccagcgccgcctccgacgacgtctccgcctccgcctcgccaccgccggcaacgacgctggacaaccccgacgacgcgctgttcgacctccccgacctcctcctcgacctcagacacggggcctcgtcgtgccagctgctctcgtgcgcgccgtcgtggtacgacgacgtgtgcttctccggcgccgccgccggtgcgttccgcctggaggagccgctgctgtgggagtactga

SEQ ID NO: 2216 - protein, 234 aa, Sorghum bicolor
  misc_feature: Ceres ANNOT ID no. 6017519
  misc_feature: Functional Homolog of  Ceres CLONE ID no. 31044 at SEQ ID NO. 680
  misc_feature (53)..(104): Pfam Name: AP2 Pfam Description: AP2 domain
MAMDDSSSGSEPEPTSSSSVEAPASPTASSSDSASAAGSDSKKRRRTKDGHHPTYRGVRMRAWGKWVSEIREPRKKSRIWLGTFATAEMAARAHDVAALRFKGRAAHLNFPELAGELPRPATAAPKDVQAAAALAAAADFPATPANAAGADDDCGPDASAASDDVSASASPPPATTLDNPDDALFDLPDLLLDLRHGASSCQLLSCAPSWYDDVCFSGAAAGAFRLEEPLLWEY

SEQ ID NO: 2217 - DNA, 3253 bp, Sorghum bicolor
  misc_feature: Ceres ANNOT ID no. 6018481
  misc_feature: Encodes the peptide sequence at SEQ ID NO. 2218
atgtcatcctctttgcctattctgccaaatcctttgaaagggagcttcccaaagccttgtaacccccagcatattcctatgtcgaggcagctgcctgatgactctatgcccttgcgtaatgacatacatcagtctgctagtttgcacccaagagctggtgttatcggggcaccatattcaggctactctgctagtccacttgattctgtgtctaaccatgatagccagtcaatggttgcaccctatatttctcagtcatccagttttgagtctttccagtctctatctgatactaccccaggaacacacactgaggcagcctggttcacatcttctatggatgtttcaccactctacacagataatattgctgctcctgatgataatcaaatccagagtatacgtcctgctatgacatctgatgagactgctaaacaaaatgattggtgggcagatataatgaatgatgattggaaagttattctagacgcaacagctactgattcacactcaaaagtacgcaactgcagaaccataatgagtagtaaacttgtagctccatcttctgttttggtagtttagaaatactctcttctttattattatgacatttattttgatactaaacctactggtatgtttgtgcaaatattttatgtattttagtcattgaaactgaagatttttttgttttgcacatattgctgtgacatacatctgcaaatgaaggttcccttactccttatgagaagttgagaagccctaatattgtgcaagtaatttggtctagctccagtttttagttgtttaagatgtcttattgaattggcggtgaagatagcagaaatgattcccaacatatttcaatttaataatgttattgtacatattagattgaccactggaggtaccatgttagaatcttttaagaacttttcatgttattaatgctaaatggttaccgctggaaaattaaagtgctgttgccgcttctcctctttgctacaacataggcatcagttgtctgtttttaagatagtcgtaggcttgtagccctgtaatttctgtgacactagctgtaatgacttatgtttcttttatgactgttactcccttctgttataggccatgattcaaacttccaactcagctacatcactacctgcagtaaaccagtcagcttcatctcatagtatggagatttgcccagttgctagtcctcccaatagcagcaatgcttcagttgctaaacaacggatgagatggaccccagaactccatgaatgttttgtagatgctgtaaatcagcttggcggtagcgaaagtatgtctgccctgttgacattttccctcaaatagtttaagttatgaaccctatacatcatttaatgcatgtgttcttttctcttattcctattcagaagctactcccaagggcgtgctaaagcttatgaaagttgatggtttgactatatatcatgtcaaaagccacctgcaggtttgctgtttagctttctaagtagtatccatgcccaaaggagaccttttcattttcttatctgaactaatttgtgttgcagaagtaccgcacagctcgctataaaccagacctgtctgaaggtttatctcgcttggactcttcccaacctatgttctttgtgttgtggattacattttgcatggcaaacgtctaggggtcatgaagctttcatcttatttatttgtgtcatgttaaccatgtcgtgtggaattctgtgttgcagacagcatgcgtgtagcaatatcaaaataactgtgaattgttagtgttaaacttaacatattacacttctgtaactgattatgcaggtgcatcggaaaaaaggacagccactgaagagctagtcctggacctgaaaacgtgagtgaataattaccgtatgtaatccctaatttcactttatggtgtgctatttttctcatttggtggtggtaactggtatcatgttgctgtgtgatacattgcttttactttgtatccgacatatggtatatgtaagtgcataacaaaatctatgtatctcgaaaagccaaaacgtcttatagtttggaattgagtgagtatgaattaaagaaaattattctttgtacatctcttgaaatgatggcagagtattaaagtatcgtctttgccatttggattgctagttacttgccaatttatgcatgtctaattggatgatagtggtttttaggaatatgctttgctttttgttcataatgttactaaagtgtgtcttggcatgtaaggtttgctgccctagaattgatctatttccacactgttctaaattgacacatttgcattatttaccatgcatttaagaattttgagggctatgaattgcctacaagccgtttcaaatctactgtattcttgaagggcctttttgcaatagaaatgcttttacaaattacaatcatggtctgagatttaacaagtaatacatactccagcatagatcatgccctgagtgtagatgcattagtcaacaccctcttgtagttctggaattgtcatgatgcgtattgagcctattgcattcactttttttgaaaaaaaaactaattttgaggttttcctatatgttaaagtgcatcatgccatcatctttgttggttacttcttggaatactttcatgatactagacattcttgtataggagcatggatcttactgaagcgctgcgccttcagatggaagtccagaagcgtcttcatgaacagcttgaggtactatttctaaatttagttggtgttgattccataagtgtttttttttctcttaacatgatgcagcatgtgcccaacatatagctaatgaagctcactttatcctaacacgatatatatattcctatattgcagattcagagaaaattgcagttgcggattgaagagcaaggaaagtatctgcagatgatgtttgaaaagcagagtcaatcaagcacggataaagtccaggatccatcctcaagggatacagtggcaaaaccatcatctaccctgagccaatcttcaaacaaggatagtggtgcaaccatggatccaaatggaacaggagacagcacgaagactgcaaaactgggagaacgatcgtctggatcaggtgtcaaccagaaacttgtagagatcgaatctgatactgaaggaggtacagacgatggatgtaagatctcccaagagaagcggcacaaactgcaagatagttaa

SEQ ID NO: 2218 - protein, 432 aa, Sorghum bicolor
  misc_feature: Ceres ANNOT ID no. 6018481
  misc_feature: Functional Homolog of  Ceres CLONE ID no. 231109 at SEQ ID NO. 599
  misc_feature (216)..(267): Pfam Name: Myb_DNA-binding Pfam Description: Myb-like DNA-binding domain
MSSSLPILPNPLKGSFPKPCNPQHIPMSRQLPDDSMPLRNDIHQSASLHPRAGVIGAPYSGYSASPLDSVSNHDSQSMVAPYISQSSSFESFQSLSDTTPGTHTEAAWFTSSMDVSPLYTDNIAAPDDNQIQSIRPAMTSDETAKQNDWWADIMNDDWKVILDATATDSHSKAMIQTSNSATSLPAVNQSASSHSMEICPVASPPNSSNASVAKQRMRWTPELHECFVDAVNQLGGSEKATPKGVLKLMKVDGLTIYHVKSHLQKYRTARYKPDLSEGASEKRTATEELVLDLKTSMDLTEALRLQMEVQKRLHEQLEIQRKLQLRIEEQGKYLQMMFEKQSQSSTDKVQDPSSRDTVAKPSSTLSQSSNKDSGATMDPNGTGDSTKTAKLGERSSGSGVNQKLVEIESDTEGGTDDGCKISQEKRHKLQDS

SEQ ID NO: 2219 - DNA, 4285 bp, Sorghum bicolor
  misc_feature: Ceres ANNOT ID no. 6020292
  misc_feature: Encodes the peptide sequence at SEQ ID NO. 2220
atgtcccaccacgacggaagcaagccgtaccagccgcgccgggggcccgagcggcacccgcagccggcggacgggatggccgccccgcctcccgccgccgttggcccgtcggtggagcacctcgtggcggccgccgccgaggcggaggcgttgaaccgcttcgccgtggaaccacaggtgcacgagcaggaggttggggaggaagaagaggaggacgaggaggaagacgagatggaggaggaggaggacgagcaggaaggccagcacggtggcatcggtggggagcacgttcccatggacgcggatgctgctgccgcggcggctgcggccgccggcgcgcagatggacccgcactcggcgatggtgcctgggaccgtgccacccatggcgaccaaccagctcaccctgtcgttccagggcgaggtctatgtgttcgactccgtctcccctgataaggtacctctcctggttgctttatatagatgtgaacttgttttctctctgcctgtagtcaatgcaattcgctggactgatgagagttgttggttttgtctgtaggtccaagccgtgcttttgctgcttggagggagggagctgagcagcctgggcggagcgtcatcctctgcaccttatagtaaggttaggataaagtgatgttgaatcttatgtataatgcctatgagttatgtccgctggaatggatggttcacatgcatgtatttgctcttctccttgcagaggttgaattttccacatcgggtggcgtcactaatgagatttagggaaaaacggaaggagcggaactttgataagaagatccggtacactgttcggaaggaagttgcgcttaggttggtgatcgctgtttaactttggctgggtactctatgagtactatctgaagtgccattaattttgttttgtcggtactcgataaacatgattgtgagggaaacaaaggatttgtccttttgtatgacatcctattccccttgaaaccgagtacatctcttgtgcacatttgttcaactgtaagtagtccctagtgggaagatgcacgtcctaactccatggcattttccaagttattctgattggaatacatcggttttttgtcagttctgttttttatgtattattttttagtagtgcatattgtttggtagtcattaggtcgaatcatgagtggttgtatgttttagtttcaccagttatcatgtatatcatacagctgattaactagttttcatcatttcttaatcagtctgtcaagtagtttttggttgcgtagcaggtttgtccatttatgctctttcaatggttgtggatattgctgtggtgtttcttggtctatatatttaaggttatgtgttatgttggatgttgcaaattgcaattgaatcctgctatacagtcctcttcatagaaggttattatatttgcaggatgcagcggaatagaggtcagtttacatcttcaaaaccaaagcctgatgaaatagcagcatcagaaatggcagctgtagatggctccccgaattgggcgttagttgaaggccgacctccatctgctgccgagtaagttacagaagtgtttccagtttgcttgtggtttcaaggtgtttgacttaggcagcaatgttttgagatgcttaaaagatgctattgcagattttcttattatttcattgtagatgccatgaactttagatctttgtttgttctctggaacaattaccggaaagacgtacagatctgagatataatataaaaaattcataaactctgctgtgactatacatcttgctggttgacgccatagtatgatagtacctctatacttctcatctagcagcacatagaatgttcatttgttagtcacatgatatgcctctaaaatcttagcaatcaaatattgtggtgttagtagctgttcaaatcttttttgttttgcttcctagattaccatgcacaacagtcatgattctccaggtttgctggttctggtggttagatgggcctctaccgcacagactatggatggtttaagattagcttcattctggtttaggcatgatttggttagtcaaacttcaaactgttgtgcaacattacaaacaagtttgctaaaagaaagaaacatttgttggcacctagcatgcattgacacatgcttctttcgaaaggttcttgttttgttgatattacgttttcatgttgcatgtgttggagttccttttaaatgttttggaagtaataaaaatatcatttctgaattgttccgacgtccaattctttcagatgtcatcattgtggtactaatgcaacagctacgccaatgatgcgtcgtggacctgatggaccaagaacactatgcaatgcctgcggcctcatgtgggcaaataaggtatttgcgattgcttagcacttagtagtacaattatgactctagattttagtactcattgaaactttaaacttatttagttatatcttagaatatgtaatggaccaagaggcacgtgtgaataagaaattcatgtgccagaaccttgacccaggctattggcctcccttttagattgccccaacatgcttgggaaggcagttgctgttttcgtaaactataaaatggacccaacataacatgtaaccactgtcttagtattagatttcttccacacacacaaaaaaaaaaacttgcttcgtcctttgccttgggtgcttacatgacaatcacgatacacagaatttagctgaccctgtaatttacagaacactacacatctatctttgtttatattgtaccactgtagtctgtaatctgtactcatgcactcttctggtggagctgcactctttcttctgtctgcttctgttttatcttttctgtttttcattatgattgcattagagaaaataccttgcaatgtggaaccttattgtttttatcccatctactcctttaagactaaggaacttatgtttgttttattagtctgttcacgtaaattttgacgaagtattatgtaaccgcaagtaaatctagggttgatcgtctattcacgtctttatagggtctcctgagggacctatcaaaatctcctgtaccacttcaagttatgcaatcagctccacttctagatggtggtgtaagtttttcttttctctgttctttgcatatgtttctacctaaagcttcatggggatcctgtttgctttagacttatcctataagttgtaagtgaaaaatctttggctcagattagttgattccttatctaattatttgtctagcaatgcaccttacatgatctctgtcctagttttggtatccaattctaacaaatggatctgagatctttttaacattgtcaagtacagtagttgcatgccttttccatctatccttttctctcttagacttaaaacttaaactgaaaaaatatttttattcctccactaaacaagagttattgttaatctctttccattacttctggtgaattgttatatctttgcttgcacttgagactagcacaaagtgatagggttcgagaaaattccttatttgacacccaaaaaacttgctgttctaatttagcacccaaacattaaatcttccttatctggcaccctttgaaattttggttcccaaactgacactactgtgagcagaggcactcaacggtattaagttgcattgtgagaggacaatttttgcccctccaagtattccttttttttcgatttttttttcctgagcacttgaacagtcatgcacgctgttcaattgctcagaaaactatttgccaaaaaaaaagctggaacacttagaagcgcaaaaatgtcctctcacagtgcaacctaacaccgttaagtgcctcaactcacagtagtgtcagtttggggacaaaaatttcaaacggtgccagctaagatttgaagtttgaatgctaaattgtggaaaacaaattttttggatgtcaaataaggaattttcttggttcgagaaaatcatagtattttagggacggtataagatggattatcttatcaacctcttccaatttctctttcacagcttccattactttctcctgtcttccttgtttatttcgataaactgtatgcctttgtattctgaataattaactggttgaaacttaattgctgtctacttttttcagcagaatggaaatgtcatgtctgcgcctggctctgagctagagaatgctgcagctgccatgaccaatggccacgagtcatcaagtagtggtgtttaa

SEQ ID NO: 2220 - protein, 351 aa, Sorghum bicolor
  misc_feature: Ceres ANNOT ID no. 6020292
  misc_feature: Functional Homolog of  Ceres CLONE ID no. 20769 at SEQ ID NO. 1469
  misc_feature (127)..(162): Pfam Name: tify Pfam Description:
  misc_feature (186)..(230): Pfam Name: CCT Pfam Description: CCT motif
  misc_feature (262)..(299): Pfam Name: GATA Pfam Description: GATA zinc finger
MSHHDGSKPYQPRRGPERHPQPADGMAAPPPAAVGPSVEHLVAAAAEAEALNRFAVEPQVHEQEVGEEEEEDEEEDEMEEEEDEQEGQHGGIGGEHVPMDADAAAAAAAAAGAQMDPHSAMVPGTVPPMATNQLTLSFQGEVYVFDSVSPDKVQAVLLLLGGRELSSLGGASSSAPYSKRLNFPHRVASLMRFREKRKERNFDKKIRYTVRKEVALRMQRNRGQFTSSKPKPDEIAASEMAAVDGSPNWALVEGRPPSAAECHHCGTNATATPMMRRGPDGPRTLCNACGLMWANKGLLRDLSKSPVPLQVMQSAPLLDGGNGNVMSAPGSELENAAAAMTNGHESSSSGV

SEQ ID NO: 2221 - DNA, 4501 bp, Sorghum bicolor
  misc_feature: Ceres ANNOT ID no. 6023650
  misc_feature: Encodes the peptide sequence at SEQ ID NO. 2222
atggtgatccccttccccctcgtcgccgtcgctgttccattcgtgtttgtgatttattttttcttcttctcgtacggtgattccgttgatctccgcactgacgctttgatgctcgctctatgtcttcgcaggctgattccccgcgcaggaggtaactacgccggcctccctattcgtatatgggcgtcgtaatcctcggccgttggccacccctgatctagccccagtggtgttgacttatgggatttcagcttaattccctagtggtgttgatttcattggggtagtatgggaaaagtgaggatccatacagagaatgtaaaaatgatatgtgggagggaatgtgtgattgtgatttctgttgttttatttgtcatgttttgagttaataatgaatagtgaggcttgctgtattttgcttcttgtgcttatgtgggcaatggtagctatatgcttagacttgtgcatcttaagggctcctgggttatcaaatatggatgcttctgcttgcctgtatgagttttttctctactaataaccccctttgtcctaaaggttttggtgtagcctcctaataaacctttaatgaccagaaactgtgatatttgtcgtgaatactgcgtttgaatctggcacaacttgcttactatctagagtttgcacgtttgtaatctttgtcttggaatcaggttaggtttctgtttgaatcggtcatgtgcatgtttagtgtagcctcatacacctttggccagaaacaatggtgtttgtcatgctggcacaacctgctttttctatccaaagtgtgcatggtctaatacctttgaccaaattgttaatacacttaatagcttaaccggttagtgtctggttctacatattattatatagacatgtctcattgtatctacaaagtcaggttaattttggagatatattccatgaacataagtgctaaggttctcctttcattccttttgttatgttatattgttctacctatttgtcagaggtgccctcaaacaagtgctattcgtgtctggcttgaatttgctagctcccgaaggtgttagtttgtcgttgcacacaactagaatattagttctggtgctttatcttagggtacctttgttttgacttttgaggaatagtttggtcctaggatttcctaggatttgtctatccatcatctggtcattcaaaaaaaaaattaggcaatgaatccattcttatgtttcatcttcttacgaggtatagtctttgaaacttggtccattactcagttgaggacaaccctttccttgagaaaggttgccttctaggtcatatacactgtagtcactcattgcttacagaaactgaagcaacatcaaatggtttgttaatggtttcaaatcaatgctggaaggcacctctgtgtttttgtggagaaagtatcctctaaggtgttattgctgccttattgagagttatcagtagagttagatttagtcgatttattcagataattcatggcatgtctatgttcatgatgaatgataaggcaagaagcatttggtctagaacacactttatgaaatttgcattttcctgtccttttatatcttgctcatggtcctaattcctgctgcaactatcagagtcttactgtaaactttgtgtttgttttaaaagtattattaggttggctgccaattttaattatgactatgatttatatgtgtttaactatgactatgatttatatgtggtgcctatcgtatttcagtgtttctctgtaatagtgtcctatcagtacttcagtagacatgtgatatcatgtgaagtttgaaaactgtgtacataaataaagttgttttgcatgctaatttagattttcaactgctcattctattcccatcttctgccagaacactttatcgcaactccaagggttgtttaatactttaatgtttaatgcatgcctgtggcaaattttttatttgtaggtactcgaggtccccttcatacagcagggggcacccaaaagcgaggtcaagatcacaatctccagctcggtctcagtctaggtcgcctgtgcctgatcctagatctcaggccaggtcaaggtctagaagccatgagaggttctcagtttactcctttcctttgtttgctaaagctacatgtgctttaaaagtttgctactcatgtggtttaaattgtttgctttggtgtgttgcttatatttgtatgaattttccttttatcactagaaaagttgaatgtatatggtaattgtatcgctggagttaagtgatgttcatgttgtaatagcatgtgtcgatgtgggctgagagtaaaaaaaaacgttctgcacctgttgttatagctgttcagtatagttcttttaagtatttaaacatggcatctttgatatacatccattttgctattcatctagatacaataatatgtctagatacatagcaaaatggatgaatgaaaaaagtcatagtgacttataacagagggagtatatttgttgtgaatcggagggagtatatttgttgtgatagttgaaagtcatatgcaatgtatttgacttgcaaacttcatatagtgagtacaaggaattttgttgctttggtgagaatgatttgcaacaaccgatgtgtgatggaccaatgtaatatggtaatagtagctgcaattggaaaggaaaattcactgatgaagtagataacaggttttgcttatgtaataatgtttttatagtttggatggcatgtaaatttttatggtgtagactagtaaaagagatacagtaggagaaaagagaggcgaaaacattgttttttacttcaatgagccacctaaatattgcatgccatttagttttacatttgcttatacttctttatctgcaatggccacattctgatttctttcctgtttgcagggaggaggatgctgttaaccgtggaaatactctgtatgtgactgggctctcttccagggtgactgaaagggatgttaaagattatttctctaagcatggaaaggttagtgacttcaaacagagttaagtctaatctatctgtgaagtatctcatcgtgacatctcttttggactaggtggttggttgccatgttgttcttgaaccccatacacgtgtttcccgtggatttgcctttgtcaccatggacactgttgaagaagctgagcgttgcatcaagtatctcaatgattctgtaatggaaggtcgaaacatcacagttgagaaggtaattttgtttacctccaccagggttgttgacgctaaataaagtgcaaccatatatgtgcagagtgttgacctggaagttttttttggttattattcagaagatattgtgcaagctgtgtccagcaatcaagatgctgagttcaccaattccaactttagctcatatggctcgatcagtggacagcccaaagggttaccatgcaccacaagattcacaacaacttaacatagcaatttttcaactaaacctgagcattcaccttcaacttccacatcaactaatcaacgggcattgccaactcgttagtcaagcatgtgtggtgccatgtgcgatagcaactttggatgcctgctagttgaagtttgggctcttcgttacttatttcctcccttggtccgttattgcagggcgtgtatccattgattgtaagaggaacttgtaattacttgcatggtcctgaatgatactacttttaatcttattattaccattccttgtaatcagactaaagtttctctttccattgtttcagtcacgccgtggtcgcccaagaacaccaactcctggaagctatcttggtatgcaagcagcattattggttctgtagataccaattcattttattttacatctttttgaatcctttctgtttatttctctgtttccctttttacttttgccatgacatgtcttatcttatcacttattgcttggtgactcatctggaaccttttcttttgcttttactgtatagaaacatatgttgcagttatcctacaccttgataccgttgacaggccatcagtactgctcactacttatgcagttatcctacactttgatacccttgacaggccatcggtacgagcgcagagagcgcgggagattccgtagaggctatggtggtgggcgtgatgagtattacggtaatggcggtgggcatgggtaccgcaggtctccgccacccatgtactcttcctacagggagagtcgggattattacccctcctacagggacagcagggactaccctccctacagggacagccgggactactctcctccccacagggaccctcgggactactacgaaagcaggggtggccgtggctactcgccgcctccttacggcggtggtaggtcaaggagggagcgatcgatttcgccgtatcggatgccagaaaggggctatggtggaggccgccgggcgggcggcggtggctacgacaggtaa

SEQ ID NO: 2222 - protein, 279 aa, Sorghum bicolor
  misc_feature: Ceres ANNOT ID no. 6023650
  misc_feature: Functional Homolog of  Ceres CLONE ID no. 32754 at SEQ ID NO. 698
  misc_feature (65)..(136): Pfam Name: RRM_1 Pfam Description: RNA recognition motif. (a.k.a. RRM, RBD, or RNP domain)
MADSPRRRYSRSPSYSRGHPKARSRSQSPARSQSRSPVPDPRSQARSRSRSHEREEDAVNRGNTLYVTGLSSRVTERDVKDYFSKHGKVVGCHVVLEPHTRVSRGFAFVTMDTVEEAERCIKYLNDSVMEGRNITVEKSRRGRPRTPTPGSYLGHRYERRERGRFRRGYGGGRDEYYGNGGGHGYRRSPPPMYSSYRESRDYYPSYRDSRDYPPYRDSRDYSPPHRDPRDYYESRGGRGYSPPPYGGGRSRRERSISPYRMPERGYGGGRRAGGGGYDR

SEQ ID NO: 2223 - DNA, 1234 bp, Sorghum bicolor
  misc_feature: Ceres ANNOT ID no. 6023739
  misc_feature: Encodes the peptide sequence at SEQ ID NO. 2224
atgaagggggccaaatccaagggcgccgccaaggccgatgccaagtaagaataacgaatctcgccgtttccttcttccttccttgttcgtcgcctagatctgttccgtggtgtcccaaccattcgatttatgttgttgttgttgttgttgttgttgttgttgttgttgttgttgttgttgttgttatatatatgcgacgccgtgacatgcgtttgacttttttttttttcgttgccctgtctctgtcgccgttggcgattggtttctgcaggctggcggtgaagagcaagggtgcggagaagcccgccaagggcaggaaggggaaggccggcaaggaccccaacaagcccaagagggctcccagcgctttcttcgtcttcatgtgagatgcgactttttttttattcccccagtttttcattgctgtttctggaactgcggttcgatctgtttttggatggatgtgtatgcagggaggaattccgcaaggagttcaaggagaagaaccctaagaacaagtctgtcgctgcggtaagttcccccaacgaatcaaatcacccactactactttatgaccgaccgatagtactatctaactttgactttgtgattaaccactttatttaatttatttactcgcctcgattcgtagtttacttaaccttttttaccccctctttcctgttggaacttttcaggtgggaaaagctgccggtgacaggtggaaatccctcagcgaatcggtaagcaaagcttgctccacacattacacctaaataataatagtagtagtagtagtagtagtagtagtagtagtagtagtagtagtagtagtagtggttagattcgactaaaagcttgtgctgtttggttaacgtacgtgtgtttgtggattgtaggacaaggctccctatgtagccaaggctaataagctcaagctagagtataacaaggccattgctgcctacaacaagggcgaggtaggaaaacttgcatacttcaattgctttgttacttatgtatatactgttctagctggttatttattcgaataagtaatgggcatactcaatgaatcatgtgttggcttgttcagagcaccgctgctgctaagaaggctcctgccaaggaggaggaggaggaagacgaagaggagtctgacaagtccaagtcggaggtcaatgatgaggatgacgacgagggtagcgatgaggtatacaaatttctttcatga

SEQ ID NO: 2224 - protein, 158 aa, Sorghum bicolor
  misc_feature: Ceres ANNOT ID no. 6023739
  misc_feature: Functional Homolog of  Ceres CLONE ID no. 31322 at SEQ ID NO. 689
  misc_feature (41)..(110): Pfam Name: HMG_box Pfam Description: HMG (high mobility group) box
MKGAKSKGAAKADAKLAVKSKGAEKPAKGRKGKAGKDPNKPKRAPSAFFVFMEEFRKEFKEKNPKNKSVAAVGKAAGDRWKSLSESDKAPYVAKANKLKLEYNKAIAAYNKGESTAAAKKAPAKEEEEEDEEESDKSKSEVNDEDDDEGSDEVYKFLS

SEQ ID NO: 2225 - DNA, 2916 bp, Sorghum bicolor
  misc_feature: Ceres ANNOT ID no. 6023883
  misc_feature: Encodes the peptide sequence at SEQ ID NO. 2226
atggcgctgcagctccagctgccgcggccgctcgccgccgcccggccctccgccctcctcccttcccgggaccatggcgcctccgcttccgcgaccgcccttcacgctcgcgccggcggcgtcgcgttctcgctccagaccaacgtgcgcctcctcaagcccaaccgccgcgtccgccgctcccgggacccctactacgacctagacgaggacgatgaggaggaggcggagttcgacgaagaggatgacgacgaaggttacgagagcgatgtaagttagccccattgccaatttgctagtagctactcctcacttatcatcgtccccataggtttgcttgatgggacacctgatctctgccacccttggatcatatcatcgtatcaatgccatattaataatagcaattgaacaagacgtttgctatttgcgtttcgcatgtggagcacaattggctttcaaatacacagttcgcaccgtgagctgaacgagctaaacgggtgtccttgtataggcacgcaacgaaccatgatggaagagttaccttaaatctagtgacctgtaaggtttagcctaccattttgcaacttatgtgattcgacttataggattggaactactgactttgtaatgttcgcgttctcctgcagtttccttctaacatgtttctctggtgtaaaattgtttgtattcattattggtgccctctctgtttccccaagctgcgccatattgtgaatacaaggaactaagtagtgtggcgtgattgatcattagcatttggtcggtgttcctcagaatcagcatcaacagattatggcttctaagtatgaagctgcataaatggcagattgcctcccaatcccagtgacccatattgcaaacactatattcttcagaagacatttgaatatggagcgagagtgcctcccttcatttgctttcggtaaaagtcaggttacctctgttaaaaaaacatctcctgcagtgtgacggaacactataatggctcaaaggattagcttaggttttaactgaatgcccgtaactgatcagcaccacatttttactgaatatcagtccaacatagtccatatgtgtatattaaaaaagagagagagattgtatgcatgcattatgaatgtagtactttccgttgtgttccagtaatgactgcatgagatgcatatgtttcactgagcaccccaataaaattagatctttgaattctgagttcgaattacatgacaggcaaatgttgaacatggaaaaacattgtgtttttatatcctgttgtttatttgtccatggaacgtaacattggaatcttatcattagttattttcatctatatctactatcctaactttatgcttggtttccttttcaggatgacatgtcgggtttggaatatcctggtgtactttattcaaacagccctcgtgcttcaagcaagagacaaggtatcttaagaactatgctaaatctatttagaaacagtggttacttggtacttaaactctaattctccagaattggaacctccactggtaaaagaaaactgggaaggaagacaacccaaaactcgtgataactacggcagtccaggaaaaagtaagtccctgtatcctaggagtaaagtgggacgatcatcaatggatcttaagaacatggatagtgaagttgaggtaaattactcagcatgtaaatgtaacctgtccatattgatttcggggtgcactgagttaacgttgtttgttgttgcagttgaaaaatgcaagtatctctcgaagtctgttccagaaactacaagaagattatgactttgatgacaaatggttaccgctgattgattacttgtgcacatttggactaaaggagtctcattttacttacatctatgagagacacatggcctgctttcaaatcagtcaggcttcagcagaagaaaggttggatttcctgctaagtgctggggttaaaagcaaggatatgaagaggatactggtcaggcagccacagattctggaatacacccttggcaatctgaaatcccatgttgattttctcgtaagcattggagttccgaatacacgaataggacaaattatttctgctgctccttcgatgttctcttacagtgtggagcactctctgaagccaacagtaaggtatctgattgaggaagttggtattgaggagagtgatgttgggaaagtagtgcagctaagcccacagattctggtgcagaaaattgatagtgcatggaaatctcgatcgcttttcctgacaaaagaactgggcgctcccaaagatagcatagttaagatggtcacaaaacaccctcagctgcttcactacagcattgaggatggaatcttacctcgaataaatttcctgagaagcattggtatgagaaacactgacattctcaaagtattgacaagtcttactcaggtattattacttcactcatgtctttgttccctattatttctattcttgctttcctttttcagttatgttcgttattcattgaacatgtgtctcatggtatatgtactgttgcacattccatgtcaggtgctatctttgtcattggaggaaaatctcaagccaaagtatctttacttggtcaatgaactcaagaatgaggttcaatccttaacgaaatatcctatgtatctgagcttgtctcttgatcagaggatccgtccccgccaccgttttctggtttcattgaagaaagctccaaagggtccatttcctctgagctcctttgtgcccacagatgagcgtttttgccagaggtgggctgggactagcttggagacataccatacattcagacagaggttgctgctaacaggttttgcagagaagtctggaaggaaaacactagtctcaagacggtag

SEQ ID NO: 2226 - protein, 506 aa, Sorghum bicolor
  misc_feature: Ceres ANNOT ID no. 6023883
  misc_feature: Functional Homolog of  Ceres CLONE ID no. 325679 at SEQ ID NO. 695
  misc_feature (370)..(471): Pfam Name: mTERF Pfam Description: mTERF
MALQLQLPRPLAAARPSALLPSRDHGASASATALHARAGGVAFSLQTNVRLLKPNRRVRRSRDPYYDLDEDDEEEAEFDEEDDDEGYESDDDMSGLEYPGVLYSNSPRASSKRQELEPPLVKENWEGRQPKTRDNYGSPGKSKSLYPRSKVGRSSMDLKNMDSEVELKNASISRSLFQKLQEDYDFDDKWLPLIDYLCTFGLKESHFTYIYERHMACFQISQASAEERLDFLLSAGVKSKDMKRILVRQPQILEYTLGNLKSHVDFLVSIGVPNTRIGQIISAAPSMFSYSVEHSLKPTVRYLIEEVGIEESDVGKVVQLSPQILVQKIDSAWKSRSLFLTKELGAPKDSIVKMVTKHPQLLHYSIEDGILPRINFLRSIGMRNTDILKVLTSLTQVLSLSLEENLKPKYLYLVNELKNEVQSLTKYPMYLSLSLDQRIRPRHRFLVSLKKAPKGPFPLSSFVPTDERFCQRWAGTSLETYHTFRQRLLLTGFAEKSGRKTLVSRR

SEQ ID NO: 2227 - DNA, 6651 bp, Sorghum bicolor
  misc_feature: Ceres ANNOT ID no. 6025104
  misc_feature: Encodes the peptide sequence at SEQ ID NO. 2228
atggcgcgcgagaggcgggagatacggcggatagagaacgcggcagcgcggcaggtgacctactccaagcgccggcgcgggctgttcaagaaggcggaggagctcgcggtgctctgcgacgccgacgtcgcgctcgtcgtcttctccgccaccggcaagctctcgcagttcgcgagcaccaggcacgcactctcactagcttggctgcctaccgttgcgcgcgcagctccactccgccgcccatccgacctcgatcacatctgccgtttttcgaaacttctcgccatggcgttttctcgtttggaatgatcgatttgttgcagatctggctcttcttctaccaagtgccaacacggtgcctcttggtgtttcggatccttgcactagctagggtttcgtgctagcttggctagtggctacctacagatttctctctcgtagtcctttctttcatagggtttggcttaattatgagggaattcgttttctcgagtacgatcggtttctacgcgttgtgtggaattgaaatcaagcttccccttgaacacctagagccttcgttgtgtcgattctggtcctgcaaactccctgacgtcccatagaaatggggaattttctacagtatttcccccaaggacccgatcgcaaagctcgcagagtacttttagtcttttacggtgtgtacgtgctgaattgctgataaatatatatatatatatatatagcagattgctgtagctcgtagtacttatatactacatgttgattccgagagcactctagtgtccggataattctctggtccgccgcatgtcctgcggtaaaaacgctgccgatagagctgatcgaactccttggatcagcgcgtggcggttgttgataagctaaacggcgtgctccccgggtcgagagctcatggagcacggccgtacctgtgattttatgtgccggttttgcctcatgcacgagacttgatcattcccgggctgaagcatttcgtgattattcgtgctggtgggataaactattctggacaagtacactgctgcttgtggctggtgctacctccggttattaacccatcatcaggttgtaggtagtagctcttattaccatatattttgctattggtgcgcaagcgaaattttaacatgctattataatataaaaatatgtacggcttagcaatagcaatataaatatgtacggcttagctatagaatgtttgattatgagcgttcgccaatatatattttttgtgcttcagattagaagacgcattcgcctacatgtcacttgcttgattcaataatgttttgtttctatggaactcacattttacatagactaggagaaaattgaacaaaatattagagatactccgagagactctttatatcattcttaatttatagaaatagagaatttagtaaaaaaatgccctcctctttaattggatcaccaaatatagtcatcttctattttagatttttctctaaccagccctgctcacatgatatagaacagctattgttgtccaaaaaagaagatatagaacaactatttgagggtacaaagtaattttactcaaatgactgatgatttagagtaaattttttgaaagactctttgagatgctcttagttaacaagataagcttagtttgaaatttatctatttgtgttttatatgagatggaatgtgctacaaagcatgcagtatgtgctatcgggctctgaaacctagcatctgatcaaggtgcctcgatgtttgctactgtggctctggcataatcaggcatgttagtgagtacactgtgcacaaatctctatgaaaagggttcaatttcatggttgcccttggagcttgtggctctagattctagaaacactacaagaactgcacgttcaatggtggtggggcaccatgggtttaggttgttctgtgagagttgatcgatgaggctaatctctggcatctaacatacacgatggggctcagcccctcaatactctttggttgggatagatcacaatgcttgtttgaatttggtcatcgatctttttcagttctgttgcacattcgccttgctaacttacttctgggtgcaagtgtgtgggtgagatccacccccttacactgtagatatcttttgtgtttagagtgaaaaaaggtatatggtatgtgatttaatcttattttctagctgttctagcttatgtttacctttagtttgataattaatacaggcatgtcactagatccatacatttccatgtccaacactgtatgtgactataatactaaaagactagacagaggctactaatatatatgacaccacaagtgcctctagcttagtgctgaccttagacttggctgcaacatggaatgtttttctcaattcctactggaaccgaattgtttcctattaaacttctgcatttcaagctgactcctgaagatgcttacattgctatattgctctgttttcaaatttcatatcctccttacattctaagcttcctttatatgtcttcattatttacagtttgcttttgcttttgtgacagtatgaatcatatcattgacaagtacagtacacattctaagaatctggggaaatcacatcagcagtctcctattgatttgaatgtatgttatgttagcaatatttttctttcttttttaacttgatcttttcttactagtaggttaatgtgtaaagcattttgacaggaaggacagatgtaaaaaagctagaaatgtatgggaagtctgctagtaggtccgcatatacgacagctacatttttttattgcgcaaatgatttagtatgaactacatttttgtagttccttgtgattaaatcatgcatatgcgtctttggtcaattcttagctgatgcaaattttcatagatcttagtatagagtatcattgatcagattacatgagcattttttttgagtaagtgactacatgagcattgggcatactcaactaaggggagatacattgaatgaataaagattgcaaataaagtactcttttctgtttgatcaattaatcatgagcaatattagtgtctacacttacttttatctaaccatctgtagaaaaatcaatgtttatcttctgagaagggaactgagtgataaatttatcaagctatcattttttccttcaatgtgatatgtcaagggtgaactaaaagtgttttctccatagtaccatatagtactcagtattccttgcaatcttagtgttaatcagtctaggacttcttattctccaagtgtagtttgcatgcactactgtcacgagaattaacaggatgtatatgtataattaatgtttgattttactcatatagtaatcctattttcccttataaattttcagatagagcagagcaagtacactggtttgaacgagcaacttgcagaagcaactcatggacttaggttatgctttgttccatattgatcatgtgattcaaagaatatttgtttgagagaaaagggacccttgaagctaacaaatgactttactgttcgatactgtagacagatgagaggtgaaaaccttgagggattgagtgtcgaggaattgcaccaaatggaaaggaaacttgaagcaggattgcatagagtgcttagtactaaggtacggtgactaatcaaggagttctacatccttcagattcttgtttgagtttgtgtataactgtttttccatacaatgcatctctcttcaggaccagttattcacgcaacaaatcagcgaactacaacaaaaggtgagaaatgattatttaacctgattgcttttgtgaattttatatcagataatatgtactagcaaactattggctttcagtgtacaatatgacattttaattaagttgcttgtctgagatcttgccatttcatctatatgctatttttacatgaaatttgtatcaaaattgaagttgcaagaatcttggaaaattttcccaattcccaggcccgtgggatagaatgttgtttcaagaaataaacgatctcgcgtaattttcttttttttccccatattttatttggaaaatctcatcctgaattttacgagttcagaacttcagattttaaccaacatcctaaaatgatggcctagccagtataagggctagcctggatcaaagcctagatacctgccagctactctggtgatcagcttagattatcccatgttccaggatatctcaatcggacgaactctctctggtgatcagcttagattatcccatgtttccaagtgaccttagtcggacaagctgatcatttttagtggaaccacataaagaggattggtaactgaattagtagaaaaataggtagatcgaaaagagagatgcttgctacataggatatgcatatatagcagtgatatatgggcctatgaaaattgtaaaattaaattcagttgagacatgggtggtaggtcatgtgccaatctcttaagaatggatagtacagtttattaaaaaaacacacattgaccactatggagatgccttctgggcattgcctttagaagctgaccatgatttgaacacagacggacaagaggaggcctcctgagcgtttttttttatttttaacccttttttgaaacaaattctaaatttgacactgaaaatattttttttaaaattaaccccttttggccgcgccatcatgcacggcgcggcattataacactgcggcagaggtggccaccctggcctgctgacgtgtcggccctgccgcgctaccatgtatggcgcggcagggccgaataagaggccgcactcgggcgcgcgagcggcactctatttcggccgcccgagccaccctctccttcccctcctcttcccacccctccccctctctcagcacctttcgcctagcctccttcccttctctccctcctcttctttcagcttcctcgtttttttcgcatcgttgtggagatattcatcttgtctttaattttgaaacaactgctttcttagtatgtagtatttattgtaccttgtgtttgctgaaacaattatttagatgaacgacatgtatcgtgaaaattattgaaacaagcggggtcgttctagagaattaattatacccagacgagtgggccacgtggccacccctgccatgccaccatgcacggcgcggcagtgttgtaatgccgcgccgtgcatgatggcgcggccgttagtttttttaatatatatatatatatatatatatatatatatatatacatagacaaatttggaatttgtttcaaaaaaggggttacaaataaaaaaatcctacacatctctatataaccgatataactcccaagaagctggtgatggcatagtctatcgacgcacacataaaaagcgagcaaatgtatgccaacttttttctaaagttgttatgatgcttgcctaagtagtattatcatttaaaatatttttgaactatgacgaatgttagctggtttggctggcaaagctttggccttgtatgtccatcttagtaggccatccatatatggtgggtactaattctgtaagccttacctaatgctagtctcaatgaggagaaattgactattataggactctaatcgtgtagtttcttcaaaataggatttctgacgttggtttctctgaaataggactccaaatattggtaataagctgtaatgacattttgtgtctttttaatctctttttttatctaaatacatgtatttattcctagagtgacccttttacggtcattagactgtgatggtgggctccattattaggggaaaaaacatcgtagctttctggcccatggcttccgtgttgccttgtccagcttttttttctataaaccgatgccttgctgcttggccatgccgccattattagataaaattggtattgcaactcacggtaatggctctcacagtcccagcaaaccgtacgtatgataaagttgcctatacaaggatatacaatattgctcttctatgataattaatctattcttccatgcaatccatcttccttcacataactatctatatattcttttgggccaaaaatcgtttctatttggaactgatacttcatatttcattgaaatggaggagcatctgcaattcaacaggtttttgtggggatgtttggaagtagagtgtgactttttccctgagtttttcaaatggaattaactgaaacaagtgaatccttcactgtgtatgcgtaaatggaaccaaatacatttaaaatgagtggacgatttaatgatgcaattctgttgtccgtttcttgcagggaacacagctggaagatgagaacaggcgtctaaaagaacaagtaacaaatcatatttctctatatagtgcgcagacttctagtgtatcccctggcagcaaagagcatgtttataattcctttcttatttttataattaagcagatgcctcaggtgttaacagctggcacaatggtggttggtgctggtgcagaaaatatcctcactgaagatggacagtcgtctgaatctgtaatgactgcattgcattcaggaagctcgctcgacaatgatgatggttctgatatatgcttgaagttatcgtga

SEQ ID NO: 2228 - protein, 223 aa, Sorghum bicolor
  misc_feature: Ceres ANNOT ID no. 6025104
  misc_feature: Functional Homolog of  Ceres CLONE ID no. 542773 at SEQ ID NO. 980
  misc_feature (108)..(170): Pfam Name: K-box Pfam Description: K-box region
  misc_feature (9)..(59): Pfam Name: SRF-TF Pfam Description: SRF-type transcription factor (DNA-binding and dimerisation domain)
MARERREIRRIENAAARQVTYSKRRRGLFKKAEELAVLCDADVALVVFSATGKLSQFASTSMNHIIDKYSTHSKNLGKSHQQSPIDLNIEQSKYTGLNEQLAEATHGLRQMRGENLEGLSVEELHQMERKLEAGLHRVLSTKDQLFTQQISELQQKGTQLEDENRRLKEQMPQVLTAGTMVVGAGAENILTEDGQSSESVMTALHSGSSLDNDDGSDICLKLS

SEQ ID NO: 2229 - DNA, 4537 bp, Sorghum bicolor
  misc_feature: Ceres ANNOT ID no. 6025808
  misc_feature: Encodes the peptide sequence at SEQ ID NO. 2230
atgaagatccagtgcaacgcgtgcggggccgcggaggcgcgggtgctgtgctgcgcggacgaggccgcgctctgcgtcgcctgcgacgaggaggtgcacgccgccaacaaactcgccgggaagcaccagcgggtgccgctcctgacggacgccgacgccgctgggaccgccgccgcggcgccggccgtgcccaagtgcgacatctgtcaggtcagtccccgaggaccgagcccttgtctctgctgcccctccctcaattcctgtagctccctccattcctttagctcgattgtgttgggggtttggagaattggatttgtcgcgtagtggctgccactgggaactccggtactgatcgtctgatctcaagctagcgcctagcagggtaggtctcacctgatgatttggcttgcgagaaacatatatgcggctgaagcaaagctgttgtcgatccttccgtctgtagcaaattgccttacctgggcagcttctctgggactctgtttctggagcattggtgcaattgctatatgatatactatgttttaccgatgatctgactggactaggactatagtgagttcaattttagctcccacagttccacaggctttccctatcccagggaagacatcatgatgtgatctgactctggtcctccaggatattgtaattatgaagagactgacttggatgttgtactgatgtgccactcctgaggacccgaagcatcatttctcaacccctttgtttggatttttttttgaagtgacccatgattattacactaaacattgcattaggactagtactgctgtgctgcacgtttatatatgcagagaagtgctagtgttttttcttatttcagtcagcatactccaagctcattcagaaccagttggtttcatttgtggctgttctgctcattagtagcttttattcacattgtacttcaaagggataggttttgctgcagtgtcatagattgttgaattgtggtgatatggctatgctacagcatgtcgcttgtagctggtgtggtgaagaagcagaggcgaaggggcttatgcaactgatctagagttggtcaaagttatctccctgtagccaatggggtttaagctcctgcctctgttaatctgacattggaagatgtaaattgttgattgaaagatttctgcacattatctcattgagagagtactgcaaattatctcttgggacatatttgtacatattagttatataattaaatggatgaacaaggcaatggtgtgctgcttttgcttccttgtggttcaattaatgcttatgtgagttgtggttcaaagatgaaaattatagacttgcagatttggtcatgtacctttattttgggtaaattacatgttttaagaaaacactccaatacttcatttatttatccatccttttgatgctctaaaattatctcttgtcagtttaaacctgcagtaacaacaacagtgccctttattccaagcaagttggggtaggatagagatgaaacataagatgagccaccaacaagaaggaaaaatttctataaatataaaagtattgaaatgcatcaataatagcaaggagaataataaatgttggctagagttgatcatactgtcctgcgtggacccaggtatgagcatgcttgcttctccatactgcctgggttactgaccatgtgcatgcacatgcaatctcagtttgcatttccagccttgttttgatgaaatggataagcatccaatctagtgttcccttataaagtgtgcactagaaatggcccaagccttgagggtagctttgttaaactacagtgcaacttttactggaatgacacttatgtttaaatgccaatagtgaagatcattccaaatgcatgcatatataagctttctcttcatttggtcatatattcttcaaatatgattgcttaccattttatgaaggcctgaaacattagaaagttgcatagctaattgtactacaggctatgtaaaatggtacatttaaccagagtgaaccacaataggctttacattgcacttgtacaagttttctctttttcagcagcacctagtttaccgcaggtggaagaaataggtaatcttcaagacaaaagacaagatcactacacaatacacgcacagacgcactagctcaagctcatgtgtgttgcatcccacagcgtcacacacatgtttacttgcacaagttcatgaaaagacgcagttacatgcacatgtgcacttcctaccttgaggaagctaaagtgaatcaccatgtgttttctctaattgcaatacatgccctatcattttttttgtaacctgtcacatttgctgattttgaaaacctggtaattgcgtcaaccatcaagttgtaaatttactaattccagtccatgtatagtgacatcattattgtatcaacctaagttgcaagtagtgtaaacagataaatgtagttgcctggtgtgcttctgcaagttgcacttgttttgcttcactggttgctagacgagaacccttgtttgggcactaagggcacctgtagtgctgttgggtacttgggtgtgccttctgtttatactcctcagtgttttacttatgaggatcaaatcaccatatggacgatgagtcaactatattttacattttgagtttgttgagctattgtccatggacatgctgtatctggatgtggccaactggctgctggggctcaggcggctggcgcaaggagcaaacaagcaacaaccttagcctgagttgctatcattatttgttagttagctactagatccatttgttagtcttatatcctagctgctagtacatggttataaaaggagggcatgtgactatagttggcaggctagaagaatatcaatctattatcctagtccccttctcctacccttacccttgtggtgtggctgccggctatcagcgagatcacgttgctggggttcagggccatctagaccagtgtttatcactgatatacttagctactgagacgcaatttgttttgtatgtactgtattgattcctcctgcaatacatttctcatgtttatccttactgcaggaggcttctggatacttcttctgcctagaggaccgtgcactactttgtagagactgtgatgttgctatacacacagtaaattcctttgtttcagtacaccagagattcctgctaactggagttcaggtgggccttgatcctgctgatccagttccacctattgctgaaaagcatgttaatgccgctggtggatcagtaaatcaaccagtgaaacatctgccaaggagaagcccgacagttcaattttcagttgaaggcagtgcttctgttccaagcaaaaatgtaacaaatggagattattcaaggcagaattctgttccaacagccagggcagaagtggttgattggactatgaacaatagtacaattcgttcagtagaatccccgcctaagtacatgtcagaggaaagtccaacacttctgcaatctagccagaccacaacagccttcaaccaaattaacggcaatagtgatgggccctaccacttgtcattctcaggtggtaatgtgacagacagtctaccagattggcctgtggaagagttcttcagtaactcagaatatggtccaaactttggcttctccgagcatggttcttctaaggcaagttaccatgtatacattttcctttttgcctttctttcttccgtattgttaatagcctactagcttctgtttaactttcaggtcttttagactgctgatgaatataggcaacatttcttgatatggatgttctggttatttcttgcattgttcatggttgcttatgaccttttactatgatgaaaattcagattgttgctgtaaacatgtttaagagcttagagtgacattctttctggcatctacatgaataaaattaatgcataagattattcaggttgaaaattaatctgatctttttgttaactagctgatggtgaactagagtttcaggtttgtgctgttgtagtgctaggtttagtgactgttactctttgcaatagtgtaggctatgtggactgtgacatgatgatgatcaggatttcattttagtgtggcatcttatttgttcattcacttgaaatacctaaaaggcggactattgaataccatctctctctttacagggtgataatgctaagctggggaatgctggtggttctccacaatgccgtttagctgaaggctccgttgctgaggaactattagggcaggtgcctggattgatcacagatgaatatatgagccgagtacctgagaattcatggacagtacctgaggttccctcgccaccaacagcctcggggctcaattggcatgggaatttgtgtttccctgcatatgacagcaccatgtttgttcctgaaattacctccctccagacctcccaaaatcagttcgccgtaccttccagtttcaagcgccggagaagagagtattga

SEQ ID NO: 2230 - protein, 375 aa, Sorghum bicolor
  misc_feature: Ceres ANNOT ID no. 6025808
  misc_feature: Functional Homolog of  Ceres CLONE ID no. 112194 at SEQ ID NO. 370
  misc_feature (61)..(108): Pfam Name: zf-B_box Pfam Description: B-box zinc finger
MKIQCNACGAAEARVLCCADEAALCVACDEEVHAANKLAGKHQRVPLLTDADAAGTAAAAPAVPKCDICQEASGYFFCLEDRALLCRDCDVAIHTVNSFVSVHQRFLLTGVQVGLDPADPVPPIAEKHVNAAGGSVNQPVKHLPRRSPTVQFSVEGSASVPSKNVTNGDYSRQNSVPTARAEVVDWTMNNSTIRSVESPPKYMSEESPTLLQSSQTTTAFNQINGNSDGPYHLSFSGGNVTDSLPDWPVEEFFSNSEYGPNFGFSEHGSSKGDNAKLGNAGGSPQCRLAEGSVAEELLGQVPGLITDEYMSRVPENSWTVPEVPSPPTASGLNWHGNLCFPAYDSTMFVPEITSLQTSQNQFAVPSSFKRRRREY

SEQ ID NO: 2231 - DNA, 2867 bp, Sorghum bicolor
  misc_feature: Ceres ANNOT ID no. 6026295
  misc_feature: Encodes the peptide sequence at SEQ ID NO. 2232
atggcggcgacggcggcggaggttcccgtggaggcgccggtgagtgctgctgctgttgctgttgcatcctccctccttccctctctgatccctcttccggtagtcggtggcgcgctggatccggagcgggagagcgcggggcaccgtggcgctagcgcccgtgagattattgtcttgaacgagtagatagatagactaggctcaatcgctcccgcccaccccgagttacggtctgggctgagttccttgctgtcctgcctgcgggagaagcttgatgcagcgagcaagcttcgctgccgattcggtggggctagggtttgtttggatctgggcgtggctggagcgtaggtagcttgctcgtatagtcgcactgcccactgcgcgggagcatatatgctcgcgtcgcgtgcttcgcatatcgacatcacatcggggactcgtaggttagcttgcccaacgttgtgggatccgtccagaggatttgctgcaagtagtcttactactatatatgctactttacatcacagttgaatgatttgtgacatgttcttgaccttgctttgactctagcagtctagctatcagcctgtgcaattgtgaatgacaagatactaagtgctgcggtatatgtccaggggattgattgctgcaagtacgctagtaccatactagttgataccataccatactagttgatacccacgaactgtttgttgcatgttctagagtttgatttgactatcaggttctgcaattgcggaagcattctgacaagagactagaccatttgctattcactttgactggcaaggtatctgtgccttagagttgttaaaaaatgtcagtgggctcatgagcttacaagtgtttcaatgtagtatttattaaggttgctgctatgatagagaaaatgtttttgtgtttttaatgcttctcatctgattttcacatgcctggttatggtttacatgcatgcgaatgagaaaggtcaagttatgtcagtcgataggttgaaggaaatactatccactgatttccgcaattgtcctgtcccttgcttcataaatcataatattcttcagtatgtacttcttgcaaaactcatattgacgtcccatttattgcaggtgaggacagtgaaggtcaccaatgtctctcttagtgcaactgtgcaagacattaaggagttcttttccttttcaggagatattgaacatgtggagatgcagaggttcgtaaaacctgtccaactaggttgccccttctcttttcatgtccatacaagcctttgattgtcatcctcattagcttgttctctttaattttgcagtggtgatgagtggtctcaagttgcatatgtcacattcaaagatgcacaaggcgcagaaactgcacttcttctatcggttagtacctgtaggccttagtatgatccagtggagttcttacaatacttggctataattgatcaccatagcgctaccgctagtgtacccctgtgcttgggaccaaaaaatgtggttcttgtattagagctatgactaaatgctttacctgaatagaatgtttgtggatctctttagcagaatttgcaaattgcaaggaatttgctgaccttgcaacattgtgttgtgttcgtgctcctagaaaaataacatcaatttatgattgtcacagggtgccacaatagttgatctttctgtcattattgcgcctgctccagagtatcagccaccccctacgtactctgcgccaccaatggtatgatatgcctctattttttatgctcaacttgcccgcatccaatttcttacatgatgttgtatcctgaactgaacatggtacacaattatacatgcattttatatgtgacgagactgagtttttctttaatttcatggatgcaacatcactgtagttttgctatctgtaagtgtcattggcatacatctgcttcttaacttcaaatcaaatcagtaggtcaaatggatgtttatctgtgttttagttggcaagcagacctgtgcatttttgtttaaattccatggtcagtcttctgttaagtaattttcaaagggcacccttgtcaaactgtaatggtgaactgcacgtgtctatctatttgacatccagttatgtttttgcaacacctttgagaattatctagtaaggttttcatgcaccagagaccataagcttttgtcattgtcactccagaattgcatttgtgttgtcaaaagcattccttgtgttatatagtagtcaaataggaacaactccagtatgtttgttttctttaaaaaaaataataaaaaaaaatccacaagtaacttgtactgaacattatcttctgttgtcagagtggaaccagagttgcagttggtggagacaacaccgttgtccacaaggctgaggatgttgtcagctctatgcttgccaagggtttcgtgctaggcaaagacgctgttggcaaggccaaagcgttcgatgagaagcacggcttcacttccacggccggtgctaaggtagcctccattgacaagaagattgggctgagtgataagatcaccacgggcacatccttggtcactgggaaggtgaaggagatggaccagaagttccaggtctctgacaagaccaagtcagcattcgccgccgccgagcagaaggtgagcagcgccgggtctgccatcatgaagaacagatacgtcttcaccggcgcgtcgtgggtcactggcgcattcaacaaggtcgccaaggctgccacggacgtcgggacgatgaccaaggagaagatggcagctgaggagcagcagaagggctctggcccttcctctgggggccactcgtacacgcccatccgatga

SEQ ID NO: 2232 - protein, 291 aa, Sorghum bicolor
  misc_feature: Ceres ANNOT ID no. 6026295
  misc_feature: Functional Homolog of  Ceres CLONE ID no. 280814 at SEQ ID NO. 1866
  misc_feature (39)..(107): Pfam Name: RRM_1 Pfam Description: RNA recognition motif. (a.k.a. RRM, RBD, or RNP domain)
MAATAAEVPVEAPVLQLRKHSDKRLDHLLFTLTGKVRTVKVTNVSLSATVQDIKEFFSFSGDIEHVEMQSGDEWSQVAYVTFKDAQGAETALLLSGATIVDLSVIIAPAPEYQPPPTYSAPPMSGTRVAVGGDNTVVHKAEDVVSSMLAKGFVLGKDAVGKAKAFDEKHGFTSTAGAKVASIDKKIGLSDKITTGTSLVTGKVKEMDQKFQVSDKTKSAFAAAEQKVSSAGSAIMKNRYVFTGASWVTGAFNKVAKAATDVGTMTKEKMAAEEQQKGSGPSSGGHSYTPIR

SEQ ID NO: 2233 - DNA, 765 bp, Sorghum bicolor
  misc_feature: Ceres ANNOT ID no. 6026758
  misc_feature: Encodes the peptide sequence at SEQ ID NO. 2234
atggagcacgagcaggtggtgtcgcctcaggtgtcagagggctgctgcacctgcagcagcagcagctttagcaacaccaccaccaccagcggcggcggcggctccctgaacgcgtcgtcgccgagctccagcgacgactccggcggcggtggcaacaagggcacgaagcggccgcggagggacctgaagcacccgacgtaccgcggcgtgcgcatgcggacctggggcaagtgggtgtccgagatccgggagccccgcaagaagtcgcgcatctggctcggcacgttcgacaacccggagatggcggcccgcgcgcacgacgccgccgccgtcgccatcaagggccgagccgcgcacctcaactttcccgacctggcacacgagctgccacgcgccgcgtcggcggcgcccaaggacgtgcaggccgccgccgcgctcgccgcggccactgtggtggtggcggcttcacccgccgtcgtcccgtcctcctgcggccacgacgatgccgacgccgagacggaggacctgccgccgcctgagcgggcaatgccggaatgcgagagtgtgaatcaagctcagcttgagcagctgggtggcgacattgacagtggactggggtttacgttcttggacgtgccagacgctcttctagacttcgggcacatgttgtcgccgctgccgcttccgtcttactgtggctcgccgtgggatgacatcgccgatgacctctgcttcgaggagccattgctgctttgggaacactga

SEQ ID NO: 2234 - protein, 254 aa, Sorghum bicolor
  misc_feature: Ceres ANNOT ID no. 6026758
  misc_feature: Functional Homolog of  Ceres CLONE ID no. 31044 at SEQ ID NO. 680
  misc_feature (65)..(116): Pfam Name: AP2 Pfam Description: AP2 domain
MEHEQVVSPQVSEGCCTCSSSSFSNTTTTSGGGGSLNASSPSSSDDSGGGGNKGTKRPRRDLKHPTYRGVRMRTWGKWVSEIREPRKKSRIWLGTFDNPEMAARAHDAAAVAIKGRAAHLNFPDLAHELPRAASAAPKDVQAAAALAAATVVVAASPAVVPSSCGHDDADAETEDLPPPERAMPECESVNQAQLEQLGGDIDSGLGFTFLDVPDALLDFGHMLSPLPLPSYCGSPWDDIADDLCFEEPLLLWEH

SEQ ID NO: 2235 - DNA, 4384 bp, Sorghum bicolor
  misc_feature: Ceres ANNOT ID no. 6029526
  misc_feature: Encodes the peptide sequence at SEQ ID NO. 2236
atgagccgacgcaacagccgtaccatctatgtaggcaatctccctggggacatccgtgagagggaggttgaggatctcttctacaaggtgggttgcaattgttttacatgtatacctttgtctgacttttcatttcgaaagcaagtgtcagattggtcagggcgtatgctaattcctgctcagtcaataaaattttctgtctcagcaagacagcaacttcagtatcctattaatgtgagaatgtagtatggagctgaatgtttacattttttatgtactacattaattaattcatccgattccaaaatataagtccatctagtattctcttagatcaccaaatataagtccatcacaacttcgtgacatctattactctcattcttccatgtctacacctgcttaaaggcgcctaatcaatgcagtacacttgttatctaccttaactgtagtaacaattggtggcaacagggtcattgtactccttaccttaatatgtgccaaagtccaaatggactatcagagggagtagaatattatctgaaatttgtttgaggggttgcacaagaattttgtttgagatcaatacatgttttttattgagttatgtcaactaaagaaacgtcatatatgttgttctctttgtctgaagtaaacaataatatctgttttgcaatgacacccgataccttttattttgtctctgcatcacctatgcttttattgaattatgacaatgccttgactttttccccttcaatgtatgattgtgcagtatggtcgtatcttggatatcgacttgaaaatacctccaagacctcctggatacgctttcgttgaggtgaggatatttttctgtggtctgattctgtaagaatagtattcttttatgggggcctgcttttaaatatgcataacttctctattactctgttcagttttaaaacctattttatatcatgctttaatcattcaaatcaaacaaatcaaactgactgataatttgttttgatgtcaccctaacaaaaaatgatgcttttttagtttgaggatccacgtgatgctgatgatgcaatttatggccgtgatgggtataactttgatggctacaggttgcgcgtatgtataacaaacttttatttaatgattctcccagaagagaggactggtttgggttttcttgcatttgctgaaaatgcattttctactcaggttgaattagctcatggtggtagaggtcagtcttattcttatgatcgttcaagcagctatagcagtgcacgccgtggaggtgtttctaggcgctctgatttccgtggttggtacttttgtcatatgagaacgtttccttatagctccttacacagactctcaagtttcatctcctaaatcatgcagttatggtcactggtttaccttcatctgcatcgtggcaagatctgaaggtaatttctttataattcatttattccaggacttttgctggaaagaactcatttactacatttcaggaccacatgcggcgcgccggcgatgtctgtttctctgatgtataccgtgaggctggaggttagttgtttgaactttgaacactcctgaacacattttctgctatttcattgcagcatatggttgtaaacgtaatccctaattttgtaatcatgtttcctaacttattgcttcactgcccctttgaagtatgaaatattcaggctttatcctgaatttctacatattgatgatatctgctccttcttctttcttgtgctgcagaaactattggaattgtggactatacaaattatgacgatatgaaatacgcggtgggtttagcatgtcgtttactcattttcttttaatgtgaacttaaaaccattttctctcatctattactgtgggtctgttttactgttgaagggagtgctctaagtaaattctgttctttcctgtttcatgtgtcatgaactcatgattgtactcatgcattttcctcttgccatcgtgtagattaggaagcttgatgactcacagttcaggaatgcattttcaagggcgtatatcagggtatgtattcttatgtttgccctagtttagttttggaaattgttacaatgcctcagatcatgtctatttgattacgagttatgttgattcttgttctattgtaggtgagggagtatgatgccagatcacgaagcagaagccgtagccggtcgtactctagaagccccagttacagcaggagcaggagtccaaagtatgtatacatgctgacaaatttgttatccatgtcttatggcagcactaactattatttgttgttacttagatctctttctcggtcaccctcacctgtggatgaaaggtatgtgaatctatgtcaataagaaatgtacatttgtgaaactgaaagtgctaatattgtttaaagaaaacggattgacaaataaatggtgaaaccaatcagatcttgtcctgaatcatctttaacgtattctgcagtacacctatggtgctaaaaaatattgaaacctgacttgcatgtcatcattttgtggactaacttaacgcagggccagggaggatgtcacaactgataggagagtgccacattaacttaattatttcctactatctgatatactcttgtcaaacaaaccaaatgcccgagctgagagactgccttgtacatacttctgcaaatgcagacctgaatttttgagcatgtgctctacctatccttatagaacatgttgaaggtttggctctatcacaaacttctagataaatctttcaatgttgtagcagcctagcagggagtattggatccttcagaagcatgccaaattgagagggtatagaaagatgtattaccagaattttacattctttcaaaacaatagtcttgtcaccttttcctgccgtaccagtcatctccatagcatggcagaacctcttcgtttctttttcctcatggaaaagcttcagtcctctccttaattatcaacttcatacatctttaacctagagctccttttttctgagtttaacaacaaacttttcctgctttatattttaaagtagaaaaaggactctacagataaaactcacatatatttgcctcagattttaataaacaatatttcaaaataaaatattttttctgctttttgttaaagcaataagaagaaacaaagtttggtgccagaatttttttttcgcgaacaggtcgtaacctgttggtgccagaaatttaacttgatatactttggaacgcctcctgaaatcacctgtgatatgtttttctgtgtaccgatttctctttaagttagcataacttttgtgatgtactaatctctctttaaataagtgtgacttgaatttgctctgtagttcaatgattaaacatacagagcttgctggctaacctccactgttcaaggtttgcttttgtttttcctagatttggccatgcggcgatctggggactgcattgatataatattggatgttttgagaattggagtggatggtttgggactttggatagtagagctggattgtgatgcatgtatgacaagtgggccacgaccagtcctaggagcaagataggactgacagtaagaaaatgtgaagtgaatcttgtggtgttattaaaacaaatgtctactattaagttcaatgactccgtataaatgaaccttaatttataagtttgtgtttttgtctaacaatgctgccatcttagtaaaaattcctatggtgccttctgcatatggctctttgtagccattttcttgtcaaggttcacacactagccaaagaagttgacattaacaacaaaattcaatatacaccttgctttgtttgcttatttgcattccagttatgacctaattaccttataggcttaaaaactatattattctcggagtattaagcataaacaccagaatgttgcagcttccctcctgtttcagttcattcattcatctgctgtggaacgttgcctctttatgcacatctcaagttgccagtttagctttaattgcaattttgtatcgcagattagagtgctactaatgcatcattaagtaatggaatttgtttctggtaccttttgcagatcgctatcaagatctcgatccccagtttcttctgtaagtatcccaagctcattataaccaagcttgtcataattgtcttgttcaatgcaattgatttttaactcttttgcagccttctcatgccagatctgcgagcagaagcacatcccgttctcggtctcctgtaattgcaagcttccaaaacaatcacttattatgttgctaggaactttcatgcttatttagtatgttgttgctggcaggtgagatccgattga

SEQ ID NO: 2236 - protein, 256 aa, Sorghum bicolor
  misc_feature: Ceres ANNOT ID no. 6029526
  misc_feature: Functional Homolog of  Ceres CLONE ID no. 7559 at SEQ ID NO. 1681
  misc_feature (9)..(77): Pfam Name: RRM_1 Pfam Description: RNA recognition motif. (a.k.a. RRM, RBD, or RNP domain)
MSRRNSRTIYVGNLPGDIREREVEDLFYKYGRILDIDLKIPPRPPGYAFVEFEDPRDADDAIYGRDGYNFDGYRLRVELAHGGRGQSYSYDRSSSYSSARRGGVSRRSDFRVMVTGLPSSASWQDLKDHMRRAGDVCFSDVYREAGETIGIVDYTNYDDMKYAIRKLDDSQFRNAFSRAYIRVREYDARSRSRSRSRSYSRSPSYSRSRSPKSLSRSPSPVDERSLSRSRSPVSSPSHARSASRSTSRSRSPVRSD

SEQ ID NO: 2237 - DNA, 1299 bp, Sorghum bicolor
  misc_feature: Ceres ANNOT ID no. 6030226
  misc_feature: Encodes the peptide sequence at SEQ ID NO. 2238
atggctgcagcgagtatgatcaaggcgccggtcggccagaatccgaggctcgcgtgccacgccccggcgaggggcggaggcgtggtcaggtgttcgttgcagggcgcggtcgtcggcggccgggcggactggcagagcagctgcgccgtgctgtccagcaaggtggccgcgctcgggacgcactccatcaacggccacgtcgcgccggcgccggccccggagccgagccagaacggggcggtgctggatttggtccccgtgactagtatcaccggcggcgccatcaccaaggcgaacctgccgcagccgctccgcatcgcggacctgtccccggctccgatgcacgggtcgcagctgcgcgtggcgtaccagggcgtgcccggcgcgtacagcgagaaggcggccgggaaggcgtacccgggcagcgacgccatcccctgcgaccagttcgaggtggcgttccaggccgtggagctgtggatcgcggaccgcgccgtgctccccgtggagaactcgctgggcggcagcatccaccgcaactacgacctgctgctccgtcaccggctccacatcgtcggtgaggtgcagctccccgtgcaccactgcctgctggcgctgcccggggtgcgcaaggagtgcctgacccgggtgatgagccacccgcaggcgctggcgcagtgcgagcacacgctcacggccatgggcctcaacgtcgtccgcgaggcgttcgacgacacggcgggcgccgccgagtacgtggccgccaacgggctccgcgacacggccgccatcgcgtcgtcccgcgccgccgagctgtacgggatggaggtgctggccgacggcgtccaggacgactccgggaacgtgacccgcttcgtgatgctggcgagggagcccatcgtgccgcgcacggaccgacctttcaagaccagcatcgtgttcgcgcacgacaaggagggcacctccgtgctcttcaaggtgctctccgccttcgccttccgggacatctcgctcaccaagatcgagagcaggccgcaccgccaccggcccatccgcctcgtcgacgacgccaacgtcggcaccgccaagcacttcgagtacatgttctacgtcgacttccaggcgtccctcgcggagccccgcgcgcagaacgcgctggccgaggtccaggagtacacgtccttcctccgggtgctcgggagctaccccatggacatgacccccatgaccgccggctcatccaccaccatttcctcgtccgatggtccctcgtcgtcgtcgtcgtcgtcgtcgtcatga

SEQ ID NO: 2238 - protein, 432 aa, Sorghum bicolor
  misc_feature: Ceres ANNOT ID no. 6030226
  misc_feature: Functional Homolog of  Ceres CLONE ID no. 37739 at SEQ ID NO. 793
  misc_feature (121)..(300): Pfam Name: PDT Pfam Description: Prephenate dehydratase
MAAASMIKAPVGQNPRLACHAPARGGGVVRCSLQGAVVGGRADWQSSCAVLSSKVAALGTHSINGHVAPAPAPEPSQNGAVLDLVPVTSITGGAITKANLPQPLRIADLSPAPMHGSQLRVAYQGVPGAYSEKAAGKAYPGSDAIPCDQFEVAFQAVELWIADRAVLPVENSLGGSIHRNYDLLLRHRLHIVGEVQLPVHHCLLALPGVRKECLTRVMSHPQALAQCEHTLTAMGLNVVREAFDDTAGAAEYVAANGLRDTAAIASSRAAELYGMEVLADGVQDDSGNVTRFVMLAREPIVPRTDRPFKTSIVFAHDKEGTSVLFKVLSAFAFRDISLTKIESRPHRHRPIRLVDDANVGTAKHFEYMFYVDFQASLAEPRAQNALAEVQEYTSFLRVLGSYPMDMTPMTAGSSTTISSSDGPSSSSSSSSS

SEQ ID NO: 2239 - DNA, 1272 bp, Sorghum bicolor
  misc_feature: Ceres ANNOT ID no. 6030945
  misc_feature: Encodes the peptide sequence at SEQ ID NO. 2240
atggctggaggcaagtccggcggcaacgccgcgcgcagcaggaagcgcgtcgaggccaccgtcctcaagcgctccagggacggcagcgcattcaccagatggtaacttcaccttcatttctacttctccctgctcgctcgctcggtcggtaccagatctgacgagaacgaatcccatcccttgcagcgaggcctgcaacaaggatgtccccgtcgtcctcatcgacatgcacagctgcagcctcgacaagcacatcaggatgatgctcgaggcgcaggtcgtcgagaagaccgtcgaggtcgccgccaagcccgccgaacgcaacaagtcctccgccaagggacacggaggcggcggcaacaaggatgccaagcgcaagcgctcgcccacagccttcttcctcttcatgtatgcaatgcgactgcgactgcgactgcgactgcacgcacctttttcttcctccctctttctaagtagatgcggataaccaaaaaaaaaaaaaatcctcccatctcatgtgttgtcgattttttttgtttcagggacgacttcaggaaggagttcaaggccgcccatcctgacaacaagagtgtcgccaccgtatgtccttttcctctacgcccagctttcttttccttcatcccacccagtttcttctaccttgagtagttgttgccctgctcatcttatcgactcactcactgactgactgaatctatctacctgttgattgaaggttgcaaaggaaggaggggagaagtggaagtccatgacagacgaggtcagtcagtcagtcctactctgtttctcttctctgttctgaatctgaattccttgataagagtctttctggcgttccgactcttgctcatcattcatcctctgttgttgttcatttctctggatcaggagaagaagccttacgttgaaaaggccgcggagctcaaggctcaagccgagaatggcgagggcagtggtgtaagtccatcttctcttctcttctgcctctcccttccttgctggacatggtcacgtgtttcagcctgctactgatatctgaagtatatttccctgattcggtgttcgacttgtgtgatgcaggagaacaatgttgccaagaagaaagccaaggcagatgacaaggatggggagcaggaggtggatcagcctgcaaagaagcgcatcaggcgcaaggctcttgacgaggacgaggatgacgctggcgaccaggaagatgaggatgagcagaacgagttggatgatgacatgtag

SEQ ID NO: 2240 - protein, 226 aa, Sorghum bicolor
  misc_feature: Ceres ANNOT ID no. 6030945
  misc_feature: Functional Homolog of  Ceres CLONE ID no. 208429 at SEQ ID NO. 1315
  misc_feature (98)..(162): Pfam Name: HMG_box Pfam Description: HMG (high mobility group) box
MAGGKSGGNAARSRKRVEATVLKRSRDGSAFTRCEACNKDVPVVLIDMHSCSLDKHIRMMLEAQVVEKTVEVAAKPAERNKSSAKGHGGGGNKDAKRKRSPTAFFLFMYAMRLDDFRKEFKAAHPDNKSVATVAKEGGEKWKSMTDEEKKPYVEKAAELKAQAENGEGSGENNVAKKKAKADDKDGEQEVDQPAKKRIRRKALDEDEDDAGDQEDEDEQNELDDDM

SEQ ID NO: 2241 - DNA, 1272 bp, Sorghum bicolor; identical to SEQ ID NO: 2239
  misc_feature: Ceres ANNOT ID no. 6030945
  misc_feature: Encodes the peptide sequence at SEQ ID NO. 2242

SEQ ID NO: 2242 - protein, 226 aa, Sorghum bicolor; identical to SEQ ID NO: 2240
  misc_feature: Ceres ANNOT ID no. 6030945
  misc_feature: Functional Homolog of  Ceres CLONE ID no. 963031 at SEQ ID NO. 1131
  misc_feature (98)..(162): Pfam Name: HMG_box Pfam Description: HMG (high mobility group) box

SEQ ID NO: 2243 - DNA, 3472 bp, Sorghum bicolor
  misc_feature: Ceres ANNOT ID no. 6031141
  misc_feature: Encodes the peptide sequence at SEQ ID NO. 2244
atgcagacatgttttacatctattgttaccttagttgctggtgtgctggtatgcatttcttcagattttaggtgtaaatgtctaaggctatttgccagtaacagggaggaattcaagaggacaaaacaatcatttgccgttcttagaaatccaagtggtactgttatgcatttcttcagattttaggtgtaaatgtctaaggctatttgttggataaactgatgaacacgagattgatctgccagagggcagtttgcctgctatggccttttgattgtattgcaaaaaatgatctcggttacaaaacccttgcccaaactccagctcttataggctgagggccacccctaggatgagcatattctagagtagattcctagataacttggctgccaagggtcttatcttcttgacccccaagcaagcctattacagccacacaaggagaaacaactaaaaacagagaaaacaaaaactgcagtgggcaatacttaggccctgctatactagatacatgaccaactgctatcactatttgccagtaacagggaggaattcaagacaacaaagcaatcatttgctgttcttagaaatccaagtgatacatagtctaaatccatttaggcaggttttgaagatccatgtgttcctgtgacccggacacccagccattgtggagatcttagtaacttcgcagttcttaggattccaagataatttatgttctataactagcagtgagcagtagagtatgaaataaaagtagtggtgttagtttgccaaaagtaccttttttttaaactacgcagaagacaacagtataggaaatcgctatggctaaattagattgaaaagtggatgttttaggcgaatgagcacaacagtatagatagattattgctaccttgctaacagtatgtcagtatcttagccacagataactgttctgtggaagataaatatgtatttgcaatatattcatcatttgtttaatacttccctttgatgttcttgaggtgggcatgcaccattttgtttgattgaaggggtaactatgctgcatgtattcatatttttgtatggttgacacaaggcatacacattttgtgccactcatgtatagttgggagatggaagaggaacaactgaaagcttaggtactttatttaaaagttgtttatgccatactcttagcctcttacaccaatgtttgtttgtgaagctactttagtcaggggcagatatgggcctagggccactagggctgtggccgccctcagaattttttatggcgtcgacgcaacagcaaagggaaaaggcccatacttccattgctttccttgtcttagccgccgacctgctctgcggcaaccctgtgttattgttgcctcacctagtttccttcacagtagttcgcgactcgcccacttcccaatcaccattgcaaaatcaacaaaccctagcgaccgtcgcgacagcacgaggcacctagaccctccccaatcaacaattccccacccggccaccaagtgcatccttgctcgacgccaaagtccacctgcattcttgggaggcatgaccgctggccagcaacccagcgttgtggcatgaggcttgggcggctggtggcagatggctgcagcagggctcactggctcggagctgcggcgggcacactgcagcagcgtgttgccgacaaccttgtacacctcacacgacagtagctagatgctggataattttaatgttgtgtgcattcgataaggcaactagaaaagataaattctcgattttccatcccaagttgcattttaatgttgaatttcgcaattcagacattctcatgccagttcccattatgaatgaatgagatgtttttttaacaaaaactggtactgttattattccatatttttgggtatttcacccattactcaagatctgcaatgggagtttattaattatatggtgtggattagagcgtatgaatgaaatatcatctaaaatcatgcatttatgcattatttttatgacaatatagttatttgacccaatatagacatcttacatacttagtgagtggccctaggcgtgaaaattgaccagctctgccactgactttagttatatgttctaagtataatttgaaaaaatggtggaagaaattaagttggatccacttcctcttcttcttttgcctttttttaacggaaacatacgcttccattaacaattggctccaagcttgttgctggaggccaaatgttctacacagttcagtgtctgactcatgaactcttgtgagtcagggattaaattacaagcaccataggcaactaagcagtcagccaccagattattgcttctagagcatacagaaacttcacagtggtacatgagctccggtatgttcctaaacaaaacaccacggggatgttgatccacatcacttgatttaagagcatctgccagtatggctgcatctatcttcaaaattacctttgtcatgccaagatcagctgcacgacacagaccttttattgcatatttctttagtagtccatattttctccagcacttctttccctgattgaaataattcctggctaaatcttttgccacagttacttgtatgcaatggaatattgacttctgtgcaactatatgcaaaaggttgctataaacactgtgcagcataagatagagttaagctaaagccattttgtgcaatggaatattagcaagtttcatttcattgtcctgtgttacagaaatggtctactgtagaattatatatttgtatggcagctttcattttcactgtggttgttgtgaagattttccattattctgctttgtcatgcaaacatccctctcatatttgttctttttgccacaatctttgctgattagagttagattttcttttgtctttaaataaataaagaaaataacaaagacccattttatttgacagagaaagcggggttctaccgaagattctgttggcttgtatgcagtgcaatgccacaagtgctacaaatggagtacggttccaaaagaagaatttgagacacttcgtgagaacttcactaaggatccatggttctgcagcagacgaccagactgctcttgtgaagatgatgctgacattgagtatgacaacagccacatctgggtttttgacaatcccaacataccaaagcctccaccagggacggagaggctagtgattatgaggagtgactacagtgaaatggacccatattatgtcatgcccaatgggaagcatgcaaagtgtgctggtgatgtggataagtttctggaggcaaatccagagtacaaaaaccgcatgtctgcttcggatttcagctttgcaccactcaaggttgttgaggaaactgttcctcgcaactcaggcaggaaggctgccaaggccaagaagcagaaggcaaggcacaaaagtgattga

SEQ ID NO: 2244 - protein, 180 aa, Sorghum bicolor
  misc_feature: Ceres ANNOT ID no. 6031141
  misc_feature: Functional Homolog of  Ceres CLONE ID no. 21374 at SEQ ID NO. 1475
  misc_feature (28)..(76): Pfam Name: zf-CW Pfam Description: CW-type Zinc Finger
MQTCFTSIVTLVAGVLRKRGSTEDSVGLYAVQCHKCYKWSTVPKEEFETLRENFTKDPWFCSRRPDCSCEDDADIEYDNSHIWVFDNPNIPKPPPGTERLVIMRSDYSEMDPYYVMPNGKHAKCAGDVDKFLEANPEYKNRMSASDFSFAPLKVVEETVPRNSGRKAAKAKKQKARHKSD

SEQ ID NO: 2245 - DNA, 1781 bp, Sorghum bicolor
  misc_feature: Ceres ANNOT ID no. 6031322
  misc_feature: Encodes the peptide sequence at SEQ ID NO. 2246
atggggcgcggcaagatcgagatcaagaggatcgagaactccaccaacaggcaagtgaccgtctccaagcgccgggccggactggtcaagaaggccagggagatcggcgtgctctgcgacgccgaggtcggcgtcgtcatcttctccagcggaggcaagctccacgactactgctcgcctaggacctcgtatgtccgttgctctcttttttgtcttgtgcttgtttattatcctcctcctccttttcttacttgtgcaaaggaaactgatcgcaaggagtcaaatttggtttggtggtaggttgtccaggatcttggagaagtaccagactaactccgggaagatactgtgggatgagaagcacaaggtgcctgcccttcagtttccgttttctttgacaatttgtttcaggcgccacgagcagattaatgattcaaaaaataataatatttcaaatgtttcagatcctgagtgcagagatcgacagaatcaagaaggagaacgacaacatgcagattcagctcaggccagtgtttctgtttcagattttctcccaatttgttgctgcgactgcactgcacttcgctggttcactgttcgtgtgtgttcatgttgtgattgtgctagcgtgtgcgtaacttgtgatggtacaggcatctgaaaggcgaggacctgaactcgctgcagcccagggagctgatcgccattgaagagggtctccagaatgggcagaccaacatgcgcgagaagcaggcaatcctccttcatccagttgctccttagcttctttgttgcttgcattgcttgcagcacgcaagcccggcagaattcatcaggcgaaggttttgtttctgattctgatgttggttttattccactgttgctgcagatggatcactggaggatgcgcaagaggaatgtacgagctctaaacttgaatcatatcctctgttcctactctatacatcctggagtgcttcttcttcttctttcttttaaaagaagtccttagtattttcttgagtaaaaataaataaattacagctcctgattcagggtgtttttttttgcagcatttgatcactgatagccatttgtgatttattgcaggggaagatgctggaggacgagaacaggatgctgtcttttaggatggtaagtcttcccttctgaatagcagttgaaatttgaaaccttgcttgatctttccttgttcccttctttccactccttatcataacttatcaggacgctattctgaacaaattcaatgttctgagctaactgaagaaacctgaacaaccacgctgagcaaatttccaagggcatgaaaattcttgtcttagaattcctagttggaacacaattatgctcaccgatgtattcaaggtgatttgtcagacttaacaacccaagaccaaactaaccagacataattgaagacaaaatttggtttccttagtgaagttcctgtattattaccaacccaaccctgatggtctgcatattgattactgaaccgcctaaaccttcttcggaaattcatactttggtgaaggttatcctcattctgcaattgctgaatgaaacctaaaagctcatggcttgctgaattttccccttcctgttcccagcatcaacaggctgttgatctgagcggcggcatgagggagctggaaatcggataccatcaggtccagcatgacagggaattcacttcccaaatgccgttcaccttccgggtgcagcccaaccaccccaatctgcaggaagacgagtag

SEQ ID NO: 2246 - protein, 212 aa, Sorghum bicolor
  misc_feature: Ceres ANNOT ID no. 6031322
  misc_feature: Functional Homolog of  Ceres CLONE ID no. 40334 at SEQ ID NO. 865
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
MGRGKIEIKRIENSTNRQVTVSKRRAGLVKKAREIGVLCDAEVGVVIFSSGGKLHDYCSPRTSLSRILEKYQTNSGKILWDEKHKILSAEIDRIKKENDNMQIQLRHLKGEDLNSLQPRELIAIEEGLQNGQTNMREKQMDHWRMRKRNGKMLEDENRMLSFRMHQQAVDLSGGMRELEIGYHQVQHDREFTSQMPFTFRVQPNHPNLQEDE

SEQ ID NO: 2247 - DNA, 1391 bp, Sorghum bicolor
  misc_feature: Ceres ANNOT ID no. 6031981
  misc_feature: Encodes the peptide sequence at SEQ ID NO. 2248
atgaaggcgagggcgaagtccagcggcggcgactccaggtactttccgatttcgcccccgcttccatccattctcgttgtttttttggttttggttttgacggggatttgtttgtttttgctgaaggctttcggtgaagaagggcaaggctcagaaggacccaaacaagcccaagaggcctccgagcgcgttcttcgtcttcatgtcagtttcatattctgtggcgtttctcttgtgtaccgccgttgttttgattttgttctgattcggttgggtctggatttttcagggaggagttcaggaaggactacaaggagaagcaccccaatgtgaagcaagtctctgtggtaagcgttgtttcatccatgattccatcattcgattcgaatattcgtggtgtgctggtatggaacttgcgtttctgatgtttgtgtctctgtgaatggcagattggcaaggcttgtggtgacaagtggaagtccctgtctgatgctgtgagtttgcttgctccccttgcccattttaatcgtttgagactgcagttcgttgcgatgtgctttgttcttaggaagacgatgaatgtcccgctctagtttcgtctggattgggtcccctgtgtttatctgtatatcgtatatcatgtggttacttgctgcagtgttagatctgttcaaattccatcgtatgttgaattcgaattttgggccgttttgttcatgatatcaattcaaatttcaccatgcctcatgttttggaattgtaactagtggctaagatactagacggttatttagacttcagatctgtgtactagccgctgcctagtgctatcctcctttggcactgactgttttggttcaatggattgttgatactcgatactattttgttcaattcggtgttgaaatctattcgtccatagaagaattttgttcgtccatatgtttgtgtccatttatgtctgaaactggtactgagatggaacaccctctgaggttgtgcgatttctgaaatgcaggagaaggctccctacgtctctaaggccgagaagctcaaggttgagtacaccaagaagatggacgcctacaacaacaagcaggtacatcatgttccactccactcacattgctcggcagtgcctagaaattcgtctgtatatgatgcactttatgagtcatgcgtcatctgtcgttgcagtctggaggccccacagcgtctggtgattctgacaagtccaagtctgaggtgaatgacgaggacgaggaggttcgtgagagcaaatcctcctgagtcctgactcttccttgccttccactgctggttttgttttgtgcatcccaaacctcactgacaccgtccatttgaaactggttttgcagggtgacgagtga

SEQ ID NO: 2248 - protein, 121 aa, Sorghum bicolor
  misc_feature: Ceres ANNOT ID no. 6031981
  misc_feature: Functional Homolog of  Ceres CLONE ID no. 333753 at SEQ ID NO. 1333
  misc_feature (28)..(92): Pfam Name: HMG_box Pfam Description: HMG (high mobility group) box
MKARAKSSGGDSRLSVKKGKAQKDPNKPKRPPSAEEFRKDYKEKHPNVKQVSVIGKACGDKWKSLSDAEKAPYVSKAEKLKVEYTKKMDAYNNKQSGGPTASGDSDKSKSEVNDEDEEGDE

SEQ ID NO: 2249 - DNA, 4351 bp, Sorghum bicolor
  misc_feature: Ceres ANNOT ID no. 6032020
  misc_feature: Encodes the peptide sequence at SEQ ID NO. 2250
atgcagccacaggccggttcctcctctctgcagcaaaactccactgccgctcccgatgtcgcggcgccgccgcccaagaagaagaggaaccagccaggcaacccaagcaagtcctcctggccctagctaactatatatataccacttgtgattatttgtgtgttgaacgatcgatctgatcgatcgacgagatgattaactctatttcttttgtttgtctgatcgatcgatcgatcgatgatcgatcgtcgtgcgcatatatacatacatgtacagatcctgacgcggaggtgatcgcgctgtcgccgcggacgctgctggcgacgaaccggttcgtgtgcgaggtgtgcaacaaggggttccagcgggagcagaacctgcagctgcaccggcggggccacaacctgccgtggaagctgaagcagaagaaccccaaggacgtgcggcggcgggtgtacctgtgcccggagccgacgtgcgtgcaccacgacccgtcccgggcgctgggcgacctcacggggatcaagaagcactactgccgcaagcacggcgagaagaagtggaagtgcgacaagtgcaacaagcgctacgccgtgcagtccgactggaaggcgcactccaagacctgcggcacccgcgagtaccgctgcgactgcggcaccctcttctccaggtccgtccgatccggttcctctttattcgtacgttctttccaccggccggccgctccgttcccgaccgccggcgtgcggggccggcccggcgcgcatgagctgcgtgcttgcattggaattgtggatcgattctctatagctttttggttgccgtgtttttctgtcctccatttctttacgaattcttttttgcgtccatgattgtgtgatgatgagttgcgaggcggtcgatgatgtgatgcgttagggtttgggctgtcagtaacaaagatgctgtgctggtgtggtgtgtccgtgtgtgtagcttgcgggtttaggattccttcgctggggctagctgctggggagagagagagagagagagagactgagagagagagagagggactgagagaaagcgaggctcaggaggactggaggaggaggagctgctcccacgtgagtttctcttgtcgggaggggactggagatatgcgcgcagcactcttcctgacatggtggtcatttgacggcagttcctcttttcacctcgtaatccacgccccgcgcgcgactgcaaactcactgactgtctctctctctctctctctctctctgtctctctctctctctccgcgcaagtttgcattgcttgcatccccacctgttcacgagcttgatgcatgcatggcgagacttgccagaactgggcgcgcacgcgctctgccgcggtgccggctggctggcttcgacccgtcgtctggcggctccggttaattgtttttgtttcgttcccttgccgctcgttttactagtcacgtacaggcctgtattttctgtactacagctggtgtgcatctgttgtacgtacgtacagtacatggacgtttctcttggtatgtgctgtagtgtagtgcatatatatagctgcattaaactcacttgtgggctgatttctctgtcgtttatcggagaaatattgtgctgatttcttgattctcgtttctgtgaaattcaagaatgatgttggtttgcacggccagtcaaatgttgtgctggcaacggtttacgctcattctagtattctacctgtacaacattgctccagtaattatcactccattcagtacattcaagaattgataacatttgactcatcactaattaaatgagctagcacacatcattgttaaaaaatttctgctccttaaataagcttcctgtcacttgaagaattgtcactccataaataagtagacttcctgctagaaaaaggggtagtgatcggctacatattactgatttaatattaaatatcttattatttttgtatgaatctttaattagaaaaaaggttgtgctggtaaattgctggttactatactaactctggtcaaaaatatctggcacacttgactttacactatctttaatgcttatctttgacagctaattttttctagaaaatattttttaaaatccttcaaatttaagagactttgcaagtttttaaatatgaatatacataatagtttacatgtttccaaactaaataatgtcatgtatagatactagtgtttgtattttttttcattgttcactaaaccttgtcctaaaagatataagtttttgtgaggccagagagagtatataccacatactattcctaatactctttagtctaaaactacctctgtcttgaaatataatgtaccttaagaattctaggacatattatgcggaaagcaaagcaaatgatgcacgtaacgcccccttaatcgggaagatcttatggttgtcatatttagattggtgatagatgatgctaatggtaggtatgcatatgaatgttgttcttttgaattgagttttgggttgcttgtacttgttattttagcatcatgcatatggaattaagaaaacgttaatatcttgttcttatttttgcataatcttcccatatactcgaatctgtctaaaataaagacatcctagaaaatttaggacatattatgaggtaaagcaaatggccggaattaaccctaccttaactgtggagagatatttgtgttggcgatagccatcaatggtaggtatgcatgtgagtgataccttttgaaactgagcttgagggttattcatccagaacccgtatagttcgacacaaattttcaatatattagcttatatttcagaatggagggagtaagtcatacctacatatatattgccaattacttaagcgaatgatattaacatggtcaagtttttttttggaaccacgtccacgaaatgttggcaggcacaatatatatattgcctacagaaaaacaacatgtatatttgcaaacccaaataaacagcctaaaacatctaattttgatttggacgagtgtctatcttggcatttaattttaaatcggtttttatgttctattatttattcataaacgacttgaatatttttatgaaatatagctaagatatcattgcaaagtttggcaattaagctaatgttgtatgcctgtatgtatgtactctacacttcattatatgtgtatattctttagattttaactcttccgtcttagcttttttttaaaaaaaaataactcttccatgtgtgtgcaactgtgcatgcgtgcaggagggacagcttcatcacccaccgcgccttctgcgacgcgctggctcgtgagagcgcgcagatgccgcccctgggcgccggcctctacgccggccccggcagcatgagcctcgggctctccggcaccgtcgcccagatgcatggctttgcagaccaagccggccagtcctcttcagctgcagccgcgcagtttgaccacatcatgccatcgtcctcgggctccagctccatgttccgctctcaggcgtcggcctcctcgccatcctacttcctcggcggcggcgctcctcctgccgcccaggatttctccgaggacggctcccaaggcagccagggccctctgctgcacggcaaggcgcccttccatggcctaatgcaacttcccgagcagcaccaccagccggggccgggcagcagcaacgccgccgtcgccaacggtaacaacagcctcctgaaccttgggttcttctcagctggcaacaatggtggcacgtccggcagccaggacgcgcgccttgtcatccaagaccagttcaacgtcaccggcggcggcggtggaagcgcagagcatggcaacaacttgatggcgtccctcggaagccacctcggcggaggcttcccttccctgtacaacaactcatcgccatcggccgggctggcccagaactcggccacggcgctcctgatgaaggcggctcagatgggctcgacgtcgagcaccgcccacaacaacggcactactagcacgctgttccgtgctgtaagcttcagcgccgccgccgccgccgccgcaagtggacaggggacaagcagggccgcaggagaagggacgacgacgtctcacgaggcacacttccatgagctcatcatgaactctctggctggcggcggcggcgccgccggcaccggcggcttctccggcgctactgcagggttcgggggcgtggacgacggcaagctgagcacaagagacttcctcggcgtcggcaggggcgccatggcgccgcccgggctccacatcggcgccctggacccggctcagatgaagtga

SEQ ID NO: 2250 - protein, 517 aa, Sorghum bicolor
  misc_feature: Ceres ANNOT ID no. 6032020
  misc_feature: Functional Homolog of  Ceres CLONE ID no. 9804 at SEQ ID NO. 1136
  misc_feature (55)..(77): Pfam Name: zf-C2H2 Pfam Description: Zinc finger, C2H2 type
MQPQAGSSSLQQNSTAAPDVAAPPPKKKRNQPGNPNPDAEVIALSPRTLLATNRFVCEVCNKGFQREQNLQLHRRGHNLPWKLKQKNPKDVRRRVYLCPEPTCVHHDPSRALGDLTGIKKHYCRKHGEKKWKCDKCNKRYAVQSDWKAHSKTCGTREYRCDCGTLFSRRDSFITHRAFCDALARESAQMPPLGAGLYAGPGSMSLGLSGTVAQMHGFADQAGQSSSAAAAQFDHIMPSSSGSSSMFRSQASASSPSYFLGGGAPPAAQDFSEDGSQGSQGPLLHGKAPFHGLMQLPEQHHQPGPGSSNAAVANGNNSLLNLGFFSAGNNGGTSGSQDARLVIQDQFNVTGGGGGSAEHGNNLMASLGSHLGGGFPSLYNNSSPSAGLAQNSATALLMKAAQMGSTSSTAHNNGTTSTLFRAVSFSAAAAAAASGQGTSRAAGEGTTTSHEAHFHELIMNSLAGGGGAAGTGGFSGATAGFGGVDDGKLSTRDFLGVGRGAMAPPGLHIGALDPAQMK

SEQ ID NO: 2251 - DNA, 1090 bp, Sorghum bicolor
  misc_feature: Ceres ANNOT ID no. 6032291
  misc_feature: Encodes the peptide sequence at SEQ ID NO. 2252
atgcccgactcctccttcgccagcacaggcatggccccctcgagctcggcagcggcgtccatggccgcgctcgcggccgccgcggcgtctggcgacggctcggacgactccggggcggccaaaaacggtggcgcgcctccgacgcacggggtggaggcgggcaacaatcccgcggagctggcggcggccgtgggtggcgcctccagcagctcctcccgggcggcggcgaggagcagggtcgcggcggctgctggcgcctccggctcctccccggtggcggcggcgaggagcaggggcgccggcgccgtggccgcggcggcgggcggcggcggtggcgtcgggccgagctgccaggtggagcggtgcaacgccgacatgggcgtggagaagcggtacaaccggaggcacaaggtgtgcgacgcgcaccgcaaggcgtccgtcgtcctcctcgccggcctccgccagcgcttctgccagcaatgcagccggtaagccccgcctctgcctcgcggcacatgggcaggccatgggtgcagtgatgccgtccggctccggcgtgcgtgacatgctcaaaagcaccgtccactttcagttcgtagtacgtacgagtactaaattaaatgagcttaattcaaccttaaaaagaacttagcgcgcgcttcggatctcttgagaaaagcttttgcagctttttcatggatcatggatagcatgatgagctgttggatggatcctaggttggtttcaaactttcagctcaagatcttgcagcagcctctttggaagttaaaccgagagctagctcctctgtttggattcctcttcctgctatataatgttggtgactgcatgcctcactccacgaagcgctctctctctctctgcctctcactcttggccccgtcgtctgcgtggttgcaggttccacgagctgtcgcacttcgacgacaccaagcggagctgccgcctgcgcctggcggggcacaacgagcggcgccggaggaacccggcggaggcgcacgaccagaacggcggccggggcgacccggggaaccaccacctccacatcagatcagataaacctatctaa

SEQ ID NO: 2252 - protein, 218 aa, Sorghum bicolor
  misc_feature: Ceres ANNOT ID no. 6032291
  misc_feature: Functional Homolog of  Ceres CLONE ID no. 12071 at SEQ ID NO. 1405
  misc_feature (116)..(194): Pfam Name: SBP Pfam Description: SBP domain
MPDSSFASTGMAPSSSAAASMAALAAAAASGDGSDDSGAAKNGGAPPTHGVEAGNNPAELAAAVGGASSSSSRAAARSRVAAAAGASGSSPVAAARSRGAGAVAAAAGGGGGVGPSCQVERCNADMGVEKRYNRRHKVCDAHRKASVVLLAGLRQRFCQQCSRFHELSHFDDTKRSCRLRLAGHNERRRRNPAEAHDQNGGRGDPGNHHLHIRSDKPI

SEQ ID NO: 2253 - DNA, 7065 bp, Sorghum bicolor
  misc_feature: Ceres ANNOT ID no. 6034341
  misc_feature: Encodes the peptide sequence at SEQ ID NO. 2254
atggaggagatcacccaccactttggagttggcgcaagcagccacagccacggccacggccacggccagcaccaccatcaccaccacccatgggcatcctccctcagcgccgtcgttgcgccgccgccgcagcaaccgccgaccgcaggcctgccgctcaccctgaacacggtggcggccactgggaacagcggcgctagcggcaacccggtgctgcagcttgccaacggcggcagcctcctcgacgcgtgcgtcaacgtcaaggcgaagggcgagccctcgtcgtcgtctccctacgcaggcgacctcgaggccatcaaggccaagatcatctcgcacccacactactactcgctcctcgccgcctacctcgagtgcaagaaggcaagcaaagacctgtactagtagcagtctaacagtagcgcactactagcgctgctgcttccggttctgctagagaagtttcgccacatctgatgatgtcaagaacggcgcacgcatatgcatatactttctgcttgcttttacatagcatactatagtttatgcatgctgctcatgtagacatgtgcatccggtgttcagaactttctcaaacggcggccgtgtgggtgcttgcaggtgggggcaccaccggatgtgtcggcgaggctgacggcgatggcgcaggagctggaggcgcggcagcgcacggcgctcagcggcctgggcgcagcgacggagccggagctggaccagttcatggtgagagctatcagctaaccgtcaatgatcccctttctgcaaaagaagacatcttttctgtgttttgctctcgaggtttattcacgcacggtggcattatttgtcgttgttttcaactcggttttaatttgcgtgtaggaggcgtaccacgagatgctggtgaagttcaaggaggagctgacgaggccgctgcaggaggcgatggagttcatgcgaagggtggagtcgcagctcaactcgctttccatctctggaagatcgctgcgcaatatcctttcctctggtactgaaattgctgcggctcatgctcctcttatattagatgatttcttggatcggttgcctcctcatgcagtgatgacctcttgttgatttttttttgggaagggtgatgccctcttgttgagatcttcatgttctcttggttgtccatcatgccctcttgttcatcttgccgtcacgagatcttcatgtcttcttggctgcccatctatcatgccctcttgttcatcttgctatcctctttcttggttgagcatatgttgttgattttttgcatctaaaaaagagaagaaaaaattgatgtggtttctcagcaatttggcatctatatggttccctttttaagagcatcttgttatgcatgcatgttttgagtatagctacctgcgcagcgcagatgaatgtcttgtctgtgcttcatgttttcctaatccgggtttcccaaagaatcttatccatgcttgcttttcctggccatgcatctgtgagattcttcgctccggcttccatcgatctttgcttctgctggaaaggaatagtcctcacacatgtgcagcagtgcaggtgcagctcaatctagcacgacaccatacggcccattccttccttgcgttctgctgtaatactgcatagagattaggatgaaatcacctgtgttttactggtactactactactactactttggctgttggcagggatgccttgttcgtcgtcctccattgattgattccatttccaatggaatatgtgcatgtgtccagagagtagttcctggttcaggcagccatcttttcccatgatgggaaccccagggaattacggagccctttccttgttctagggtttggggaagggcaacagtacagcgtgctgtgctgtacaggcattgtgcaagcaacagttcatggccgaggagtctcactggcgtatgtcagtgaaacacgagtactacacagacgtactccgcctgtgaatatgggaggagtgagagtactgggccggtagatagaaagagatggggagtcatcccccatctgtcacgcaagcttgtagcctggccagaacattcttgtcatctttctccacctcaagagatgtagttacctgttgtcctagaatctatagtgtgttgtgttgttgtcttcccagatgtgcttgttctgcatgcccagtagtctctttgctaattttaaatgaacacatcaggtggatcgagacgatcctaggggcctttctaatgacctatcacgaggctatagtaacaactcgtgctaccacagttaacttccgagcccagagttttttcacttcggttctggagcactggctacttggctagtagtagttgacagcaacacacacaatcacttcatcattattggagcatgttagcgaagaagctgccatctgatgatgtcgtagaatgctgcaaaaatggccagtaagccaagaacgctgcaaaaattgaatggagcttcatatgcggctcagttttttgtgttctgaaccggtccatgcagtggacaaaatggtctgtgtgcctcgagaaccatagaaacagttaggctagtacatcaacgctgaacgtcccccattatttgatgtgagatctctcttgcaatggatgtgtgatctgctaggccttatattatatgcaacaactagtacttctttgtccctgtattttgtcacagactttctccccgtgcattctctctcataaataatgacggtcaaggaacattggatgccggcagtccaagttctgcgatacatttttcagctgtcaactcagatttcttctcagctccaactgttctttgaccttctcggcagacttttttatttttgaaagaaactatttgtagaccacatagattcttttcttaaacataatacaatcccttttgtttatgagggccacagacgaactattgaactaatcgcaaaacaacactgcattttctgactgatgttgcccatgtaccccaagattcttggttgcatctactctttcaaggtcatgcaaaagcagggacacagatatcacgagtttccatttgtctcgaggtaagaccaaaaaagataccagaagcaaacaacataaaacaaaacgatgaaaaagaaccgatgggttttgcactgagacaccagtggaaaagacaacgcccgactggaggaaaggaacaatctggcacgtccatctgcgtgaactcttttatttgatctgcatctcgtgcatgtttatattcttggttactggagtcaggtgcattcatttttattttctttgagattgatcgtcggattctgattctcgtcacttctgctgttggttttatcattttcatggattctattatatctatcgtaatgttcagtatcacaaaaaatgatgtgatcagagttgtttatcacataacttatatttttttcattttccataacagtggaagtgtttgacaatattatccagaaacaattgataaatttaaacataccagcttttttaaaatatataactttatttaccttaaaaaccagctgtattgaaatgaaacactaggagatcaagggcgttaaatgtattgaaatgaaacactaagaaaatatttgaaaaacatctggaatgactatggaacagctcctaagggttccttcggcaatactatttcttaagtgtaccatgaaatcttttccagaagttttttagatactgctgtaacatgtactcactcttccctataaacaactttgactaaatatacattaaaaaatattattgtttatggtatataattagtatcattggaaagatctttgagtctagtttttaacaaatttattggaggacaaatattgcacgtattttttacaaatcgagtcaaacttatggcacggaaaccaaaaacgacaattaatttgtgacgggagtacaagctgtgacactcttcttttttattttggttttccacattttcaacaagtccaccaaatatttccacaaagtaaaatgtcttatccctgtggtatcccaaaacaatttcatattttcatgggttactatgtccattgtctaatgttgttttagtgagcaaatggttctttcttcatttcaaagataaccacacacatttcgcataatttttaatggatcattaaattattatggtcatttactattaccatatctgttgtgacctcacactgctttaatctgttccaattaacagcataacgaacagatactcatgtcgtgtcacatgctcaaaaatcattttcaaaataaaatgatattttcactgttgcttcatcagaatgcacaaacataaaatatttatttcctttatgcaaaaatatatacgaatgttggtttcatggagcgataagaagatatttatacagttaaagaaggtcctgttacccttttttttccaaacatatcagatattttctcaacattccaggctaaatagacctgcatagtatcatgctcacaaatgacaaactgtggttgacccatggtcatggtaggtatgcacaggactgagtagcagcacaaggtccaaccgctgtgctgtatgaaatgaaactaaaagaatgttgacatcctggctcttggtctcgaatgtgtgttgttattttctagttattgatcttatctaaagataactaagtgtttgattttagtatgcgcagcagggttttgcactagcttgccaagcttatcacagccctcctttacctgtgctcctgggctaggcaccggatgtgttgaaacaacacgagcagagttgttttgttagaacagataaaaatataacttaatattggagaacatacttcattttcccatatatgatagggtgctcttagataggcaaacattttattcaagtcttaaacctgtgttcctttgcttatttctatattgcttccaaatttgttgccatcaagatgtttatagataattggcaaaacaactgtacatgggtcatttatgcctgttgtcaaaagcataagttaaatattaagatgctaatatagaaaaacaaatgcagtgctgactgttgagaaaagaacatggtgtgcacatacagatgcaatataatattttacccacaatataaaaatgatcaaaatatcatgcaaataaagtaatatgcgcagaaacatccatactttttatattcattcactaaaatagtgcaaatgcacatgtccgtgatatctgtacttcaatgggtatactggagatgttagactgattgatggacaatagcccaatgtaaattcccaaggctgttgtcacgtgggagttggatgatatttgttttgtatagaagcagattgctgtgctacttaacttttagattatcacacttcacattcataaaatcatagttaagttgttatgtggctgttgggattgagagaagagagttgaggggagctccagcggctgccgcactagcgtacccgcaggtactgttcatggctagggttgtgagggcacgagagggccagacacggggcctttgcccacggctaggcaagagggaaggattttccttcttaatgtttgcttgattagattgatacatctactctccttatatagagaggtttagttaacttacaagcaaggattacttgacccctaagcaaacaactcttatctctaattaatcctaacactaatgggctatggcgccagcctaggcccaatagatcccttaacataagttcacttgtttaactgttgcacatgaaaagtactgtttattgctttgcttgtatgggacatgtatttagaatcttagtaaataagttcagtacttggtgctttgccagccaaatgttttctaatctggctatgaatgctgcttgatcacttcttttgttgtagctaacacttccatctgttatgcttgaaggctcttctgaggaggatcaagaaggtagcggaggagagacagagctccctgaagttgatgtccatggtgtagaccaagagctaaagcaccatctcctgaagaaatacagtggctatctaagctcgctcaagcaagaactgtcaaagaagaagaagaaagggaagctccctaaggaggctcgccagcagctccttagctggtgggatctgcactacaaatggccttacccctcagtacgtcttctttttattcttccatttttaaaattgttggcatcacatgattttgatgcaaagtcttcatgagcttttatagccagcaaaaatccaatgttagtgctgattgcacatggtaattcaaggggaagcatgcataaaacaaatttggcaaatctaagctagatatgggtctttgatgttccatggttgtctgttcccgaatttgcatattagcatataataagtgagtcaaagtatgccagagtctactattgatcagggggtggcaggcgattattggtattattaaccttatttcaggtaattctgaaacttctacggtggtcttgctaaataccattaattttaagcaactaaatttatctgaaaggtaagccttctcccagatacagattaaagagtttccattggtttcacttgggaactacatggctgaacagaaaattatagtgctctgaagtatgtgttggtacttcagcacttgtataagtcaagaccctaatatgctattttcaagttcagggttctaagtgaaacaagcatcaagtcaggagttcacaataaactttttttatatatcttcattttgttggatgttttgtatacgacatagcctgcctttccctattggatatgtattaactcttcacatgggtgagcaggagactcagaaggtggcactggctgagtctaccgggcttgatctgaagcagatcaacaactggttcatcaaccagaggaagcggcactggaagccgtctgaggaaatgcaccacctgatgatggacgggtaccacaccaacactttcttcatggacggccatttcatcaacgatggcgggctctaccggcttggctag

SEQ ID NO: 2254 - protein, 360 aa, Sorghum bicolor
  misc_feature: Ceres ANNOT ID no. 6034341
  misc_feature: Functional Homolog of  Ceres CLONE ID no. 541719 at SEQ ID NO. 1779
  misc_feature (104)..(148): Pfam Name: KNOX1 Pfam Description: KNOX1 domain
  misc_feature (155)..(206): Pfam Name: KNOX2 Pfam Description: KNOX2 domain
  misc_feature (244)..(265): Pfam Name: ELK Pfam Description: ELK domain
MEEITHHFGVGASSHSHGHGHGQHHHHHHPWASSLSAVVAPPPQQPPTAGLPLTLNTVAATGNSGASGNPVLQLANGGSLLDACVNVKAKGEPSSSSPYAGDLEAIKAKIISHPHYYSLLAAYLECKKVGAPPDVSARLTAMAQELEARQRTALSGLGAATEPELDQFMEAYHEMLVKFKEELTRPLQEAMEFMRRVESQLNSLSISGRSLRNILSSGSSEEDQEGSGGETELPEVDVHGVDQELKHHLLKKYSGYLSSLKQELSKKKKKGKLPKEARQQLLSWWDLHYKWPYPSETQKVALAESTGLDLKQINNWFINQRKRHWKPSEEMHHLMMDGYHTNTFFMDGHFINDGGLYRLG

SEQ ID NO: 2255 - DNA, 5963 bp, Sorghum bicolor
  misc_feature: Ceres ANNOT ID no. 6034346
  misc_feature: Encodes the peptide sequence at SEQ ID NO. 2256
atggaggatctctcggatcttggaggtcgcggccaccttggtgctgccaccagcaggcggcccgcgccgccatcattgccgtcgtcctcttcttctaaggtctcggtgcaagtctacaccgtcccaagcagctcagctgccggcggtggcggtgaagcagccgcccgagctcaaggcggtgttgcaccactgatccatgcgtcgtctagcgtcggtggccatggcggccgcgttgctgatcttctagatcccatcaaggccaagatcgtctcccaccctcgctaccaccgcctgctcgccgccttcttggactgccacaaggcacgcgcgccgatcgatcgatgtccacgtcttcattcccggcctgttgctgtccttcgtagattacatgtgtgttcaccttattactcaggtcggctgcccgccggaagcggccgaggagatcgcggcggcggcgagggagcgcgaggcgtggcagcgcgcagccgtgggcgacgcgcacaatacaaggccggacccggagctcgaccagttcatggtggagtaccaaacatgcatgcatgcttgcttgcttgtacacatgacaggcctcttgttcttgtcgtcccagtcccagctgggatcatgcatgcatatggcctcatgaggggattcgggatcttgaagaagcttattatatagtattatacagtttcaataatatgtgtgtttggcctttgatatgtgaaaagtttgtgttgtgaccaggagtcctacagcgagctgctcgtggcgtggaaggaggagctgacccggccgctccgggaggccaaggagttcctgacgacggtggagttgcagcttaactccattaccaacaccgggccacccatgggagctctcatctcttcagctgcaggtgattaaccttcagcttccgttaactgtctaaatccatcaatcaatcaatcaccggttaagtccgtattaattacctcgtcatctcaccaaaatagtcaccacagtaaccgtagatgattaacagattttccttttctttacatggagcgaatagattgtcaagtgtttgttcttgtgacgactagtacatgcctagctagctaggtagctagcacaaagttttcttttgttttcttttatattgctaacaaagctatatatactcctagcacaaagcatatatactaacacaagctacgttgtttttcagcaagggtgaggtaaaaattcataggtttttctcgatctagatgagaagatctttttaaaaaactagaacactcatgggctgtctatccatggtggatcgaactttttaagttatgcgtttctcaagacacgacgctctcccgagttttaaaaaaaaagtcatgatgctcccacgatcagaatggagtatatgtcaatcggttgcctactaggtctatgtggcactatatcttggagtactcactcagtcaaaatactcatgctcatttgttgagttcataagtcttacatttaaccaaattagatgctttttatgaataacagagtatgtttttataataaacctatttagagatgcaaatgtttagtttaacttagtccacaaggctagaatggtattattcttctgatggaggtaccacttgctatttactcctaccaatctcttagggtgcagcagtactactccttccattcagaatgaaaataatcttatgtttgattaaacatatataaaagtattaatacttacgatccgtaataagtaccactatattagctatgaatatatttttaaaggtacacatatcaatataattttttgaaagatacttgaattttagattgtttgatttctccagaaatgagatttttattcttcggacggagtactgcgtagcgtaccaaagttgatgaacagggcaccactagtctacatgctagctatatgtagctatgtatagtcttgcgcacatgtctggtctcagatactggtcctgacgttaaagttttgcttttttctgattataaacgtgaagaagctggctgctctttgggggcaaatcctatgcttggattgaactgggacttagtagacagtagtgctactttaacttgagtgtccaaataactgttcttccctcttaaacaagtcaaaagagctgtagctcatataaccggtggatttttttatcttcgctagatagctagcataaaaaactaaagagatagaaaaaaattgatgacatataggatttcttttcccatatgtgatgacccttttgaacaaaggatccgccatcctaaatttctacaaaattcttaaggaatatagttcaatcaattggagttttagaggaaatataacatgaggccaatctcttgaaaacttcctttatatttatctctctttctaattcatgtgtttctcctgttctatattcaaattattttttagaaactttcatgcgtttgcaattcctctgctgtatccaaatgtctgtaagatttcaagtgacatgtaactgtcaaattctgttttttttttctattcctaaattttagatgttctatgttctatagagagactctaacttttctttgttttacaagtgtgtgccgtgcattaaggctcgacatataagatctcagcgtctcttgcccactgttatttgacctgttaacaaatctagtcatgtaggctgattattaggtgcgtaataatatttttgaaatttgaatgggaaacaacgacacactaacttggttatataagtagcaaaaggcctttatcctgctttcattgtttatcaactacagttgtactgtagacataagtaatatgaataacttatttgtattgcttagcttgcttagtctaaaatcagcctcggcacatggcaataacgtaggctggattattgggtcctcttgttggaatctgtatctatatatctatatataaaagcaaacccattttttaatcttattaagtaccacaacatcctcccactaaggatagtcccaatgctagaaactacatgtagtttttatacttattaatttctataggcactacatatagaaaccatggtcccaatgaatagtttttattcaataattttttatccaatccattcattctctctccattctcaaccaatcatatcgcttcatgtcttggttttcgtatagacatggtttctaacttagacccagattctatgatttttgctttctctctcttcaataactaccttgctacatcaacaaaatacttaggtagcactacaatcaatgtctatataaactatgatgatttctgcattggaggtactttaaggccagtgtcagtgaaagtttcatatgttcacattaaataggttgtatctaggtattttatttttgatgatatgaccgtgtatttaagaagagatagaagaaatgagttttatctagatgaaactctcttggcacgattaccaactctctatgaatcttggaattaaatgtctatgaaattatggcatgaaactctcgattgagggtgggtgtttcatccaagtttcatttcatttcacatgacatggcagcttggaaacaatgttacgaaacttaccactgaaattggccgaagtacagttacttttccagggcaaatctagctaaaaagatcatcgggatcaccaaggtttacttcattacataacataaaaatattaacagataaatatggctaaattcgcctcttccccatagaagcagtccacatcatttccgactataagtgtcatactattttcaatctgtcaacatataaggcatccacaccatattatttgtttggccatcccatcctcctataattcgctataatatctattagaactttaaattagcttgtctagttttgaccatgtccgatgcaataacacgtagatccatcccatacatgcacaacctctttttaagaaggtctcgctgcaacacgtgggctttcttctagtattattaaaaacataaccatgcatgtaagctgatcttccaacataggatatctcataaacaaagaaattagtattttcaaattaattagtacatatgtgccaaggattcttataagtctaactataggagtatgttacttctaacgtattattttccaaaaaggtttcagagttcaacataacacattaacacctatatatgcctccattttaactcggtacctgagaaagaaggaagctactcttatggcaaacttattgggaggggttttgtgtttatagtaaagaacgatattctaagcaatttattggaaagtattactgactaaacatgactaagcatctgttgtgtagtcgtttgtatcatgcattctgtacagaaggatagattcacaaagagatcaagttaatgtgctggcgtttgactaggcatgtttggtttctgataactatgttttgcatataaaactttaccaaaggttagtaatgccatattttgtggcaagaaaattgtctaaccttaggaaaaaatttggcaaaaaaatgtttccatgacaggtgggcctgacagggttcttatagtcaaggtgaaattgtttctgcctaatcttaaatgaggcaaggttaggtgacaaatgcatgccctttagagctagctaacaagtctactatacaagctatataaaattatatatacacgtgtgcgtgtttgtaatgcttgctaggcactaccatggagagaatctccatagcctagttattagttactattatgtattatctatataagaaatatacgtcaccaatagatagcacaatatattgatgatattagatatcatttccaatgacctaactatatatattgctagttctcgtaaatttttatgggtttaagtcataaagtttatttagatccatgttgggagatgtgacatgtgagtagagtatgtactattccctccatttcaaattataagtcattttgactttttgggtacatcagtcttgttatgtatctagatataacatatgtctagatacataccaaaaactatctaccaaaaaagtgaatttgaaataggagtagtcaacttgtatctgtattatctctcctcaagagtaattctctatgagccataggcaaaaaaaacttatgtaaacatttgtgccactgttcttagtgtttgtgttaattcgctcactgatgcgttagtgccattgtaatcgcttctccagtgctgttgatattttggtgtgtcagtgtaagtcgtaataataagtaaatgttactaacatttggctgtaccagaagataacactggactcgacatgtccgacgatgaccaagaagaaggcagcggcggcatggaggcagaagcagccctggggatcgacccttgctccgatgacaaggagctcaagaagcagctcctcaggaaatacagcgggtgtttgggcaacctgagaaaggagctgtgcaagaagaggaagaaaggcaagctccccaaggaggcccgtcagaagctgctcagctggtgggagctgcactatcgatggccctacccctcggtacgcatgcacgggcccacacatgacacatgtatatatagctaaatggtcgcatgcatgcatggaaattccgagccacgctataaatatatatagctaaatggttgcatggcgcgccattgttgcgtgcatgtgcaggagatggagaagatcgcactggcggagtcgacggggctggagcagaagcagatcaacaactggttcatcaaccagcggaagaggcactggaagccgtcggaggagatgcagttcgccgtcatggatgggttccacccaggggcgccgccgaacgccgccgcgttctacgtcgacgcacgcctcgtgggagcaacgccggcgatgttctatgcccggccggagcatggggctcatcatggcctctggcacaataattga

SEQ ID NO: 2256 - protein, 371 aa, Sorghum bicolor
  misc_feature: Ceres ANNOT ID no. 6034346
  misc_feature: Functional Homolog of  Ceres CLONE ID no. 541719 at SEQ ID NO. 1779
  misc_feature (135)..(186): Pfam Name: KNOX2 Pfam Description: KNOX2 domain
  misc_feature (235)..(256): Pfam Name: ELK Pfam Description: ELK domain
  misc_feature (83)..(127): Pfam Name: KNOX1 Pfam Description: KNOX1 domain
MEDLSDLGGRGHLGAATSRRPAPPSLPSSSSSKVSVQVYTVPSSSAAGGGGEAAARAQGGVAPLIHASSSVGGHGGRVADLLDPIKAKIVSHPRYHRLLAAFLDCHKVGCPPEAAEEIAAAAREREAWQRAAVGDAHNTRPDPELDQFMESYSELLVAWKEELTRPLREAKEFLTTVELQLNSITNTGPPMGALISSAAEDNTGLDMSDDDQEEGSGGMEAEAALGIDPCSDDKELKKQLLRKYSGCLGNLRKELCKKRKKGKLPKEARQKLLSWWELHYRWPYPSEMEKIALAESTGLEQKQINNWFINQRKRHWKPSEEMQFAVMDGFHPGAPPNAAAFYVDARLVGATPAMFYARPEHGAHHGLWHNN

SEQ ID NO: 2257 - DNA, 5141 bp, Sorghum bicolor
  misc_feature: Ceres ANNOT ID no. 6038039
  misc_feature: Encodes the peptide sequence at SEQ ID NO. 2258
atggccaacgcgaagggctcgtccgccggcgccgccggcgcaggccacgccgacctcggcagggccatttcacacgagcaacaccaggcgttcatgatggcttccgtgcaccgggccgccccgggggccgcgaacgtgcaccagcagcacttccaccagtaccccgccggcctgatccgggcgccggtgccaatgccggttcatgtaccggtgtcacagaccccgtactccgcccagatcgcggtgccgccgccgcagccgctcatcccaccgccagaccaccgcctgcactccctgccgcctaccggtcagtaccccggacgacggcatgccgaattatgcgttggagtctccatgatctttagtctattagggtttcttcgatgatgcttctagggttttgatgcgcgctcggatctgtgcgtcggctcgtgctacatgtggggcgatgtgattatgtccccgattgttcttatattagcggattttatagtctcgtcatgattagctcccggcctagacaaaaacttatgattggcgagctttatttcatcgttgcataaagttatctgctctacgggttcagagccattttgacacacttctgagatctccatttgccattttaatctcacctcagtgtcactaatcaatcactaacaaaatttttctttcaacgagttactaattatgagttttctttcaacaagtaaccatttatgtctttctgagttttctttcaacaagttacgtaccatttgtgactagtcatatgcatatagtgattcattattagcatcgtcttcctgcaaagatcatgccaccatctttgctatgttacacttatcaattcttgatacttcatcctctcttcttcttcttcttcttcactcttcaccattttcattactatgtaaacatctaattaaggtctgctcccaaattttccaggatgttaccaggattattctccatatggcaacacagcatctttgcagcacacagcagcaaggggttttgcagactggggagtgcacaacaatgcaattgtgtccttggctcatgccactagttttgccaacgggagcaacaatatcaacagcaatggattattacatcaaaatttatccccgtataccacccatacatggactactacttacgtgcagaggccttacaacactgcttatgctcctgcaacaatgaatatgctccaaactccttcctttcacagcaacaaccatgaaaaagagtcaggtatatatatgcgcgtgtacatttggcacttacaaatggaatatttgcatgggtttgttttgtgtagtggactggtcactggtactgtggattgtttctaagtagtggggctagtcaattagaggaccttggagccaacgcgaagctagagaaaaaacaggagggcttgcggcatgtgtttgggtgcatagagttggacattggtacaaatatggtgaataattgatatcaataattgatttcttgttttggtgtgggtgtggccgcacgcccgcacccacattgccttatatggatctgttgcccttgctcagatctatgatgtagataaagaaaggagataggagtagtattttccttgcttgtattcattaatgttgtttcctccttattagagattgttggctctagcaaaacctctaacaaattaacaaagcaaatccctgatcacaacatgtcaattttatctaataatatgatttaccttgattcaaaaagaactacctcaatattctatttgagtggtcgtagcttgatttgtggtgccaccatagatgcaaacccacataagactttgacactatttatcttggagggagggactctatctttttagggtttgctttaactcatgagaacttagggaaaaacatacgtatacattacgagtgaagatgtctaaagtagaaatggtttgtcgtattcatcattatagtgcaagggttgaacacgtgaagtagggtagtgatatatgtcaaataggggcatgtttgtctttttctcttaggagattccttccaagaccacagtctcatttagatgtgtcaacccccttggtctttcaaagtcaaggtagattcatcagttttttggtaaatacaaggccaattaggacatgcagaaattttagataatttgctcacctcttttctaactcttatgcaagtttttccatccacgagcccctgcaaggattctactccatccgttctaaattgtaagtcattctggcttttctaggtccattgcttttgcgcacctagatattatgtttatatacatagtaaaagctatatatctagaaaaaagtcagaacaatttacaatttagaaaggagggagtacttggcaccatgcttcttcatttgttattaaaaattgttaggtaaagaatcgtaaatgaaccgaaggtctggttgggttatctttacgattcatgagaagttagagttacggtttggggtccattaggtctaggagcttaattcatagagaattagatgcatagcatggattacatgaggctataggttgtaagaatgtaaagggagggccatgagaggtttcggttgctgttttgtgtgtgtatgttgggggtggggggttgctggtgggggaggggtattatatactctgattaatttctaaacagcctcaatttcacaattatttctgctcgaaagtcaaatacactctgcaccttgttctttactgaaatcaaaattggctagatagatttattttattttccgcagaaaacaaggaacatttaatttacttgcgatagaaagtgcagagttattttatgattaattaatttatagacatccccgacaaccaaagatttttttccaatgcatccaagtgcatgtttcataaatatgtgatactaatgcagaagcctaagtctctaaaccttgcattttgttgacaaaaatatatgtatgtcatgcagctatatatggtttgaaataaaaggagaaatgtactgtgtgttgcttcattacttatcatttggtggtgcgcaggtgcagttttttcaaatagctttaacatgggcccatcagggacacctacctccccttttcaacttacgtctccaagctcaaccaactacacttccactcaaatctttgaggaaaccaacaacttagaggtaaacattaggactatttcagagtatggtcaaaatattttttttgttcatatgagtagttatggtgtcatgattctccaggacacttcaagagtctttggaggtggggataatgaaagcaacaacagtgaggaaccagatcccactccggctgtggagatggaagacctaaaccagggcaatgggcatattagttttacaaataaaaaagtatgttgccattttaatgcatcatatgctttgttggtactattagtattttctatacaggattgacacattatttaactcaagaaaataattatactcattgattgcataggagtaaagtcaactatttattattctctaggactgagggaaatgaattcacaattttcaactagttgattctacctaaaaagttttattataaaagaatactcaaacctagtgaacgtatggcaatgagtaggaaaatagtgtttttagatggataaacataattttaggttgttccaaactataagtcgctttggcttttctaaatacatatacctgttcgcttggctgaaaaggcatgacagaaagttcgctgatttgttgtgaaagaaaaatactgctgaatgacagacaaagtcggctaataagctcaaacgcttttgctacgtatctagatgtactagaaaagctaaaacaacttacaatttgaaatggagggagtagctaaaatgtactatatatagaaggtatcattctccagtatgtattactggtatgccaaaattcattgctgaccgcttaaacaatcatcatatttggtggcttcctcctgaactaagtctcatttttttctcatatgccaatctgttacatgcaaaaggtcaactgtcaagattaccgtatggtcttgcgcaaggacttgacaaacagtgatgttggaaacattggaagaattgtgctgccaaaggtagatacttgcacttgcatatcctgttaactgggttttactctctggtatgttcattgtgttctacattatatttccagcacgaagcccagctataatgcaagtaagattttaactgtgagctgcaagtcatcttgcaatttcacctttttctgaattctgtagaaagatgcagagcctaaccttccaatcttggaagataaggatggcctgatactggaaatggacgactttgagctcccagctgtatggaagtttaagtacaggtatcttcaccatagtgcactactattggttgctcagatgtcagagtttctgatgatcatcagtttagagtgaatatttgcctgtagtttctccagatgccaaaaagtaatgcaagcctcagcttgaggatcgatatatctgcctgttgctcggcaactgaattttatcatgctgatgcaatatattttctttcaggtactggcctaataataagagtaggatgtatatcttggaaactactggtaagtcgatcatagagtaaagtaattcttaacttggagttctgtatatatgtcaacgaattgcatgccctattctcaggtgaatttgttaagaggcatggacttcaagctaaggacatcctcatcatttacaggaacaagagatctggcagatatgtatgtaaaagttatattacccacttccttattctgtcagctacattcaaacggagtattattgttcctctgatcatatccatcttgcatcctgacacctctgatcatagagttactttccatcgtacggagtaatatgtatgtattctctcattttcttttcctgacagctctattctatcttctcatgcctctatcctctctatgctaaggttgcccgcgcggtgaaggctgagcacataccagcgccaggatgtgagtgcattaaggcaggcaatcccagagaagagtgcggcttctccgtcagtccttcggtcaagaagattatcacgtag

SEQ ID NO: 2258 - protein, 434 aa, Sorghum bicolor
  misc_feature: Ceres ANNOT ID no. 6038039
  misc_feature: Functional Homolog of  Ceres CLONE ID no. 660003 at SEQ ID NO. 1653
  misc_feature (299)..(402): Pfam Name: B3 Pfam Description: B3 DNA binding domain
MANAKGSSAGAAGAGHADLGRAISHEQHQAFMMASVHRAAPGAANVHQQHFHQYPAGLIRAPVPMPVHVPVSQTPYSAQIAVPPPQPLIPPPDHRLHSLPPTGCYQDYSPYGNTASLQHTAARGFADWGVHNNAIVSLAHATSFANGSNNINSNGLLHQNLSPYTTHTWTTTYVQRPYNTAYAPATMNMLQTPSFHSNNHEKESGAVFSNSFNMGPSGTPTSPFQLTSPSSTNYTSTQIFEETNNLEDTSRVFGGGDNESNNSEEPDPTPAVEMEDLNQGNGHISFTNKKVNCQDYRMVLRKDLTNSDVGNIGRIVLPKKDAEPNLPILEDKDGLILEMDDFELPAVWKFKYRYWPNNKSRMYILETTGEFVKRHGLQAKDILIIYRNKRSGRYVARAVKAEHIPAPGCECIKAGNPREECGFSVSPSVKKIIT

SEQ ID NO: 2259 - DNA, 3509 bp, Sorghum bicolor
  misc_feature: Ceres ANNOT ID no. 6039189
  misc_feature: Encodes the peptide sequence at SEQ ID NO. 2260
atgctcccgccgttcggcaacccgctctgggtaccggaggacgtcaacgatcagcagcagcagcacgcgcctccgccgacgcccatggggttggtgacggtgccggcgcagcaggggcacgaggagcagaacctcctggccctggcctccgccgccgccatgggggtcggtggtgttttcagctcgccggcggtgctcgatgacgactggtgcttcgaccccgtggctgcggcctccgccgccggcgcgcaggggcacctgctactggcgccgccggcgccggcccccggcgccgggtcgcagatgttctcgctcttcaacgttggcggcgcgacgttcgacgtccacgggttcgacctcggcctcggtggcctcggcggcggggccggtggggaactggtcccgttcgccggcgccgggaacgcgtcgaattccgcgtccttttccctgataccggcagggaacgccggcttcctcggctcgttcggcggcttcggcacagcgccagcgcaaatgccggactttggcggcctcggcgggttcgacatgttcaacaacggcgccggctcctccaccgcggcgccccctcctgcctcggtgtccctgacggcgccgttctctgggcgcgggaaggctgctgtgctccgcccgctggagatcttcccgcccgtgggcgcgcagccgacgctgttccagaagcgcgcgctccgccggaacgccggcgaggaggacgacgacaagaagcgcaaggctgaggccatcaccgcggctgcgggagcttcgtcggctggtggcggtgacacggtgctggacgacgccgacgacgatgacggcgggagcatcgacgcgtccgggctcaactacgactcggaggacgccaggggcgtcgaggacagtgaaaagaaggacggtaaggattccaacgccaacagcacggtgacaggcggcagcaccggcgacgggaagggtaagaggaagggattgccggccaagaacctcatggcggagcgccgtcgccggaagaagcttaatgaccggctctacatgctccggtctgtcgtgcccaagatcagcaaggtgagaattgtacccttgcatctatttgttaatctcttactatgaatcgtaggtcgtaatttagctgaattctcgcgttttggtagcaattagcatctagcattactatgtatgcttatattggtatatgtttcatggaattgatatgtgaagcttgtgtactccatggtgtagagatgtagctcatataaggtgcagttgttcccttagaattgtagatgcaaagtgattttttattgtttgtttgataagaagaattctgtgattagcatcgaggctctggcattgtaatgcgtgttcaagtcattttggtatgtttatgctattgattttatcaagctgttgtccatgttgtgatgatttttttttttttttggtcatgaactgttggtatgcacatctcaggtgcaaattttatacctagatggcagatatgtatgcaggatcgatttagccatttaagacttttctatgttcatctagggataaccgctttcaggttctataagttgcacatctttagttcaaaaaggtatatggttagcatctaccatttcagtttttgtttaggttttgatgatgctatgggtagtgcttcagttagggtcccaacctataagttgtgacttcgattatgtgcatttctttcttctctcttagaaaagcacctcctgttctatttcctgcagttattgttgcggttaagggaacctctttgtcaagtgtcatcatgactaacatagcaaaattgagatttcaatctgtccatgatctatgttcataagttgtcctgcatacagatcactatccagcacagtgtcctttgcctgattccagggcctctttctctgtttcgagtcaatcatgtaacagcttgcacaaatacaataaaagatcttccctacatctctgctgttacagtttggttcagatcaaagtgagaattttttctttctttcttttttccaccatagaacagaaaggcatcagttatggtgtaatagtgcttttttgcatgactagtttcagttatctgttttgtgctgagtacttcacctttagtcttattggtacatcctttattatattcatagatatatcatatcactaatgttagtttctccgtttgaccggccaatgaactaattgtttctgtttgcaactggtagatggacagggcctccattcttggcgacgcgatcgagtacctcaaggagctgctgcagaagatcaatgatcttcagaatgagctggagtcatccccttccacagcctcactgcctccaacacccacaagcttccacccactgactccgacactgcccactctaccatctcgtgtgaaggaagaggtgtgcccaagtgcattgcctagccctacttcccagcaaccaagggtcagtatatgttctctctgaatccacactttatatgtagctttccttcatatgaaatggtttgacagtacttgtggtgacacggtatcatactctttggttaaacagaatatagcttcagctgtaatatgaatgatgtaggcatcagtttatgtcagttttttttttttttagggtcaaagggggggagtcgttccccacctggaaaacattttattttagcccaaaacggctcataacaaaggtagcaaatacaataggtgcaacagcgacgttgcaaaaaagggggggctagttgtttctaacttagaacttacaacttcaagcttattactaactagccatggacaggacgttgcaccaggtatgcacgacagcccttttagaaacattgaaccggaattgccatagctcagctgctgctctgcagtcggcaagcagttgatcgactgtcactgtttcttgtctgaaaacacgggcatttcgtgccttccagatgtgccaacagacaagcgataggaaggtaggtaactggttgaagcattttagctgacttgtgccatttgtactgctgcaacaggttgaggttaggatgagggaaggccgggcggtcaacatccacatgctctgtgctcgcaggcctggtcttctgctttctgctatgagggcgatcgaaggcctcggactcgatgtccagcaagctgttatcagttgcttcaatggattttccttggacatcttcaaggctgaggtatgtacaatacaattgcacatatctttcttctcattctcactgtcagaacctgacacttacatagctatccataaggacggtgaagttcatgcacaagctgtcatgttctaacagcttgaaatttggactttttgttatttgattgccacatgaaaataaacttacaaggatccttattgttttcctcactgcagctatgcaatgaaggccctgggcttctgccagaagagatcaagtccgtgctcctgcaatctgctgggttccatggcgtgatgccatga

SEQ ID NO: 2260 - protein, 520 aa, Sorghum bicolor
  misc_feature: Ceres ANNOT ID no. 6039189
  misc_feature: Functional Homolog of  Ceres CLONE ID no. 118001 at SEQ ID NO. 409
  misc_feature (330)..(377): Pfam Name: HLH Pfam Description: Helix-loop-helix DNA-binding domain
MLPPFGNPLWVPEDVNDQQQQHAPPPTPMGLVTVPAQQGHEEQNLLALASAAAMGVGGVFSSPAVLDDDWCFDPVAAASAAGAQGHLLLAPPAPAPGAGSQMFSLFNVGGATFDVHGFDLGLGGLGGGAGGELVPFAGAGNASNSASFSLIPAGNAGFLGSFGGFGTAPAQMPDFGGLGGFDMFNNGAGSSTAAPPPASVSLTAPFSGRGKAAVLRPLEIFPPVGAQPTLFQKRALRRNAGEEDDDKKRKAEAITAAAGASSAGGGDTVLDDADDDDGGSIDASGLNYDSEDARGVEDSEKKDGKDSNANSTVTGGSTGDGKGKRKGLPAKNLMAERRRRKKLNDRLYMLRSVVPKISKMDRASILGDAIEYLKELLQKINDLQNELESSPSTASLPPTPTSFHPLTPTLPTLPSRVKEEVCPSALPSPTSQQPRVEVRMREGRAVNIHMLCARRPGLLLSAMRAIEGLGLDVQQAVISCFNGFSLDIFKAELCNEGPGLLPEEIKSVLLQSAGFHGVMP

SEQ ID NO: 2261 - DNA, 699 bp, Sorghum bicolor
  misc_feature: Ceres ANNOT ID no. 6039428
  misc_feature: Encodes the peptide sequence at SEQ ID NO. 2262
atggcggccaatgttggggaatcaacaagcggcagcagcagtggcgctgatgctgggggtagctttgagtgcaacatatgcttcgagctgccacaggagccgatcgtgacgctgtgcgggcacctcttctgctggccgtgcctctacaaatggttgcgcatccactcgcactcccccgagtgcccagtgtgcaaggccatcgtcgaggaggacaagctcgtccccctgtacggccgtggcaaggaccgtgtggacccaaggtcaaagaacgtccccggggcggcagacatccccaaccgtccggctggacagaggcctgccacggctccgcaggtcgaccccaacacccacttccccaacgccaacccgaacccgtggttcatgggcgggggcatcccgctggcgaacgcgcggtgggggaactacaccttctcggcggcattcgggggcctgttcccgctgctcagcttccaggtgcatgggttcccggacgccaccgcctatggccagcctgctgggttcccttacggatatggccacggccatggccatgcgttccatggcgggcatgctggaggacatgcccacgccgccgcagctcctcggcatgggcagcagcagcagcaggcggatgtgtacctcaaggcgctgctcatcctggttggctttctggtgattgcgagcctcatcacgttctag

SEQ ID NO: 2262 - protein, 232 aa, Sorghum bicolor
  misc_feature: Ceres ANNOT ID no. 6039428
  misc_feature: Functional Homolog of  Ceres CLONE ID no. 17402 at SEQ ID NO. 529
  misc_feature (24)..(64): Pfam Name: zf-C3HC4 Pfam Description: Zinc finger, C3HC4 type (RING finger)
MAANVGESTSGSSSGADAGGSFECNICFELPQEPIVTLCGHLFCWPCLYKWLRIHSHSPECPVCKAIVEEDKLVPLYGRGKDRVDPRSKNVPGAADIPNRPAGQRPATAPQVDPNTHFPNANPNPWFMGGGIPLANARWGNYTFSAAFGGLFPLLSFQVHGFPDATAYGQPAGFPYGYGHGHGHAFHGGHAGGHAHAAAAPRHGQQQQQADVYLKALLILVGFLVIASLITF

SEQ ID NO: 2263 - DNA, 2535 bp, Sorghum bicolor
  misc_feature: Ceres ANNOT ID no. 6039802
  misc_feature: Encodes the peptide sequence at SEQ ID NO. 2264
atggcggcgccgccggcgagggcccgggccgactacgactaccttatcaagctgctcctcattggggatagcggtgggtgctgctagatctctctgtctcagtgaataaacgggtctatagggggcgtactccctaggcgcgcgcgcgttcgtgggatcggagttggattcgggcatacgatcttgctcctgttgcctgtggtcgtgttcgctcgattgatccgtccttcgtctggggtagagactagagagtggttgagatgttgcttgctggttcctcaatcctttgtgctatctacctaacgtaccgtacgttaatcagtaggcatctggcgcattagtcggagatgcaaaattgggcactagtgagaaggatggattatgctttactgtgagttttgaacattcactcgttaaattgctgtgggtgtgttttttttccctccacttccttgatgagcattcattcgtgggaactctttggttaaaggaagatgcgcactggaaatagtccaatttgtggaaatgtcctttcaaggctccatgttctgcagattaagtttgtagactggttcaaaggttgacatgttgaactgatacttcctggttaagcgattatttgttttaccagttcttttattgagcagagagactagaatattcacttcaaactgcacccactttagggggtttagacaatgtagaattatttattgtgatgttgcttgctgttctatcttctataattatttgcctgttagtgtgtgtaccatgtaaccatgaaacttatgaaacacgctgtgagtttttgcggggcagataacttgtaaaagtggcagctgctggacgttagatggagcagtgaactctgttgaacgaatattcctgggttggagaaactgcctctacggaatttaactaagccttagccaggaaatatgcctcaagtaaataagagcattgtcttgttctctctattttattttttattatctatatttccatctttcctggacatccttactgctgagagcctgagactaacagtgttctcggcacacaatggtgattggttccattgtcatacatgtctgtatgcataggttttgagcttatctagtatttgattgaagtttgttgattcctggcataacctgggtattgtacttattcatgagtctttgtccagttcctgtattgtgataacatgcaaagtgtaggtcttgatagctatggtacaaggttgtgtttttgactgaattgttaatgcataaactagtggcatgttcatcagtagagttttttattgcgtcaattgcatgatctcttttactccttatctatgttcaggtgttggcaagagttgccttctgttgcggttctctgatggttccttcactacaagctttattaccacaattgggtaggtccctttgttgaaactgctcatcatgctttcttacatcaaatgggaattcagcattcgttatttactccacaatgattttgtacctgttactgtgcagtattgactttaagatacgaacaatagaattggatggcaagcgtataaagctacagatttgggatacagcgggccaagaacgcttccggactattaccactggtatgatgttttgtttcatttctgattgacacttcgaaactatatggtgacccttctgatccaatggactttattttacctcagcgtactaccgaggagctatgggcattttgctggtttatgatgtcaccgatgaatcttctttcaacagtaaactcttcttaatcatatactccaattccttaatgcttccattttaaacgattttaccatttattcgcaattggttcatctaaaatacagacatccgaaactggattcggaacattgaacaacatgcctctgataatgtcaacaaaatcttggttggcaacaaggccgatatggatgaaagcaagagggtacatgcctgaactcattgttctccttaaatgtttgactgtttccgttctgtattacttgtttgaaatcagtagttagatgcttatttttcccccttcaattagataaataataaatcctacttctactattgcttcaggccgtacctactgcaaaaggacaagcacttgctgatgagtatgggatcaagttttttgaaacggtatgttgctttcagacttgagataccttcagtgagcagtttttattattattaaaagaacagagtttgcagttgttttaatctcacagatttctgtgtctttcagagtgccaagacaaacctgaatgtggagcaagtgtttttctccatcgcacgtgacatcaagcagaggcttgcagagactgattcaaagccagaggtacaaataactgcgcttagttatgcttgacattgcatcattcatcgtgttcagtgttctgagcaatatatctttgcactgtaggacaaggcaatcaaaattaacaagccagaccagggttccgaggcaccagctgcccagcgatctgcctgctgcggctcataa

SEQ ID NO: 2264 - protein, 193 aa, Sorghum bicolor
  misc_feature: Ceres ANNOT ID no. 6039802
  misc_feature: Functional Homolog of  Ceres CLONE ID no. 543118 at SEQ ID NO. 994
  misc_feature (17)..(157): Pfam Name: Ras Pfam Description: Ras family
MAAPPARARADYDYLIKLLLIGDSGVGKSCLLLRFSDGSFTTSFITTIGIDFKIRTIELDGKRIKLQIWDTAGQERFRTITTDIRNWIRNIEQHASDNVNKILVGNKADMDESKRAVPTAKGQALADEYGIKFFETSAKTNLNVEQVFFSIARDIKQRLAETDSKPEDKAIKINKPDQGSEAPAAQRSACCGS

SEQ ID NO: 2265 - DNA, 1372 bp, Sorghum bicolor
  misc_feature: Ceres ANNOT ID no. 6039826
  misc_feature: Encodes the peptide sequence at SEQ ID NO. 2266
atgagcaccatgaagttttgccgtgagtggtatgcacccttctacattgatcatcttcctctctcttgcattagattgatcatacagttacttgatggatggacgtgcagcaacaacatcctgtaccccaaggaggagagagacaggcgcaccctattcttcgcatgtcgcaactgtgagcaccaggtacaactcatcaacctctatccttgttccaccaacaaatccaatccaatgttcctgctatacccctcatgagtgcgtcactacaagaatggtgtttgggcacagcacttggatgatggggctcggatgaggactaaaatgtttataggatgggggttgttccctttttttccccaaattttaagattttggtagggtcatgccaatgatatgtgtgcccttcatttccatctttggctagttaatttcctcatttatttcatgtatgcatagcaaagttaaacataattgtaacaggaaaatgattatcctgttcctgtccacaccaaaaatactacacttgtcctacagtgtttgttgtgtctgtgtttaatgaatggtgaattgagtaatttgccatccctcaaacaccctttcttctgcttacaagttaacagaactattcctggtccgattcaggaggtctctgacaataactgcgtctatcggaacgaggtgcaccacactgctggggagcgaacgcaggtcttgcaggatgtagcttctgaccccactcttcccagaaccaagactgttcgctgtagtgcttgtgggcatggagaggctgttttcttccaggtttttttttcttgttttgccttgtcgcattttcatgggttgcattttcatgttatattgttatgcaatctaaatgacttgttaaacaacatagttcgccaaaattctgcaccttgtcaatgttaactttggatgttgcatcccctttttttggcagtatgtatcctatcctatatatgttgaggcctgcatctatatccctgacatgaacatgtcctaattgacaagtcaggagtcagttcccaagaaaatgtggccttgtattattgttttgtgccagaataagagtcctcttttgtggagtaatactactaaatgccattagaggcgtagcgcaaatcactttgcatgtctctttctgtattcttcaaaattaccacatctgcagttaagcaatatttatatttcaatagttgcaattgatggcactgatcctacttatgttttgagacaatcttaatcccaatgctgtttttatcatttgcaggccacagcaagaggggaggaggggatgaccctgttctttgtgtgctgcagcccagattgtggtaatcggtggagggaatga

SEQ ID NO: 2266 - protein, 114 aa, Sorghum bicolor
  misc_feature: Ceres ANNOT ID no. 6039826
  misc_feature: Functional Homolog of  Ceres CLONE ID no. 12256 at SEQ ID NO. 417
  misc_feature (4)..(58): Pfam Name: RNA_POL_M_15KD Pfam Description: RNA polymerases M/15 Kd subunit
MSTMKFCRECNNILYPKEERDRRTLFFACRNCEHQEVSDNNCVYRNEVHHTAGERTQVLQDVASDPTLPRTKTVRCSACGHGEAVFFQATARGEEGMTLFFVCCSPDCGNRWRE

SEQ ID NO: 2267 - DNA, 1860 bp, Sorghum bicolor
  misc_feature: Ceres ANNOT ID no. 6040047
  misc_feature: Encodes the peptide sequence at SEQ ID NO. 2268
atgatgtaccatgctaagaatttttctgtgccctttgcacagcagagggctcagaataatgaacatgcaagtaatattggaggtattggtggacccaacgtaagcaaccctgctaatcctgtaggaagtgggaaacaacgcttacgatggacatcagatcttcataatcgctttgtggatgccattgcacagcttggtggaccagatagtgagtattctgttctcagttgagtatttgtcagtgtggttaacttgatgcattgctgaaacagtcatgtatatgtgtttattaattaactgcgtacattatacgtgccatttatatgtagcaaactgggaaatcaattaaaccgactatgtaaatgttcaggatcagattgctgcacacttttcgaaattcctatgagcatgctatttaagtatgtgtgagcttctataactgtgtgctatgttattaaatccaatcacattggaaaatgtttatgccttgagaactgtaatccttgtccatgggaaacagctttgagtgttgcatgtggcacatgtctgactctcttaatccaaacttgacttttgataagctagctggttatcatgagggtacttggtgttttggggatttcagctacaagtactttgtatctaaggctcttatcatatttcttcaggagctacacctaaaggggttctcactgtgatgggtgtaccagggatcacgatttatcatgtgaagagccatttgcaggtgaagaatttccttcaaaggaaacagatttcaaaatgtctcactgcaactaatactttcctttccttggtgcctgtgtagaagtatcgccttgcaaagtatataccggaatctcctgctgaaggtgaatattgttgtggccttcaaattttttcttctgcctgtctccttcacttcggtcaaacacaagaactaaacagccattgttgccttttgttacgatggcatctcatgtaggttccaaggacgaaaagaaagattcgagtgattccctctcgaacacggattctgcaccgtaagtgatctttactcagctgtgtcctgtagcatagctgttatggctggtgcctggtccttatggattacacaaatattctgaaatgtttcagaggattgcaaatcaacgaggcactaaagatgcaaatggaggttcaaaagcggctacatgagcaactcgaggtctgttattgaatgatgttaactaatttatttctgttcaagtttacatcattttagtttaccaacaatcctacttagctggggtaagctgatcttttagtccattcttaatattcacttattatttgtcaagttacacctaaggatggttccttctcgtggttgtagtaatgcttagttgtcaataatctcttgttggcatttcttctgttttgacttctttcttgtagtttatgagttcttttagcttcaacatcaatctaaattttccttgcgaactctcttttgcttatctgaataagttacattttcaggttcaaagacaactgcaactaagaattgaagcacaagggagatacctgcagatgataattgaggagcaacaaaagcttggtggatcaattaaagcttctgaggatcagaagctttcagattcacctccaagcttagatgactacccagagagcatgcagccttctcccaagaaaccaaggatagatgcattatcaccggattcagagcgagatagaacacaacccgaatttgaatcccatttgatgggtccgtgggatcaagaaatctgtgcgaaaaacatatgcggcgttgcattcccagtggaggagttcaaagcagaccctggtatgagcaagtcttaa

SEQ ID NO: 2268 - protein, 265 aa, Sorghum bicolor
  misc_feature: Ceres ANNOT ID no. 6040047
  misc_feature: Functional Homolog of  Ceres CLONE ID no. 115924 at SEQ ID NO. 1383
  misc_feature (47)..(98): Pfam Name: Myb_DNA-binding Pfam Description: Myb-like DNA-binding domain
MMYHAKNFSVPFAQQRAQNNEHASNIGGIGGPNVSNPANPVGSGKQRLRWTSDLHNRFVDAIAQLGGPDRATPKGVLTVMGVPGITIYHVKSHLQKYRLAKYIPESPAEGSKDEKKDSSDSLSNTDSAPGLQINEALKMQMEVQKRLHEQLEVQRQLQLRIEAQGRYLQMIIEEQQKLGGSIKASEDQKLSDSPPSLDDYPESMQPSPKKPRIDALSPDSERDRTQPEFESHLMGPWDQEICAKNICGVAFPVEEFKADPGMSKS

SEQ ID NO: 2269 - DNA, 4471 bp, Sorghum bicolor
  misc_feature: Ceres ANNOT ID no. 6040882
  misc_feature: Encodes the peptide sequence at SEQ ID NO. 2270
atggcttccggcgggtcgtcgtcgtcgtcgtcccgggcgtggacgcagcggcagaacaagcagttcgagtgcgcgctggcggtgtatgaccgggagacaccggaccggtggcacaacatcgcccgctacatgggcggcaccaagtccgccgacgaggtgcgccgccacttcgagcagctcgtccacgacgtcacccagatcgaggccggccgcgtccccttcccccgctacggctacggcagcgcgccgcccgccggcggcggcggccttgacgacaccaggtatatatatactatacctaccttagtcatcgatcacatcaaccactttggctcgtcgtcgcagttagttcggcagtttggtacgtagctaggtctaggtgtgtatgcatgtggaactgtggacatgcatggcatgcactacagttgagttgagctgttgctggttagtcacatgagatctaatcctgatgcatgcatgtgtgacagtgatgagctttattattggaaaggtagctagatacttcctccataccataaagaaaattattttgaataaggtttgggtcaaacattagaaatataaattatgaataactttaagttgttgaatttgaaaatgtggaaacgatataaaaaaatttgtcttgaaagatacttttataaaagcatacatataccaccttttgataaatatttttataaatacaatgagtcaaaattaggctttagagacaatgtcgttgtcctaaataacttgagggagtacatacatatatatatatatatgtagcatatatattaaaacaaacaaaacggtgctatatatatacgtgtagatactagatagatatgtgtacattaattccacatgcatgatgcatccggcctgtatatcatcctttgccgacatctccgttgtctgacacatatgaagagctagcaaagctacgttgacacatgccctcacatgctagctgcatgcacgaacgcatctcttagggcctgtttagacgagctaattaaggctagctactagttagttagactaaaaaatagcttaaattaacttagtttggctagctagctaactagttagaaacttgactaaaaaatttatcctatctattagcctatctatttggatgcacttggactaattttcgctagctagtaattagcacttgttccaaattggtccttaattgttcagtcaaaaaaaattggcccttaattatgtgttttattggatgcaccagcagggccaagtacatgaagttccagtgattaagacaaatgacggctgcccgagagacgcgtacaaccatgcatgtacatatatatttatatataatatatatgtatgacagttctttgcaactgtggtgtaaacttatactattaccgtgcaatggctctccgaaaataaacctagctatattagggaagaagaaggaggcgaagaaggaagaggtatcatcgtaattttaccctcctgtatatatatgatgtacaattgtagattagttaattattagactgacattgatcgatcgatgatcggtcaatgctgctgaaataatgtacatgtaagctatattctagctagtatcacaatcaatgtaaagtgttcatcagcttctccattcgagaacaaatacttccaaacactgctctattgggcacaccgcttttcatgagaataaacgtactatctctcaaaaattaataataagaataaacttatcatgtacatatatattcaatatagatttattactaccactactcggatatatatatatataattccattggacacacgacactttgactgctccaagggatatgctattcttccgtcaaatattctgcttttttttcccgagccctcggattatggagttttgttttatttactggattcatatatacatttcgaaaacacaagttttcttggcctcatgctcattaatctcataaaaagggtgctattggatttataattttttttagtagtccctgttcaaatcatacgtcatgctttagccgtaatctaaatcaaaattatttaatttaactaagtttatagaaaattataataatactactgtaccggattaattagcttgactaaatgatccacatgaaatatgttttcacagtgatttatttgaactagtagcttgtctatgtgaagttagacttattagcacgaagctaaagttatagatgcagatagattatatttatattttggacatgggatttgaaactagctaggggggggggggggggtttatctttatttaaagaaaccattacatgtatatgatgttttctctatcaagataaatatttgaaaagatatgagtatcgctgcacaatatgatgaactagtctctttttctcgttgaaagaagaattatattagataataactgggtacgtcaatattattacaaacactctggattacacataaatatctagatttacatctaaattatatctagactagattgtgaatagctccagatctcaaaatcaaatctgtacgacactttgcaatatgaatgaccgcacatgcaaagactcgacaaaagacatgagaaaagatgcccaacaaacgacaaccaacattcatggtatctttcttctttaatttttttgagatcacgacttcacgtgtttttcattaagaagaagagccgaaagaaacggcaggtaaccgatacaatgagttcgcaagtaatccaaggattaccattgaaacttagaacacaaacaaaagcaagaaacaagagggggggtcctccacctaacaaccccaacagctaagccaaaaacaagaaggacaactcaacacctaggtagccagcagtgttcggagccgcaacagataaggacaactgacggccatgcatccgtccccacctcttcaacctcaacgaccaacccagccggagacgcgtcctcagtggcaaagcaaaccaaccgacggccaagcatccgtctccacctcagcaacctcgacgaccaacccagccggagacgcgtcctcagtggcaaagcaaccatccgacggccaagcatccgtccccacctcagcaacctcaacgacccacctgccggagatgcatccttggcggcaaagcaacgcacctcggcggcaaagcatccgccggaaacacctcggtggcaaagcatccaccggaaagagcacaacagcagctacaacaaacactagccagcaaacctgagtggagagcagcatgaagcacgaaaaggcttggcacgacgcccgagggaccgcgcgggcagcagaccacgcgtagaaagaacttcagcggcaacgccttcaagaaggggagcgacgccgttgccggcccatacgggcagtggcggagccaggattttacggctgggtattccgagcatataaaaatttttgatgtaaatgtgcaatagtaacaaggctttgttaatttagttccacccaaaaactaaaaacatttttaacatttttatcacattgaattttgcagcacatgtatgaagtattaaatatagataaaaaataactaattatataatttatctataatttatgagataataaatcttttaagtctagttagtctatggttagacaataattatcaaatacaaacgaaaacatcgccaaaacaaaattcgtgtagagaactaaacaaggcttaagcaacgtacaagatctgaacatagtgtcatagtgccattttctctaataatttcgatgcaaatgtgctagtgtatgtgctcaccttgcctcaagcagcaagccggaggccggaactgaaaccgtggacatcgccggctgccggagcgccgggctcgccagtcgtcactgcccaccggtcgccaaagctaggacgctagggtcgggagttggtgcgatgcggagcggtgcgatgcgatgtgagttgggagactagggggttgtttggttgatagctacaatttgccacactttaccttaggcaagtttgaccaaattggcaagtgtttggttgacaactaagcttaggcatgattcttttggactccacatgtcatagagtttaaaagtgtggcaagatttctttaggcatgacaaagtgtggcaaccaatttgttagtcacactttttatagcttgccacacttacctaaagttagttgtggtagactatggcttgcaaccaaacatcccctaaaagcgacaaccagaaaacgttgccatcttttttttctttactttgttgattgagctgaaaatcactgctttctgttggctttgggccagatttacaccatgtagcaactatatacgttatacttatacgtatacatatatgcatttgtgtttatttccaaaatcttgggtattccatggcatacaggggaatacccctggcgccgcccatgcatacgggcgaggctttcacctag

SEQ ID NO: 2270 - protein, 109 aa, Sorghum bicolor
  misc_feature: Ceres ANNOT ID no. 6040882
  misc_feature: Functional Homolog of  Ceres CLONE ID no. 143475 at SEQ ID NO. 1838
  misc_feature (11)..(61): Pfam Name: Myb_DNA-binding Pfam Description: Myb-like DNA-binding domain
MASGGSSSSSSRAWTQRQNKQFECALAVYDRETPDRWHNIARYMGGTKSADEVRRHFEQLVHDVTQIEAGRVPFPRYGYGSAPPAGGGGLDDTRGIPLAPPMHTGEAFT

SEQ ID NO: 2271 - DNA, 2417 bp, Sorghum bicolor
  misc_feature: Ceres ANNOT ID no. 6041092
  misc_feature: Encodes the peptide sequence at SEQ ID NO. 2272
atggagttctggggtggcctccctttctctctcgcaaactcaattcgccgcgataactgcgctttgtttgtcttgttttgcgataccgttgtttgattttcgtcggatgtttcaggacgctgggactagaacatactactgcatcttagggcgttgctgtgacatataaattctcctcttcttttttcttgtttatataattatatatgtttagttgatgtttgatgtgatgcttttgttctactgccagtagcaatgcggcaatacctattaaatgcttgaagtcagacacgaatgtgtttgtgcttgtttagggtcatcttataggacatgatgccactatgccactgaatttggtctgtgcgttgcgggatgattgttcttttgctacccttgttaaacagcatcagatcaatgtaaactatgtcagattgctctgtgattcttttgttctactaccattgcctagattaaatggttgaaatcatacatgaacgtgttctgtttgtttaggggtcttattataggacgtggcatcactgaatttgttttgcgcattgcgggatgtttgttcttttgctacccagtatcagatttgcattcttaatgtaacctatctcagattgcgccgtgttttgcaggtctcgaggttaagcctggaagcactgttaaatgtgagcctggacatggctttatcttgcacctttcccaggtaaatcttattgctatgtgtacttcttttctccactgttcgatgctatgtgtacttactctttttctccactgttggatttgctttgtatacttaattggatttaatccggcaggctgctcttggggaatcaaagaaaagtgacagtgtcttgatgtatgtcaaagttgatgatgagaagcttgccattggcaccctctctattgacaagaaccctcagatacagtgtgatttggttttcgataaagagttcgagctgtcgcacacatcaaaaactaccagtgtctttctcacaggttacaaggttgagcagccaaccgaggaagatgaatatcctttttagcttgaatttgttctatttttagtaggagtggtcaaaacaattttttgtatggagtacttgcttccttgaccttctttttgccttcttcttctttttgccttcttccacaatggatcttgattctgaagatgaggaggaggaggagctgaacgttcctgttatcaaggaaaacggtatctataatctctgttgcatgaaatttgtttccatctttcttagctttagcttttgcttgatgagatggattatgaacacatttacttatgtctcaaggaatctctgttgcatgaaatttgtttccatctttcttagctttagcttttgcttgatgagatggattatgaacacatttacttatgtctcaaggaaaagctgaagggaaggagaagcagaaaagtcaagagaaggcagtttctgcagcttcaaaatcaagtcttgcttctaggcttgttggaaagaaaagcaaggatgaggatgattctgatgaggatgagactgatgattcggatgtggatgagacggatgattctgatgagggtgagggattatctcctgaagaaggcgacgatgatgtgagttgaaagatggataaatggtttgtctacatgtcatggtagttccatgttgataagttccatcgttgtaggattcaagtgatgaggatgataccagtgagggtgaggaggaaacgccaacacctaagaaggtgcacttatggattttactcctttgttaatttcagtaatttgttgttatcacatatcactgtgatatcaatgtgcccttatggattttactcctgtgttaatttcagtaatctgttgttattagatatcactatgatatcgatgttatgtttttcctgcctttttcagccagaggcaggcaagaagagagctgctgaaaatgctctgaaaactctgctttctgataagaaagtaaaggttgccacaccgtcagcccagaagacaggtgtgtactcaagtagcttgtgctagggcgtcaagtattcttttttgccatgaaactcttgctatgaatttgtaatttgttcctcttgcaatgcaggtggcaagaagggcgccacccatgtggcaactccatacccagccaagcgggcgggcaagacccctgcaaacaatgacaagtcaaaggagaggtctccaagatctggtcggtcggtcccttgcaaatcgtgcagcaagtaagtcggcacagttttatttggtgagcctatttggttatttgttggtgaaaaaactacgtattgatccttggtctctattggttgttctgtccaggacgttcaacagtgagatggctctgcaggctcactcaaaggcgaagcatcgggccaagtga

SEQ ID NO: 2272 - protein, 289 aa, Sorghum bicolor
  misc_feature: Ceres ANNOT ID no. 6041092
  misc_feature: Functional Homolog of  Ceres CLONE ID no. 15990 at SEQ ID NO. 524
MEFWGLEVKPGSTVKCEPGHGFILHLSQAALGESKKSDSVLMYVKVDDEKLAIGTLSIDKNPQIQCDLVFDKEFELSHTSKTTSVFLTDEEEEELNVPVIKENGKAEGKEKQKSQEKAVSAASKSSLASRLVGKKSKDEDDSDEDETDDSDVDETDDSDEGEGLSPEEGDDDDSSDEDDTSEGEEETPTPKKPEAGKKRAAENALKTLLSDKKVKVATPSAQKTGGKKGATHVATPYPAKRAGKTPANNDKSKERSPRSGRSVPCKSCSKTFNSEMALQAHSKAKHRAK

SEQ ID NO: 2273 - DNA, 1199 bp, Sorghum bicolor
  misc_feature: Ceres ANNOT ID no. 6042650
  misc_feature: Encodes the peptide sequence at SEQ ID NO. 2274
atgcaggaagctctcatctctccgggcaatgcctgccgctttcgctcagccttggagctgaagccgttcgccttcggggaccagcgcctcgcctcgccgccgggctacctcaacctcgccgccgtcggcggcggcgacgacgcgctgttccgctgctcgtcgccgttcagccccagcctcggcttctcctcgccgtcgccgctcgcgaccaccccctccgtctcgctctcgccgtcctcctccgcctcgctcgtcgacgactgcgacgacgccgcggccgccgacgtggacgccttcgccacgggccacaggctccagctcgcccgcctcgcgctgcagtaccaggaggtggccgaccgctacgagctctgcctcgcccgcctcgccgacgccgcggacgaggccgccgcgctccaccgcgagaacgccgagctccgcgtcgccaacgccgacctcacgcgccgcctcgcgctcctcagcggcatcggcaagcaggccgccgccgccgccatcgccgacgaggtctgccgcctccgcttcggggaccacaacaaggccgcggagtgcgctcccgagaagcccgccgccgtgctgcccaagagcatttccgtccgctccaacgactacctcaagatcaacaagcccaaacaggtgcaggcccccgccacgccggccgcaaacaaccgcaagcctcgcgcgtcgaacacgaccaacaacccaagctcggtggtgagccccagttcacgatcacgtctcgccaacctctatcacgtcccgcttgttaattggcatctgacattgatgcatgcaccttgatgtgatgcgatgcgacgcacggatcagcagcgcgtgtacaagggcaatggcggcgacaagaaaggcgaggaacccaaggagccgccacacacggcggcggcggcggcggcgggcggcatcggcatggagctggaggtgtacaaccagggcatgttcaagacggagcgtgcaacaagtgggagcagacgggggcgtgctcctacggcgaccagtgccagttcgctcacggcgtcgccgagctccgccccgtcatccgccacccgcgctacaagacccaggtctgccgcatggtgctcgccggcgaggtctgtccctacggccaccgctgccacttccgccacacgctcacccccatcgaacgcctcgacctgccccgaccttag

SEQ ID NO: 2274 - protein, 349 aa, Sorghum bicolor
  misc_feature: Ceres ANNOT ID no. 6042650
  misc_feature: Functional Homolog of  Ceres CLONE ID no. 207419 at SEQ ID NO. 1465
  misc_feature (279)..(300): Pfam Name: zf-CCCH Pfam Description: Zinc finger C-x8-C-x5-C-x3-H type (and similar)
MQEALISPGNACRFRSALELKPFAFGDQRLASPPGYLNLAAVGGGDDALFRCSSPFSPSLGFSSPSPLATTPSVSLSPSSSASLVDDCDDAAAADVDAFATGHRLQLARLALQYQEVADRYELCLARLADAADEAAALHRENAELRVANADLTRRLALLSGIGKQAAAAAIADEVCRLRFGDHNKAAECAPEKPAAVLPKSISVRSNDYLKINKPKQVQAPATPAANNRKPRASNTTNNPSSVQRVYKGNGGDKKGEEPKEPPHTAAAAAAGHVQDGACNKWEQTGACSYGDQCQFAHGVAELRPVIRHPRYKTQVCRMVLAGEVCPYGHRCHFRHTLTPIERLDLPRP

SEQ ID NO: 2275 - DNA, 884 bp, Sorghum bicolor
  misc_feature: Ceres ANNOT ID no. 6042920
  misc_feature: Encodes the peptide sequence at SEQ ID NO. 2276
atggatagcagcagcggcagccaggacaagaaatccaaaggcaatgatcgccgtgaagcaaaaggtccaccattttcttgctttgctttgttttgctttacctttgttcactgcctcttgagcctgtttgcttgagcttatctgccgaatctgtcaaccattcaacaatgtttttctcttacaataaatcaacgaatagtactttcagccatgacttttctgtcaagcaaacagtctcagctttttagttaataccattgtgttcaagataatagctcatatgatttcgttattttaattaagagatcttgcaccaacatattctaaaccttcatgctttagttccgtgtacatgaaaactaaaatagatggtgcacagtacccatttaggatgccttataactgagaaaaactgacggggcaaacaggacgccaaattatttaccatcagaccaacctaatgaagatgcagtatccagttttagccccttccagttccagcatacgaaaaataggggaaaattattcctaagaaaactgcaaattccgatggcgaacataggattggcaaccataatatatatttctatatggtttgctaatgttttttcttattgcagaagctaatggcactgcacagcattttgttgatttcacggaagcagaggaagatcttgtttccagaatgcacaggcttgtggggaacaggtacactatacatatatgtgttaataaaatcagacgaaataatgtcttccattccccctaattgtgttgctcatacaatggcattatgtaggtgggagattatagcagggagaatcccaggaaggacagcagaagaggtagagatgttctggtccaaaaaacaccaggaaagatga

SEQ ID NO: 2276 - protein, 78 aa, Sorghum bicolor
  misc_feature: Ceres ANNOT ID no. 6042920
  misc_feature: Bit Score of 56.1 for HMM based on sequences of FIGURE 30
  misc_feature: Functional Homolog of  Ceres CLONE ID no. 22671 at SEQ ID NO. 590
  misc_feature (30)..(75): Pfam Name: Myb_DNA-binding Pfam Description: Myb-like DNA-binding domain
MDSSSGSQDKKSKGNDRREAKEANGTAQHFVDFTEAEEDLVSRMHRLVGNRWEIIAGRIPGRTAEEVEMFWSKKHQER

SEQ ID NO: 2277 - DNA, 884 bp, Sorghum bicolor; identical to SEQ ID NO: 2275
  misc_feature: Ceres ANNOT ID no. 6042920
  misc_feature: Encodes the peptide sequence at SEQ ID NO. 2278

SEQ ID NO: 2278 - protein, 78 aa, Sorghum bicolor; identical to SEQ ID NO: 2276
  misc_feature: Ceres ANNOT ID no. 6042920
  misc_feature: Functional Homolog of  Ceres CLONE ID no. 25795 at SEQ ID NO. 1518
  misc_feature (30)..(75): Pfam Name: Myb_DNA-binding Pfam Description: Myb-like DNA-binding domain

SEQ ID NO: 2279 - DNA, 2526 bp, Sorghum bicolor
  misc_feature: Ceres ANNOT ID no. 6052977
  misc_feature: Encodes the peptide sequence at SEQ ID NO. 2280
atgtcgcacttcgggaggtcgggtccgccggacatccgcgacaccttctcgctgctcgtcctcaacatcagcttccgtgagcgagacctaaccctagccgctccagttcagcgccgccgccgcgcgagcgcgccctctctctctctctctctctctctaatcgcttccttctcgtattcgtattcacccgcttcgcaggcaccacggccgacgacctctacccgctcttcgagcgctacggcaaggtcgtcgacgtcttcatcccgagggaccggaggtgaggcctcggtttcaattttcggactagtgcttctatgcctgttttgtttcctcaggttttgtttgtcggtggctcgcaggaccggggactcgaggggtttcgcgttcgtgcggtacaagtatgccgacgaggcgcagaaggctatagatcggctcgatggtggggtctggctttttctgggggattttctacctctatcgattaggtacctgaactacttctctttttttttgtgtgtgtgtgtgtgtgcaggccgtaatgtggatggaaggaacatcatggtgcagtttgcaaagtacggccccaatgctgagccaatgtgagtaggcaccacctcttttcctctcttgttatgttgatatatcctgttactatgttctccaggcaattagtttttctcctagagtccaggcgtgagtcgggtttctttcccccttcttattcttcttaatataatgatacacactttctcctgcgtgttcgagaaaatatatcctgttacttgtggtgtttattatgtagttaacataacaatatgaaccatgttgcttatctcatttgttgtaaaccactcttggtttgatgtgactaactatatgctaacagcaaggaatatgattaggttgacgtgtctcgtttctttatttgtctgtgatcttgatgatggttgatgactggttgtctatcttttatcacccaaacacgtcttagtttaatctactgacatgagcataccaatgtactagttatgccttatttcatctagtcttgataatgtgaatgaacattttggagtttgtttgttcttagttcaaaaatactaaaatgagactccagaaacaaaatcagcaaaatcttgctgttccctatatttttgggttactgatacaggaaataggttgagagaatcaattgtctaataatatgtagcattgtgtttatccagctttaagatatatagcttgtttttcttatggtaaaattccagtacccatacaatactcattctatacatctagtctgtcatatgcattcatgaggtagcttgtgtaaaacagtttgtttagttaaatgtatacaactcaaagacaacacttgcattcaatctcatgtactaggctctgttacagaatgtagttttttttttctccttgaatttatttatctcctgaagctgtgtgcaaagagagtgtatgcatccatttatcttatcttctaattatttcattcaggtcaccatagtttgtccctgctttttttgtttctgtagccaaaaaggaagggtcaaagagggggctgagaaatcacgagacaggtcaagaagccgtagtccaaggccaaggtgaagactttagttccttttacattatctccagaattactaaatgtgttaaatggtatccccccctttgcgctggtaactatccctccctccaggcctccgttgtagtcattcacgtctttctctgaaactatgccagcatgttttttttttcggaggagcaaactgtcagtattagcactgctttcactttatttgcaaagcattatttctaatgtaccaacttagcatatccttaacttattcattttgatttactagatcagcagtctaggcaacttatagtgcattcattgttttaactaggaatagagacagagatcatagaaggcgaagtcgaagcaggagtaggagcagagaaaggcatggtcgtgatagagacagggactatcgtcgtcggagcagaagtagaagccgaagtccaagttcaagccctgaccgcaaaagtcatcgtagagcaagagatgatggcaagcgcaagagcaggagtaagagtagaagcaagagcaggagcaggagcaggagcaagagtatgagcagaagcaggagtagaagccgctcgtaccataggttcctcaataccagtttgcagttccaccattttgttattctttacatgttaccaaattctaatttgatttctttcaacagtgcttcacctgcccggcgtagtgctagccctcacaagagcccaccgccacggaggagccccactcctgaaaagcataccaatgggaaagattcacctctgtcacgcagtgtttctccatcaccaaagcgtgcaagctcccacagcccaggcagcgatggcaaggttagattgatgtttgactgttggctatttagttttttgcccattcatttaagtatcttacttttgaaagcaaattcacgtcaggaatga

SEQ ID NO: 2280 - protein, 296 aa, Sorghum bicolor
  misc_feature: Ceres ANNOT ID no. 6052977
  misc_feature: Functional Homolog of  Ceres CLONE ID no. 1492 at SEQ ID NO. 465
  misc_feature (18)..(89): Pfam Name: RRM_1 Pfam Description: RNA recognition motif. (a.k.a. RRM, RBD, or RNP domain)
MSHFGRSGPPDIRDTFSLLVLNISFRTTADDLYPLFERYGKVVDVFIPRDRRTGDSRGFAFVRYKYADEAQKAIDRLDGRNVDGRNIMVQFAKYGPNAEPIQKGRVKEGAEKSRDRSRSRSPRPRNRDRDHRRRSRSRSRSRERHGRDRDRDYRRRSRSRSRSPSSSPDRKSHRRARDDGKRKSRSKSRSKSRSRSRSKSMSRSRSRSRSYHSASPARRSASPHKSPPPRRSPTPEKHTNGKDSPLSRSVSPSPKRASSHSPGSDGKVRLMFDCWLFSFLPIHLSILLLKANSRQE

SEQ ID NO: 2281 - DNA, 7593 bp, Sorghum bicolor
  misc_feature: Ceres ANNOT ID no. 6054789
  misc_feature: Encodes the peptide sequence at SEQ ID NO. 2282
atggcggcgctcctcgacgccggcctcttcgggcccgcccaaacgctggtacgtgtgccgcgatccctgcctcccctccctccttccctcccattctccctgcgctcgaatctctagggtttcggggagagcaaaagcggtttcggggttcgccgggcgcgtctggggcaggcctaggtctctcgcctgcgacgtgtgcgagcggggttgggttgctgcattgggtgatggagcgaggcttccgttgcagcagtgattactaattactcattcgctcttctcattcacttgcaggggtgtttccttgtgtcgtcggcgggtgcgggcaacgatgctggcatgtccatgaaggtggagagcctggtaagctcgagcttccctgagcagcagctctgcaactggtgttagtttggtttggtctaacttattgctatgcttctgtcaactccacttcctgtctcagcttctgatgccgcattgtggaaactaaatgtgttgattactagtttcttgacagtcaatgcacggattgccccgtccatctacatttcacgatgccagttctgttgcttacagggcccaaatttttttctttggagctgatgtgcttgttggcctaccgtgcaggtccagcatggtgatgctttgtatggagagagagaatttcgcagggcactggtaatatttccagaaagctcatgattggcttacaataagttgtagaagtaaacactgcggttgctgatatctccgtttctaatttccctttcttccatgcagaatgcgtacaagcaagctatgcaatatagtagaagtatccctaggcaagcaacaagtagcaccagaagttcagtatccgccacaggccgatcaccttctccgaattcttcgaatctcttatcattcaatgaaaatgaggtgtgaatggctgaacatggcactcttgtgttctcatgttgatatctatttacgtcacagctagcaagtacctcattcagttttgtggtgatgttgcaggtgaagttcaagattgctctctgccattctgctctatgtgagcaccgtgaagcacttcatgaggttacttttttttttgtctacttatgtctaatcttcattttcaaccttattatcctgttttacgaatacagatgatgtgatatgtatactttctgtagatggaaggtattccttcgaaagtgagaacattaaaaatgaatatgatgttagggaagctatatcgaatatcaagaaatagtcgcacagctgctgtctgttataaggagtgcttgaggtataacatatgaaagaaattgctttcttggagattgtgttctccaatttcatcgacataagttgcccattttgttcttcgatagcaagttctttctaaacttggttacataaaccactcaacttctctatgctcacaagactgtctacatctccatacttctctgtcaggcaatgcccttatgttttcgaagctatcacagctttggcggaaatggggctttcagcaaaggaattttctttattatttccacaagtaagtgtatgttttgtttgcttataagctgtaaataggaagttctgagggcagataagttttaactttgcatggtagaattcaggacttctctctgcttcattttcagatgtcttggttgtcaactttattgtttgtttgagctatcagaatctattcatgctctacatgacttccagatttgcagcaaaacttgataggctattgtttcctctaatctgttgtacaacatttgggctagcagagtctattcatactttacaagcttgccagatttgcaacaaaaattgataggctattgtttcctttcctctgataaaaccatcactttgcattttataccaaaagatgctgatattgtcaatcctgtgagccaacgttttcaggtcggctggtcgaacctggtcgacctgggaccagatgattaatcgaccctggttgtccatgtatatcaggacatatacctatatatatatatatgtacctctctatatatactatattatacacaataaaggaagcatcaagactgcattagtgtttagctggtgacttatttgtgggagttgttttcctctcttttctgcactgtccagaggtccatattcatgtcccaaactccatttctttgctgacttgctgctagaagcctggaataccataattagcaagtagcaacactaatgcagtcttgatcttgacacaccttaacagcaacactgctgcaatagcaaataactaacatttagcagaccatagcagccacacagccagcatattacataaccaaagtccatgtcctggttaaacaggcccaaaaacaaagtaaccaaactggtcgtccatgtcctggtagtcgtcgactaatcggacaaccagctttctggtcgagctggtcgagtcggacctcctaatcgaacacttgggaccgaccaggatgactaatcgtgattaatcagacgacctgaaaacattgctgtgagcaagttcttaccttttccattgctgaacgctgaaattttcttgtcattttgtacacagtaccttagcatatgtgacaatcacagaaccatatgctgtcaaaccttttatatgtgttacatttgttctgtttctgtacatataatccatatggactgttgggtttcatttttgtttgaacaccacatacaacacatgtaaagctttatagaaacaacaatacacatacatcagtttattcaacaaccttttctctgtaatttttagtcattagtcagttaaacttccttgcaggcaccaaatagaggaggcaaggtgccgggtgactttgtagatgcacaacgttggtggactgtaagtgaacaatgttgaggcataaacatgcatagtactcgatgcttaatcttaaagatccttctctatcaagtaactagattcacaacatcggtggagtgtaggtgaacaatgttgagacataaacattcatgccactcaatatttaatcttaaacagcctactccatcaagtaactagatttgtggttgccatcttatgtttgatttgctattaattctcataaaccattggactccaaaaccacattttgcatatataaattctaaactctgttaagttgaaactgtatgccaatgaagtcatcaccgttttagctccatgttttgatcacgtgtctgatgcttatttttgtgtgttgggagtggggaatgcatctggcctctttctgattatgtagattgcataatttgccaccatttctgcaacttatgtgcatgtttatctctgcctcattgcaccgtcattgatgaagtgtgatgtgacagatatgtttctttcagaacagtacttgttattgcaattttagatttagttatggttttcaagaaactctgtcaactcatccagagatgtcatcatactgcattgttctttttatagattggttcagattgattattcacttaaattataattttcttgacagcgttatgttgaggcacagtgctgcattgcttcacatgattataaaggtaacataagtgtccttatgaaacgttttatctgagggttccaacatatagttgaattttgttgaacttttgaagtaacaatttacattcccattgagagcttcttttattattattattgttagatgataaatgatctagaatcaacattgactcttggccactgaatgtaactttgtagttgacacttcctaacttttacttgtatctgttaagcataaactcgtagctttggaagtatttttacagggatgtcatttctttatatttatcagtaatggatactccatctgatccaaaatgtagcgtcattttaggattcatttcggtcaaacttctgtatctttgaccatcaacagatataaaaaaatcatgttcactgaaaatgtatggttgatgttattagattcaccacaaaaaatacttgcataatgtgtattcctttctatttgatgtagattattgcaatcacataataactaggcttactgttgcttgttttttataggtggccttgacatatatctagaactaatgcaacggttccccaataatgtgcatatcttgctggagattgctaaggtttgtcttttcatttaatctctattattttctcgaatacgcaggagaactgcgtatcattgtattaatagtagagaaaaggagtcatacagagaccctaacacaaacacacatacacacagagacccaaacacacacccacactcgcaaacttactgactgaaactaatcgcttatgactgagaagaacgacctgaccaaagaccttctaaccaccaacccaagctgagtgcatcctccctatgtggaagatttgttaacctacaaattagggctgtcaagttcactcagatttttcttagataatatatcccttcaactttgatgtcagtgtgcttgtcagtgtctagaaaacatgtgaagttaattgttcatttgcagctttattttggtgttttttatgacctttcttcatgtgttgatcctgatttttgagcttcttgtttgaaggttgaagccatcataggcaggaatgatgaagcaataatgaactttgagaaggtaaattgaaaatgtacagagctaaaagcccctgattcggaaatcgtgtgaacaagtaacaaggttatataaacatttgctatattcactgttttttttttcctttccttttctttgcaggcccgtttgattgatccaaacattatgacatatatggatgagtatgcaattctactgaagtcaaagtctgactacgtcaaactgaataagttggtacatgatatgctgcatattgatcctgcgagaccagagacatgtgttgctcttgcagcaatgtggaaaagaaaggataaaagaaaagctttgacatatgcagaaaaggtaaataccttgtgggtttgatggaacctcaccttccatctaatgctccttacgatgtcttccttttcagagcctccgagttgatgacaggcatataactggctatattatgaaggtaatactgcaagatattgtctatgcaactggatttacattattatggtaattcctcttgcattacaatttgcgaagcacaaggatggttgctgcttattttctctgggacgttcatgtttagattttgtgtctgctaccatttttgcttttttaggatcgccatcttccattgctagggcatatcatgattttccctcattggtttgtcattgtttgcctactcttctttcaagggcaatttgcatctttcattgaatcgaccagatttggcagtgacagacttcaggggggctcaagaattgagagctgatcttcgttcttatcaaggttggtaggcttggtgcatctgatattcaaaatctattgtcatattgttggtctaaatagacgtattctccaggtttggtgtgtgcttatgtagcactttctaaatgcaaagaagcattattcactgcacgtgaggcaatgaaggttatgcatcagtctgcaaaagctctcaagctagttggcgatgttcatgcaattagttccagtgggagggagaaggtaatcttattttgccatgggtcactgatttgaggattatatattttttggggttctggaagcaatcatgctgctagatagctagtatgtttaaccagctgaaggtgggttgctgtagcagtaaaaaactgctgtcctagctgcaggataagcctgcaaaacttagctaagggacactactagcctaccaaaagtctgtccccactacacgtctagtctagtgttctcactacagcttgactgctattcagcctttgaaagttatctgcagttgcagacttctagtctagtgttctcaccaagctgcagccttgactgaagattggtctgcatttgcagacttctgtgcaagaccagcagcagattattattcaacaaaggatcgtcttaagacaagtatatgtgctttgtaacctgctttcttttctcaattaagttactgtgactattgaaattgacttcatatatcttttcaaatggatatcttgtgattcaactttgtacactattattgaatgatactacctgttggtcgattgtgctgatacagatatcattgcatctcttacaggcaagaaagttctatgaatcagccattcgtcttgaacctggatttcttggagctgcactggccctggctgatctgcatgttgtggaaggacggaacaaggaggctgttatgctacttgaaaaatatctaagacaatgggcagacgattctctacacatcaagttggctcaagtgcatgcgtcaacaaatatgctttctgatgcactttcccattatcaatctgccctaaggtgcgcattttcatagtagcaattctgcagtagcattcatcatctattaaccttttctttgctgttggtttgaatcctgaagacgtggtacataaataaaatttagtatatgaatatgtaggagtaaatctgattattgaggtggttttagtgatagttcctgtagttgggtttatgtaccatcaacgaaatgtaaattaataattaaattgtggaaagttttgtactaatcatgttctccttcaattttaaattgaaacttggttcttgatgttagtaccatggtttttcttccaaccacggcttgagattgctatgacaggattgggtgggttagctcaataatttgtactaatattttgattattctgccgattttggaagaattgaactattctgaattgacaatcagataattcccttccatccttatcctgcaaggcccaaagaagcatcagagtgttgtaattgatgtatatgagtaaatagctactttctgttttctgataagctttgttcctgtttattttaatccaactttgtggtacaaatcaactggtctgatattgtccctgcggttattgactccgtgcttactgccttgtgcctttctatttcttggtattaccttctagttcatgaaaaggaactcaattgtgtttcagaataaacccacaaaatgaagctgcaaagaatggattggagcgcttggaaaaacaaatgaaggtttgtgcagttcataactactccctcaattccaaattataagtcataagtctttctatctaagtacgtaactcttcctatgtatccagttatacgttatatcttgatacaaagaaaaaactattgtatttagaaaagccaaaatgatttataatttgggacgaaggcagtatatcatactgattagctcaccaactttcagttcttgttttcgttgtttgtttcggtctaccttatataccccttttgctttcccaaccctcatttactcgtttctaaatatcctactggtgcaagataactagcattgcctcattgcctacacttgtttttcatgtgcagggagtggacccagatgctccggaagaggaggaagagaatgaggaggatgatatcgatgatcgagatgagtttatttga

SEQ ID NO: 2282 - protein, 551 aa, Sorghum bicolor
  misc_feature: Ceres ANNOT ID no. 6054789
  misc_feature: Functional Homolog of  Ceres CLONE ID no. 5398 at SEQ ID NO. 1897
  misc_feature (478)..(511): Pfam Name: TPR_2 Pfam Description: Tetratricopeptide repeat
MAALLDAGLFGPAQTLGCFLVSSAGAGNDAGMSMKVESLVQHGDALYGEREFRRALNAYKQAMQYSRSIPRQATSSTRSSVSATGRSPSPNSSNLLSFNENEVKFKIALCHSALCEHREALHEMEGIPSKVRTLKMNMMLGKLYRISRNSRTAAVCYKECLRQCPYVFEAITALAEMGLSAKEFSLLFPQAPNRGGKVPGDFVDAQRWWTRYVEAQCCIASHDYKGGLDIYLELMQRFPNNVHILLEIAKVEAIIGRNDEAIMNFEKARLIDPNIMTYMDEYAILLKSKSDYVKLNKLVHDMLHIDPARPETCVALAAMWKRKDKRKALTYAEKSLRVDDRHITGYIMKGNLHLSLNRPDLAVTDFRGAQELRADLRSYQGLVCAYVALSKCKEALFTAREAMKVMHQSAKALKLVGDVHAISSSGREKARKFYESAIRLEPGFLGAALALADLHVVEGRNKEAVMLLEKYLRQWADDSLHIKLAQVHASTNMLSDALSHYQSALRINPQNEAAKNGLERLEKQMKGVDPDAPEEEEENEEDDIDDRDEFI

SEQ ID NO: 2283 - DNA, 7593 bp, Sorghum bicolor; identical to SEQ ID NO: 2281
  misc_feature: Ceres ANNOT ID no. 6054789
  misc_feature: Encodes the peptide sequence at SEQ ID NO. 2284

SEQ ID NO: 2284 - protein, 551 aa, Sorghum bicolor; identical to SEQ ID NO: 2282
  misc_feature: Ceres ANNOT ID no. 6054789
  misc_feature: Functional Homolog of  Ceres CLONE ID no. 539801 at SEQ ID NO. 964
  misc_feature (478)..(511): Pfam Name: TPR_2 Pfam Description: Tetratricopeptide repeat

SEQ ID NO: 2285 - DNA, 783 bp, Sorghum bicolor
  misc_feature: Ceres ANNOT ID no. 6063956
  misc_feature: Encodes the peptide sequence at SEQ ID NO. 2286
atggcggagaggcaggaggtcatctccggcgtcggtgcggcagcggcaccgatgtgcgccaacggctgcgggttcttcgggagcgcggcgaccaacaacttctgctcaacgtgctacaagcaggatcacctgatgatcaccaagaccgccggcgccggcgccgctcccgtcgatgagaagaagaagatcgaggtcgcagataaggctgctggtctcgtgatgcccgagcagctggctggtggtggtggtcaagatcctgccgctgcggtggccatgtcgacgccggttgctcgagcgccgacggggaaggagaacgcgaacggtggccccttggagacgctgatgctgcagctggaagcgtccggccgccgcggcctcatcgagtgcgccaacgcgtgcggttacttcgggtacccagcgaccaacaacctgtgcaccctctgctacagggacttcctcgaaagcgttcactcctcccctgccgcggcggacaaggtcgtcgtcctcgctgccgagcagccggcggcggcccagatctctgctgcaacttctagtgctacacgggcggtggaggcggcggcggcggcggcgtcgagcaggtgcgcgtcgtgccgcaagaaggtggggctgctggggtttccctgccgctgtggcggcacgttctgcgcgctgcaccggtacgcggagaagcacgcctgcggcttcgacttcaaggcggcgggccgggagaagatcgccaagaacaacccgctcgtcgtggccgccaagatcaacaagatctga

SEQ ID NO: 2286 - protein, 199 aa, Sorghum bicolor
  misc_feature: Ceres ANNOT ID no. 6063956
  misc_feature: Functional Homolog of  Ceres CLONE ID no. 14203 at SEQ ID NO. 445
  misc_feature (140)..(180): Pfam Name: zf-AN1 Pfam Description: AN1-like Zinc finger
  misc_feature (16)..(40): Pfam Name: zf-A20 Pfam Description: A20-like zinc finger
MAERQEVISGVGAAAAPMCANGCGFFGSAATNNFCSTCYKQDHLMITKTAGAGAAPLEASGRRGLIECANACGYFGYPATNNLCTLCYRDFLESVHSSPAAADKVVVLAAEQPAAAQISAATSSATRAVEAAAAAASSRCASCRKKVGLLGFPCRCGGTFCALHRYAEKHACGFDFKAAGREKIAKNNPLVVAAKINKI

SEQ ID NO: 2287 - DNA, 882 bp, Sorghum bicolor
  misc_feature: Ceres ANNOT ID no. 6064272
  misc_feature: Encodes the peptide sequence at SEQ ID NO. 2288
atgctgctgaacccggcgtcggaggcgttggtgctggacaccatccggcagcacctgctggaggagccagcggcggcggcggcgggggacgagagcttcgggagcctggtggcggaccagtggagcggctcgctcccgttccgcaccgacgacgccgacgacatggtggtgttcggggcgctgcaggacgccttcgcctacggctggctgcccgacggctccttcgcgcacgtcaagcccgagccggcgctgtccccggactcccactcctactcctactcctacgacggctcctcctgctgcttcggcggcctcctcctggacccggcggagccgctgacgcccagcagcgaggcggccgccacgcccaggcgggaggcggccgcggcggccgtggccaggggcaagcactaccgaggggtcaggcagcggccgtggggcaagttcgcggcggagatcagggaccccgccaagaacggcgcgcgcgtctggctcgggacctacgacaccgccgaggacgccgcgctcgcctacgaccgcgccgcctaccgcatgcgcggctcccgcgcgctcctcaacttcccgctccgcatcggctccgagatcgccgccgcggccaccgccggggacaagcggccgtcgcccgagcccgccacctcctcctcggactcgtccttctcgtcctgctcctccaccacctcctcgtcttcgaccagcggctcgcccaagaggcggaagcgaggcgaggccgccgccgccaacatggccatggcgctggtgcccccgccttcccagctgaaccggccggcccagccttggttccctgccgcgccggtcgagcaggcggcgatggcgccgcgcgtggagcagctcgtcatctag

SEQ ID NO: 2288 - protein, 293 aa, Sorghum bicolor
  misc_feature: Ceres ANNOT ID no. 6064272
  misc_feature: Functional Homolog of  Ceres CLONE ID no. 603410 at SEQ ID NO. 1752
  misc_feature (136)..(188): Pfam Name: AP2 Pfam Description: AP2 domain
MLLNPASEALVLDTIRQHLLEEPAAAAAGDESFGSLVADQWSGSLPFRTDDADDMVVFGALQDAFAYGWLPDGSFAHVKPEPALSPDSHSYSYSYDGSSCCFGGLLLDPAEPLTPSSEAAATPRREAAAAAVARGKHYRGVRQRPWGKFAAEIRDPAKNGARVWLGTYDTAEDAALAYDRAAYRMRGSRALLNFPLRIGSEIAAAATAGDKRPSPEPATSSSDSSFSSCSSTTSSSSTSGSPKRRKRGEAAAANMAMALVPPPSQLNRPAQPWFPAAPVEQAAMAPRVEQLVI

SEQ ID NO: 2289 - DNA, 882 bp, Sorghum bicolor; identical to SEQ ID NO: 2287
  misc_feature: Ceres ANNOT ID no. 6064272
  misc_feature: Encodes the peptide sequence at SEQ ID NO. 2290

SEQ ID NO: 2290 - protein, 293 aa, Sorghum bicolor; identical to SEQ ID NO: 2288
  misc_feature: Ceres ANNOT ID no. 6064272
  misc_feature: Functional Homolog of  Ceres CLONE ID no. 6397 at SEQ ID NO. 1637
  misc_feature (136)..(188): Pfam Name: AP2 Pfam Description: AP2 domain

SEQ ID NO: 2291 - DNA, 3076 bp, Sorghum bicolor
  misc_feature: Ceres ANNOT ID no. 6064740
  misc_feature: Encodes the peptide sequence at SEQ ID NO. 2292
atgggcgccaacggccacccgccgccggcgagcaccgccgcacagaacgggtcccactccggcggcggcggaggaggaggagggggagggggagggggagctaaccctagcaacggcggcacggcggcggcgcttcggcacgaccctggcctggcgcgggagtggtcgccggaggagcaggccatcctcgacgagctgctggtcaagtgagtccgccggatttctgggttttgcgggtttgggagccccgcaaggccgcaattcgagttagacggttgcttttatttctgaattctgactattggatagaattgactggtaatttgagcaattaagcaacgcttgtgttatgtgattaccaattcagtgagattgtacctgcataggcatagatcgcaacactcgatggcctccttttagcaaacttatccctagccaatttctcatgctaatgcttctccttgcaacgtaatcctagttaatccaactttgactttttgatgcaagtggataatgtttgccctttgttcactcttcacacttgctttattctgatatactgcaaagcatgggaactcttgttagttatataacacaaatcttacgcgcaagtcagcgctcaaaatgactgtagcatcaggtgtacaggcttgcattttgatgttgcaagtagaatgtttggatagcaccgtgaaggcctgttaacagtgagttccttaattttttaccttatgtttccattaatgtttctcggcgtttgctctcaggtatgcatccgatttacctgtggtacgttatgcaaaaattgcgatgaagttgccagagaaaacagttcgggatgtagccttgcgctgccgatggatgaatgtaagataagacttagcattcatagtgtcatgatgcctggcctctttagtctttaggtttcagaaatgatttgagagaatttgttgatcctgcagaaaaaggagagtgccaaaagaaagaaagaggatcacagctcgtctaagaaaagcaaggacaaaaaggttttcaaatattttcctgactgtactccatttaaataaatgttacaatgcagcctagagtatcaattgttgcagtaatttccacacaaaacagatatctggttgacagtgtcacaatatgtgtgtgtgttcctattacacactccttaaataagagatttgcactgacagctacccattgatgcaggagaaggtttcagattcttcatcaaaaccacctgtccatatggctggtaggcctagtgttcctccataccctcttccagttcttccaatggacgatgatgaaatctcatccaaaggtaaatcagattgatatttattccattattggtattgcagtgtaaggattggtgtttgcatcattgcatgatttaacattctgtttcgttttggatagttctgcttctattactctaaagtgatgcagtgactgctacttgctagttgctactatcatatacttgtctacagcaatggcatccatcgtgtattggtttctgcagtatatctgaggaatcaaaaccagaaaccaactgacttggtgtttaaaatatagctgacctatcatgcagagtctgattctgggtaatgttactgctacaaaaggggaagtgtattggtagatgcagtcccctttcacgcctaactgcggtagagattgacagtttgctgcattaaaccattatttgctattgtgatctttttcatataagtttctctcacatcagacacaaatcaattaatttaaattataattttgtattaaaatcttcaaaggataatattcttaataataggtgctaggaatagactggtccaggactggcagattgtactcttttttcaacataaggacagtgcatactagatgacagtcactatgtacagttgcatggcttctctgctttttacatgattctttatctggcaatacattgtgggaatctacagatagttgcttgacatatttgagctgttctttctactctatgcatttttaaatttgatggaaattcttgagccgcttgaatcatgggcaatggactagatactgacttatcagttatttcacctttttcgtcttccgcagccattggaggtccaacaggcgaaatccttgaaactaatgcccaggttttgagtcaaatttcgtcaaaccttagcaacatgcaggtatccttttatttctgggtggcttgtgggtgcgaactgcccagattttttttgttgactttctaatcaacaagctctaggttttgtcttgttatttattcgtggttaatttatttccgcagatacaggacaacatctctctgctgtgccaaactcgagataatatactcagggtcttgaaagagtatgttttgaattactgttgggtttatttcaaaatcttttaaagtggtctgttcatccaatatgttcagtcccatctgttattagctgcatacattttgcataacatagagatatgtttccttcaccatggcaatgcatcatatatgcctgttgcaattcagcaagatcctccttttggcagtgttaaagagactgtcaaactgagatcacttttaagttttccattcttgctatacgtaatctggtctttgactgttgacagcagtaggatgttctatgtagaatccaatctgctagttctttttaggagtactagttttatcaccctctgaatacgcaggagtgctgcttgctgctacttactaccatgaataagttcctttaggtttttagctatgtgtcaggaattctaaaatcttacaggaagttcactgcccttgaaaagcccagaaacacaaatgtgcatccttaccaaatacatcgctggaacttctttgctctacacaaagtattttattccgtccaaaattcaacagttgtgatatacaagttctgatcccatgcaaaatgtttgcaggataaacgatgctccagagatcatgaagcagatgcccccgctacctgtgaagataaacgaggacctcgtcaactcgttgctccccagaccaactgtacctatgcagtag

SEQ ID NO: 2292 - protein, 246 aa, Sorghum bicolor
  misc_feature: Ceres ANNOT ID no. 6064740
  misc_feature: Functional Homolog of  Ceres CLONE ID no. 2942 at SEQ ID NO. 671
MGANGHPPPASTAAQNGSHSGGGGGGGGGGGGGANPSNGGTAAALRHDPGLAREWSPEEQAILDELLVKYASDLPVVRYAKIAMKLPEKTVRDVALRCRWMNKKESAKRKKEDHSSSKKSKDKKEKVSDSSSKPPVHMAGRPSVPPYPLPVLPMDDDEISSKAIGGPTGEILETNAQVLSQISSNLSNMQIQDNISLLCQTRDNILRVLKEINDAPEIMKQMPPLPVKINEDLVNSLLPRPTVPMQ

SEQ ID NO: 2293 - DNA, 3076 bp, Sorghum bicolor; identical to SEQ ID NO: 2291
  misc_feature: Ceres ANNOT ID no. 6064740
  misc_feature: Encodes the peptide sequence at SEQ ID NO. 2294

SEQ ID NO: 2294 - protein, 246 aa, Sorghum bicolor; identical to SEQ ID NO: 2292
  misc_feature: Ceres ANNOT ID no. 6064740
  misc_feature: Functional Homolog of  Ceres CLONE ID no. 337432 at SEQ ID NO. 737

SEQ ID NO: 2295 - DNA, 1071 bp, Sorghum bicolor
  misc_feature: Ceres ANNOT ID no. 6064763
  misc_feature: Encodes the peptide sequence at SEQ ID NO. 2296
atgatgatggctgaggtggccaaccacagcaaaaggaaccacaccgacagctacttcagtggcaaagccgccgccgtcgccgtcgcggccaccggcccagaggagttcgcaagcatgtcctcgaagaagccgaggaataccagcccgagaatcgcgcccgtatcaccaaaggtacgcaccgtatgatgttggtgtcccgtacatacatctcccatggttgtttcttggctgaagtttttcttggtgcgatcgagcaggagaagaaggacaagatcggcgagagagtcgcggcgctccagcagctagtgtcaccatttggaaaggtatatttttcaagttttcgctgcaataattcctgcggtctttgtcatccgcgcaagtggaatttcgtcttgcaagcgctgcaatcacctctgcttctcgttgctgcagaccgatacggcttctgttctgcaggaagcatcgggctacatcaagttcctgcaccagcaactcgaggtctttatttttgtgaccgcaaatggcactatgatcttcagctttctgatccttcatctgctgatcgcaatggcaccgatcttttcaggtcctgagctccccttacatgcgtgctcctccggctcccggcgctgtgcctgaggtgagctctccccatccctcgtctcccactgaattctgaatgcaaacatgtagagcatgctaaactgaattctgaatgcaaacctgtagaacatgcaaagccactttcagtgctttggtcatatagagggaaaagttaagagtcctgaacttcatgctcgaaaaaagaattctgaatttgaccgaatttgaaggatacaaaacccaagtcaatgcaccatttcttttttatttcatacaacaaacctagcaggagatcatgtcataacacgcttgcatcatatttgacatgtgatcctgatccaggaccccgagcactacagcctccggaaccgcgggctgtgcctggtgccggtggacctgacgctgcagctgacccagagcaatggggccgacctgtgggcgccggcgaacacgaccaggcgcaggtga

SEQ ID NO: 2296 - protein, 160 aa, Sorghum bicolor
  misc_feature: Ceres ANNOT ID no. 6064763
  misc_feature: Bit Score of 319.3  for HMM based on sequences of FIGURE 53
  misc_feature: Functional Homolog of  Ceres CLONE ID no. 3900 at SEQ ID NO. 838
MMMAEVANHSKRNHTDSYFSGKAAAVAVAATGPEEFASMSSKKPRNTSPRIAPVSPKEKKDKIGERVAALQQLVSPFGKTDTASVLQEASGYIKFLHQQLEVLSSPYMRAPPAPGAVPEDPEHYSLRNRGLCLVPVDLTLQLTQSNGADLWAPANTTRRR

SEQ ID NO: 2297 - DNA, 975 bp, Sorghum bicolor
  misc_feature: Ceres ANNOT ID no. 6067965
  misc_feature: Encodes the peptide sequence at SEQ ID NO. 2298
atgtgtggtggtgcgatcctcgccgagctcatcccgagcacgccggctcgccgcggtggcggtggcggtggcgcggcgtggcccggcggcaagggcagccagaggaaggccgacgacttcgaggccgcgttccgggagttccacgaggactctgacgaggacgaggagatgacggaggtggtggagagcaagcccgccttcatcttcagcgccccgtcgtccccagcgacgaagcccagggcggcgcgccaggagcagccgatccggcgccggaaggccgcgcagcagtacaggggcgtccggcgccgcccgtggggcaagtgggccgccgagatccgcgaccccgtcaagggcgtccgcgtctggctcggcaccttcccctccgccgaggccgccgcgctcgcctacgaccacgccgcgctcgacgtccgcggacccagggccaagctcaacttcccctcctcctccgccgccgccgctggggccccagccagccgcaagcgcgcccgcgcctccgacgccgccttcatcgacctcgtcgaccaagaggaacaagagcagctcacggcggcggcgacgacggccttgaagcacgaggccgccgaagaagcagccggcgagagctccggtgcactcccggacttctcgtggcagggcgtgctgtcggcgtacgacgagtcccccgccgtcgacgtggaggccggccagagcggcgataagaagcggccgaggaccgagccggagagcaccgaagacgaggcgtcgccacgggcctcctccggctccgagccggacgcgctgttcgacgcgctcctcttcggcgaccagttcgccttcttcgacgccggcgcgtacgagtcactggacagcctgttcagcgcggacgccgtgcagagcaacgcggcggcggaccagggcatgccgctgtggagcttcgatgacggctgcctcgtcgaggacaacctgtcgttttga

SEQ ID NO: 2298 - protein, 324 aa, Sorghum bicolor
  misc_feature: Ceres ANNOT ID no. 6067965
  misc_feature: Functional Homolog of  Ceres CLONE ID no. 158240 at SEQ ID NO. 520
  misc_feature (95)..(146): Pfam Name: AP2 Pfam Description: AP2 domain
MCGGAILAELIPSTPARRGGGGGGAAWPGGKGSQRKADDFEAAFREFHEDSDEDEEMTEVVESKPAFIFSAPSSPATKPRAARQEQPIRRRKAAQQYRGVRRRPWGKWAAEIRDPVKGVRVWLGTFPSAEAAALAYDHAALDVRGPRAKLNFPSSSAAAAGAPASRKRARASDAAFIDLVDQEEQEQLTAAATTALKHEAAEEAAGESSGALPDFSWQGVLSAYDESPAVDVEAGQSGDKKRPRTEPESTEDEASPRASSGSEPDALFDALLFGDQFAFFDAGAYESLDSLFSADAVQSNAAADQGMPLWSFDDGCLVEDNLSF

SEQ ID NO: 2299 - DNA, 1146 bp, Sorghum bicolor
  misc_feature: Ceres ANNOT ID no. 6068499
  misc_feature: Encodes the peptide sequence at SEQ ID NO. 2300
atggaggccgtcctacggcatccatcgctctcgcgcctcaagcctccgaacccgaaccttcccagaacgccatcgccatcccttcctcccccatctctcctccgccttcgggcgcgccggctcatcgccgccgcggtgttccaggaccagaagccgaaggagccagcaagcaagggaggcgatgacgaggaggcctacggcgaggtggaccgcatcgtctccagccgcaccgtcagcagcccggtgttcgcggaggacggctcggccagcgccgccgtcgccacggaatacctggtggagtggaaggacgggcacgagccgtcgtgggtgcccaaggaggccatagccgcggacgtggtggccgagtacgagacgccgtggtggacggcggcgaagaaggcggacgcggaggcgctggcggcgctgctcgcggacgagacgctgcggcgggaccccgacgcggaggacgcgcaggggcgcaccgcggcgcacttcgccgcggggctggggtccgaggagtgcctgcgcgcgctcgccgcggccggggcggacttgggccaccgggagcgcgcggggggagggctcacgccgctgcacatcgcggtcgggtacggccgcgcgggcgccgtgcgcgcgctgctggagctgggcgcggacccggaggcccccgacgggcagggccgcacgccgctggagctggtccaggaggtgctcgccaggacgcccaagggcaacccggcggcgttccagctgcggcaggggcttgaggcggcgcagaaggagctggagaaggccgtgtacgagtgggccgaggtggagaaggtgatcgacggccgcggcgaaggcaagtggcgggagtacctggtggagtggcgcgacggtggcgagagggagtgggtgaaggcggcgtgggtggcagaggacctggtgagcgacttcgaggcagggctggagtacgccgtggcggaggcggtggtcgacaagaggcaggtggcgacggcgacggcggaaggggagaacagatgggagtaccttgtgaaatgggtggacattgaggaggccacatgggagcccgccgagaacgtggacgccgagctcgtgcaggagttcgagctgcggcagtcggggtctgcaggtggtgactga

SEQ ID NO: 2300 - protein, 381 aa, Sorghum bicolor
  misc_feature: Ceres ANNOT ID no. 6068499
  misc_feature: Functional Homolog of  Ceres CLONE ID no. 37980 at SEQ ID NO. 808
  misc_feature (193)..(225): Pfam Name: Ank Pfam Description: Ankyrin repeat
  misc_feature (320)..(373): Pfam Name: Chromo Pfam Description: 'chromo' (CHRromatin Organisation MOdifier) domain
MEAVLRHPSLSRLKPPNPNLPRTPSPSLPPPSLLRLRARRLIAAAVFQDQKPKEPASKGGDDEEAYGEVDRIVSSRTVSSPVFAEDGSASAAVATEYLVEWKDGHEPSWVPKEAIAADVVAEYETPWWTAAKKADAEALAALLADETLRRDPDAEDAQGRTAAHFAAGLGSEECLRALAAAGADLGHRERAGGGLTPLHIAVGYGRAGAVRALLELGADPEAPDGQGRTPLELVQEVLARTPKGNPAAFQLRQGLEAAQKELEKAVYEWAEVEKVIDGRGEGKWREYLVEWRDGGEREWVKAAWVAEDLVSDFEAGLEYAVAEAVVDKRQVATATAEGENRWEYLVKWVDIEEATWEPAENVDAELVQEFELRQSGSAGGD

SEQ ID NO: 2301 - DNA, 4144 bp, Sorghum bicolor
  misc_feature: Ceres ANNOT ID no. 6068623
  misc_feature: Encodes the peptide sequence at SEQ ID NO. 2302
atgcagggcggcggcggcggcggtgatcaagcaggagggagcctaggcatggacatgggcgtggggtacgccgccggcagcggcggcgccgagtgctcgtcgtcgacttcggcggcggctgcagcagcggctgccgcggccgccgcagccgccgcggcggcggccgaggcggaggagcggcagctgctcaagggggagatcgcggtgcacccgctgtgcgagcagctggtggcggcgcacgtggggtgcctgcgcgtggcgacgcccatcgaccacctcccgctcatcgacgcgcagctggcccagtccagcggcctcctccactcctacgccgcccaccaccgccccttcctctccccgcacgacaagcacgacctcgactccttcctcgtacgtcgtcctgccgctagctctactacctgctcccactattactagctatatatatatatgcatcatccacgcatgcatatatctaaggttaatttccatccatcgagctgactggttcttctcgatctcttcctctgcatgcatgcatgcatatgcatggcggctctggttgtttactttaacctgcatggatgcatggtggtgcaggcgcagtatctgatgctgctgtgctcgttccgggagcagctgcagcagcacgtccgggtgcacgccgtggaggccgtcatggcgtgccgcgagatcgagcagtcgctccaggacctcaccggtaagcagctggctagtggctacatccatatatgtttcatttcatcaattagtttaattacgtttatataattttcccaattgtctcctccaaatttctgtttccttcctccttccatttctggttgcatttgcgcaagtttgggtgttgttttctcaagatttgcctatccggtgcgctgcctttttctccttgctgctggtagttagtttgaagggtaccacacgctcactgtttctttagtttgttgattgatgcagcatgtgtaagcatacaaaggtaaaattagttgtagcgtcgtcttctatggcttctatgcatctctgttgggtgtgtgtgacttgcttgcgtcttaaggttttcctctcaatcctaacgaagttctttaaccgttgagagtatcgatggtaagagatactaacaagcacagcaggtattttagtattaattcttcttctctgtgaatacatatgcccggcaaatttcttgctagttgctttccccaaaaggagagttttagtattcaacgagaaacagaataagaaatatgcaaaatcaaaaggagaatatatgcacgtactcacgtagtgcgtacgtaccagctgggctgttgaaataccggaataacatttcaaatgcatgcaactaggtcggaccgtcggatggtgaagttgtggcccacgtagcaagcctaacagcccaaccgtacatggcaaaggacaggagaactactaaacccttgccgccatctctatgttgttaggaaaaacaaaccgaaggcacacatgaaaattcatattttcagcataattttcacacatgttttttatgggttgtcaatggttatttacccttcctaaaaactaaagccaaattcaaaaatttccacaataaagctagtacctaatagtttaagaaaaaactagctagtacccaatacgtggttactccctccgtccaagtatataagtcgtaaccacttttttgtttatatcccataatataaggcgtgctctctcacaaacattaatgcagtagtactagtgctgagagaggttttcaatataaggcgtaaccactttttgttcatgtttcaaattaagaagttatcaggaggtttggcgaaacatcagtagcgacggaggtatagcatacactggccatttttttttcaaaggctcgactataagagcaagaaaatcacaaaagtataattttcttacttcccatgtatcagggaaaaatttgatactctgacgttctcagaagcaaatttgacttggatatatgtagttcaattttgctgtgtgaatcgatcattacggaaaagtgatcggctagctagaggtactattatcaccatgcatgattgaacatgaactatccatcggcccatcaacaccacctgacatgaccgtgctcttggtggtcgtcttcatataatgagaagtcagaacatatttgcaccccctcaatttactggtgtgcgacacatatataagctaacttatgatcatcaaaaaacaaaaagacgatgcaatacacaactaaggaaaatatatatgttgtcgtctaataataactaattaagcatgaaaacttatctttcaatcatgacccctaggttattattaggtcatgttgcgggtgttgaatttacaacacttatgtcgttataaagggttttagactttagaggcgtcaccattttaccgcgcctacttcaggagttttgttcttttcgacagctattaattttatctctagcttcaccttgacacaagcaaattcatgatggtgcggcgtttttttcttaaatcttcgacttagtggttaactctagatgtctatatattatctttccaacctacatatatatgcggtttaattatttcttcaaaaactatatatgcagtttaagcccatcccatgcccctgaccctaacacacttgagtcagtttcctattatatagctagctcttccggacatgcactatcgttacttttagagatagctgcaaaattccaaaagcgtgtctagcattcatgtgtttaatcgggtgcttcttcctcgcaatgcaagtggccatgctcagagctggtacaaatgtctacctaggcatagcttagccagctggttctcatgcatgcatgtctatctcgagtccacgtcccagagagatcacctttcattcatgcatgcctccgtacatgtttctatggtgtctcgatcacggatcattatactgctacttgtgattaattgtgatccgaactgatcgatgcaaacgattgacgaggaatatactttccatgttagcaaggtcattaacacggtttgtttcagggtaaatcatcgttgctgacagttagtcagtcagtcactaatgatctttttctgatggatgttgcccatgtcatatgcatatatatgtaggagcgacgctagaggaagggacgggggcgaccatgtcggaggacgaggacgagccccccatgctagagggggccctggacatgggctccgatgggcacgacatgatgggcttcggcccgctcctgcccaccgactcggagcgctcactcatggagagggtcaggcaggagcttaagatcgagctcaagcaggttaaaaaacataaagaacaagaggaagaagtagattgtgctatataccattgcaaactaaaccgtgtgaaagcttttggttgatgtgaagtcatgtcgaattcgttgcagggtttcaagtcaagaatagaggatgtgagggaggaaattctgaggaaaaggagggccgggaagctgcctggggacaccaccagcatcctcaagcaatggtggcagcagcactccaagtggccataccccacggtgagtgcattgtagctatcatgcatgcatgcaagaatgcaaccagccatctgctgctactaccaatgcatacactgatgatgtggtgtggtcgcccttctgagctgttctccatatatccaacaacttgctgatgaagcttattgctgccaatatatatgcatttaataaattatgtggttgttaactgagctcttgggaaagaaagaaagaaagaaagaaagaaagagatttgtggtttgtaaagtatcatgtgtgcatatcctaaagatggtatcatttgagtggctggtacaggaagacgataaggcaaagcttgttgaagagactggcctgcagctgaaacaaatcaacaactggttcatcaaccagaggaagcgaaactggcacaacaactcccagacgtcaaccctcaaatcaaagcgtaaaaggtcaccaataatgctcgcttcaatgcatgatttgatatatatacatctctcatgtaataagtagtaacactctcagtaatccctacagtttctgacacaaatgcatatatctgcaggtga

SEQ ID NO: 2302 - protein, 323 aa, Sorghum bicolor
  misc_feature: Ceres ANNOT ID no. 6068623
  misc_feature: Functional Homolog of  Ceres CLONE ID no. 106887 at SEQ ID NO. 1832
  misc_feature (116)..(171): Pfam Name: KNOX2 Pfam Description: KNOX2 domain
  misc_feature (227)..(248): Pfam Name: ELK Pfam Description: ELK domain
  misc_feature (61)..(105): Pfam Name: KNOX1 Pfam Description: KNOX1 domain
MQGGGGGGDQAGGSLGMDMGVGYAAGSGGAECSSSTSAAAAAAAAAAAAAAAAAAEAEERQLLKGEIAVHPLCEQLVAAHVGCLRVATPIDHLPLIDAQLAQSSGLLHSYAAHHRPFLSPHDKHDLDSFLAQYLMLLCSFREQLQQHVRVHAVEAVMACREIEQSLQDLTGATLEEGTGATMSEDEDEPPMLEGALDMGSDGHDMMGFGPLLPTDSERSLMERVRQELKIELKQGFKSRIEDVREEILRKRRAGKLPGDTTSILKQWWQQHSKWPYPTEDDKAKLVEETGLQLKQINNWFINQRKRNWHNNSQTSTLKSKRKR

SEQ ID NO: 2303 - DNA, 4918 bp, Sorghum bicolor
  misc_feature: Ceres ANNOT ID no. 6073498
  misc_feature: Encodes the peptide sequence at SEQ ID NO. 2304
atgatgagcagcaacagcggcggcggcgcaggaggctctggcgggggcatgggtccgggagtgggtggaggcggggacgggcggcatgacgatgaggctgcacttaccgagttcctctcatcgctcatggactacacccccacggtatggtgccgccgcttccctcttgccttctctacttttctgtcagcggtttagccctgatgcttggttcggtggttcggtggtgcggaagattcccgacgagctggtggagcactacctcggccgcagcgggttccactgccccgaccttcgcctgtgagtgatcgtcctctttccaatctctcttcctgatggatagtagtaagctgagatctcatcagtgccacggattaaaagttaaaaacacaaattgcttgatttcttgcacacataatctgatttcgtgttttacagaacgagactggttgctgtagccacccagaagttcctatcagacattgctagtgattctcttcagtgagtaaatttcatagtcttgttattacaaagtaaaatgattctcttcttaatttcattgatagcatattcaaaaattaaacattatcattcttttcttccatgtgaatggctgaatgcaaatcttctgtgcaatactgcaattccatatttttgtttggtttgacaagtatattaggcttcaacaaaaatccctccctaattgcatgtacttgtgaaattaataaattattcatcaaacacatggttttttaaggtgtcgcttaggcgataaggcttgctggaaatctaggcgtccctgttgccatgatcaaatagagagggagggaaggaaactgaagaagaatgggaggggagggggccatcaaggctaagaacccgagctgctgccatccctgctggctaagaagtgggaggaaggagaagtttcagcagtggcagtggtggtgcatctagagagagaggtagagggagctatgctccatggatacatgggggtgaccatgtatatgcacacaggagccattggtaccgtgaagggagggagagactaaagaaaggaagagcatgaagagaaccaggcaaggctgcacctgcctcactctcatctccgttggctccggcgcctgtggtcatacagctcttcaccggtcaactgtatagctcgatctgaagggggcagcaccagtacacaatctgcatatgagtagagctcaatttcaaaatgggtggcatcggccctcaaaacagggagacgtgctcttgggacagccaggctcgtcattgctccaacgcggtagcatcgggaaggactgatggaaacggcatccagtgaggaatcggtagattaaagattgaggggagagggtagggttttgctttatgggctgttggttgaattgggttctaatgagttagtgggctggctgctaatagttattatggcccatcggagcttgtatttacctcttattctctattatatatatcttattacatattttatgtgccatattctttggcaatggaccaattgatgactaaaaattttggttgggaaaaaattggaagccaaccaagcaggcccattatttacttttctaaaatattaaaatatatccccatattgtgatttgggaaaagatgacgtatctgtgtatccgtaattctgtatcatagactgagggaagggagcactgacatgagggacatatgtaggtctcaccttactgccttaagaaccatgtaaccacaatcatcaatgtaataatatcggaatgatgacaaacgttttcctattgttacaacatttcatttttctactgttccattcagaactatgttatgatcctagttatcacttacttgcatttatgctggttgtaagtttgactcaataaccttcctagttgctgaaacattgttcgctctttgctgctctcgcaagcttaccataccaccatagtgatggattagtccgctggatatttcttggtaggaaagaatataccccgtcttcattgtctaaatatatggtatgatctctcttggaattttctatactagccaagggttccgtggatccctctgcatccactaactccctcccagggttcttgttcattaaaggaattcatttttgttaaaggattatgttctgatacataatggatgtgcctatactactcacttaatttgtgaggcctttcctcattttaaagttctaaagctacaaatagtataatggctttaagttcagtgtgactccttagagtttcgtgttatatcatacaacgtgcaaaatttaaaagtattaataatttcccccctatttctgcatagtcaagttacttttataaacatgagtatataccagctgaggcttggtttctttaatggaaatccaaaggggtaacagtgtaacatgcaattgtcttcttcaaagttttttaaaacatacaagatacatttacaaagtgtatgctctagtccaactggttagagtgcctcagtggcactccacaggtcctgggtttgactccccgtgggagcgaattgtaggctgtggttaaaaaaaatcccctcgcctgttccatggccaaagcacaggtcaaaaaggcatggcccggttctcacaaggcaacagtgcccctgtgtcagggtgggacaggggttcgggggttttctcggcctgtgtgagaaggtcttctatcgtagcaatgcccggggggtggtctttaccccctgcagatcaggttatttttatgcctaattttgtggagattctgtaattatattaccaatggagctcattctttatgtggcctggctaatcaagtgatgaataactaaaacatactgaaattagaaaacaagccaattagatttttttggtatcatcatcatgatgcgttaccaactaaaagcatacctaattaactaaaagatgcctgatcaatcatgataggctcatgtatcacatcaatgtactaatcccatgagaaaacagattcattgtgaggggagggtgggctcttttggattatattgtgtaagtttgcttattttgtggggttttttttgtcagtgtatgacacactctactcttcactatatagcaaactattgtaagattttcttagcaacatatacacactgtagttgtgtgcactaattttgctattacattattctttcccttgaactagacactgcaaggccagggtagcagcacctatcaaagacaataagagcaaacagcctaaggtgtttttactcaccagttgaacttttcacgttcctagcgttaaatcttgtttagtatccttactgcttacttatcacatttttattaaaaaaatgttattttcaggatagacgtcttgtattaaccatggatgatctttctaaagctttgcgtgaggtaaccatgtttccatttaattctgcagtttgcactttacttttttgttggcagcagcttaccatttactatcttctgtattccaaccagttggtcagatctgtattcttgagagaaaaattagtcaggcggcattatttggtttgaacactacaacaatctgttttgtcaggacttgaaattgaatcttcccactgttttcttaaacttaaacagttatgtaagatccagtttgatatgcacttgctcctcacaattttcaaaaaaattcatgaggaaaacgaactgttagcagcagttaagaacagagcacatgaacaaaaaattaatgatgcaggatagatatttaagcaaatatcatgtgctgcacagttggagatcttaatgatgattgagttcctttagactagatacgatcaattccaccaacccacggcagtgtggcagtgcccatatgacctgtatcttttgcaagagtgaggtacacaccatcttctgttattgatattgtgcatggacctaaatatgcaaagccatatagagatcagactagtgcggttttctttgcctgtattgaatggagcagctaatcaaatttcaaattgccaatccaacattgcatattctgaccttcttagtgacaataccctttataggtttaatagtttatgcaaaattatcgacaagaagaccactatgcatggaagtaagcacttctggaatctagaacataggaatttcacttaaaacagtacaatccctgcaggaacatggaatttcctctttcctgcctaaatctttcagtccgattagcacaactcttgaggctgttgaaaactatggtatattcttcagtccacagcaaattatcttctccggttgacctttactaatcaagcaatgtatatttggtaccataccagttccattaagcatgatgatgatgtttttgttctttcttatattccaaagtaagtctatgttatatccaaactttgcacaaaggcattgtttttgtgctttatttcaaatacaaagttcataatgttgatagagagattcttcagcatccactatccagacatccttctagaaaatagatttggtaaaattcctgatgttttgaaggtgtgcttctgtagtacctctaatttgaagttccagtatgttccagattccttaatacttaataacatctcatggcatcattgttggaagaatggagtgactgataaatgtaggccaaattcgtaaaatctttatcctgtttaggcatagaaacttcggttaagtcatattccattcgttcatagtaactactggtcatggtcactggactactttccaccacattagcttttgctccatttgtgatcttatataccctgatactcacatgagacctctgtgcagcatggtgtgaacttgaaacacccggagtacttcgcagacagcccttcagcaggaatggctccttcgacaagagaggagtag

SEQ ID NO: 2304 - protein, 148 aa, Sorghum bicolor
  misc_feature: Ceres ANNOT ID no. 6073498
  misc_feature: Functional Homolog of  Ceres CLONE ID no. 25793 at SEQ ID NO. 1854
  misc_feature (47)..(91): Pfam Name: TFIID_30kDa Pfam Description: Transcription initiation factor TFIID 23-30kDa subunit
MMSSNSGGGAGGSGGGMGPGVGGGGDGRHDDEAALTEFLSSLMDYTPTIPDELVEHYLGRSGFHCPDLRLTRLVAVATQKFLSDIASDSLQVAAPIKDNKSKQPKDRRLVLTMDDLSKALREHGVNLKHPEYFADSPSAGMAPSTREE

SEQ ID NO: 2305 - DNA, 3153 bp, Sorghum bicolor
  misc_feature: Ceres ANNOT ID no. 6078685
  misc_feature: Encodes the peptide sequence at SEQ ID NO. 2306
atgtactcaccaaaaccagaatctagttttgccccaaatcccaactcaggcacacaccagcagcaaatggaattacctggagccaacatgggtcctagtaatggagcaaataacaataccaacatggctgcaaggcaacgcttacgctggacaaatgaactgcatgaaagatttgttgaggctgttactcaacttggtggccctgatagtatgcgctcatactactgctcatctacatccatccagttctttaatttgattttactgaacatttaagcaggatttttttcttgtataattacactttttcctctctctctctctctagatgtcatgaaatcatattctatcaaacaaatattctttttcaatactcagcttttttacgcgtcgtattagtcctaagtcaaacatttgtaactttcatcattgatttcaaaagaatttatgtaggtttatgacagaagatttatgtttttagattccctatgagaaatactttcataatatgtaattcatatgttgtgaaactataaggatttttttttgaaatagatggtcaaagataataatgtttgacttaggacagctaatgcgacatgtaaaaaagaacagagggagtattatgaaaatatgattgctctgtgggggaataaaatgtacgcgattctggacttcaatacaaatgtggatgagttgcaaaagctaccaatctgagatgccttagcttggggattatgagttgcccactgagaacccactttgaagttagctacaagaagcatctgagccttcctattacttggtgttgaatttgtcatagttttcatagggacgcaatctgcttgaagttttggttcataaatttcaaatattctttttgggctctattcttgtcaaactcttagtggtaaaagctatttttcatgaatggaattagttgacctatccataaagaagcaaaatttgcaacttagtttggcaggaattttgatgccaaaggaaacctacagatttttatgtgtgttactgttctacttatctgggcttatggccctttgaattttacttgtactatgtggacatgtaattttctgcttctgctaacacttagtcgatcaaataaaacaggagcaactccaaaaggagttctaagaattatgggtgtacaaggattaacaatataccatgtaaaaagtcacttgcaggtatattatttcagtgtgacacttgccttttaacagtttttatttgtcactttcactgtttacttcaactcctccgttcatgtttcagaaatacaggctagcaaaatatattcctgatgcttcaactgatggtaggtgtctaaattcatcactataagtgtgatactacagtattgttttagttcttcctaatttgtatctcatgcaggaaacaaagccgataacaaagacccaggggatttgcttgccggacttgagggatcctcgtatgaacacataattttaattccttttaattttattgaagaagggcataattcaaaattcatttttagtggaattttactggcctagtggcatgtcataagatggaaatatgattgtctatgctagattttacaatttactaagaaaaatacatgtactataatgaatgcacttgactttatgtgattagttagatgtgaacatattgaaattgtgttactgttagaacaataattctgaaactataattagttatgtgtgaacatattgaaattgactactttattgcatccagatgttacattcaccgctccacaaaaaaatgttgatttcatctgctcattagttgtgaccttaccgtaaggtccataactgttagacaggaaatacagaaaggtcaaaataacttcaaaactgaacaataacattttttatttcttctgatgaaaatactttttccattttagtcccttttatttcttttatactagatatatttttaattttttacataaggaccttccatcatataagtttttgttcacagtggattgccgatatctgaagccctcaagctgcagatggaggtccaaaagcggctgcacgaacagttagaagtaaatctttcctggatgttctaccctttagcttttgttatcttcataatgtgtagatctgagacacatacaaggatacagatatttcttctaaagtaatttatttattgaacatatttgtggtaccttctgaaatgttcacttaggggtaggtggtaggcccttagctgcgtactgcaactgagactctcttgttactaaatgtttgtactagaaatatttttgtagctatcctcttgcaaagtatctaagataggcaaatcctgcattaaataaattgtgcatccaatgttgttttctcatacattctttgttatttatagctggtcttgtgtttgttctgctaaagtagtaaaatcgtttcatcatcttatttgctagtgaacaaaatcaatttgtttttaatattgtgatctcaatggttctattttattattagtagctgcaagtctgcaataaacatactgttcacattttactttagtcttattcgtattaccaaatttgcaaaggtaattggttgaacaattagatacttagatattagataaacaatggacttagaattcttagatggtctgatttcacattttctttaggtacaaaggcagctgcagttgcgaattgaggctcagggaaagtacctccagaagatcattgaagagcagcagcgcttaactggtgtgaaatctgaaactcctgctggaggtgcttctgtcacagtatcaagtgatcaattccctgactccgagcggactgagccctcgactcctgcaccaacatccgagtctccaactcaagttggtgcttccaatagggaccccggagatcgaactgaaggaaccaagagcacctgtcatgagccactaacccccgattccaactgccagaatggctctcccgttgctagtccaaaccatgagagggcagcaaagaggcagcggggcagtggtactgaattcttagattctgagtctgagttttcccttccacgccacatctttgagtcgagctcaggctcagagttccaacaatactcaatgtcctactcaggacagtag

SEQ ID NO: 2306 - protein, 305 aa, Sorghum bicolor
  misc_feature: Ceres ANNOT ID no. 6078685
  misc_feature: Functional Homolog of  Ceres CLONE ID no. 115924 at SEQ ID NO. 1383
  misc_feature (47)..(98): Pfam Name: Myb_DNA-binding Pfam Description: Myb-like DNA-binding domain
MYSPKPESSFAPNPNSGTHQQQMELPGANMGPSNGANNNTNMAARQRLRWTNELHERFVEAVTQLGGPDRATPKGVLRIMGVQGLTIYHVKSHLQKYRLAKYIPDASTDGNKADNKDPGDLLAGLEGSSGLPISEALKLQMEVQKRLHEQLEVQRQLQLRIEAQGKYLQKIIEEQQRLTGVKSETPAGGASVTVSSDQFPDSERTEPSTPAPTSESPTQVGASNRDPGDRTEGTKSTCHEPLTPDSNCQNGSPVASPNHERAAKRQRGSGTEFLDSESEFSLPRHIFESSSGSEFQQYSMSYSGQ

SEQ ID NO: 2307 - DNA, 678 bp, Sorghum bicolor
  misc_feature: Ceres ANNOT ID no. 6079953
  misc_feature: Encodes the peptide sequence at SEQ ID NO. 2308
atgaacacgtacatgtctctctccttggagagcagcagcagcaccaccaccagcagcgtggtccgcgacgtcgccacgcccgcgcctctgtccagcggtgccagtgcctcgtcgtatccacgggcgggcgcgggcatgggcatgggcacgtcgctctccctggccagcgccgcggcggcggcgcacgggcacggacagtacctccccctcaacgaggatgactccctggagatggtcctcttcgacgtgctccgcgaggcatccggctccgctgcggcgcccaccacctaccagccgccggcctcgtcgttgcctacgctgaagaaggcgctcgcttccggcgccgccgcgcgcaagggcggcggcggcggcgtcggttgcagcagcagggcagcgcacgcgccgaaggcggccacaacggggcggcactaccgcggggtgaggcggcggccgtggggcaagtacgccgcggagatccgtgaccccgcgcggcacggggcgcggctctggctcggcaccttcgccacggccgaggaggccgccgcggcgtacgaccgcgccgcgttccgcatgcggggcgccaaggcgctgctcaacttcccgccggcggtcgcgggctgcgggaacgccgcaaccgccacggcggagcaggctgctggggtgacggaagccaagtga

SEQ ID NO: 2308 - protein, 225 aa, Sorghum bicolor
  misc_feature: Ceres ANNOT ID no. 6079953
  misc_feature: Functional Homolog of  Ceres CLONE ID no. 6042 at SEQ ID NO. 1064
  misc_feature (142)..(194): Pfam Name: AP2 Pfam Description: AP2 domain
MNTYMSLSLESSSSTTTSSVVRDVATPAPLSSGASASSYPRAGAGMGMGTSLSLASAAAAAHGHGQYLPLNEDDSLEMVLFDVLREASGSAAAPTTYQPPASSLPTLKKALASGAAARKGGGGGVGCSSRAAHAPKAATTGRHYRGVRRRPWGKYAAEIRDPARHGARLWLGTFATAEEAAAAYDRAAFRMRGAKALLNFPPAVAGCGNAATATAEQAAGVTEAK

SEQ ID NO: 2309 - DNA, 907 bp, Sorghum bicolor
  misc_feature: Ceres ANNOT ID no. 6085974
  misc_feature: Encodes the peptide sequence at SEQ ID NO. 2310
atgggtttggcgatggggaggcttcttgggtggaagcaggaggcgcggatcgtgctactaggcctcgcctgcgctggcaagacagccatcctgcacaagctcaagcacggccacgtcgtcaccaccggaccaacgataggtaaacacgcatgataattgctactactgtctaaccagctcaagccaagttgttgtttcaacaacaaaaaaaatatatgctattgtgtagggttcaacaccgagacgcttgaatacaatggcatcagcttcagtgtttgggacgtgggtggtagtcaaggcgaggtaccttcctgaatcggcattccgtatgcatactgtggaactctgatgacttgtcattttggtttgcagctcctacggctcttgctaaggcactacctctatgccgcccagggcgtgatattcgtcgtcgacagcagcgaccaggagtggtttcatcaagccaaagatctgctaaacatgattctgaacgaggtaggtaggtagccagatactactgcataacaccaggtttcagtagccaactcagtagctaggcctagcctaggccctataggactcgtatggtttggttctgaatccgaattgaactaatgtcaggacaagttcagggatcccgcgctgcttttgtttgcaaccaagcaagaccttccgaacgccatgagcgcagcagagatagcagacaagttggggcttcagtcactgctttgcaaccgtagacgatggtttgtgcccacatgaggtttctgtctctctagtttcagtaagacttgatcatccaaattgcttctgcttctgcttctgcaggcacattcaaagttgttgtgcgatctcaggagaaggcctccatgaggggatggattggctctgcgccaacatacaatag

SEQ ID NO: 2310 - protein, 179 aa, Sorghum bicolor
  misc_feature: Ceres ANNOT ID no. 6085974
  misc_feature: Functional Homolog of  Ceres CLONE ID no. 14909 at SEQ ID NO. 1211
  misc_feature (1)..(178): Pfam Name: Arf Pfam Description: ADP-ribosylation factor family
MGLAMGRLLGWKQEARIVLLGLACAGKTAILHKLKHGHVVTTGPTIGFNTETLEYNGISFSVWDVGGSQGELLRLLLRHYLYAAQGVIFVVDSSDQEWFHQAKDLLNMILNEDKFRDPALLLFATKQDLPNAMSAAEIADKLGLQSLLCNRRRWHIQSCCAISGEGLHEGMDWLCANIQ

SEQ ID NO: 2311 - DNA, 2741 bp, Sorghum bicolor
  misc_feature: Ceres ANNOT ID no. 6086494
  misc_feature: Encodes the peptide sequence at SEQ ID NO. 2312
atggtccgtcgtccctcccctcgtcctcttggcaaggctccgatttgccacagattttcaggatctttttttctcatttttgtgcttcctccaatcggctggttttgatatgtcacaatctatgtgattttctcgtttgattcatactactctgtgcgcgcgtgtgatttttgacggatgcgtgtttgttgtgcgcacagcataagcttggtagaggaagccgggataaggtgcagcaattcatggcaataaccggcgcaaggtacatttttcaaacgtttttttaactgttcggagagatcggtgtttagtgctaaattgtggtttggttggttagtggcggtggtctgtcaattttgcgggccattgggaggaagttcttttggggtgtaacatggaattttgtattgtcttttatttatgtggaaggatgtgttaccgcctgatcttgatttgtgattttgcgatggaattctgcaacgggatggtggcataatatcctcccctttttgtttaggatggaccacttttccatcttttcccaaaagttatcttttttttttgtgctgcaagagtgatccattgtcattatcctgaaaaatcagtagggttgtacattacagtcagtcatgggaccaactgaacctccgaggactactgtacatctttagacactgccatctcaactgtatttctgttaattttgtcaaacatcgcatatttcacacagtgagaaggctgcgcttcaggctcttaaagctagtgattggcacttggaaggagcttttgatgttttctacagccaaccacaaattgctgttgctaatactcgacatctggaagagctctacaacagatataaaggtgaaatattttactctcttttgcacctatcatcttttctatgccttgttgctgattttttttacctgtacatcattttgtgtcatggttgctcagaaccggatgctgatatgataatggtggaaggcatatcacagctctgcaatgatttacaggtcattttttttgttttttttcctcttactttgaatgtatgttactatagcctgcagtcacttgtaatgcataggtatactatacatgttcgaaatttgtggacagtgaactgtgtttgtttcatttattctgtgttttcatttttctatggaatacttgaactattcaattttcttcctatctacatttgctcttggtctgtgaagtgtagtaaattatagatttagaatatctgcaacaaacaacctgtctaccatggctttgtgggttaagtttgactatgtagactggcatgattgctaacttcagcatttgttgcttattattatttttggcccacagtagatactgcaggtgctgcatgtattttgttcctattataaggcccgagcatcttttattttggttgtctatcttgtcttcatctctatgtcctgttatatgattctgatacggaaatcatgtgtgtttccctttgtcaggtggatcctcaggatattgttatggtacgttcatattttatcttgaatctactttctctatatactaaccaaatgcatttgcttcaagttcaaatacgaaagatgacactgggatactgttatttgtgttattttgtccatatatgcattttgattacttgttccctgttaacagcttgtcatatcgtggcatatgaaagcttccactatgtgtgagttcactcgccaggagttcattggtggactgcagtcaatagggtgagactgatctatgcaatttttataatcatttgtgctacaacttgagattctgaagtgtaaatagattgaatagtttcaaaagatcttactcattttcagagtggattcaatagagaagcttcgcgagaagttaccttcattgcgagctgagcttaaagatgatcgtaagttctctttttttcagtttgaactgctgctattgtagcaaatatgtcatttgaatacaaatgcttgcataagcagcttgttcagccaagggatagactagtaatgaatggtttcatctacctatcacatacctgttcacttcatacagagaagttccgtgaaatatacaactttgcatttgcctgggcaagggaaaaggtatggcatttgctgtgcacattattcatgaaactgtatcagaacatttgtttcattcatatcttgaaaaactatattgacaacatattatgcttgattttatagggccagaaatctctcgcattggagactgctattggcatgtggcggttgctaattgctgaaaggaactggtctctgattgaccactggtgccagtttctacaggtgtataccagcttattttagtagctaatcgcaaaggttttttttttcctgctttgatataaatttattgaatttgtgtttacttgtttgaacttggtttcaggtaaggcacaataaagcaatctccagggatacatggacgcagttattggagtttgtgaaggtaacctcatcctcacttatccccaggaatacaatcgcgaaatggatacccatcatatttagagaccatgccatacttagttgaatctgcttgtcgtgtaatgcatttctgctcttatcttgttgcttcagacaatcgatcctcagctaaccaactatgacgaagaaggtgcttggccctacctaatcgatgaatttgtggactacttgaaagagaaagggcttgtccagcatagaaggtga

SEQ ID NO: 2312 - protein, 250 aa, Sorghum bicolor
  misc_feature: Ceres ANNOT ID no. 6086494
  misc_feature: Functional Homolog of  Ceres CLONE ID no. 478453 at SEQ ID NO. 901
  misc_feature (126)..(241): Pfam Name: DUF298 Pfam Description: Domain of unknown function (DUF298)
  misc_feature (7)..(44): Pfam Name: UBA Pfam Description: UBA/TS-N domain
MHKLGRGSRDKVQQFMAITGASEKAALQALKASDWHLEGAFDVFYSQPQIAVANTRHLEELYNRYKEPDADMIMVEGISQLCNDLQVDPQDIVMLVISWHMKASTMCEFTRQEFIGGLQSIGVDSIEKLREKLPSLRAELKDDQKFREIYNFAFAWAREKGQKSLALETAIGMWRLLIAERNWSLIDHWCQFLQVRHNKAISRDTWTQLLEFVKTIDPQLTNYDEEGAWPYLIDEFVDYLKEKGLVQHRR

SEQ ID NO: 2313 - DNA, 818 bp, Sorghum bicolor
  misc_feature: Ceres ANNOT ID no. 6086771
  misc_feature: Encodes the peptide sequence at SEQ ID NO. 2314
atgtgtggcggcgccatcatctccgagttcatcccgcagcgcgacagcgccgctgcccgcgccggccacggcaagcgcggcctcgtctgcgccgacgacttctggccgccgcacgccgccgacttcgacgacttcgccgccgccgccgccgcctccttccatcccgaccaaggtactgtaatactcattgttcatttgcacgcttgctacctgcagtgacacggccagcaggccggacacacgctccaccgcctgaacctgacacccgtagcgtgcatggtgcagagccgccggccaggaagcgggagcgcaagaccatgtaccgcggcatccggcgccggccctggggcaagtgggcggcggagatccgtgaccccgccaagggcgcccgcgtctggctcggcaccttcgccaccgccgaggccgccgcgcgcgcctacgaccgcgccgcgcggcgcatccgcggggccaaggccaaggtcaacttccccaacgaggacccgccgcccgactacgacgacgacgaccacgccggcgccgcgcaggggatgctcgccatgtcctgcgccggcggcggcggtggcagggaccacctcgtcgactacgacgtcgacgtcatgggcatgggcatggggacgacgttcttccagcaccacccgcagccgtcgtacgtgtccgacgccgtcaccgtggcgcagcaggagcaggtgcccacggtcgcgtacgtgcaccaccaccagctgccgccgccgcaggacgacgccgcggggatggacatgtggacgttcgacggcatcaacacagccgtgcccatgtga

SEQ ID NO: 2314 - protein, 234 aa, Sorghum bicolor
  misc_feature: Ceres ANNOT ID no. 6086771
  misc_feature: Functional Homolog of  Ceres CLONE ID no. 158240 at SEQ ID NO. 520
  misc_feature (68)..(119): Pfam Name: AP2 Pfam Description: AP2 domain
MCGGAIISEFIPQRDSAAARAGHGKRGLVCADDFWPPHAADFDDFAAAAAASFHPDQEPPARKRERKTMYRGIRRRPWGKWAAEIRDPAKGARVWLGTFATAEAAARAYDRAARRIRGAKAKVNFPNEDPPPDYDDDDHAGAAQGMLAMSCAGGGGGRDHLVDYDVDVMGMGMGTTFFQHHPQPSYVSDAVTVAQQEQVPTVAYVHHHQLPPPQDDAAGMDMWTFDGINTAVPM

SEQ ID NO: 2315 - DNA, 3546 bp, Sorghum bicolor
  misc_feature: Ceres ANNOT ID no. 6086887
  misc_feature: Encodes the peptide sequence at SEQ ID NO. 2316
atggggaggtcgttcagggactcgctcaaggtgctcgaggccgacatccagcacgccaactcgatgtgagtagtagcgaagctcgcctttcttctcgcgttctgttcactcacttgttcagctgagaggacagagatcgtctgttactgtcctttggccgtgttcccaggtgttctgagctcgcacactgcgcgtacttactgctagtacctaaccgcagattgctctgctgatttgttttaggacagaattgcttgggttatttcaggtctggaatggaatctaatggattacaaattagatcatgggacatggctattcaccttttcgttccttgatcccaaccaaaatctctagattagatatgatgcgttgttgactatgacacctatataagaatgggacccaaacaaaacttttatgcagctatatacaacacttcacttttgtagttttcttgtgtttgggtataattagtatgtgtaaatgacttaagcttgctgccagtagcttctcgcactgccacctgtcagcaaatctgttacttttttggctaaatctccttttgttggtgaagctctgctatatgggagcccttttgagttgccatttcagaattcctattgttgttgtgtcaaattcatcttcgtttggcctggaagaactgtattttacttatagcactgggggaaaaaaatcctctttacccatgcacttccactcgagtggcatactggcatctgttgtctcttctttattgtcatcatcgtcatttggtaaagatcttgtgtctgcaaatataccagccaccatgagacctaatatcatttggctaacaaggctttaatgatgaatttagctactgttcatgatttgtttcatggcctagtcgtatgagcattagttggcctggcaagtcatcatttagattctctccatggcttcagtacattacccaacagttcatcactgatcattttgtttctaaaaatacagtgcttctgaatttcggagggaatatgatggcgcctgccttcagatgaggatggcatactgccctgctgcccactttttcctttttcttgtgcagtggacagactgcaatcttgctggtgcacttgggctgttgaggattctaatttataaggttgatcaacacttcggttttagaaccaaatttctttccttttctaatggtgagtcagtactaaagttaacatcacaattatgttaaatgtgcaggtttacgctgatgggacaaccaccatgtgtactcatgaaagaaaagcaagcatcagggaattttatggtatagtgcatgcctttgagaactttttgaatgatattttctttgcacatttatcatccttattactttcttgttcattagctctcagttgtttttggcagctgtcatatttccctctttgatgcaattacatgaaggaatcaatgaagttgaggataaaaaacagaaagcaatatgtctagagaggtatagaagacgagatgaggatcagaaaacagtaatatcagagattgatgataatatagaggaggaatgtggcatatgcatggaaataaacagcaaagttgttcttccaacttgtagccatgctatgtgcatcaaatgctaccgtgactggtacaaatctgcactcctgtttctaaagattttgagacattttaattattatattgttctgacagttatgtactcctgcatgctcaagatgaaattgtttctactgtaacacaataatgcttggatacatgtgtgtaagctgtatgtttcataaatttatggatttgctaggagcgaactgaaaagaactttcttggtaggtgggctattgtgtcattttttttcttgccctgagctccacattacattacaggatcaattcacccttacgaactattcatcctaattcgtaactgtaaatctgtacctgccattttgctttgctatccattgtgtccttcattcttatgccgctgtgttccataagctattggttgatcttcgcgagattagttgggcaacaaactgtaattggaaaatttactaaaaatctcttttacacctaactaatatcagctgcagctcttgctctttgatgtttacatgctcttcatgcaatgattgtaatcctattgtatgtatgaaatagaagttttggggcagaacttgaagccgttctgttcatcgcttcctcctctactatttttgtagattctttttcagtagacattttgccacaggaacagaatttaggaatgggtgctgcagacttgaataattctctgataatgtaatgtaacttcaataatcaaatgacaatattggtgttaacaaagctcaaggcagccaaatgttagatagggagcaattttctttttaactatatagggagcaagttggaagaacattttaacagctaaggagaccaagattcatgtattgtggacttctcttgaacacttgtttaggcctgaattaaaggatattagcgactgaattgaggcctaaatttcttgtgactggtctatattttttcaatagtgtccctatctgtcggtgactctggagtgttttccttgagatatccactgagcttatttgcttgcacgttagaacatgtcatgccatcgcttttttgtttggatataggtttttccattattctgaaacaagacaaagctaattgaattcatgtgatgggcaaaaggctctctttttgtgaaaatgcaaatgctagattacctaggactagagacctggctatcagttcatttccatataacaataattggatacatgttctgttcaagggcaagcactcatttgtatgcctgctgggactgttcttttattggcattggaattggaatcgatattatattatacatcaagccaagtaagggcaatagtcatcctctgtatttgttattaacgactgaatgcagaattagcatgtggtttgttagtgtcagcctggctatcaatatctagcctacaaaattttatatgtttctgattcttctattgaattttctttttgagggctaaagttaggcatcagaaatgtggttgctaactaaacaatcctgtggtgttacatctagccaaacaaggacaatggtcattctttgttgttattagcatgttgacgcagaacaagcatgtggtttgttagtgtcagacagtcaatctgaccatcactagctatcctacaaaatttgatatctttcagattcctccactgaatttcttcttccttcgacgaccgtataatctctattgttctaagtcagtgatgttgttactgcaggaggtcaagatcccagtcctgtccgttctgccgcgacagcctcaagagggtaaactctgctgacctgtggatatacacagataacaaggacatcatcgacgtggcgacagtccgaagagagaacctgaggcgactcttcatgtacatagacaagttgcccactgtcatcccagaatctgtgtttgacgtctacgactcccatgtaaagtga

SEQ ID NO: 2316 - protein, 237 aa, Sorghum bicolor
  misc_feature: Ceres ANNOT ID no. 6086887
  misc_feature: Functional Homolog of  Ceres CLONE ID no. 99033 at SEQ ID NO. 1165
  misc_feature (141)..(178): Pfam Name: zf-C3HC4 Pfam Description: Zinc finger, C3HC4 type (RING finger)
MGRSFRDSLKVLEADIHASEFRREYDGACLQMRMAYCPAAHFFLFLVQWTDCNLAGALGLLRILIYKVYADGTTTMCTHERKASIREFYAVIFPSLMQLHEGINEVEDKKQKAICLERYRRRDEDQKTVISEIDDNIEEECGICMEINSKVVLPTCSHAMCIKCYRDWRSRSQSCPFCRDSLKRVNSADLWIYTDNKDIIDVATVRRENLRRLFMYIDKLPTVIPESVFDVYDSHVK

SEQ ID NO: 2317 - DNA, 941 bp, Sorghum bicolor
  misc_feature: Ceres ANNOT ID no. 6087117
  misc_feature: Encodes the peptide sequence at SEQ ID NO. 2318
atggcctatgatggagatgatggacaaagccaggattatctcttcaaaattgtcctgcttggggattcctctgttggtaaatcaaacttgctagcaagatttgcaaggaatgagttctacccaaactctaagtccactataggagtggagttccagacacaaaagttggtaatcgatggaaaggagattaaagctcagatatgggacactgctggacaagagcgctttcgagcagtaacttctgcttactaccggggcgctgtgggagctcttctcgtctatgatattagcaggcgtcagacttttgatagtgttggtcgatggctcaatgaactgcacagtaagaaccaatattttacttaactccagcaaacctggttcaagtttgcttcatacgttcctagtcaatagaccaagctcaggtcatgtagaatgatttgagttttagaattagtgtactttgccattacgaacaaattgccttgaagctgaccatgaacaagtgcaactcaaaaccaagtatacttgttataaatttcagcgctaggttcattttccttataagttttatatgatcttgtttcgtttctgacctgttttggttacatgcagctcattccgatatgaatgtcgtcacaattctggtgggtaacaaaacagatctgaagcatgcacgtgaggtgagcactgcggaaggacaagccttggcggaggcccagggcctcttcttcatggaaacctcagctttggattcgtcaaatgttgcagcagcttttcaaactgtcgttaaggagatctacagcatactaagcaggaaggtgtttcaatcactagagcagaagaaaagcgagctgcagtcgctaagcaacgggaaagccgtggtgctgcagggtgagaccaaccaaacaagcagtggtgggaggtggtgctgttcttcatga

SEQ ID NO: 2318 - protein, 222 aa, Sorghum bicolor
  misc_feature: Ceres ANNOT ID no. 6087117
  misc_feature: Functional Homolog of  Ceres CLONE ID no. 6827 at SEQ ID NO. 1888
  misc_feature (16)..(177): Pfam Name: Ras Pfam Description: Ras family
MAYDGDDGQSQDYLFKIVLLGDSSVGKSNLLARFARNEFYPNSKSTIGVEFQTQKLVIDGKEIKAQIWDTAGQERFRAVTSAYYRGAVGALLVYDISRRQTFDSVGRWLNELHTHSDMNVVTILVGNKTDLKHAREVSTAEGQALAEAQGLFFMETSALDSSNVAAAFQTVVKEIYSILSRKVFQSLEQKKSELQSLSNGKAVVLQGETNQTSSGGRWCCSS

SEQ ID NO: 2319 - DNA, 3826 bp, Sorghum bicolor
  misc_feature: Ceres ANNOT ID no. 6087143
  misc_feature: Encodes the peptide sequence at SEQ ID NO. 2320
atgggatccgaaggctttgcggccgcggcggccgcttgcccctccgccgccgaggccttcctcaagtactatggtgagctccccgccgtcgaattcgcttgctcgcgagtgttccggtcgatccgtcgttccagggttctttcggtagccgcttacggggtttggagcttgcggtttttggggttggtttagtgggtaacttttttggattttggtcttcctttctttttgcgaattatgacgaaccttgtggtttccatgttggtaattctgctaaatgggtgggttcgagtactgaagaagtgatcttgaacgttaatcggtggtcaattgtctgacttcttgacgaaaaatgggtccttctcttatcggttcttgctttcttgggtgacgaaaaattcaaagaagtgttagttatagctaggcagatgctagcgaaacgactcgtgcaaactgatatgttgtccttcacaaaagttcatacttcgaggctgtacgtttgatagtttctgcaattcgatcatatcatccttctttggcacctagagtagacaaaattctcaggaactggaaccaagcctcgtgcatagtacaaaagttaaatgtgcagtaaacggttctcgtgttcacattgttagttcagattgtgtttattggggcactatatcgacctattggttcttttggcctttgttttgctaggtatcgtatcaggaggtacaagtgtggagacaagacagggattggttgagctttcactagctatagatggaattgaaggaatgaggtttgcatctttgagagttcttttcattatgatatatcctgcaccatggtgaaactttatgacaggatgcatgcttttctacttcttgcttgcatatgtagagttgaaatatgaaaccttgtctgagaattagagaaatctattgacccttgtttactctctgtttagaatttggctgaggtgtaatttgacgaagatttaaacgcgaattgaacaatatgtgaatattaatagtcgttgtacttttttctctgttgctgtaaatatataaatcttttggagttgattttcctgtgttaatgttaccagcacattgacatttaactgtttttacttggaagtaaaaaatatcatggtggctattcaatgttgcaaacatcatggcattttaaatttgcttgtcgctcgtatatcctggccaagacacaacacacaagcgcacatccttaatcagccctgatcacataaactttcataacctccatatcatgtgaatgtatgattctttttttgtatcatgtttggttctgttttattttctcatcctatgtagcctttcacatgattaagcatcctaatgttgatgcagggatgtgatttttgctgatatcccaaagctcattccatttattgatttggtgagtgacgctttccaagctgattgagattttttttgtcgatctttactaccttatgttaattgagagccttcttcactaccttatgttaattgagtgccttctgttttaggaggatatgaccctattcagttgcttctacgattttgtcttcttcatctgtcgtgaaaaggggcaaaagagtatcagtaagatcctctattctcaatgtctactggtatcctagtatatacttcttataccgatagaacactaactaggagtttcctatttcatttgcatagctattcagagagctgtggcagcatggaagattgttctgaacggaaggttccgtttgcttgatcgatggtgtaacttcgttgaggtatagaaatcgctctgcttggccatgatatgacatctccatgattcaactcaaatgtgtgttgttctgatatttgttttttgtgatagtttattaaattattattattagtgctccattcttatccagtaaccctagagaataataaaagcaatattgacatggatattctatagttgtcattctaccgacatttactaagacatatcatatatgtatgaagataagtacttcactctagttgaaaggctggcttatgctgtaaattatatggtttgatacacgatgactattgactaaatagaaatgttgaatattgatgcacgtggtaattatcagatgcttggtttccagttgtgctattctggctaatacttatgttcttgtcaaacctaaatttgtgttgcaagatgcatagtttaattagcatattgcagaatgcatagttgctttagttatcatttggcatcttttgtttggaagaaatgctgaaaacctaagagttgaaatactataatactgctttgcaacagttcaaatctttagtcctcaataaaccattaatattctttttcttgattatttcatgacttacacccccttttcctatgatgaacagtcataaatagacttcactgtttttttcttagctaaaagcctaaaactataatactctttctcagaagtaccaacgccacaacatatccgaggatacttggcagcagctgctagctttcagcagatgtgtaaatgaagatctggaaggttatgacccacgaggtacaaattctttctacatgactatatcgattttcaattctatatgtgcaggctgcagctgtctttatagcgtagctctatgataattaagaaattttcttagttcctgttccctgtgtcttctttcaggtgcttggcctgttctgattgatgattttgtggagcaaatgcacaggtttgctgccacaacatgattatattctcttgcagttcagtttatatattttcttcctgttgtcaaacataaagcataaccattaaatggataatgcaagggaagattttgggaaaatctcaagacctattttactcatgtaacattctataggaatataggcctacacgtggcttgcttactagctttttgtagaattgtttattttgcaaagctctgtgtgattggtgcatactactgtctattcaaaatcataatgacaatctatacggggtagcaagttaaaaaaacactgcagaaaccagattggctttgtagaaattacaataggatggggctcgctcacagaagttgctgatgagcgctgattcatccataactgttgcatgtcagttcttcttttaaacgtgtaatgggaagcttcccacgggggaaaccctggcttccgcagagaaagaatgattgggacgtttgttttatgcaatagctaattagctacatagttttagtgaatttgttcttcataataagctaatttagtcttcttgttgtctcggagagtaatgtttcttcctagttgtatgctgacttatgtgtctccacttgtaaaatgtagaatttatcactctactgactgcagcagtgcgatggaagcacagtgtagcatttcaagtacatttaaaggtattatttggagcattgttatttttatttcttcttttagccaacttgacattacacaccattctgaatctgctgttacaggactggatcctctacctggatcaaagaggaaatgtcctcacttcaagtccaatgaagaggatgtagaactctcggatagttttacacgctccgtccatcttacaccaataaagcgactcaaggaaagtcacgacgctagatatggagtgggggaatcccacaaagttatccatttttctagtagctcctcagattaccacgaggagacgcatttacacaactcaagaggttgtcttcagaactccccttgtaatgttgaggatgccctgtcgaaagggtttgagggttgtatttcgatgaaatgccctttttga

SEQ ID NO: 2320 - protein, 296 aa, Sorghum bicolor
  misc_feature: Ceres ANNOT ID no. 6087143
  misc_feature: Functional Homolog of  Ceres CLONE ID no. 478453 at SEQ ID NO. 901
  misc_feature (69)..(169): Pfam Name: DUF298 Pfam Description: Domain of unknown function (DUF298)
MGSEGFAAAAAACPSAAEAFLKYYGIVSGGTSVETRQGLVELSLAIDGIEGMRDVIFADIPKLIPFIDLEDMTLFSCFYDFVFFICREKGQKSITIQRAVAAWKIVLNGRFRLLDRWCNFVEKYQRHNISEDTWQQLLAFSRCVNEDLEGYDPRGAWPVLIDDFVEQMHRIYHSTDCSSAMEAQCSISSTFKGLDPLPGSKRKCPHFKSNEEDVELSDSFTRSVHLTPIKRLKESHDARYGVGESHKVIHFSSSSSDYHEETHLHNSRGCLQNSPCNVEDALSKGFEGCISMKCPF

SEQ ID NO: 2321 - DNA, 3992 bp, Sorghum bicolor
  misc_feature: Ceres ANNOT ID no. 6090309
  misc_feature: Encodes the peptide sequence at SEQ ID NO. 2322
atgtccatgagcttcgtgtgcatggtggaggcggagttgcccccagggttccggttccacccaagggatgatgaactcattcgtgaatatctagcaccgaaggtctttggcaagatcggcttctctggacatcgcccgcctatggtggacgtcgatctcaacaaggttgagccatgggatctcccgagtgagtctctctctctctcccccgctcctctccttaatcgagtactgattttaattcataacaggcttgcatgcaccacttgctggtgcagacacagagagagagagagagcgctatgcagcctgtggatctcatttctatttgttattgctatcctcaatcgcttcagcaatccattgtttgtgttgtgcataccgtacatacaataaacctaggtaaaatttacccgtagtatatctagacttttaaatgtttaattaaaaaggttccacctacatctatgctccttcattacttcaactattctctcatcttagtgtgtttcttacttttcagtgtctgatcgatcattgtcgtggtcaaattaactctaatagtgcaactgattctgtgctactaaatttacgaatacaaataacaggcatcatgaattactatgttgttttaaaaatagtaattggctttttgctcgtataaaaacacatgataaagggccgtccgcgaagccctctttgccgaatcaaaattccccgagcgctctttgccaagggccaacctcgacaaatgcatttatgaaggtttatgggcctttgccgagggcttcggaccctcgtcagagaggccgcttctagtagcgattagggcaaatttgcatccatgaatggagtacttaagctgagcatgcaataacggtgttgcccctaaacttgagatcgacgactaaagttataactaccacgacatgacaactttgtttaaccacatatgaatctgaattattcatagtctgtttcaatatcaagtactcaagctgttaagcctctttctgtcgccgtatgcataaacatcttatatacgggatctcagatcctctataacaaaactgcctcttatgtttattttctcaaacgctgtgattcctatatactactatattattaatcatttaatccatatatagtttatcgctttccaatgtaatagttttttccaccaggaaaagggaaaaaaaaacactggaaagcaaagggtgaaaatggacactatatatgaaccaacaagctgtgcgagtttactatcaaaacagcagtatgcatttaaacataaaggaagccatatctctatttacatacagacatatatttgtcctttgggataactcagcacagtaaatgatgtttgctatatattttgctattttgtgtgctcaggggcagcattggtggggcctaggcagtggtatttcttcagccaaagggaccgaaagtatgcgacggggcaacgcacaaaccgggcaacagcatctggttgctggaaggctagctacaggcaaggaccgtgtggtggagtgtcatgggatgctggtggggatgaggaaaacccttgtattttacaatgggagagcccccaagggaagcaagacggaatgggtgatgcatgagtacaggatgatggagggttcacattatcagcaatcctccaacctttccaaggtaattaattaaattaataagatgtgcctagctatagtggacacactacagatctagtttacacatgtgcatgaattaaacaagaaatttttttgcacatccaagacatggcacaaaaaaggggggtagtaagtcatcattgacttgtgacagtttgaaatggtaattgatttgttcataaaactaaataggaacaagctagctgtcagcacaatgaattgcattgttgtataattttcggttgaacatgtggtatcctgatcgactatttcaaattatgtgtacatatatacgagaggaatctatagcgatcatgtttcatccatataaattcaagattagctttatgttattaattaagtcccctaaatatataatgttagagaaatacaggaaatatactatacctcggtgcatgtcacaatgtttgtccaatttgttaatttgtatggaacaaaatcgttagtcttggtcttattaaatgatttatccagtgaataaaagttaaaatattaatcaaatacttgtatatatacagttctaacagaaaatgtgaaacagaggaagtgatgtattgcatgcaaaagtccaaagttaaactaaaaacataaaatgaattgcccttccgcccagcctttttgtaatcatttttattttaatattactgatcatgaacacaaggatatttgccccatttacctgtccactacgtggtttacaattattatgttacaatatagaaatgtactagtagacaaatataataagaattaatcaacattcttcttggaaaagaacaaagatatagccttatatggaattattcttccagtgaagaaaagagacagtcatgccaacttgcttgcaataataacttcacttaattcttcactcaaaatttgcttgtatgaaacaattcaaggaatttcttatgcttatcaagtagtaagctctttaataatttgcaaatagtttcattttcagcctaacataaaaatacataatttggatcactgatcactttatttgattgaccaaattaacgaaaaagtgtgtagccctgaaaaagtaaagttaaagtggatacaaattttacacgtatatgtatgaatcagggtcgtgtaaaatggaaaaggtccaatttactcccctagataggaacatcgttctcctaatgcctaaactaattttttatgttcaatttatccctctagatcttttagttgatccaagctaacacttaataatatttttttgttttcagatataagttcaattttaggttcaacttttataggatcatatagaacattgtaattaattttagaaaaatatattatgatcttttctcattttctatatcttaggcatcttaaaaaataaccctactgatacatgacttaaaaatatgatgaaaaataatatattttcctaatataaatttatggaattcactatcatccaacaaatttcaacttcaaactcaacttgaacgtggacaaaccaaggaaaaataaaattgtaatattaatgggtactagattggaccaactgaaaaatgaagagtggagcaattaatgaattgaacagaaatcctaatattaatgggtaggttgggccaactgaaaaaccctagttgatttggatttttcccctttaaacttgatgtattaattcacaatgttgagtcacacaatcaaagctagtacagctacaaacgttgacaagattgccaccagggctgcagttgaataatcaatgagatgttgacagtagtttatttatttattatatgggtcctcgtctcctcgatgtcccaccaccaggaagattgggtactgtgcaaagtcatctgcaagaagaaaccaggagttgccaacttcaaggcaagcagaagcctagccactgatggtcatggcactacaacagcctcaacaccaccaccactgcaaactctcatgggcatcacactaacgcaggtccaggctgccatggcaatgccaagggccagcctcaaaaccaccacagcaaactctcatgtgcaagaagaaatcagggggacactgcaaaacggtgccagcaacaacattgttgttgatggtgttcagcaaccaagctaccttcctgtcatcgcagacgacaataatgccaagggccagcctgatgaaatgggaagctacactgatcctgtaaactgtgaaaaggatttgctcacggtattgttgagtgatctgggaggtgaggtggtgccaagcctgccacctgaaatggctgcatctatgagctcgacctggatgatgaatcacttctag

SEQ ID NO: 2322 - protein, 289 aa, Sorghum bicolor
  misc_feature: Ceres ANNOT ID no. 6090309
  misc_feature: Functional Homolog of  Ceres CLONE ID no. 205648 at SEQ ID NO. 555
  misc_feature (13)..(128): Pfam Name: NAM Pfam Description: No apical meristem (NAM) protein
MSMSFVCMVEAELPPGFRFHPRDDELIREYLAPKVFGKIGFSGHRPPMVDVDLNKVEPWDLPRAALVGPRQWYFFSQRDRKYATGQRTNRATASGKDRVVECHGMLVGMRKTLVFYNGRAPKGSKTEWEDWVLCKVICKKKPGVANFKASRSLATDGHGTTTASTPPPLQTLMGITLTQVQAAMAMPRASLKTTTANSHVQEEIRGTLQNGASNNIVVDGVQQPSYLPVIADDNNAKGQPDEMGSYTDPVNCEKDLLTVLLSDLGGEVVPSLPPEMAASMSSTWMMNHF

SEQ ID NO: 2323 - DNA, 4658 bp, Sorghum bicolor
  misc_feature: Ceres ANNOT ID no. 6091796
  misc_feature: Encodes the peptide sequence at SEQ ID NO. 2324
atgaacggcgccgggggcagccaccaccagcagcagcagcagaggctccggcagcagcagcagcagcaggcgctcctgatgcagcaggcgctgcagcagcagcagcagtaccagtccggcgtcctcgccgccgcggcagcggcggccatgacccaggtcgtgcccccggatcctcgcctcctctcgatctgctggtctgtgtgcgcattgggcggcagtaatgcgcgccgatctgcttgtgagcgtgggagattgttttcttgctttgagcatttttcttaggctgcctcgctgggttactggactttttttttttggtggcgggcgggctagcggcagcacaagttacagcttgatagattgggtttcttctagctcattttgtggtggaattggagcaagcgctgtcgctgcacaagtttgtctgctgattgcgtgttattgttgtttgtgatacgtttctagtcgcgtacgagatgcttgtgctactgcctctatctctatcgttgttgcgacttggaagaaatgttgttaataaaggaaggcgtttggatgtgatttcttggaagacggttactacgaataggaaggattgtgttctcactcccttcatgcttttagctaaagggatgctatttttttttcttttgtgcccccttttcttgtctttgcttgccccgtaccactagtccactacggtctacagcctattttcccatctatcatttgtatcggctgtggattgggtggtaacacaaactgatgacctgatctgttcgtgaatctagaatgtcgtgtgcatgcagttcgagcattctgcttaggttgccccgcagatcatttgggtgcggttttagtacatttattggtattttattttattggaataatgtagtctatacatcctgtactattattatctccagctttatgaagtctgttaagtgcattatattattcttgatagttagttgtgctctgacttttgttccttaagctaaggaatgaaaacaaacggcactgctgcatatgcaaagcggcattgttctagttcggaagagatgtttggtagtaattgtatgcaatcactgattctatggccaatgggatacaatatggctagaagaactgagtttatattctcttcacatttttagtacacaattgtactttattttgatttgcttgtcattagtgtgtttcacagtaagtgtagtacacaattgtactttgttttgatttacttgtcattagcttgtttcacaataagtgtagtacacaattgtactttgttttgatttgcttgtcattagcttgtttcgcaataagtatcttcttttttattttcttctatattttatattttgcagatggaacctatttccaatggcaaccttccacctgggtttgatccttccacttgtcgcagtgtgtgagtgctttcggtgttcttctctgttttcactttcatatgtgatttatagcttacttttcctttttccctttttatctgtgcaactatgttttccttttaaaaaattaaaaaacctgaagttttcaaaggtaacgaaagccaaatttacgtaaatgcacagtttcacatatatgctggtgctaaatctgtagctaattgcagttgcataatctagatacagtcttatagtacctaccttgaatttttatgcagttatcttctttctcctaagtatgattttaagtcatgatgatttgctgaataggtatgttggaaatgtgaaccctaacgtcacggagagccttttgattgaagttttccagagtgctggccttgtggaaagatgcaagctcatacggaaagagaaggtgaacttctgcagtcaatgtttaagatttggagcacatgtgatattgcatcagaaatggttgtatttaaatagtcctccaactttctgaaggcacatgtgattatgtgttgaaccaaaggttttatgaatgctagagaaacaccagtggttgatatatagttgtaacttgatggtaaatttttccagtatgctttatgctactgccgagaagtctcatgatctttctctggctgataatttcacagcatacatacttttttgagtcaattgcatttatctgatgagctttcactctttctgcagtcttcctttgggtttgtggactactatgatcgaagatctgctgctctagcaatcatgacccttcatggccgtcacatgtaagttctgttatactactttaaacaacacaaatttcagagatttaaattctggtgttctttattgtcgcaatccttacacagatatggacaagcaatcaaggtgaactgggcatatgcaagtacgcagagggaggatacatcaggtgagatattcttaaatttatatatatatattcttgttgtctctttcttttcatattataatacttgtttggttaaccgtgcccattgaattatttccagggcatttccatatttttgttggtgatttaagttctgaagtgaatgatgcaactctttatgcctgtttctcagcatatccttcttgttcgtaagtccttagttctttgtatcatgatggcatctatgacgagcttgacctacagcctatgctttcaaatggtgacttgtcattcaaatttcgcaatatgctatctcaaatctatatatttcttgtgctattgaatttaggatggtagagtttgggcactatgacttctctcttagcttctaccatttttgtttgtctgtagccttttagattttcatttgtatcatctatatgtgcagcgatgctcgagtcatgtgggacaacaaaactggacgctccaggggttatggttttgtctccttccgtaatcaacaggcacggacaatttggactttgcttccttggattttgcagaactgtcaccatttttattcgtgtgccttgacaccacagttcatttcttttcctattatttttgcatttaaatgtttggtactggtgaatttcccagtgcctgaattctgttaaaggcaatattatagtttaaattagcgaattgtttgcagagtactgctagtttaaagaaaacatgtgatgttaatttcccatggttcaaatttctattttttcttgacattttttgtgaaatgattttatgatgctatgttctgattactgtctaaattctaaaatgttcttgtgagatttcattggttgtgcacctgataaaactttatctggctccttttgtcatccatagttaaaattcaaactgtattgttttagtttgtatttcatataccatgcacatgaagtttgagtatgaactggcatttccattagcgttacacttgcttacttgtacgattctctttgctggtgcaggaagctgaaactgctataacagaaatgactggtaagcatgctatcagtgcctatgacaatattcactacttctttcctgcctgtagtctactgatatgcaatttctgaattttggaaactaatttgtaggaaaatggcttggaagcagacaaataaggtgcaactgggcaacaaagaacaattcagaagagaaaccagaaactgacaatcataatgcagttgtactaacaaatggtagctccagcaattcaggttagtgtttttgaatgatttcatgaccagaaaaacaacagttctttttaaggccgtcaactttaccatgtttatattaaactattggcatgagatgaagaacatgcaacataattagtgataacaatttgagccaataaggttgtttattatattctgcagcaacggatgcaagccaggatggaggaagtaaagagaacccagagaacaatcctgattgcactactgtatatgttggcaacctcggacatgaggtacaatgaaattgctgcacaaccactttcatcgtcccaactggttctagtttccagattttttcactgttgctagtgcctactgaaattggagtgaatgtgtttctcattactttttcctagcactctagactctagagaccattgagattgtagcaactatgattcatctttcacttaactggtcaggttaaccgggatgagcttcaccgccacttctatagcttgggggtcggggcaatcgaggaaatccgtgttcaacaggataaagggtttgggtttgtgagatatagcacccatggggaagcagcattagctattcagatgggcaatggattggtagtccgtgggaaaccaattaaggtaagatccaaagcattaatataaatgcctcctgcttacatgatcctttatataattgtttttatgtaatttttctaatggttttaactgctctgttctcttgtagtgctcatggggtaacaaaccaactccacctgggacaagttccaagcccctacctcctccagttgctccataccagcctgctgtagcaatgccaggtgtcccgcaaggtttcacagcagcagaacttcttgcttatcagaggcagcttgccttaagccaggctgcagccgggcagattgctggccagcatggtctcgcgggtcaggtttctgcaggtcttcttgctgctgctggttcccaggccctctacgatggctacccaaaccagtcatcagcccagcagcttatgtactacaactag

SEQ ID NO: 2324 - protein, 447 aa, Sorghum bicolor
  misc_feature: Ceres ANNOT ID no. 6091796
  misc_feature: Functional Homolog of  Ceres CLONE ID no. 115366 at SEQ ID NO. 381
  misc_feature (158)..(229): Pfam Name: RRM_1 Pfam Description: RNA recognition motif. (a.k.a. RRM, RBD, or RNP domain)
MNGAGGSHHQQQQQRLRQQQQQQALLMQQALQQQQQYQSGVLAAAAAAAMTQMEPISNGNLPPGFDPSTCRSVYVGNVNPNVTESLLIEVFQSAGLVERCKLIRKEKSSFGFVDYYDRRSAALAIMTLHGRHIYGQAIKVNWAYASTQREDTSGHFHIFVGDLSSEVNDATLYACFSAYPSCSDARVMWDNKTGRSRGYGFVSFRNQQEAETAITEMTGKWLGSRQIRCNWATKNNSEEKPETDNHNAVVLTNGSSSNSATDASQDGGSKENPENNPDCTTVYVGNLGHEVNRDELHRHFYSLGVGAIEEIRVQQDKGFGFVRYSTHGEAALAIQMGNGLVVRGKPIKCSWGNKPTPPGTSSKPLPPPVAPYQPAVAMPGVPQGFTAAELLAYQRQLALSQAAAGQIAGQHGLAGQVSAGLLAAAGSQALYDGYPNQSSAQQLMYYN

SEQ ID NO: 2325 - DNA, 2463 bp, Sorghum bicolor
  misc_feature: Ceres ANNOT ID no. 6094234
  misc_feature: Encodes the peptide sequence at SEQ ID NO. 2326
atgcggaaggcgtacagggactccatcaaggtgctcgaagctgacatccagcacgccaacaccctgtaagcccagctcttgcccgcctccctctttctctgcccgccctgattccggcgccgcctcacatctccctgttcgtcgattctgctccacttcactagtacgggcccgtgtccctctcgtttctctgtttggcctccgtggtcgagcgggtgcgtggggggtttccgcggggctgggtcgctggctcctctcggcctgctgccggggttgcgcaatgcggcggcaaccgagggtggtgggttgatcaatccagcgtccggttcgcccgccctccgctgggatccgtccgtcgtggtggttggtccggtgcctgttgttggttgcgctatccgtgcgcgcgcgcacgagcggcgaagcggcagtagatcaggagggaatcgcatgtgtttataggatgtttaaaaaagaaactctgcttcccatgtgtttcagcgttctaaattatatacctttttttcctgcttatataagaggaaaagggggcgagatgagtgcactagtgtggtctttaggtgagggttgccttattatctctgagtgcatgtgatctggcaagtgatgctagttgtttatctggatgagcagggcctccgagtttccccgggactatgacggtgcgtgtctgcagatgcggctgtcgtacagtcccgcagctcatatattcctcttcctggtgcagtggacagactgcagcctcgccggggcgcttggtctgctgagaatcctcatatacaaggtctgtggcatgctctgcttcacggttgttggttcagtgctcacattgtggatgtgctctcctgaatttgtagctcgttgttcaggtttatgtggatggcacgacaaccatgtcgactcatgagaggaaagcaagtatcaaagaattctatggtaagagtgcatgatgttcttacatctttgcctaactatgttgtcttttgtgctgcattgctgatcagaattgctatatgcttggcatgagcagctgtgatatttccttctttgctgcaactgcaaagggggatcactgatgtggaggacaagaagcagaaggccgtgtgcatggagaggtacacaaagaaagatgaggacgaacggggctccttatctgatattgatgtcgagagggaagaggagtgtgggatttgcatggagatgaacagcaaagttgtgctgcccaactgcacccatgctatgtgcctcagatgttaccaagactggtatgcgcacgattcagtttctgcccatgtgttttctgtgaatgcattgagtgctatattctcaaatttcaatcaccctacttttactgctatgcaagtgcaaacttattgggtgggctcttgttatcaattatcgattaaaaaccttctagctagatgattcatctatatcattcctccacctatctgtatcatggtaaggtagatcctgttaaacttgaactgctgagaacaatggctatagataagtttaaacttgtcttccttgttctttccagcaacttatatgcttgtaaacaagatggaacccctccgtgcatatgggcttgtacttcttttaatgaaaccttttggtatgaatggccaatagctcaacagaacatagtgctctgtgaaacagatctgtattcatttatatgctttcccattgtctacttcattctgaaaatgaagtgatcattggaaggtggcattgtgatattcatgtgaactacagtaagtaggcttaatgtggtgattagccaccagattctttttaactatcttctgccattccttagtgcaaagaggaacctgagtgtggtgccctgtcaagtattggtttttatttttggtccagtccatgaacataatcattcatcttatgtgtagactgtgcactctgtttacagcccattggttctaggctaagaagacacagcactcatttgttcacttaaacgaacaatttagctcattaaactacttgtgctcctgctgatcatagtagcttcatatgttagcaagccctgatgatgggtgtctactaggtgttcctatgatatttgtggtttgtctgtattcttttggccaatgtaactttctcaatcagcataacttggattgaatcgctgaatgtcctgtttatcaccattaagatagtgttgtttatgtttgccatagtttgacaataacattgcctttttacaggagttcaagatcgcagtcctgcccattctgccgcgacaacctgaagaagacctgtcctggtgacttgtggatctatgtcgaggaccaagatgtggttgacatggagacagtgtcaagcgagaacctcagacggctgttcatgtacataagcaagctgcctctgattgtcccagacgtcattttcagtgtttatgattcccacataaaatga

SEQ ID NO: 2326 - protein, 242 aa, Sorghum bicolor
  misc_feature: Ceres ANNOT ID no. 6094234
  misc_feature: Functional Homolog of  Ceres CLONE ID no. 156298 at SEQ ID NO. 490
  misc_feature (146)..(183): Pfam Name: zf-C3HC4 Pfam Description: Zinc finger, C3HC4 type (RING finger)
MRKAYRDSIKVLEADIQHANTLASEFPRDYDGACLQMRLSYSPAAHIFLFLVQWTDCSLAGALGLLRILIYKVYVDGTTTMSTHERKASIKEFYAVIFPSLLQLQRGITDVEDKKQKAVCMERYTKKDEDERGSLSDIDVEREEECGICMEMNSKVVLPNCTHAMCLRCYQDWSSRSQSCPFCRDNLKKTCPGDLWIYVEDQDVVDMETVSSENLRRLFMYISKLPLIVPDVIFSVYDSHIK

SEQ ID NO: 2327 - DNA, 2463 bp, Sorghum bicolor; identical to SEQ ID NO: 2325
  misc_feature: Ceres ANNOT ID no. 6094234
  misc_feature: Encodes the peptide sequence at SEQ ID NO. 2328

SEQ ID NO: 2328 - protein, 242 aa, Sorghum bicolor; identical to SEQ ID NO: 2326
  misc_feature: Ceres ANNOT ID no. 6094234
  misc_feature: Functional Homolog of  Ceres CLONE ID no. 99033 at SEQ ID NO. 1165
  misc_feature (146)..(183): Pfam Name: zf-C3HC4 Pfam Description: Zinc finger, C3HC4 type (RING finger)

SEQ ID NO: 2329 - DNA, 4565 bp, Sorghum bicolor
  misc_feature: Ceres ANNOT ID no. 6094284
  misc_feature: Encodes the peptide sequence at SEQ ID NO. 2330
atgcaccagcccagagcccgctacccgcccggctatggctccggcggcggaggcggagccgggcgtggcggcggaggcggcaatggaggcggcggcggaggcggtggcggaaaccacaactactacggccggaacccgcagccacagcagcaacaccaccaccaacagcagcagcagcagcagcagcacgtgcataggaactcctcgcaccagcagcagtggctgcggcgagaccaggcccccgccgttgcgggggcagcgtccggaaacgctgcggctaagacggcgcctcagcttgacgccataggctcgaggtactgcttttgcttatctgcacatctcctctggtgaaccatatttgtatactctgcttggtgctctggcgatctctagggtttgtgctttgtttttagatgtagaggcgacaacatgcggggtgttggagtgattttggttgcttcactggttaaatttgtcctactgttatatcatgctgacgtgagttaatgagcttgctgttgttgactattctttgattatgtcaggtttctggaaaaaaaatacaacaattgctgtaaaaatgactatcactgttgtaaatttgatctgcatttgtatattttttttgcccttcatcttgtgttttctatgtataaagtgtgtgattttgacatttgtttacccgtcgctgctattctctacttacctgttatataaatgattcacttgggactgtattgtattcagcactagcatgtcatgatgctaattaaactttatctattactagcataatcaatgagcttttcatttgtttgtttcagttctcatgattggaaggctcaactaaatataccagctccagatacacgctacaggacagaggtgagttctctttctaatacttattatccttctgtgttcaagtatatatgcacaatgcatccttgtccctttgaatggtttcagagtagtttttgagtggctcttgttttcttttacttctacaagctattgatagtttgcctctgatatttgtgttgtcgtacacaggatgtcactgcaacaaaaggcaatgagtttgaggattatttcttgaaacgtgaactgcttatgggaatctatgaaaagggatttgaaaggccatctcctattcaagaagaaagcattcctattgcgctgactggaagtgatattcttgcaagggcgaaaaatggcactggaaaaactgctgcattttgcattccagcacttgaaaaaattgatcctgaaaaaactgctattcaaggtgaactattctttcatatgttcaaattggaagtaagcatatggggtcgtttatttagttgctgcttgcttgctaccataacatgagcaacttaactggccaccaaaaaaaaaaaagttcctgtttcaccaattactctatgtatccatttctgctctatttatgttgcaagcccactgaattattgttattactttggtcaccttaatgattctgatatggtgaatgaaccagttccttaatctgtctttttgtatgtatattagataaatccacattcttgaaattttggtgtgttgtttttattgacgtgagaaataatcacaaaaaaagtttggtactgatactagtaggtatgaaatgtagattttttttgtggagaagcagaccatttgcacttagcattctatggctgtttgacagactgaatttgtaatagtgcaacaacattctactttctttgttgatcagtgtgccttttcaaaaacatgtgttatggatgatgtttatgtagtgccagttttacatccactggtgaattagttcattgttgtgtttcatggagtctcttatttttgttttctggttctattggtctttcttcagttgttatactagtaccaacaagggaactggctctgcaaacttcacaagtctgtaaagagcttgggaagtacctgaacattcaagtcatggttagtactggaggaaccagcttgaaggatgacatcatgcgtttgtaccaacctgttcatttacttgttgggactcctggccgaatacttgatcttaccaggaagggcatttgtgtgctgaaagattgttcaatgcttgtcatggatgaggtataaataattacactttttttttcttgtgctgtatatattttatcatagcttagtcactggagtgtgtccttttcacaagtttctctcccccatttgatttacactaaatcatgtcactttgctatatgatgttgtgttccctcactgaaagaaaagaatctgaaggtttttttgtatctcttttcaaaattttactgtgatgttggccgcccttctgcatatgttcctgatgctaacattggtcttgataatgcacacttgttggtacactgctcaaataacattccagaaccatgttgttcttggagtcttatttcttaatttctacaatttgctgatttgtggttttgtgggtgcatttgtgcctttaaagtgtgttcatggtttgtatttgataatccatagtgctacaagctcatgtggggtttcagctctagcctttccaatttggttggggctaaaaggctttgttgttgttgtcttgttgatagtgttaggcagtcccaacgcgacactacctctagtttccatggcattaattagcttgccatgtaggcagaaaagctgacatggaatgagattagatgagtaaagagaaggaaatcagatgaaatcgtttcctatttgagaaacagtgtcggctcaagctccaaagtgtgaagaaaccggcgattttgcattggagacaaggagacgtttcctcatgtgggtccacagccacacctcgtcggtggtagctgctcgctaaccgcgagcctgttgcgcgcaccttgctgctcctgttcttgccgctggtcactgctcgctctgtgcgtgcctcgccaccagctgctccttgccagagcgcacgcctggccacgctcagcagccatgcctcgccggtggcctctgctccgcagccatgtcttgcaggcgactgctgctcgccacgcatgcgtgcctcgctgctggctgctgctccttgcgctcactgctgccccctgcatttgcgttgtttttcgatctgagtgagagaagaattgagtcatcctggccaaggagcagactcgagaaaaggaagaggatgcccatatgcagactggaacaatagggaggaggagcccacgtgaatgaagaaaaaggaagaagggacccacgtgaatatttctcgggtgtgtggtatagtttctatctgtactttcttggtgatgtggcagttatagaaactacccggtagtttcagggttgggactgcccttagtaactttcgaagtccattattgttgcttctgcggtgatctgatgtggatgttgcatccatttcgtatgttaatatgtatattatctgtcaaaagttacaagttgaacaaacacattatttgggatatcatgcaggcagacaagctattagctccagagtttcagccttctgtggaggcacttattcatttccttccacctagtcggcaactgttgatgttttcagcaacttttcctgtaactgtcaaggaattcaaagagaaatatctgcctagaccttatgtgattaatctaatggatgaactgacactgaaaggaatcacacaatattatgcttttgttgaagaaaggcagaaagttcattgcctgaatacacttttctcaaaggtacaacaaacattaactatacattttctgtttcatccacagttaagtgtaaactgacacatttccttttttgtgtgtgtgtttttgtcagcttcaaattaatcaatccattatattctgcaactctgttaatagagttgagctactggctaagaaaataactgaactcggttattcatgcttctacattcatgctaagatgttgcaagaccacagaaaccgagtgtttcatgattttcgtaatggtgcttgcagaaaccttgtgtgcacaggtctgtactgatattttccttagtagtctttctcaatttagtaacttacttttcagcatatgttcaattgtcatttatgaaggtttctataagagtatcatggctctctttgttgcagatctgtttaccagaggaattgatatccaggctgttaatgtggtcattaattttgactttcctaagacatctgagacatatttacacagggtgcctttttttaatcttttcttctgtagaagctgtttattttataaccttccgaaatttaaaatttatgtgtgtgttgtcatgttcctaggttggccgttctggaagatatggacaccttggtttggcagtgaacttgatcacttatgaggaccgtttcaacttgtaagcctgcgttaataaaatggcctgtttctctagtcttacatcaaaattccttatccttttgtccctttgttttgcaggtataggattgagcaagaacttggaacagaaattaagacaatacccccacagattgacctggccgtgtactgccaatga

SEQ ID NO: 2330 - protein, 507 aa, Sorghum bicolor
  misc_feature: Ceres ANNOT ID no. 6094284
  misc_feature: Functional Homolog of  Ceres CLONE ID no. 534281 at SEQ ID NO. 938
  misc_feature (157)..(323): Pfam Name: DEAD Pfam Description: DEAD/DEAH box helicase
  misc_feature (389)..(465): Pfam Name: Helicase_C Pfam Description: Helicase conserved C-terminal domain
MHQPRARYPPGYGSGGGGGAGRGGGGGNGGGGGGGGGNHNYYGRNPQPQQQHHHQQQQQQQQHVHRNSSHQQQWLRRDQAPAVAGAASGNAAAKTAPQLDAIGSSSHDWKAQLNIPAPDTRYRTEDVTATKGNEFEDYFLKRELLMGIYEKGFERPSPIQEESIPIALTGSDILARAKNGTGKTAAFCIPALEKIDPEKTAIQVVILVPTRELALQTSQVCKELGKYLNIQVMVSTGGTSLKDDIMRLYQPVHLLVGTPGRILDLTRKGICVLKDCSMLVMDEADKLLAPEFQPSVEALIHFLPPSRQLLMFSATFPVTVKEFKEKYLPRPYVINLMDELTLKGITQYYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKTSETYLHRVGRSGRYGHLGLAVNLITYEDRFNLYRIEQELGTEIKTIPPQIDLAVYCQ

SEQ ID NO: 2331 - DNA, 4541 bp, Sorghum bicolor
  misc_feature: Ceres ANNOT ID no. 6094287
  misc_feature: Encodes the peptide sequence at SEQ ID NO. 2332
atggaccagcccagagcccgctacccacccggctatggctcccgcggcggaggcggagccggacgtggcggcggaggcggcaatggaggcggcggcggaggcggtggcggaaaccacaactactacggccggaacccgcagccacagcagcaacaccactaccagcagcagcagcagcagcagcagcacgtgcataggaactcctcgcaccagcagcagtggctgcggcgagaccaggcccccgccgttgcgggggcagcgtccggaaacgctgcggctaagacggcgcctcagcttgacgccatagactcgaggtactgcttttgcttatctgcacatctcctctggtgaaccatatttgtatactctgcttggtgctctggcgatctctagggtttgtgctttgtttttagatgtagaggcgacaacatgcggggtgttggagtgattttggttgcttcactggttaaatttgttctactgctatgtcatgctgacgtgagttaatgagcttgctgttgctgactatcctttgattatgtcaggtttctggaaaaaaatacaacaattgctgtaaaaatgactaccactgttataaatttaatctgcatttgtattttttttggtccttcatcttgtgttttctatgtataaagtgtgtgattttgacatttgtttacccgccgctgctattctctacttacccgatatataaatgattcacttgggactgtattgtattcagcactagcatgtcatgattgtaattaaactttatctattactagcataatcaatgtgcctttcatttgtttgtttcagttctcaagattggaaggctcaattaaatataccagctccagatacacgctacaggacagaggtgagttctctttctaatacttattatccttctgtgttcaagtatatatgcacaatgcatcctggtccctttgaatggtttcagagtagtttttgagtggctcttgttttcttacttctacaagctattgatagtttgcctctgatatttgtgttgtcgtacacaggatgtcactgcaacaaaaggcaatgagtttgaggattatttcttgaaacgtgaactgcttatgggaatctatgaaaagggatttgaaaggccatctcctattcaggaagaaagcattcctattgcgctgactggaagtgatattcttgcaagggcgaaaaatggcactggaaaaactgctgcattttgcattccagcacttgaaaaaattgatcctgaaaaaactgctattcaaggtgaactattttttcatatgttcaaattggaagtaagcatatggggtcgtttatttagttgctgcttgcttgctaccataacatgagcaacttaactggccaccacaaaaaaaagttactgtttcaccaattactctatatattcatttctgctctatttatgttgcaagccactgaattattgttattactttgatcaccttaatgattatgatatggtgaatgaaccagtcccttaactctgtctttttgtatgtattagataaatccacattcttgaaattttggtgtgttgtttttattgacgtgagaaataatcacaaaaaaaagtttggtactgatactagtaggtatgaaatgtagattttttttttgtggagaagcagaccatttgcacttagcattctatggctgtttgacagactaatttgtaatagtgcaacaacattttactttctttgtggatcagtgtgccttttcaaaaacatgtgttatggatgatgtttatgtagtgccagttttacatccactggtgaattagttcattgttgtgtttcatagagtctctcttatttttgttttctggttctattggtctttcttcagttgttatactagtaccaacaagggaactggctctgcaaacttcacaagtctgtaaagagcttgggaagtacctgaacattcaagtcatggttagtactggaggaaccagcttgaaggatgacatcatgcgtttgtaccaacctgttcatttacttgttgggactcctggccgaatacttgatcttaccaggaagggcatttgtgtgctgaaagattgttcaatgcttgtcatggacgaggtataaataattacactttgtttttcttgtgctgtatatattttatcgtagcgtagtcactggagtgtgtcctttccccatttgatttacactaaatcatgtcactttgctatatgatgttgtgttccctcactgaaagaaaagaatctgaagttgttttggtatctcttttcaaaattttacactgatgttggccgcccttctgcatatgttcctcatgctaacattggtcttgataatgcacacttgttgatacactgctcaaataacattccagaaccatgttgttcttggagtcttatttcttaatttctacaatttgctgatttgtggttttgtgggtgcatttgtgtctttaaagtgtgttcatggtttgtttttgataatccatagtgctacaatctcatgtggggtttcagctctagcctttccaatttggttggggctaaaaggctttgttgttgttgatagtgttaggcagtcccaacgcgacactacctctagtttccatggcattaattagcttgccatgtaggcagaaaagctgacatggcatgagattagatgagtaaggagaagaaaatcagatgaaatcgttttctatttgagaaacagtgtcagctcaagctccaaagtgtgaagaaaccggcgattttgcattggatacaaggagacgtttcctcatgtgggtccacagccacacgccgtcggtggtagctgctcgctaaccgcgagcctgttgcgcgcacctcgctgctcctgtgcttgccgctggtcactgctcgctctgcgcgtgcctcgccaccggctgctccttgccagagcgaacgcctggccacgctcagcagccatgcctcgccggtggcctctgctctgcagccatgccttgcaggcgactgctgctcgcgacacatgtgtgcctcactgctggctgctcctccttgcgctcactgctgctccctgcatttgcgttgtttttcgatctgagtgagagaagaattgagtcatcctggccaaggagctgactcgagaaaaaggcagaggatgcccatgtgcagactggagcaatagggaggaggggtccatgtgaatgaagaaaaaggaagaagggacccacgtgaatatttctggggtgtgtggtatagtttctatctatactttcttggtgatgtggcagttatagaaactacccggtggtttcagggttgggacttcccttagtaactttggaagtccattattgttgcttctgcaatgatctgatgcggatgttgcatccatttcgtatgttaatatgtttattatctgtcaaaaggtacaagttgaacaaacacattatttgggatatcatgcaggcagacaagcttttagctccagagtttcagccttctgtggaggcacttattcatttccttccacctagtcggcaactgttgatgttttcagcaacctttcctgtaactgtcaaggaattcaaagagaaatatctgcctagaccttatgtgattaatctaatggatgaactgacactgaaaggaatcacacaatattatgcttttgttgaagaaaggcagaaagttcattgcctgaatacacttttctcaaaggtacaacaaacattaactctacattttctgtttcatccacagttaagtgtaaactgacacatttcctttttttttgtgtttgtttttgtcagcttcaaattaatcaatccattatattctgcaactctgttaatagagttgagctactggctaagaaaataactgaactcggttattcatgcttctacattcatgctaagatgttgcaagaccacagaaaccgagtgtttcatgattttcgtaatggtgcttgcagaaaccttgtgtgcacaggtctgtactgatattttcctatcttagtagtctttctcaatttagtaacttacttttcagcatatgttcaattgtcatttatgaaggtttctataagagtatcatggctctctttgttgcagatctgtttaccagaggaattgatatccaggctgttaatgtggtcattaattttgactttcctaagacatctgagacatatttacacagggtgccttttttaatcttttcttctctagaagctgtttattttgtaaccttttggaatttaaaattaatgtgtgttgtcatgttcctaggttggccgttctggaagatatggacacctcggtttggcagtgaacttgatcacatatgaggaccgtttcaacttgtaagcctgtgttaataaaatggcctatttctctagtcttgcatcaagattccttatccttttgtccctttgttttgcaggtataggattgagcaagaacttggaacagagattaagacaatacccccacagattgacctggccgtatactgccaatga

SEQ ID NO: 2332 - protein, 507 aa, Sorghum bicolor
  misc_feature: Ceres ANNOT ID no. 6094287
  misc_feature: Functional Homolog of  Ceres CLONE ID no. 534281 at SEQ ID NO. 938
  misc_feature (157)..(323): Pfam Name: DEAD Pfam Description: DEAD/DEAH box helicase
  misc_feature (389)..(465): Pfam Name: Helicase_C Pfam Description: Helicase conserved C-terminal domain
MDQPRARYPPGYGSRGGGGAGRGGGGGNGGGGGGGGGNHNYYGRNPQPQQQHHYQQQQQQQQHVHRNSSHQQQWLRRDQAPAVAGAASGNAAAKTAPQLDAIDSSSQDWKAQLNIPAPDTRYRTEDVTATKGNEFEDYFLKRELLMGIYEKGFERPSPIQEESIPIALTGSDILARAKNGTGKTAAFCIPALEKIDPEKTAIQVVILVPTRELALQTSQVCKELGKYLNIQVMVSTGGTSLKDDIMRLYQPVHLLVGTPGRILDLTRKGICVLKDCSMLVMDEADKLLAPEFQPSVEALIHFLPPSRQLLMFSATFPVTVKEFKEKYLPRPYVINLMDELTLKGITQYYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKTSETYLHRVGRSGRYGHLGLAVNLITYEDRFNLYRIEQELGTEIKTIPPQIDLAVYCQ

SEQ ID NO: 2333 - DNA, 3683 bp, Sorghum bicolor
  misc_feature: Ceres ANNOT ID no. 6099734
  misc_feature: Encodes the peptide sequence at SEQ ID NO. 2334
atggccatcaactcgctgagcatggtggaggccaggctgccgccggggttcaggttccacccgcgggacgacgagctcgtgctcgactacctcgccaagaagctcgccggcggcgccggagtcggcggaggcccgctggtggtgagcatctacggctgccccgccatggtcgacgtcgatctcaacaagtgcgagccctgggaccttcccggtatgtaatcaagcaagacgacctacaactacaccttgttcctgcatcattttgtacgtacatatgcctgcctgtccttatattaatttctgggggaagatcgatcgagtttttgcctttgtcaagtctttaattgcgctgcgaattattcttcttcttcttccttccttttgggtgttttcccttttcccctctgtgagaacactattcttccctttgggctctgatttgttattatgttatgtgttcctggtgaccaatgattgatctctctcaaataatccttttgtgctaatcaaaatttttaatgagagagatagcagtcgtacgatctgtgatccgttccgacatatatacaagtctacaccacaaatatatcatccaagatacgcttgctgatcacatctgtttgtaacaagggttgccaatcatgcatgcccatgtcctgctgttggctctcatcgatctacaagaatatgtataagatcttaaaataaacccagccataccttctctccattattagctagctactagtagtcatctattccaaggaaattctctttgttcctttcgcctgcatctctgcatgtttctccttcaaatggcacaaaaagtatacatacacctagctatatatgtacttcgattcgattaattgcgcgccaccgaaaatctaagatgcatgaataaccacaagtagtgtactgcatgctagttgaaactgtcccactccgagccataagtgaagcgaccatgacatcctcctcctgcaactttcaccgatcaacttgcaacagatagatgcaactatgcactactcatcccatacctcaagaatcccttacttttctttccttcaatcgtcgcttatccctttctttttcaccctctttttggggtgtgcccatgccatcggttttctttttttggagcatttataagctgctatatttatgggacacagtcacacagctcccttcttttgaaaagtctttgatgatctaaaggcataaacaaaaccatagtcagaccatctcgatgcaaatatatatttatgtgtgcaacaatagttgaggagagacagtttgcaagaactctctctcaaatccttgcatgtattctgtttttaaaaaagaaaagttcagctggatcggtactctagctagctgtgtttaagctatatatgcatctacaaaatctactgagagctaaattcacacgtcttgtctgcctccttgtcgccttcctttgccccatataacagaaggatattctcactgcctagagtttgtttggccccatcttggccttctatcctcatttgtccctgttcctgccatgctatcaaatattctctcgctttgcctcatccttaaagggaattaacagccaaatggatggggacaaacaccaaaagaaggcctctcactttgctaccagtagaatactgcggcaaaaaaccttgtcaaaatagattaagataatcaattgataaagaacatattgttttttcttcctaataactcttcttttatccatttctccccattattacactaataacaaatacatgttgggctctggtttagcacagttttttagtctataagatcaatgattaattgtgtttgattgtacgtgtctttatgtttacatctaataaccaaatgtgaaaatgatttacacagcagtgctatatattaactatcattaacctcgtttgctagtttattaactaactgattttcccctcaaattcagaaatcgcgtgcattggtggaaaagagtggtatttctacagccttagagatagaaagtatgccaccggccagcgtacaaacagagcaactgattcaggatattggaaggccacggggaaaagaccgtccaataagccggaaaagggttacttgttggtatgcgcaaaactcttgtgttttatcaaggtagagccccaaaggggaagaagaccgagtgggttatgcatgaatttcgcatggaagggcaaggtgatcccatgaaattacctttcaaggtaatacaacgacttgatttcactatagtgtgtccttttttttagttggacgtgatagtttattgcataattttattcacaattttcccatctgatggatataaaaaaatacatcatatatattctagccaatgagcaatatataacacatatacaaagtaggaaaatgatttattagggggtaatgaaaaacaatggagttggccccatcggttttcctatggataaactatggttgtgatgaaatcatcaagagcatccgcaattttcattctccaaaaaatggtgatcatatgagaagtatatatcaaagattttgaggagtacaatatatctgtgtgaactaaaaaagtacatacataatttgttcatgacacttgaggacgaagcttgtactatatatatgcagacactttttcttcattcatgtttgcatttgcataatcacatggaatgccagctcattctacacacatgtatcctctcgcctattcaagagagcgagaaaggcacaagcgcaaatttacagtcaagttgacaaattacttagttcttagtgttaccagttcaattgtgtgttggagaataaataaattaaagtaaagacgtatacatggttttggattaagatatcacacttcaatcgctacattgtttactgttaaaagaactgatggtcatagtattgtattaatgctaattaagagctttactttttttttgtacttgtgactttctttactactcaatgacttgtcactgtcatgcacagcaggttttctctaggcattgatatctcccatctatttccattcattttatatataacagtatatcacacacacactgcacacatacatactcttccttaaaaacaaataaatacttatcatgacttcttcacaatgtataggatacatgtacccatttacttattattatctatattggcctaatcctcatctgatttttttcatatataataattcacaggaggactgggtcttgtgtagagttttctacaagagtagggcaacagttgcaaagccacccacagagagtagcagcagcttcaatattgatgctgccacaacttcattgcctcccctcattgacaacaactacaatatttcctttgatcagcctggctcatcagtgcaaaacctagagggttatgagcaagtgccctgcttctccagtaacccctctcagctatcgtcatcgataaacgctccgctgtcgtctgccgccaccatggctgatccggagcaacacatggggaagtcaataatcaaggatgttctcatgagccagttcagcaggttcgaagcaggcaacgtcaagagggaggcgcctcaaagcaatttttctcaggatgggtttgagtacttagctgagagtggattcacacagatgtggaattctttcaattaa

SEQ ID NO: 2334 - protein, 294 aa, Sorghum bicolor
  misc_feature: Ceres ANNOT ID no. 6099734
  misc_feature: Functional Homolog of  Ceres CLONE ID no. 205648 at SEQ ID NO. 555
  misc_feature (13)..(137): Pfam Name: NAM Pfam Description: No apical meristem (NAM) protein
MAINSLSMVEARLPPGFRFHPRDDELVLDYLAKKLAGGAGVGGGPLVVSIYGCPAMVDVDLNKCEPWDLPEIACIGGKEWYFYSLRDRKYATGQRTNRATDSGYWKATGKRPSNKPEKGRAPKGKKTEWVMHEFRMEGQGDPMKLPFKEDWVLCRVFYKSRATVAKPPTESSSSFNIDAATTSLPPLIDNNYNISFDQPGSSVQNLEGYEQVPCFSSNPSQLSSSINAPLSSAATMADPEQHMGKSIIKDVLMSQFSRFEAGNVKREAPQSNFSQDGFEYLAESGFTQMWNSFN

SEQ ID NO: 2335 - DNA, 2047 bp, Sorghum bicolor
  misc_feature: Ceres ANNOT ID no. 6106161
  misc_feature: Encodes the peptide sequence at SEQ ID NO. 2336
atgcgcaagtttcaggactccgtcaaggccctccaggccgacatcgatcacgccaatgagctgtgagtcctgggagcagagtttcctgttcgcccccctttgcttgctcgagttaaaggcggaatctttgtctacttttcgacgttttggtgcctgaattgcttgcttgcgttttttttcttttttgttgctgcggcgagcagggcgtcggaattcctgagggactacgacggctcggtcatccagatgcggatggcctacagcgccgtcgcgcatttcctcgtgcagtggaccgactgcaagctggccggcgcgctcggcctcctcaaggttatgctatacaaggtattgcctcgcacccgtggttcgattcggttttcacgccgcgagctgcctgctgagttgccccgtttctccggcaggtgtacgcggacgactcgtcggcgcttcctgactgggagagggaggccagcatcagggagttctacggtaattaacccaccccccgtttcttcccatctagcaagccgtgaagaattgtgccgctgagtgtcggttctgacggcgtagcgcaattgcaggcatcattttcccgtcgctgctgctgctgccgagcggcatcaccgagctggacgacaggaaacagaggaaactctgcctgaagaaattcaggagcagggatgagcagctctcggaggtggacacggagagggagctcgagtgcgggatctgcctcgaggttagccgcaagatcgtgctgcccgactgtgcccacacgctctgcatgcgctgctttgaggactggtatagctccttttctcctagcttaaaatcattagccgaatccataaacatgcaggaaggctgatttttttttgggtatttattagtacatttgcactgatttggtcatgttagcttatggatggcaaagtattaattctcatgccttctgaagcagaattacagtcaagtagttctcgaaggttctgaagcataattacagtcttgtgaatgttgtttgaaactttgtattgggaaacgtggcaaatttgtttttagtgaaattatatttctttatgtagtgctatttttttttaaaaaaaaaaattagtgtcgtgctttttttctgaatgaaacaatttcagtgtaggtggtctcttaggaaccttgttagtgttgttagatggtctgtctctagatctctagtcatttgacagaattccatgttcttgatgcaagctgttcgtccaagcaacttgcaatgataattccattattatgctaggaaagagtaggaagctttctatcgaatcagtagtctgtttccgaggcatcactttcattttggttgcatgatgactctcgtcagaacagcaaacccctgctactttgtgttttactataccgtgggtgtatgtaccttcaatatttatgctcaccttgaggttaaagattcaagttatagttttttttttggtgaaagtattcatggtatagttggttagtagcagatgaagtggtctgataaaatgtgatatgctcagttaatgattgttccattcagcttatctctttgttgagtcaggatatgcttcgctctctcatgccaatgtttatcttccactggatactttgtgctttgctctctaatcttccactctcttgagccaatatttaacttccactggatattttgtgctttgcatcttcatcaagcataacaaatctctccttcccttccctactcggctactcccaatctatcattcactcaaacaaatttgtatggaagctattacaagtgatcatcctattcactctgtattgcaggaacgagaaatcaaagtcctgccccttctgtcgcgcctgccttgaggaggtgaagccaggcagcctgtggatgtacactgacgacagcgacgttgtggatatggatactttgactagggagaacattaggcggctgtttatgtacataaataagttgccacttgtagtcctacatgtagttgaccttgacatttacgagtaccgcatcaagtaa

(The sequence listing continues in the following parts.)

What is claimed is:

1. A method of producing a plant, said method comprising growing a plant cell comprising an exogenous nucleic acid, said exogenous nucleic acid comprising a regulatory region operably linked to a nucleotide sequence encoding a polypeptide having 95% or greater sequence identity to a polypeptide having the amino acid sequence set forth in SEQ ID NO:2133, wherein a tissue of a plant produced from said plant cell has a difference in the level of lignin as compared to the corresponding level in lignin of a control plant that does not comprise said nucleic acid.

2. A plant cell comprising an exogenous nucleic acid, said exogenous nucleic acid comprising a regulatory region operably linked to a nucleotide sequence encoding a polypeptide having 95% or greater sequence identity to a polypeptide sequence set forth in SEQ ID NO:2133, where a tissue of a plant produced from the plant cell has a difference in lignin content as compared to the corresponding lignin content in tissue of a control plant that does not comprise the nucleic acid.

3. The plant cell of claim 2, wherein said regulatory region is involved in lignin or cellulose biosynthesis.

4. The plant cell of claim 3, wherein said regulatory region has a nucleotide sequence selected from the group consisting of SEQ ID NOs:1909-1918.

5. The plant cell of claim 2, wherein said regulatory region is not associated with said polypeptide.

6. The plant cell of claim 2, wherein said regulatory region is a promoter.

7. The plant cell of claim 6, wherein said promoter is a tissue-preferential promoter.

8. The plant cell of claim 7, wherein said tissue is vascular, stem, pith, xylem, phloem, fruit, seed, seed pod, root, tuber, inflorescence, or leaf tissue.

9. The plant cell of claim 6, wherein said promoter is a cell type-preferential promoter.

10. The plant cell of claim 9, wherein said cell is a sieve, laticifer, companion, sclerenchyma, xylem, or trichome cell.

11. The plant cell of claim 6, wherein said promoter is an inducible promoter.

12. A method of expressing a sequence of interest in a plant cell, said method comprising growing a plant cell comprising:
  1) an exogenous nucleic acid comprising a regulatory region operably linked to a sequence of interest, said regulatory region comprising a nucleic acid having 95% or greater sequence identity to a regulatory region having a nucleotide sequence selected from the group consisting of SEQ ID NOs:1909-1918; and
  2) an exogenous nucleic acid comprising a nucleic acid encoding a polypeptide having 95% or greater sequence identity to a polypeptide sequence set forth in SEQ ID NO:2133;
  wherein said regulatory region and said polypeptide are associated, wherein said plant cell is grown under conditions effective for expression of said regulatory protein, and wherein said plant cell expresses said sequence of interest.

13. The method of claim 12, wherein said exogenous nucleic acid comprising a regulatory region operably linked to a sequence of interest and said exogenous nucleic acid comprising a nucleic acid encoding a polypeptide are included in the same nucleic acid construct or in separate nucleic acid constructs.

14. A method of expressing a sequence of interest in a plant cell, said method comprising growing a plant cell comprising an exogenous nucleic acid encoding a polypeptide sequence having 95% or greater sequence identity to a polypeptide sequence set forth in SEQ ID NO:2133, said plant cell having an endogenous gene involved in lignin biosynthesis, said endogenous gene comprising a regulatory region and said sequence of interest, wherein said polypeptide and said endogenous regulatory region are associated, wherein said plant cell is grown under conditions effective for expression of said polypeptide, and wherein said plant cell expresses said sequence of interest.

15. The method of claim 12 or 13, wherein said sequence of interest comprises a coding sequence for a polypeptide involved in lignin biosynthesis.

16. The method of claim 12 or 13, wherein said sequence of interest is in an antisense orientation relative to said regulatory region.

17. The method of claim 12 or 13, wherein said sequence of interest is transcribed into an interfering RNA.

18. The method of claim 14, wherein said endogenous gene comprises a coding sequence for a polypeptide involved in lignin biosynthesis.

19. The method of claim 14, wherein said exogenous nucleic acid encoding said polypeptide is operably linked to a regulatory region capable of modulating expression of said polypeptide in said plant cell.

20. The method of claim 19, wherein said regulatory region capable of modulating expression of said polypeptide in said plant cell is a tissue-preferential, cell type-preferential, organ-preferential, or inducible promoter.

21. A plant cell comprising an exogenous nucleic acid, said exogenous nucleic acid comprising a regulatory region operably linked to a polynucleotide that is transcribed into an interfering RNA effective for inhibiting expression of a polypeptide having 95% or greater sequence identity to a polypeptide sequence set forth in SEQ ID NO:2133; wherein said regulatory region modulates transcription of said polynucleotide in said plant cell.

22. The plant cell of claim 21, wherein said exogenous nucleic acid further comprises a 3'UTR operably linked to said polynucleotide.

23. The plant cell of claim 22, wherein said polynucleotide is transcribed into an interfering RNA comprising a stem-loop structure.

24. The plant cell of claim 22, wherein said stem-loop structure comprises an inverted repeat of said 3' UTR.

25. An isolated nucleic acid molecule comprising a nucleotide sequence having 95% or greater sequence identity to the nucleotide sequence set forth in SEQ ID NO:2132.

26. An isolated nucleic acid comprising a nucleotide sequence encoding a polypeptide having 95% or greater sequence identity to the amino acid sequence set forth in SEQ ID NO:2133.

* * * * *